United States Patent 12,059,441 (PROBIOTIC BACTERIAL STRAINS THAT PRODUCE SHORT CHAIN FATTY ACIDS AND COMPOSITIONS COMPRISING SAME) - sequence listing, part 11

SEQ ID NO: 28 - DNA, 4717687 bp, Clostridium butyricum (residues 1-1,572,563 of 4,717,687)
  misc_feature (3536924)..(3536925): ">" designating noncontiguous sequence of whole genome
  misc_feature (3555028)..(3555029): ">" designating noncontiguous sequence of whole genome
  misc_feature (3939428)..(3939429): ">" designating noncontiguous sequence of whole genome
  misc_feature (3947488)..(3947489): ">" designating noncontiguous sequence of whole genome
tacatcttctctatatttattttcaatataatatggattaactattatatcctcattttcagtatctaactcaccaagcttttcaacataagataatatttggtttagatcttctgctaaaccttctttttcactttcatcaaagcttaatcttgcaagttcagcaacatattcaacatcttttacactaacagacatttctattcctccctctttatagttaacagttgtaagttaacgcttaacagttatgataatattattgctaactttttaattaaaattttagcaataatattattaatttaactgttcactttaacttaattaactgctaactaaataaatttattttgatattttataaaaatatattttactgcaaaatgtttattttcaaaaatcacatcatgattctttcattaaattattaactaataatcgttaactagataaattttatcataaaatttgtttttttactatttgtaccttaagttaacttatcttatcgaacaagaccattcatgaagaatagtaaacatacagctatagcaaagcttactgctgaataaagtattctcttgcttccactttcattaaccagaaatctaattgacagaatagccatagttatacaaacgcctaactgtatcggaaagtatgaattaaaaatttgaccaacataataaaactgataagttgttaaaaatgtgcaaattattaatatgctagttataaatgccgatccaaaagatagcagatttattaactttttcataactttacccccttaatatttcttcaaactcctcttctgaaagtactttaacaccaagttcctgtgcttttgtaagtttagaacctgctgcttcgcctgcaattacataatcagtctttttacttacacttcctgcaacctttgccccaagactttctaacttttcttttatttctgatcttgaataattctgaagtgaacctgttgctactactgtttttcccataaatggattttcagttacttcaacctcttcaaacttaggattaactccaagctctaataattcatctatagtttcaagaactttttcttctttaaagaatgacataacatcttgagcaacaatatccccaacatcaggaacactaactaattcttcaaatgtagcattctttaatccttctatagatttgaatctacttactaagtccttagcagttttaacacctacatttggaataccaagtgcatatataaaggcatgaagttcacattccttactattttcaatagcttctaaaagattctgcgccttctttggtccaaacttttcaagaccaataagttcttcttcttttaatttatataaatcagaaattgatttaatattaagcttttcaaataactgttcagctgttctttcagagaaacctgcaatattcatagcttctctacatgcataatgaactatactcttaaccatctgtggtttacatgataatgtgttttcacagaaataatgtgctccatctagtataatgtggcttccacatgccggacattctttaggtggtttaatatcctctgcaccatctaatgtttcaggtactattcccattatttcaggtataacatcattacttctacgaacaaatacatctgcccctattttaacaccttttcttgcaatatcatccatattatttaaagtggctcttttaactgtaactcctgcaagttctacaggttctaatatagctgtcggtgcaagtctaccacttctaccaacattccattcaacaccaagaagttttgtagtagcttcctgagcttcaaacttataagcaattgcccatttagggaattttactgtatatcccataagttctcttgttctcatatcatcaattgcaactacaagcccgtctatatcataatttaaatcaaatcttatactatttatataatcaatttgttcttgtatctcatcaattgtagtacaaactttcatatagtcatccataggaagacctttttcttttatgaaatttagcatttctaaatatgttttaaaaggagatccttctttataaccaatgtcataaaaaaatgcagaaaggtttcttcttgcagtttcctttacattaagatttctaagtgctcctgctgcaccatttcttaaatttttaagaggaacttgtgcactttcattatatttatcgaatgcttcctgagtcatcactgcttcaccatgaacttcaagaatatcattattttcaatctttagaggtattgatttaattgttttaacctgagcagttacattttcaccaatatttccagttcctcttgttgcagcaatttccattactccttcttcattatatgttaagtttattgtaagtccatcaaatttctttgtgagaacatactttaaatctggcaaatcttcaccttttaatctcatatcatttacaaacttaacatttctgttgtgccaatctataatctcctgaatagattgagccttatcaagactccaaagctttgctttatgagtatatttttcaaatccatcaagaaccatatcaccaactcttaaagttggtgaataaggaagtacaaatcccgtttcctcttctaatttttttagttcatcatatatcttatcatattctttatctgttacacttggatcatctaaaacataatatttataggaataattgtttaactgttcaactaattcttttattttttccttcttatccacttctttttctcctaaacttgtataatttcttttttaattctaataaatcattcaagtcacatttttatgctcattacaaagttactatttaaattaacaagttaacagcatgatggaatactataaaattactcatcacctgttaacttatatcttaaacttttaatacatttaattatatcattttaagctttgcaaatgataatagcaagacttttaccccttgtttatcaaaggcaatagtaagttttttatcatctcctgaattttggactgatactatagttccaactccgaatttttcatgcattacttttcttcccattgtagcttctgcaactgaaatataatcacctgaagatacattacctattgaagaagatccaatagaattaggtctacttgcattaagcccacttccagaaactgttctagtcatattatttctcaaactatgtggattattatatgaacttttatttataaatgactctcgacttttaattcctgttttttccaccgaaacatattcttttaagtctggttttatctcatttataaaatctgattgagaatatgctactgtcttaccaaatactcttcttacctctgctgaagtcataaatagtatttctttagctcttgttataccaacataacataatcttcttgattcttccatttctgattctttttcaaatgaagcactacctggaaatataccattttccataccaaccataaatactactgggaattcaagccctttagcactatgtactgtcataagtacaacactatcatcttcatcttcaattttatctgtatcttgaaccaaagaaaccttttctaaatatgctgataatgacttatcttcactatttttttcaaaatcaactgcatcagatactaattcctttaagttttcaattctactcttatcttctatttcattagacttttttaactgatccatatatcctgtatcttctaatattgtttcaataagcattgaaactggagtagtttcacttaaaatcattaagttttccatcaattgaacgaatggatcaatacatgatacatttctaggtgttaatgttggaatacttcttacttcacttaatgcatcccacatatttaactcgaaactatcagcaaaatcttgaatcttatttacagttgcatcacctatacttctctttggaacattaataattcttcttatacttatatcatcttgaggatttataagaacctttaagtaagcaagaatatctttaatttcttttctatcgtagaatctagttcctcctacaattttataaggaattccctttcttctgaaactttcctcaaaaattcttgactgagcattagttctatataatattgcaaaatcattatactttttatcttcattttttcttatatctaaaatttgttttccaacaaagtctccttcatcgctatccgaataagctctataaacctttatcttactacctaattcctgttcagttctaagagccttactctttctatttgagttattgactataactacattggcagcatttaatatattacctttcgatctataattctgctctaattttattacctttgcatcaggataatctttttcaaaatctaagatattttttatatctgcccctctccattgataaatacaattatgaactacaataccatttgcaatatagtttcgtgcattatcaatatttaagtcatatacatatccatcataatcttctaattcaacagatattacaatatcctcttctattttctcactattttgtatagcaatagacattcctggtttaaaacttcctataggcataaacataaaactcttatcattagaaagctttgccttttttagaatctcaaaactctcttccaccatactaagctttcttgcaaattcctcagcttcatcatataaagctctttccgtttctactctatatgtatttctttgaccatctctaacattaaatcctgcttctataaatttattttttgagtcatctgccgatgaattaagtcctattctatgtgaatatatccctctttgaacagacttctttcctccaaaaaagcttaaattaactctctttctaatagagtctcctcttatcactgcattactcaaatgatgtggatattcattatataagaattcgtcttccataagcttctcagctgcatttatagtatcaatttctttaaacattttttctatctgttcttgtgagattgttatatttctacctcttgaattaaatactattgtcggtattccatatttcactgaataatactgttcataataagttgcatcaccttttgtgtcacaaactttgattatccacattttatcagcctgttctccatttaatcttatagctaatccactagcatctctatcgtctctagatcttactgatgaagtttgacctattctatacccaaacccacttttgtacattaagtaaacatagtacttatcttcttctaatgatattttcccaaatgaaatatgattaggtgtagcttttataactctattgttttttgtagttatttttactatctttccacaatattttttcttatttatatcacttattttaagtaatgaagtttcaccattacctgatgcaactctaactaaatcttctttcataagcttttctatttcaacatctttattttctgtagaaaccatagttccttcaactaagcactgatcatcatcccctacaacacaaatatttttgtatttagatgcaagaagcttaactagttcatattgagcaccattggtatcctgatactcatcaaccataatatacttaaactttctttgataaaattccagtgtttcaggattactcttaaataactctactgttttaaatattaaatcatcaaaatctaaagcattattttctttaagtctcttctgatacatttcatatacatcagctattttgttttctctaaaatttgattcattttctagcttaaaacttcgtgcagtttgcattctatctttagctttccctattttactaattatttcttgttctgatatatctttatcatttatattaacagttttcatacactcttttactaatgtcttctgatcagaactgtcatatatagtaaaacttgatttatatcctattttatctatttctcttcttaaaatttttacacatgttgaatggaaagtagatatccacatattttcagcacattcaccaataagtgccctaactctgtctttcatttccttagcagccttatttgtaaatgtaattgctaaaatattataaggtgcaatatttaagtcctctaccatatgagcaattctatgagttaaaactctagtttttcctgaccctgctcctgctaaaatcaatacttgaccttcaattgtagttgccccttcatattgttctttattaagtaagttttttaaatctaacattactttttcctcctttcccaatccttaaatattataacataattacataaatataaagtgtctgctataaaatctccttataaaaagcacacactcatctatgtaaataaaatgtaattaactaaataaaatctatcccttaaataatattgcctttccatataaataaaattcatttgtattttctattattttacttatcatgtaaagttaaaatgcaaaaaatcattcatataataatatatatgaatgattttttgcattttgtacgaattttaccattacttttgaagcaggtataattcgacattttttgttttcacaaattaaacacataatacttaaaaatatgtattataatcaacagaaaacattttcattttacgaaataaaaaaacgcaacccttggggctaggttgcgctttagcaataagcaataagcaataaataaaaagggggctatatattccttttatttatccttgcacaaattattatagattattacgttccataatgcaaggattttattaaaaaaatttaattttttcgcttaaaatgaatgtttttattgcattttttttaatcattcgttaataactctttaatagggctaattcttcatctgataattctctatattcgccttcttctaaatcagcatctaatgatagtcccccaaattcttctctttttaaatatacaactttctttccaacagcctcaaacattcttttgacttgatgaaatttaccttcttgtattgtaactctaatttccgatccttcttcacttgcagatattatttctaatttagcttccatacacttatatccatcatctaatgtaataccacttttaaatgcttgaatatctttttcatctacttttttgtcaatttttgcataatacactttatcaacatgccatttaggggatataagtctatgattaagttctccatcattagtaagcaataataatcctactgtatccttatctaatctccccactggaaatggttcaaaaacttgatgatctacatataaaagatctataacagtttcatctctattatcatgagttgcagatataactcctgctggcttattcatcattaaatatatgtactttctataaaaaacctcttctccattaatcttaataacagatttctctggatcaacagaaagcccgttatctttaacaataactccatcaacttcaattaatccttttttaacaaatgctttaacatcttttctacttccgtatcctaaatttgaaataaccttatctaatctttccatatgttcacttctctttcttatctcatcattttactttatgttaattaattataccaaatcatgttgcaattatacaattaactattgtatacatcgatttatatcaatttaaaaagaactattctaaaaaaaatttagaatagtcctacctatatttataatataaacattattaattaactattacttgttaactgttaactgttaactgttaactgttaactaaaatcatactccactttgataatatcccattacttttggaacataattttgtgtttcttctggcatcttatacaactcatcagatgatgcaacacctcttctttgcatagttccaggaccaccattatacgccattaatgccatctgtatatcaccgttatatttatctaaatattctcttaaaagtttagttccaccatttacattttgatcaacatcataaggatcacttattccaagatgagaataattaccaggcattatctgcattagccctgatgcacctacacttgatgtacatgttgaatcgaaatctgattcttgttttataactgcaagtataagagattcacttataccgtatttttttgatgcatcacttacagctgaatatattttctttaaatcctctggtgttctattattcaacatagaagttcccgaactatatatatttccatatgaattatttaaagtcaaaggaatatctgttaacttttgacctgcaagataattctgaaccgctcttgaagtttgattagaagctgctgctgcatttattgaatcggatgcatccgtttgcttcttcacttctgttgttgaattattattttctgtatttgaattattaactattttatcaacattgtctttagctgtatttttggctgaatccatatagtttttcatcatcatttgaaatgctaaattgttgtactcactagattcagttgatgatgttgactcattagttaactgtccattactcatcaacgacattgccattaattgttcgttagatatattattactcaaaccatctatcggcatcttaattgttctcccttcacactcttcttatagttatttttcgtttattacaaattaatctttaacacaaaaattcaattcactataatcttcatagctcacttttttataataactcttagctaaagctaatattttatattttccacttgtaaaaggtataaagctataaaaattctttttactatatgattgtacttttttccactgaccattttccattaaataaaattcataacaaacatcttttccacctctgcttgtaacttcaatcgaaaattcttcattaacttttccttcaattttatttgatattatctttgtatttaatactggtgaagcctcatttacatacaaacttatctgttttttagaatcaaattccttctcacattttatattcttagcacaaacttctatagtatattttcctggcgttttaggaataaccctaagtttcttattcttagaaaattcagtctgttctatcgattgtccatttattttggtttcatatttaatcaacacttcatttgtattttgactgatacattcaaactctattgcatcacctattaaataattttctttataaggtaataaaatataatctatttctccaggaatatattccattgcttttaaatatattaaattatgaatatcaaaatctttttcagaatatttatccttaacttttatttcgacttcatattcaccaaccctatcaggagtaaaatcaatccaatttgatgtactgtatttggattcttcaataagtctgccatccctttttattataaaagaataaagtaagcctgtaccaccttctgcatgaaccattatattaacagtctctccaataataatttttttctctttatcaacaataacatctaaaattttaattggctttttcccacgcttctcaatagtaaatgcaatctttctactatcttcatattcaccagtaaacatcttatcctttacataaagaaatacttcatactctcctggttcttctggattccacgaaaattcattacttattgtaaaaccagtatcttcttctatcggaccttttactttatatctgtataataggttttttccaccctccacatcagaattaaatattatttcagtttcagtagcttgaggtgaatttaaatcagctataaaatcttttatttttatatctgtatatggtttaaccttgtacataagtacagctctatcatcatattctttattggataatatacttcttacaagacataatattctatatgtcccgtcgtgaggctcaataaattgaacattgctatttgttgaataatcctgtatgcatgatgatcttccatcttttgatattttataaaatttataaagtataacttgtccattattctcttttatatttgtatcaacagcaaattctaattcttctccacaaatcaattcggttgataaacattttatattaactatttctactttttcgttttcttcaacatctatatctataattctaaaatcatcaaaattgtctgttgaattaagtctcttgcattgaactaaaaattccattcttccaggctgtgttgcagtgtatactaaaatattatctgtatcgtactcttttattatggaccactcattattgttcttaatataaaatttatataaatacgtttctttttctatagaattaacttttataactgctttttcaccaacaaaaatcttatttttttcaattataatgtcttctattatttcattataagtatcatcaatactatttatatcattatttaaggacttttcagataatttactcattatcttttcactattgaatttatttatttcatcatcttctctattctcaacttctactctcttttcaatttcttttaagtcaataacatctctagtaactgccatttcatccctagtttcatccatagtttcatctattcccttcatcaaagtcttcttctcttcaggactcacctgtgaagcctttaaaaataatatattatcattagtttcactcattatttctttaaattcgtttgaatcagcttctgttattctaccaatctcagaataattttcatggtcagtattatctttaaattcttctttcataggctgtgaaatctctcccttaactattgaaaattcttctttagctaaataatccaatggtctagcctttaacttttctctggcttgtaccataattatatagtttccatcttcagttggaacccataaacattgattacttttggagaaatctttaataacagaccaaatccctcccttaccaataagaaatttatattctaattcttcactgatattttctgcttttacttttattcttattgaagtatcaacactttgtggcttttctttatcaaaaataatttctatatattttgattgaacttcattcataaaaaccaaaccctccgaatacataattttacagcataattatattatactctttttccattttttgtaaattaagagcgagtggttttatttaaattatatcatacatacttaattattcttatatatttagaaatttttatactatttttaccattttaataaattatataattatatttttaacatatttatataaaaaaagaagccttacagcttcatgatatttttcttaattacaaatgttaaatttttttcaagtctttgatcatcttcaggtgttctttttttaggattaccagttctccctccaccttttcttattttttgtgatatgtgcctttcttctagaagtctatcaatatttccttcattatatatatgtcccttgggatttaaaacttctgccttttttccaagacatattgctgcaactccataatcttgcgaaatcactatatcattttctttcgtttcattaacaacatacatgtcaacactttgaaaaccactatctacaatttttactgcactatagtcactttgaataaaatgatttatatcacaaaatataacaacctcaactttatagctttttgctactttttcaataatggagatacccggacaggcatctccatcaattattatcttcattagaattaaagtctcttttctaattcagctttcatttcttcatatcctggtttacctaaaagagcaaacatgttcttcttataagcttcaacacctggttggtcaaatggatttacacctaataagtatccacttataccacaagctttttcaaagaagtataccatatatccaaaatagtatgctgatatttctggtacattaacaaccatgttaggaactccaccatcattatgagctaataaagtaccttggaatgcttgcttattaacaaaatccatagtctttccagctaagaagtttaatccatctaaatcatcagcatctttttcaatgttgatttcatattttggcttttcaacgttaataactgtttcaaaaagaactcttcttccttcttgaatatattgtcccattgagtgaaggtcagttgtaaagtcaactgctgctgggaataatcccttgttatcttttccttctgattctccatataattgtttccaccattcattaaagtaatgtagtgatggttcatagttaactaatacttcaattacttttcctttattatataaagcatttctaactgctgcatatttataagcatcattttcttttattgaaggatttgaataagcttctctagcatcagctgcacccttcatcatttcatctatattgattccagctgctgctattggtaataatccaactgctgttaatactgagaatcttcctccaacatcatctggaactacgaatgtttcatatccttctgaatcagctaatgtttttaatgcaccctttgctttatcagttgtagcatagattctctttctagcttcttcaacaccatatttcttttctacatatgattttaaaattctgaaagcgattgcgggctcagttgtagttcctgatttagatattatatttaagctaacatccttaccttctattgcttgtaaaagttctgccatatatgttgaacttatgttgtttcctacgtagaaaatcttaggagcttttcttttatcattatctaatgcattgtggaaattattagttaacatttctatagccgctctagctccaagatatgaaccaccgattccgattactattaaaacttctgaatcagattgaatcttttcagcagacttttttattctttcaaattcgtctttgtcataattaacaggtagatcaatccatcccaagaagtcattacctgcgcctgttccattgtgtaatttatcatgtgcacatttcaccatatcttccatatagtcaacttcagatgtagctaaataaggtgctacttttgataaatctaacgatatacctttattcattttttcttctacctccatatacaataaaatattcttcattgttccattataacataaattatgtatttaattacttgctatacgattttttttattattataattgcagaaactttttagtagtttctataatttattatgtgcatctagagaaatttaagtactattatttataataataatgaaaaaaataaggaggaatagatatacactattcctcttatttattaaaatattaaatgatgattgttaatattttaaatttagaatctacaacagcatttgttctttctgcatttccttactttatcaacatatgcttgaacttcttgttttgctttttcgtatccagcatcataaccttctttgtatcctgcatcatatccacatttgtattgatttttgcatttcttttttaatccttcttcatagccttcacaatatccttcttctattccgcctatgaagcattcgccacaactatcacagcatctatggctaataaaattacaatcagattttgaacggccacattctggttcatcgcaagatctttcataagagctaaagctaaaattatcatcacttgaactcatatcttcagatacagagctaaagtcacaatcatactcgcactctggagtacatcttggaggacattctggtgtacatactgtatgatatctgcattttttatgtggtctgtattcacaacaatctatttcttctgaagcatagctcaaattacaatcatgtccacattctgatgtgcattttggaggacattctggtgtacattcgctatggcatttatctcttctgcatccacaagaattacagctatgacgttcttctgaaccacagcttaaattacaatcatatccacattctggtgtgcatactggaggacattctggtgtgcattctggtgtacatgcactatgacatttatcttttccacagccacaagaattgcaacagtgaatttcttctgaagcacaacttaaattacaatcatatccacaatctggagtactttctgaagaatactctggtgtacagtgacaatgtcttgtacatttattacaagatttttttccaccccaacaacttttttctttgcaactacatttattatatggttgacagcaaccatgctttctgtttttcatgttcttctctcctttgtagcaaaacataatgctctatagcatttgttaatattaaaacttaaatattttttcaatattttagaatctatggctttctaaatttcttcaattagtattccgtgaaacttaagaattacctgatattatattatgctagaagtctcgatttgttatcattttatatgattcattttcatagatttatgtaaatataaaaaagcccagacttatattattacaatctataaatctgaacttaatttaaatactatattattatattttgctacattttgagctataaaacaattttcctacaagtattataatataatctttatactctttgggttagcatttttagttatttattattgttaataaattttcaaaactaaatatactctttgtttcaaagctttcataaagtgattctacattttcttctgaatgttcaatgtctttagaatacagctttactatatctacttgattattcaagttaaactcttcattatttttacaccatctaaccacatctaactcttctattatcaacatgcttataactgccattttaatttttgcagatacatcataatcaaaaacagccttcataaaatatctaaatataaaatatactataatttgttcatactcatataatctatccacataatatgacttaaacttattatgtttttccacataaaattcaaagcctgaattttccccataaaaatgttttattgcttcatctaaaactaaagggcactcttcatttatatgatcaatatctttgtacacttcaaaatatttctttatgttatcatatctagcttctttattgttttttaaacttttcaaactatcaacgtagttgtttataaatttatcatcagaatatttttttctaacctgaactatttcatcaattttatcttcatctatttttttctgaatttcatcagtaaaacttaaaataatagatatcctatgacttaattccatagaacgattttgtattgtattcataataagatttcttgatgttgaaagttgcataaaaatatcataacttatatcattataagctgataccatatcatcatcttctacaacatcaaattcagtgatatttgtttttcctaatattattctcgctgcttctggacatgataaagataatcctacttcacgtatacttccaaactcttctgtaaacctagggtattccttgcatgtatagcataaatgttcttctccaagttcattataaatatcacataaatctctatcatttaaaaatgcacatctatttcctttaagaataaaaatattgtccccatcttcatcttgcactatttcattttttaatctgtttccaaacttacctttaatacatttataataatcatatgtttcatcatcaactactatctcccatccagcacagcatgtatcctcacattctgaagcaatgcatttaaattttttaaaataatctggtactcgtgttctcattttattaccttgtataatgaaaacacagtaaaaaacagattttcattacacttttcctttcttttatatttttcatatcaatcaagaaaaaatcctgataaacctattaatatagttttttcaagattttattataaaatattattgaaattaagcaagttgttcttgtaggagttgtattaaattatcttgatacatcccctttatttataatctgacgatatttcacctaatttaccaattttcttttgccaccatattaacaccacgttttttgttttaatcgtaccactgtgtattactttatgaaatacactaaaatcaactccacatatatcaattaaaaaaatattatttcaatgcatattttttaaatatgcatattggataattcctactatataacttttttctagaaattactttaattttagtatatttgtatattctcacttaggtatttgctcaactgcacactggttgattgtaaaatctatctcatttccatattcttcttgcaatctagataaagcctttttagcttcatcctctgtattgtattctcctattgtaaaaataaatccaccatcttcatttttaatctgagaaatttcttcattctgatattgcttcaataattgttgaatttcctttgtagatgatatcacactactcctcaataggtatatcgtctgacctggtcttttttctccatctgtatagtaagcatcctgataaaattgaatcgtaacttctccaggatcatggtattctatcaattcataattatataattgtttcaattggactacaaaactcaaggtgttctcatcaagcgactcaaccatataaatatctttgcatgcttttaaagaatgtatctgattcttaatgttgttaaatataactgttttgtattttgcatcaacattataaaatgaaaattccattcttgcaggagcataatgaaattctgtagaatagcttaatactttatttgaaatcaccccaccttctaagaattgaaatgtaattgcgcgttcatctactgatacatttatagatacttgatcaatgctctctccaccgcttccatttcttaatgcctgcaccaatgttttaataactgggatattgctcgcatacgcatacatggcaggaacgttagcagtaatcaatagtaaagcaaaacaagctgctactgccaaaccagatcttttgacaacaagcattcttttcccctgatcccatttccgttgacctttttttaatgcttctattaatttatcatcaggtattgctatagaatcatacaattccttccctgtatccatcatttatcgcctcccgccaaataatatttcatttttttcaaactgcgatatatttttgattttatggtgctttgaggcattttaagaatatctgacatttccttatatgtacattcttcaaaatattttagaataacataagacttttcatctggctctaacatatcaattgcatggtataaatccaaattttgatcttgttctgtttcttctacttttacttcttccatataatcctcgtatggagtaagtttggatttcttacgtagtgtttccaatgaagtatttattataatcctagtcatccaagtaagaaaatagtccatctctcgtaaatccttcaagtgtactagtcccttatacatagcatcgcttacaacctccaacgcttcctgttcatttttcacatagctgtatgcaattcggtagaatttttgcctattttccatcataagttcagcatacctgcattcgttaatatatttcacatttataccacctatactttattcttatatttcagatactgcatggtaacatttatgccatatctaccttttctagatataaagaactatatcctctttcggcaaatgaaactttaactgataatttcgtaagcccccctcaaaataatccaaagtttatttgcctcaatatgttatttccttttaacaactcttcctttcttagcttagtatcaatcaacgatgtacttatctatttaatttcctaatgttaggtaatttttattttccatatccttgatcatattattgcaaataatggctgttccttcaacctgatctaatccctcgaagatttttgcatctgcaacatttgtatagacaccatcatttgcaaccaattcaactgtttctctttctgctgctccacttcgctgtaatattagtctccttgctccgaactcacgaccattcactgcatcctttgtaacaataattggagtgttaactagcgtaaatgcctgataaatttggaattttccttcaacttctcttccccatacagcagaatctccaccagatccgcttgtatatggacccacaataaccgcgataatctcatctgtaccatctccgtttaaatccacataattatagtaatattttgttgtgcttaattgatcatcaggaatttcatagtattcgataatagctttttccaacgcttcattcggttctgtttctgccattacttgatttacaccttcagggagccatccggtataaagctgatctgtatcaaacgaatgtgcattatcctcactataatttggtgtaatttctaatgaaacaagtcctgattgctgatacaactgaatgatagtatcttctacattccaagttttccatgtcgctccaccctctgatatcttatcattggaactcatgggttctccgtataagcttatcagctcatctgcgtatgtgtttacatcatcttttttaaattgcataattacatccattacacattgattttcatcatacaacgttcctacttcgattgtctcaccaaatagttttgcgtgataaatacgaccaatttttgtagttccgtctccagctatattttcttctccacccccaagcagttctgctgactcagcatcactttttccaataagattcatgcattcttttaatatagtttttgcatctaaaaatggttctgatgccgtatcagtatttgttagcactgttttttcttgtaatactttaacctgtgcagactcaacataattgtctgaagccacagatccatatactgtcactccaataagcatacctgtagtcaataaacataaaataatttgttttttcataaatttaaattctctcctttaatatcttttaataattagatgcattaaagagttatttggtcgaaataattttgcaattctttaaaataatagacgcgattttcctgttttcttctctatttaaaacacttgtaagttctatatttttgaaggttcatcaaacttccatatcacaaaaaacaataccttaaaactgctgctttaacagtttcaaggtattttatttttctaggttttattctattttttccacaggctcaaaatatctaaggttgcttttgggggatattctggggtgcctggggatattatattattcaaattcaatagttgctggtggttttccagtgcagtcatacattacacggttaacacctttaacttcattaactattctagttgttacttttccaagcacttcccatggaaggtcagcagactctgctgtcataaagtcacttgttgttactgctctaagtgctatagcgtaatcataagttctttcatcacccatgacacctactgaacgcatatttgtaagagctgcgaaatattgacctatttccttatcaatacctgcatttgcaatttcttcacgataaattgcatctgcatcttgaactattcttactttttcagcagttacttcaccgattatacgaataccaagtcctggacctgggaatggctgtctataaactaatttttctgggattccaagttctaatcctgctttacgaacttcatccttaaataataatctaagtggttctattatttctttaaaatcaacataatcaggaagtcctcctacattatgatgtgattttataacagctgatttaccaagaccactttctattacgtctggataaatagttccttgtactaagaaatcaacagctccaatttttttagcttcttcttcaaaaactcttataaattcttcaccaattatttttctcttagtttctggatcttctactccagctaatttttcataaaatctttcttgtgcatttacacgtatgaagtttaagtcataattaccatttggtccaaatatagcttcaacttcatctccttcatttttacgaagtaaaccatgatcaacaaatacacatgttaattgttttccaatagcttttgaaagcaatactgctgctactgaagaatcaactccacctgataatgcacataaagcttttccatttccaacttttgctctaatttcttcaattgtcttctcaacaaatgaatccattttccaatctccagaacatccgcatacattatatacaaagttattaagcatctttgtaccttcttgtgtatgcataacttctgggtggaattgaactgcatataaattcttttcttcacattccatagctgcaactgggcaaacaggagtattaccagttatcttaaatccttctggagctttttctatgtaatcagtgtggctcatccaacatatagttttagatgatacaccatcaaaaagtttagaatctacctttacatctacttctgttttaccatattcacttacaggagctgttgcaacttttcctccaagcatatgagacataagttgagaaccatagcatataccaagaataggtactcctatttcaaatagagctttatcgcatagaggagaatcttcaccatatacactgtttggtccacctgtaaaaataattccctttggattcatttcctttatttcttcaacacttaacgtataaggatgaacttcgcaatatacattgcattctcttactcttcttgctattaattgattatattgtccaccaaaatcaataactaaaattaattcttttttcatggtttcctcctaaaaagttcttaatatatactattattgcccaaataaatatttttttcaactaaaaatatttattttgggcattttttattaacatttgattattttttaattataatattcgtctattgtccaacactgtagtttggagcttcttttgtaatatttatatcatgtggatgactttctcttaatccagcacctgtttgaactacaaatcttgcagtttcatataaagtctctaagtttttagatcctaagtaacccattcctgatcttattcctccaattaattggaatatagtatctgctacaaatcctttataagctactcttccttctacaccttctggaactaattttttatttccttcttggaagtatctatctttagatccacattccatagcagcaagtgatcccatacctctataaactttgtaacttcttccttgatatatttccatttctccaggagcttcatcacatcctgcaaataatgatccaagcattgctacagatgcaccagctgctaatgctttaactatatcaccagaatacttaagaccaccatcagcgattactggaactccatgctttcttccaacttcagcacaatccataactgctgttaactgaggtacccctacacctgcaactactcttgtagtacagatagaaccaggtcctataccaattttaacacaatctgctccagcttctattaagtcttctacagcttcagctgttgctacattacctgcaattacttgaagttctgggtaagtttcttttatctttttaactgcgtctaaaactccttgtgaatgtccatgagctgtatcaagaacaataacatcaacttgagctttaactaaagcatcaattctttccatcatgtttcctgtaacaccaacaccagcaccacataataatctacctttttcatctttagctgcatttgggaactttttaactttttctatatctttcattgttataagtccttttaagtttccttctgcatctactaaaggtaatttttctattttatgtttctttaaaatttctttagcttcttcaactgtagtcttttcatgagaagttattaaattttcacttgtcattacatctgaaattttcttttgaaaatctgtttcaaatattatatctctgtttgtaataatccctactaattttccgtctttagtaacaggtactcctgatattctatattgtgccattaagttttcagcatcttgaataagatgatcttctgataaataaataggatctgtgattacaccattttcctgtctttttactttatcaacttctttagcttgttgttcaatagtcatatttttatgtataattcctattccgccttctcttgccattgcaattgccatcttagattctgttacagtatccattccagcactcataagcggtatgtttaaagctatcttctttgttaattgtgttcttgtagttacctctcttggtaatatttctgatttgttaggcattaataatacgtcatcaaaagtataagcttctttaataatttttgccattttaaatttcctccctatttttgaattatttattgcatttcttattgattttgaaatatttattgcattttcacccttatttttgtgtataaaaaaagcacattaatcatcctgagtgatgttaatatgctaataataaattaatatcagcttatattaatatcactcatagtcagaaatttaaggtttccggtagatactccctgccatatccagggtatatatgagttttttaatgtgccgtatctttgaattaaacatattataatgtatgtaaaaaataaagtcaataaacttgacacaaaaattgcattttttatgtattatttttcaaattaatgattacttttattagactacttaaaaatagctcaagtagtctaataaaaaatttataaaatattatattttattctatctctaaattatctggttgtattactgctgttactttttctaactgttcattttcatctattgtgaattctgaaccattaacaatacttctacattcctctattttcgtattatctttaagattatcaaatttaacatcctttagatatttagaaattccagcttcacttttaatatgactaactgttttatcttcgggatattttactttatttttcaaattatatgagtctacagccattactacacttctgctttgatctactactttcatttttttagcttcagttatataaccacccacttgtggtattaatgcactggctaatattcccacgatgcacataactactaccaactcaattatagtaaaagcttttttctttttttgtttttttcttgattctcttaaatgcatataaaacctccctttttactttatattcctatatttaccaattatatattttgtattcataattataaaaaaagattgatagaaatctatattgggatttctatcaatcttttatattaaataaataattaattttttatattaaattttagtacattccgtccattcccattcctggagctccacctggcattacaggatctttagatggaatatcagctacagcagcttcagttgttaagaatgtagatgctacagatgcagcattttgaagtgctgatcttgtaaccttagttggatcaactatacctgatttaagcatattcttatattcatcatgtaaagcatcatatcctacacctggttcactatttttaactttttcaattattactgaaccttcaacaccagcattgattgcgatttgtcttactggttcttctaatgctttaactattatatttataccgatttgactatcttgaacatcagatgttaattttgcaacttcattgattacattaacataagctgttccaccaccagctactataccttcttcaacagcagcctttgttgcatttaatgcatcttcaattcttaatttcttttcttttaattcagtttctgtagctgcaccaactttaattacagcaactccacctgcaagttttgctaatctttcttgtaacttttctttatcaaattctgaagaagtttcttctatttgagctcttatttgattaactctttctttaatttctgctgaatttcctttaccattaacgataactgtgttttctttgcttactttaacgctatcagcagttcctaacatatctatagtaacttctcttaaatctcttcctaattcttcagcaattacagtaccaccagttaagatagcaatatcttgtagcatttcttttcttctatcaccaaatcctggtgccttaacagctacacaagtaaatgttcctcttaatttattaactactaatgttgccattgcttcaccttcaatatcttcagcaatgattaatagtttcttacctgtctttactatctcttcaagtataggtaatatttcttgtatgtttgttattttcttatctgttattaagatatatggattttctaaaacagcttccattttctcagtatctgtagccatgtaaggtgatacatatcctctatcaaattgcattccttcaactacatctaattcagttcccattgatttagattcttcaatagtgataacaccttcattacctactttttccatagcatttgcaattaattgaccaacttcttcatcagcagcagaaatagcagcaactctagcaatgtcttcttttccttctacttgtttagaattctttttaatttcttcaactgccttttcaacagctacttttataccatttctaagtaaaattggattagcacctgctgttacattttttaatccttctctgattatagcttgtgctaataatgtagcagttgtagtaccatctcctgcaacgtcattagttttagttgcaacttctttaactaattgagctcccatattttcatatggatcttctaattctatttctcttgcaattgaaacaccatcatttgttattaatggtgcaccaaattttttatctaaaacaacatttcttccttttggacctaaagtaactttaactgtatcagctaatttatctacaccaatttgcatagctcttcttgcttcttctccgaattttaacattttagccatttataacacactcctcttaatttaactttctatccatttattaatgcttaaaatttcattctaattgattttattcaactattgctagtatatcttcttgttttaatatagtatattcttgcccatcaactttaacttctgttcctgcatatttagagtataaaaccttatctccaactttaacttccatttcaattctgtttccatctacaactgcgcctggacctacagcaactacttctgcttcttgtggtctttccttagcacttcctgttaagactattccactcttagtcttttcttctgcctctaattttttaattactactctttcaccaagtggtttaatattcatgaaaaaaccctccttaaaatatatatattattatttttattatttttatttcaattgttagcactcatcatcatcgagtgctaatataattataatagcgtttatatccatataattcaaacattacttccaatattatatcctgtttttctgtaaatattaccgtttatttctgaataaatcgccaatactcattttttctttaattttctcaaaattatagtaagcaaaataaatcttgttttttctttatataaatgactttaattacaagaaaaatctctttaaaattactcatattttctgaggttttaaagagattttacaagttttatttaaaaacttttattttgctaaatcacttctttaagcttatattgtcaaattcatctaatattttattagacatgacacttttgatttctccttctttattatttttcacacagttagctttagcttttacagaagaaacaactttagctgcaccattaatacatccaccttcacacatcattccttcaataaaattcccatttaatttacctgctttagccattatcatagtctttttaatttctgatccaccagaaacttttactggcttaaattctgtttctattcttttttcagaaatatagttttcaatagaagcggttagtcccccacctattgcaaacccccttccaaaaatagaaccatcatcaactgtaatctcttcacactcagatggatttatttcaaaagcatcgaataacgcaaatagttcttcaaatgttagtacgtaatctacagaatctttaatactatcaattagcacttcatttttctttgctgtacatggtcctataaatactactttagcattcgcattcttattctttatatatctacctgtagcaaccattggtgatactgtacttgatattcttgaagattgatctggtactaacttttcaatatagctaacaaatcctggacagcatgaattagtcatataagaatctcctatactcattctctctataaattcattgctttcatgtacagtaacggcatctgctccacacgcagcctctgtcatatctttaaaacctaatttctttattgcattttttacttgtccatatttaacatttatattaaattgtcctgttatggcaggtgctacaactgcataaatatcattatcagacatcaattcattaacaattttaactatactgctcttatcctctattgcaccaaatggacatgatgccatacatgctccacaatttatacacttactttcagttatttcagtgcttaaatcgtatttattaaaatttatggctccagtagggcacgctctcttacaaggtctcatatcttgtgcaatcgcatcataaggacatgcttttttacacattccacattccttacactttgttgtatctatatgtgctcttccattaacgtaacttatagctccaaaattacatacactctgacacttatgcgctatacaatttctacaagcatcagtaacctcaaatttttttgtaggacatctatcacatgctgcttttatgacatataaaatttgtttattttcagatatatctattaattcttcactatatcttccatttggaagatagccggcggcaagttttactctctctaaaaccacatttctttcatgttgaacattatctctatatttaggaatatctccttgtatcatttcatatggaattttttctatttcttctcttgttagattattctgctttgcaagtacagccactctagtcaaaacttcatgttttaatttagccaactgattttcaaattgaaacattaaaccacctctatatttatgttataattttacatcattgtataattataacatagttttatatttaatttaatgctattcctataaaatactaaactcttttgattttaaattctattatgatataattaatacatgaaatatatttttatatacgaggaggattttatggcccaataccatatttgtgaattgtgtaatagaagtgtctcgataataacaaatcatcatttgataccattagaaaaaggcggtaaaaaattagatacaatacacttatgtccaacttgtcattgtgctattcatgcactatttacaaaccgtgaattagcatctagatttaactcactagaacttataaaaaaggatttcaagattaaaaaatatttaaagttcgtagagaatatacctggggattcttacgttccaataaaaaaatcacgtcgagttagaaaaagtagttgatttaaattagaaaattaatgaaggtgtttctaagaaatatcttgagtttaaaataatatataaattaaaggcaaggtgattataccttgcctttaattttgtctatatttattaaattaatcaattgtaatcttattttccctagcataataaaataagtactgttgtgcaaatcctgataattctttaaattgatttcttgcaaatattcttatcttatttaatgatgcatcttctgctccataaaaataaatcatagcacgcttaacccatacatcaactggaaatgctgaatacttttccattgaaaaaagcataatacaatctgccacctttgcacctacacctttaaattcctgtaaggccgaatgacattcatcatcattaagactttttatatactctaaatcgtattttttaaattcttctattttttcggagtctttgtcttttttagctttataactactatatacatttgaaattgtatctataatgtatttgcttctaaaagaagctcctgtttcttgaatctcttctaatgtagcatcttttatttgttctattgttggaaatgcattatatgtatttcctttgtactctatagttctcccccattttgcagatatcttatttattgttttcattattgaaggaatactatttctagctgatataataaagctaattaatatctcaaatggatcttgatttaaaattcttataccaggaccatactcaacactttttctcaacaaatcatcttttgataattcttctttaattttggaataatctctatttaaatcaaaataatcaatccagatattttcaacatcttctctgctagaattatatatctttatatcatttccgtcttcttcaagttctataacacgttcaaatgctacagttatgtaatttgtatcacttattttatgaaatctaaaacattgaccacattcaaaagtctgctttaacttaaaatttttaacatcttctattactaaataatcatcatattcttttatttgtttatagtccatcttcattaccacctttatatttgtttattgtaattccacttgtaactaaattaataatctctattagtataatcaaatcattgcataaagattatggataattatacttaattaacaattataattatatcatggataactttatttttatatgaacatatatattatgtttcaatttacactttataatttatgaactaaaactatagtgcatatgtaaaattaaataaactgcataaaacttacattttatacagcctttaataataatttatattaataatttccatcacaaaaactcctaaaagcagactgcttctaggagtatatttatttaacgggatattataaagttaaaattatttagaataatcgtagaatccttttccagtctttctacctaaccaaccagctctaacatactttcttaaaagactgctagctctgtatttactatctcctgtttcgttatataaaacgtccatgatagctaaacatacgtctaatcctataaggtcacctaaagctaaaggtcccattgggtggttagctccaagtttcatagctgcatcgatatcttcttcctttgcaacaccttcttgtaaaatgaaagtagcttcattaatcatagggattaaaattctgtttacaacaaatcctggtgcttcagcaacttctactggagttttacctattgattctgacatttccttaacagcatcaaaagtttcttgagaagtagcagctcctcttataacttcaactaacttcataactggagctggattaaagaaatgcattcctataactttatcagctctcttagttgcagatgcaacttcagttattgataatgaagaagtatttgaagctaaaatagtttctggtttacagatttcatctaattcagcaaatatttctcttttaattttcatgttttcaatagcagcttcaactactaaatcgcagtcagcagctaatttcatatcagttgttcctgatattcttgaaagaatttcttctttgtctgcttcagtaattttttctttagccactaatttagataaagacttagttattgtagctattcctctatcaacaaattcttcttttatgtctcttacaattacttcacaaccttttgcagcaaatgcttgaacaattccagcacccatagttcctgcaccaagtacaaatacttttttcatgaataaattcctcctaaatatatatatttctgttccatttatttaaaatactaagaccaggcatatttctggccttagatatagtaaatacataatatattaaccaaaattttatataaatttattaattaaattccgctctaaaatccactactgtttttctataatcaattaattattcagcttctacaatttcctttgcttgagcaattaattcaggtaatacctttttaatatctccaacgatagcgtaatctgcaaccttcattattggcgcagtttcatctttatttacagcaataatcatatcagaatcttgcataccagcaacgtgttggatagctcctgaaataccacatgctatataaattgatggttttacagttttaccagtttgtccaacttggtaagcattttctatccatcctttttcaactgctgctctagaaccagcaactgttccacctaatatgttagctaattcttctagtaatgcaaagttttccttagatccaacacctctaccaccagaaacaataactttagcttctgatatgtctatgatatctttagcagttttaactgtttctaatactttagttctaacatcagaatcagttaattccacattaactttttctatgttacagttagctccatcactttcaactttagcaaaaactcctggtcttactgtagccatttgtggtctatgttcaggacatgcaattgtagccattaagttaccaccaaatgctggtcttgtagctaataaatcaccattttcaacttctacatctattgatgtacagtcagctgtaagtcctgtgtttaatctagctgcaactcttggacctaaatctcttccgataaaagtagcaccaacaaataatattcctggttttctttcatttactaggtcacagataacttttgtatatgcatcagttgtataatgttctaataatttatcatcagcaattaaaacttcatcagcaccatgttctgctaatgttttgcttaatccttcaatattgcttcctaataataatgctgttaacttaactcctagtttatcagcttgtcttcttccttctccaagtaattctaaagacactttttgtaattcgccttctctttgttcagcaaagacccaaacgcccttgtaatctgctatattcataattacttaacctcctattatcttagatgtagtgtttctcttttaattttcctaaaacgtatgttacagcgtctttaggttcttgtttaactaattcaccttgacctttaacttctttagtcattgacttcttaacctttgtaggcgaacctttaagtcctaattcttcaacaggtacatctatatctgctgctcccataactttgatttcatcatcgttagtttcaaatattcttgcaacgttcatatatcttgggctatttaattcttcaattgcagttaatagacatggagtcttaacttcaactacttgatgaccatcttctaatgctctgtttactatcaatgtttccccttcaacttttacgtcttgaacgtaagttacttgaggaatatctaaatgttcagcgatttctggaccaacttgtgcagtatctccatcaattgcttgtctaccagcgaatactatatcagcatctaatttagctataactcctgataatgcttttgaagttgctaatgtatcagctcctccaagtgctctatctgttaataaaatagcttcatcagctcccatacataatgcttctctaagagctgctttagccattggaagccccatgcttacaactgttactttagcaccagttgcttcttttattcttaacgcaccttctaaagcatgtttatcctctggatttattattgatggaaccccatctcttattaatgtaccagtctttggatcaatttttacagctgttgtatctggaacttgttttacacaaactactatattcattctaaaagtcctcctatcttaaaatgcttccagcgataaccatcttttgaacttctgaagttccttcatagatttcagttatcttagcatctctcatcattctttctactggatattctttagtgtatccataaccaccaaataattgtacagccttagttgtaacttccattgcaacatcagcagcaaataatttagctcttgctgcatcaactgaataaggtataccattttgtttcttccaagcagccttatatactaagtgttttgcagcttctatcttaacgtccatttcagcaatgtaccattgtaatccttggaaagctgaaagtggtttattgaattgttttctttctttcatgtatgcaactgcttcatcaaaagcaccttctgcaatacctaaagcttgagctgcaataccaattcttcctccatcaagagttttcattgctattccgaagcctttaccttctttaccaattaagttttcttttggtactatacaatcttcaaaaattaattcagtagtagaagatgctctaatacccattttgttttctaacttaccaattgagaatcctgggaatgacttttcaactataaatgctgatattcctctagttcccattgatttatcagtcatagcaaaaactataaatgtttcagcaactccaccattagttatgaagatttttgaaccatttaatacataatggtcaccttctaatcttgcagtagtttgttgacctgctgcatctgtaccagcacctggttcagttaaaccgaaagctcctatttttttacctgagcaaagatctggtaaatatttagctttttgatctggtgtaccattttcatttattactgatgcacataatgaagtatgagctgaaagtataactcctgttgtaccacaaacctttgataattcttctactgaaattatgtaagaaagaacatctccgccagctcctccaacttctttagaaaatgggattcccatcattcctaattcacccatttttttaacattttccattggaaatctttcagtttcatcgatttcagcagcaattggcttaacttcatttactgcgaattctctaaccatttgttgtactaattcttgttctctagttaattggaaattcattaaattgccctccttgttaattaaaaccttgataacatatatataaatctgtaatggatttttaccatattaaaatactatttattttggaaattcttttcttttcttctttctaagaaagcagtcattccttcagtttgatcttctgtagcaaaacatttaccaaaatcttcagcttctatcataacagcttcatcgattcctacttgcatacctctgtttattgcatccttacataacttaacagctactggagcatttgctataatatttgaagccatttttttagcttcattcataagatcttctaaagctacaactttgttaactaatcctattctataagcttcatcagctttaatatttctagctgtataaatcatttctttagcttttcctagtccaactattcttgctaatctttgagttccaccaaatcctggtgtaattcctaaacctacttcaggttgtccaaataatgcagtttcagatgctattcttatgtcacatgccatagatatttcgcatccgccaccaagagcaaatccttgtattgctgcaataacaggcttgtttaaattttctaatcttaaaaatactttattaccaagttctccaaattcttttccttgagcttcatttaaatctttcatttctgcaatatctgctccagctacaaaagatttttcacctgctccagttaagataacagcatagatgttagtatcattttctaaatcttctaatactgtatccaagtcctttaaagtcgcagaatttaaagcatttaaagctttaggtctattaattgtaacaattgctaaatgtccttctttttcaagaatcacattttctaattccatactaggatcccccttcaatttggcttatttttatttttttaattttcttactatttagaataatgatttcactcattcatttgttaatattataacaaatgtaagtaaaataattggagccatgctccttatatcaaattataatactttgttaaattttttgcaataaaatattaccatttttaagtattttttttattaattctttttttttcattattagtatttatattaattttttgtataaatatattaacagtttaaactttctattttgtacattcctttcttgaaaaataaaaaaatcacattgtaaataaatcaataatttacaatgtgatttttctcttatgtcttaattatcttgttcatttaaaagatatatcaatgttagtaaactctcacttaagtgaacattctctactttcacatgacttggtacaattaaatctacaggagcaaaattccaaatagctcttactccacctttaattaaatcatcagcaactgtttgtgcattttttcttggaacacagattatcccaatatctattttctcattttctaatataggcttcatttcatcaatatccacaatttcaacgtctcttatcttcattccaatgagttttggatttgcatcaaaaattgtactaatcttaaaacctaaatcttcaaatctcgaataattagatactgcttgacctatgttaccagcacctactaatgctgccttgtatcctctatctagccctaatatagacttaatttgattatataattctgttacattatacccatatccttgttgtccaaagtctccaaaacaatttaagtcttgtcttatctgagatgcagtaaatcctatcttttcccctaattcctttgaagaaattctatctacttcatttcgcttaagctcaccaagatatctataatactttggcaatctctttataactgccatagatatatttttacttttctccatctttttttctccttaatttagtctaatttttaacaatccattttatatttataactaattatcctaaaataaacacatatcaaataaactttatacttctttatcttgtattaataataagtattgtcataatcagttattctaatacttactttatttagtaagatttataaagtacacaccaatttattatactctatgtttaataataataccatacttatataattttatgtcaagtataaaagctatatttttataacccctaaatgttctaataaaattttcaatccgataataagtaaaattaatcctccaaatattcctgctttattttttattacatttcctataactttaccaagatatacagcactaacacttaaaacaaaagttgtaattcctattataaaaatagcataaaatatatttatatttaaaaaagcaaatgtaactcctattgctaatgcatctatgcttgtagcaattgccaatataaaaaatgttttattactatattcttttattttattttcttcattaggtttgactccatctattatcatttttatgcctatcaaagtcagcaaagcaaatgctatccaatgatcaatgctttgaatatattttgtgaattttatacctaatatccaacctaaaaatggcattattccttgaaatataccaaaatatattcctgactttattgctattttatttctatctacattatttatattcatacctattgttaaagctactgcaaatgcatccatagataatccaatagctgttaatagaattgatataatcgacataatactcctcccaattatctctcaatcaacttttctcttatattaattatttatagtattcctactcattctaaaaattatgtgattttaaaataattggtttttctgtaaaagaaataaactgataaaaacaaaatattttagttttaatcagtttatttctacatatataatgctataactttaatgctctcatagaatttaaaacagctattaaagtaactcctacatctgcaaaaacagcttcccacatgctagacattccaaaagaaataagaattagtacaccaacttttattactaacgaaaatattatattttgccataatatcttattagtctttcttcctataacaatcgcatctgctaaagaattaatagaatccttcattaaaactacatctgctgcttcaattgccgcatctgagccaattccacccattgcaactccaatgtcagcccttgcaagcactggtgcatcattaattccatcaccaacaaacaccaatttattattagaattattatttaataattcttcaactttgccaactttgtctcctggtaataattcaccataaatttcgtcaatctctaattcgtttcctactttttctgcaactttcttattatctcctgtaagcataacaacttttcttattccaagattttttaatctttttactgcttcttttgaatcttcttttatagcatcttctattacaatacttccaacacatttttctgatattgctacataaactacagtacctacagattgtgtttccttacattctatattatattttttcattaatttaaaattacctagtaatacttcttcttcatctatttctgcttttattccatgccctgataattctgtatagttttttattctgctcttatcaatttctttgttatattcttttactatggattgagcaattggatgatttgaaaaactttcgcctaaggctgcaatttcaattaatctatcttttgatatattataaacatttacttcagtaaccttaaaagaaccttttgttaatgttcctgttttatctaaaacaactatatctacatctttaagggcttctaaataatttccacctttaactaatatacccttccttgatgctcctccaattcctgagaataatccaaggggtactgaaactactaatgcacatggacatgatacaactaaaaatgacaaggctctataaatccaagtagaaaaatttgcatcctttataacaaatggtggaattatcgcaattgcaactgctgaaaatacaactattggtgtatagtatttacaaaattttgttataaatttttctgtatgagcttttttattacctgcattttcaaccatctctaaaattcttgaaattgtagattcaccaaatactttagttacttttacttttataaccgaattcaaatttatagttccagataaaatttcatcattaatttgtacatctctaggaattgactcacctgttagagcagatgtatctagagaacatattccatcaattaatattccatcaagaggcaccctttcacctggtttaacaacaataatatcatctatatttacatcttctggatcaacccttttttctccactttcagttaataaatttgcataatcggatctaagatccataagtgatgttattgattttctagaacgattaactgcataactttgaaataactctccaacctcgtaaaaaatcattactgcaacagcttctggatattcgccaataataaaagctcctagtgtcgcaatagtcattaagaaattttcatcaaaaacctgtcctcgtgttatatttcttaatgcggtcattacaacttttccaccaactagaatatatgccactaaaaataatattaaatttatatattctttatcttcaaatataagtgcagttgcatataacactattcctaataataaactccaattcttttttaaaaaaccaggttcataaccttgctcattttctgtatctaatacttgcccttcatcatgtttgcaacattctccatcacaatgctgatgttcatggtttttaatatctttaatttgtttttctttcccatcttctttaacaacaacatctggctctagttcttttactattttttttactgaattaattatagttgctttttctatattttcattaaattttattaataatttgcttacagaaaaattaagactagcttctattacattttctaaattattaactctagcttctattttattagcacaatttgcacaattgagtccttccagaattaattttatttcattatctttattcgtattcgtatgattattagaattaggtttttttaatggttttgataccttcttatattcacttacttctacatctggttctaattcctttactattctcttaacatgatttattacattttctttagaatcttcattctttatttttatatttattcttcctaatgaaaaatttatattagcttcttctacttcttctaatttattgactctgtcttcaattttattagcacagttggcacaatcaagcccttttaaattcaatttaaattctttatacatacgcctccatcctttcttgaattatatgtagctgactataaattcataatatgatacataattaatttgtttccataattaaaattattctattatatgtttgaaaccttcattgaaaatatgctttatatgttcatcttcaagagaataataaacaacttttcctactctcttaaactttaccaatctagaagcttttaaagttcttaactgatgagatactgctgattggcttattcctaaaattgctgataaatcacatacgcacatttcagattcaaataatgcacataatatttttactcttgttgaatcaccaaaagccttaaataattcagcaagatcatataacacttcatcttgtggtaatgcatttttaaccatttctacaacatcttcatgaattacattacaagaacaattatctatatttgtattttcttctttcaaaattcttacctcctatgaacatatgagcacttgttcatatgtttgtttttattatatgattaatttcataatttggcaacactttttaaaataaaaaaactactttaaaagttaaattatctataacttttaaaatagtttctccaaaattccaagcttttatattattactttgctcttatacgcaattatattttttcccgataaatttttattactaaatacatgattcaaaaccatattgattacactatcgcaaacatagtaagcaaaagtaagatcattattataattaactattccatcatattgcttttgcagttcttctataaactcctctaaattttccctattgatgtttgtattaattatctttgtaggtttaaatgtcttgcataatttagctaacttctgctcatacatcatatgctgttttactgcatttgtactcttaaattcccatctataataatgtggtgcacagaaaaagtcacataaaaaatgacagactactccaagttcttctgaaaatcttccaagcttcatatcaaaatatacttcttctaatgtaagagatgataaatgtattattttatctattatcatatctatactttcatcataatagtgttttttaactttatatttcggtgtacaatctggttttatattaccccatataaatcttttcttattaattaaataaatacttttactattggcatattttaaaatattctcacccataagcctgtgagtattaatcatcaagattagaccacttcctccaatattaataatattcaaatccctttatttaataaataaagttcatatcttggtctttaaggattaaaacaccttacttttatatgataatactctaccaaactatttacaatattattatatattttttaatactaagatatgtttcttaataattacgtaatattttatttggatatatatagttatatcttcataaaaagccatgttaaattaagatagctaactaaatttaacatggctcacaactattatataatttattttttaatagaaaacttattctttattaactaaaatatttaaattagtaaaaactgataaaatttttattaattatttacaccttcattttcttgttttgctgccattattacaaatggaatatatattaatattgttacagctaaacatataagagctgtaattccacctcttattgaattagttgataatattgctcctaatactggtggtgtagtccatcctgccattacaactactttaggtgcaaatccaatgtatgttagtgtataagcaattattgttgataccattggtgctaatataaatggaataaagtaaattggatttaatattaatggcattccaaatattacaggctcattaatattgaataatcctggtgcagttcctaaattagcaataaccttttgttgagcgcttttccttttaccaataataaatattgctataagtaatccaattgtagctcctgatcctccaagatttacatacgaatcaataaactgactgtttaatatattttgaggtgcttgaccgttagcaaaagcttctgtgtttgctaaagttaatggtaataataatgcgtttattattggtgccattatatttgaaccatgcaatccgaaaaaccataataaatgtatcataaatactataactaatactccacctaagcttccagctaatccttgaagtggtgcttgtattgcattaaacaacgcttgatgtacatctggtaaacctaatactattaataattccttggcacctgctgccactgctaaaactactattgatggtattaatgctgcaaacgattttgctactgctggtggaacaccatcaggcatctttattattaatttaggattacctatcaatttaacaaatatttctgttgcaattatagctacaataagtgcaataaataatccttgtgctcctaaaaatgtaaatggtaatgttccatcttcagctgttttatatagcatcatagctgctgctgatgccactattcctgctgcaagaccatctttattataagacctagataaatgatatgaaacactaaatacaaccaatattgacattattccaaaagatgcagtccatatatctccaccaaaatttttccaccctgctggtaataaccagttcataaaattttgatatggttcaaaccctaaattattgaataatgttgcaaatgcacctgccattatcactggtgtcaatgttgcaaatccatcacggattgctactaaatgtctttgagatcctatttttgatgctatcggaacaaaataattttccatccattcaaaaaactttttcatatttttctcccctttatttcaaattaatatatatactatttttctataaatccaaaactactccaaggttcaataaaatctagtaaaaatttctcatcgtcaacaattcttcctatgacattagttttaccttcatttttcatttcttttaatgctatttgtaattctccagcatatcttgtatataaatctgaatctatcaatatatcacctttctgtatgttaggtgtatttactggaggaaaactctcattcttatattttactctgctttgtgtagaccttatcatatattccgaaacatcacccctattataatgatattcttctaatacaatcttcttatctaagtctcttgcaaattcattaaattcaaccgtaaatgttaatttttctttatttaattcacttaatgatttaagttcttcttctgttgcaaagcaattagctactataatatcgtctacatagcttgtagcaattaaatgtttagcttgaacatcaattggtaagtttctgtgcatttccaatgtacataagccctctgatactggccaaggtccatattgagcagcttgagagtttacaaaagcagcaacatttactcctaattctttaaattgttttgaacactttataaaatgctcatatgataatcctgtatatttatgtggataaaaattatgacaaccatatatattattcaaattagccttataagataaaatattatcaatatattttgtaccattacttatatttaactcaacttttaatccataatcgttaaaagacattatagcttcttcttgtccgctaaatcctaaatctaatctgattccatctagaccaatttttttaaatatgctcaaatcatatattgtagcacctaacttcttaaatatagttggatctatatctgcaataacttccatgtcttcttgttttgctgcattaagcattattttaaattcatctattacactgtctatatccttatctcctgcagatattaaacatgtaaatattcttttaaatccatattttcctgctaaatgtatatagttaactatttcatctattcccatgtgatttggatatacagaaattcctaatcttttcatcttaattcacctcatttattttaagttcattaatatactcataatatgctccttttgttggcgaaacttcttcatatataaattcatccactttaatgttgtcctttaaatatccttcaaatgcatttttaagcaaatctatgtttctaataaccccaccaacaagtcctattgaacaattactaaattttaattttttatataatctttcaactgttctagctaattctgttccttgttctaataaaatttcctctgctattatatctccatcttttgcaaccctagcaattataggtgttaatgaggctatttcatcttttgttcctgaataaacaaactcagtaattttattaactgaattaattttcaattcttttaagatagcttttgttaaatctgattgtggcaaatcttcttcctcttcttttatcattctttttatagcagaaataactatctgatatccactaccttcatctcctaagagatttccccatccaccacatcttgaagaaatccctttgttcattccaaatacaattgatccagttcctgctattgttaaaattccatcactgcctttcagcatagccttcaatgcaatttctgcatcattcataacttttatataagtattgatcttcaatttcaatctttcttctataagccttgcattatctccaacttcacatccagctgctcctacatatatgccatgtaaattttctcttccacatgtagacattatttctattacagcactttctatattagataatgcaacttctttatcatttaataaatttccaaacccctttacagatcttgcaataatttttccattaccgtcatatgctattgcttcagtctttgtaccacctgcatcgactcctataacatatttcatagttcccctgctttctttatttaaacttactattatttaattttttcatgtatgtctattatttctatagctaaatcctttacagtcatacttgtcattaaatgatcttgtgcatgaactaataacaatgaaacttctgttttcttccctgctgcttcattttgaatcaatgaagtttgaaccttatgagattctgcaagttccttatctgccttttcaattaaatttctagcttcttctatatttcctcgttttgcttcttgaatagcttccattgaatagcttcttacttctccgctgtgtaatattagattcattattatttcttccatctttattctccttaatatactccgtatgttgttataattttttcaaaattaattatttaataagatctaatgcttgttttaatactaattctccattcattgttccataattaactgaatttattacatctacttctattccatttggttctacaagctttttaatttttgataataaaaatcttacttgtggtcctaataatattacatttgttccatccatattttcttttaattctgattcccctgtggcactaattaaacattcgatgtttttatctttagctgcttgttgcatttttgatactaataaacttgttgacattcctgctgaacatactaataatatttttttcatattatcattcctcctgtacttttattacacttatatataaagcaataattatgccaagtctaaaacttattttttaattttatgtaattggctatatcacttgttttacgtcctacaaactactgtgtaatgaaaaaaatatagtgtgtattttctatttacacactatattttttacacacttacttgttataatttacacgcttatcttattttctataaccatcctaacaatgtgtgctaattcatgatcattaataataattttgtattcgttttctattttactcaaactctttttcactaaaataaattctcttccatgttcatatctatatttatctaagtttttaaatttaatttcttcattttcttcaattaatctctctattaaaaatgccatatgaatcaaaatacctattttagcctgttgatctatattaatctctaagctttcttcaatatttgaaatagtatctcttatattaatagccatcttcctgcaatttaaacctttaatctgtgattctaatgattctgttacttttaaaaactcatcttcaatatttattaaattttctaaacgtacaattcccttatcaataaaaatttcttgtgctgatatgaatggaactccatcaataaacatatttactgttccaacaatagctaaaattgtatatcgttcttttagttttttaacttttttgaaaaaatcttctttatctaaaatatctaaaggtattatctctaatttatttatgtgttttaatgaattttctattctattttttattttttcagctgcaccttcccctgtaaagcaagttgttattatagctaattctttttcttttaaataatcttccttttccatttgtattgaaaatcttccaagctcctggcaagaagtatatattgactctaaacttctaccatttaaagcctttcgcccagcttctataacagtaagagtcgttaccatattaatagttttaatttttattccaagctcattttcaattatttttccaaagttacttaaagaccccatatctacaagcattaaaataccatttcgattttccatatttaaaattttcttctttgcaagttcaagcatatcttcagctttcatcgttaatggcatatctaatgcttttacatattcttctccaattaaggtatttgccacttcaaccatgctagatgcagtattttttccatgcattataactaaaacgccaacttttatttctaataactcattaaattcatcttttccagctgctaaaaacatagttatataacctatctcatctaagcttgcctgaacattaaagttagtttctattatcttaataatctccattgctgttataaattcatctctatactgcattctaatactattaagttttggatggtgtatcttgatccctcgactcattctttcaatactaccttgtaaatgtaatgataatccaaaatatacttttctatcaaactgtctatctaatttttcagatgcaattttcagcatttgctctactgaatctattaactttatatcaacaatttttgatatttcattttttccaacttcatcactcagactatttatatactttttaaaataattttctaaatctacgtttaaaatattatttatttcatctggatctatattctgttctttcagctcattcatcttatcttctatcatagaataaaaacttactttagctatttcttttgaattattctggcgtatctttaatgctgaattactttcaacatcatatgaaaactgcacaatatcactaatactagatgatattttctcaacttcatttctataggctttaaaattcatcattcctttttgcaccctaggctgcaactcgtcttggtctattaatataaagtcatttttatttactttataatttagaaatgccttagcacaagctagctgaacatcacttctaagctctccgatattattattacagtcatatatcaaaaacgagattattgaatttttactgatatatatttttttttgcaatctcacagattcctctcgaataaatgattccagtaacaaataccgttcttccaaagttctttgtctaagaggcggtaaagttattgtcattggaattcttctcgtaaaagttttaagcatgaaagattgtatatcttctgttgtagctgatattatctgaaccgatgctttaatttgagtatcagtatctcctagttttctaaatgtgccattatcaataaatgtaaatagcatctcctgtccttggggcgatagcctatggacttcatctaaaaacaagattcctccatctgcttttttcaaaagtccatccttatctttatcagctccagtaaaagctccttttttaactccaaatatctgagcaacaactagctgtggattatctgcataatcagaacaattaaatcttacaaaaggtgcatcttcatttattgatttagattctttcgcgaaattatacatcatttctgcaaacaatgattttcctacacctgtttccccaagtattaatgtatgaagtcccctgggaggatataaaattgcagctttagcttgctgtataggcatttttaaagacatttctgctcctactagtttttccaagctatctttgcttttttctaatttaaatgtagagttatcagaatcaatatcttttgctataatttgattttcttcattttttcttatgatagtggtatataatacaggtctcccatttaatttaattatttttcctgctttactcaaattatttagatgacggcttacattagccctatccattttcatatatgaacctaattctaaggcactaacacctctattatattttcgttcaagatttatcaaaacttctataatctgctcttcttttttcatatttttacactacatcctcataaatttatttcaaaaatagctatataaaaattaattctaaatattattaaacttctctacctaaaacaaaaaccttttttatattaatatcatcatcaaataatattaaatctgcatcataaccttcttttattataccttttctattttgtacattgcaatgtactgcgggattatatgatgccattttaataacttcaaataaaggtacatttaaattcttatatatatttttaacagctttatctaatgtaagtatagatccagctagaactccattttttaatcttgctgaacttccttttactacaacatcctgtcctccaagagtatacattccttctttcatacagcacgctctcattgcatctgttactaataataatttatctgatcccttttccttatatgcaacttttagcgctggataagatacatgtattccatcactaattaattcagctgtaatatctgtattaaatactgcaccaacaacaccaggttctctatggttaaatggagtcattgcattataaaaatgtgttgcatgagatactccccattttatatgatcaatagtctgttcatatgttgcttttgtgtgtccagtagaacatacaactcctgtttctgatacatattttaccaaactttctgctccatcaacttctggcgaaattgttattgaaactattgcatcttcatatccatctgttatttctttatatttgtcaacacctggttctaaaatatattttccattttgtgctcccatagcatccttattgataaatggaccttctaaatgtgctcctaaaacatttgcacctctagttccagtatttttacacaattgtattacctttaatgcttttctagtatcagaaactgatgcagtcattgtagttggtgtaaatgatgttgttccatgctttactatagtttctgcaatagtatttatagattcaactgtcccatccatagtatcgcaatttcctgcaccatgtatatgaacatcaataaatcccggagaaacatataacccaccagcgtctattacatccatatcttcacattctttagggttaatttcttttatctttccttcttctattaataaacttccttcttctattctatcccaatatataattttacaatttttaataatcatattttcaccttccctaattaatatcttttcacaactggtaattaccacttatataattcattatatattaattataaatatcttttcaagtatttataaatttaatttggagatacttgaataatgtatactatttatttagttataattatcacagagtgtgctttattactaatattagattaatatacgacagctaactattaatattaaaatttctaattatgtttttgctgaatataaaatctctttggtaattaccactttatcttctaaactcagataaattgtaactatgaacttaaatgttaacgtaaagaaatatagaattattctagtaaatttacatatgctgctcattagaacgtatctaaatttactatttaaattgattttttttgcaatctaatactataattaattagattagtttgaaagaggtgtcttttgtgaacacaatcgataaagaatcgaaaattccattgtatattcaattaatgaatataattatttataaaatagaacatttcatgcatgaagatgatcagttagattcagaaagagagatatgccaaaaatatgatgtaagcagaactaccgtaagacaggcattagatgaattagaaaaaaagaaatatatttataaagttcaaggaaaaggaaactttatagcacctaaaatagtggcacaagatttaataaaagtttcttcttttacagacgaaatgaagaaacttgggaaaaaaccagcttctaaattattagcatttgaaataattgaacctgatcacaaaataatgaataaattaaatctaaaaaaagactctctagtttttaaaattattagactcagacttgctgatgatattccacatatatatgaaatatcctaccttccctatgatagatttgaaggattaactaaagagcttttgggtgaaaatcctatgtatgaagtattaaaaaataattttaaaataaaaatatcttctgctgaggaaattttagaaagtatattgataaataaacttgaaggtatttatttgtctatacctcaaggaaatccagctctaaaaatcgagagaattacttatgataatgataccgtaattgagtataccataagcatagctagagctgataaatttaagtatagagtacatctgaagagctaaacatgcaataatctatgcgaaattagtttttaatttcacatagattattatttttactcttataaaaacttattaaactcattttcttgactcagtttattcaatagatgtttaatttcttgatctttatttttatccataacaagtattacatccccagcgtcaacaactaccaggtcttttatcccaaatccgataattaaatttttatttccgaatattgagcaattttcacattcatcaatatacacattctttgatatactgttgtttttatctttttgaaggagcctgcttaatgccccaaaactgcccatatcatcccattgaaaatcaccctttatgacaaatgcttttcttgttttctgcattactccaaagtcaattgatatcccatcaataagttcgtattgctctttgataacctcttcttcgttttcttctcctaaattcttatatatctccattaatggcttatacaatttaggcagatacttttctatttctcgtagtataacatctgctctaaatataaacatgccagaattccataaataagttcccttcaatataaagtcttttgccacttctaaattaggtttttctgtaaaacgagctattttataagttggtatattaccagtggttctttcgcccatttcaatataaccatatccagtttcaggtctgcttggttcaattcctaatgtcacaacacatcttcttctattagcaagctcaatagcttgagacaaggtgtctgtataaactttctcaccttgaatataatggtctgaaggaagaactaccataacagcatcagcatcctgctttaaaagcttcaccgcagataaacctatacacgtagcagtctccttattagcaggctctacaaaaatattattttcattaatatcagaaagttcatttttaaccttatccttatactccatatttgttaccacatagatattttctttgtttattataggggttatcctatcaactgtattgactaaaaaacttttatcatttatgagctttagaaattgttttggcgctcctgctcttgataaaggatacagcctacttccctttcctccagctaaaatcagcccgtatatcacgcactttcaactccatgtaatgatattagttcattatatgttgaaaatttgctatttgtgaattataaatgtgaatccaaaatcactaatacagaaaaacagaccatattaaattgattaaataacttcaacttaatatggtctattattttaaattttagcttataactctatactagtattgtgttatgctgctaattctctatattcacattcttttttctctatatttcttattcttttttcctctgcataagctacaattaataaaagagttattccaataataagtgctccataaaacactacaaacacatcattccaaccatgaagagttacatttccaatagttatacctgatgatttaggatctgctatttttgataatgcaaccttggctgtagaatctccaaataaatatccaaaagtaccactcaatccattggcaactgcaattgattttttaggagcaaatccaataagtgataccccaatcaataattgaggtccaaatattaatgcaccaagagcaaataatgaaatatttaccattgtaacacttgtagcatatctatatccccaaacagcaaatcctgttaaaatcaaacaaaatacagcaactattgctcttcttccttttagtaaatcagatacatatccccaagttaaacttcctaaaagagctcctatttcaaaataaaatattgtatttactgcatcattcattgcaaaatgcagttgttctgtaacatataatggagcccaattatctattccaatacgtactatataaacaaaaacgtttgctatacataaaacccatatccaaggattagttaaaacatattttttaaatatttcaaacttactcatttcttctatttcagcatcactttgaaccctaggttcatcaaatatttcttctgctgaattccatcctaattcttgtggctcatcttttccaacaaaaagtaaaacaaaacctacacaaattcctactatagctggaactataaacatccccgctacattaccatgaaaaaatgtatttgctccaaataatgctatcattccagctaatgccccaccaatattatgtgacatattccaaaatcctaaaaatcttcctcttttattagtaggtgtccatcttgaaatagttgaataagaacttggaccacctggcgcttgaaaaaatccacttaatccccaaaatactaatattgttccaacagctttattacctgacaataaaataatacctattataaataccattgttgcagacattattagtaatgttgatattatacgctttgcatttttaccatcaacaaaatatcctaaaatagttttccccatagcataagttatagagaatccaaaacctatatacccaagttccgatgttgtaaatccaagttgatttttcaacaatggttgtgctgctttaagattgtttctaacaaagtacatacatgcatacactgaaaatacaactaaaaatgcctttaaaaattcttttaaccatctttgtctttgttcttcaataggaacagatacttctcttttatttatatcaaaaaattttattatattattcatatttcttcctccattgtaagtatataatgaaataactttttaattgaagtaggagtattgcctattataaaaacatattaatttaaattgttccacatattaatcaaccattctctatcattgctagcctttacaaaattgtaatcattatatatatctaattgattaagctttattccacctatatctcttgtatcttgacgtgttaacattgcaaaggatatattatttaatgtttcctctacttctttagttgtacaaaagtctatgaaatactttccgatatcgccattaggtccatttttaatcttggaaattgcatctatattccatccactatctttgggtacattagttacaatattaaaacctgaatccttaatcaaaagctgatcgcttaaaaaattaatacctattagatattctccggttgcaactttttgcgctggcgtatatccattagttgtaaattcaccaacattatctttcattttctttaaaaattcttttgctttatcttctcccatactttgaataattgatgctaacattgtataagctgttcctgaagtattgggatctgctattacgatttctcccttatatattggatttagtagatcctcatatgttttaggcattgctattcctttattagcgaattccttttcccacctatcgctattaattgcaattgatagaggactaacttcaaaaccaatccaatatccctctctgtctttatatttttctgggatactatcataattttcagatatatatttttctgaaagattttcttttttcatcaaaacatgaacatcacatgttccacctaaaaatatatctgccttaggatctttcctctcagattctattcttgataaagattcctgagttgacatttttaaatattcataagtgcatcctgttttttctttaaaaagttctaaaattgcacttcctacctcatctctagacgcaacatatacaacaatatgttttccttttaaatttggatatccatcattaaacgttatattctcttttttgtcattgcaagctaacatatttaaacacataattattaaaaatacgcaataaacagttttcgttatcttcattaattcaatcctcctaagttaatacctatttataattcatttataaatattttcttacacacatcatttagttttcctctaaaatatatatgtcgtccattttcatcacccatatattgaacaacgaaaaaatcattctcatatacatcaatatttactaaattagagcatttaacttttgaaagattgtctttatcattatccagataaatcttaatatgatataacgcttctgttttgcttttcaataaatttattatctctttattgttctcaagctttaatgaatcatttatcgtattttctatattttctttatgagatttgtctagctctttaatatttttattcctatcaattatgattatctcattattggaatttatgatttttactatgttagatgttgaatataaatatccaagcaatttattttttaaactatttattaatggtattttatatttatcattataagtattattatttaaagataatttattgcttatttcaaaattatcttttgttccatttaaataataaatagttccattaattttaatatcactaacttccgaatcataattatcatcaacagaagagtcctttgtaatttcatttattgaattccatatttgttgtattgaagtctcatcttcaaaaaaatattccccccacctttcattagaaatttcaacttttataggtatagacatatttattttctttaccacttcatccttatcgttgattattattaccttattgtataaaaagctataattaagatttattataataatacaaataagaagcataacaatatatatgcctgaaatcttaactcttaaattgatttttttcacttcctactcctcctatataataaaaccttaatttatcaaaaatatttcgcaaatgtttcataattgtaacattttaacgttttcatgaatttttatataacttactaaaaataattttaactaaagtccatttattttcttcactgtatatctctatgtctccatcttgttttctcattatttctttacatatacaaagacctaatccatttccatttttacttctagaattggccttattaactctataaattggttcaaaaagtttatttaaatgacttttttctatacctataccatcatccataattgttaattctatatcattattagtctctttaatttttaatataatacttgtacattcgctatactttatagcattatctaaaacatttagaattacctgtttagttttatccttgtctatatataaatttacattgcataatttttttattatatctatatcatacttttgaagtcttggttgtataatatttaaagcttcttctattattgtagctaaatcattcttacttctattaacattaaattcagatttcccaagttttgataaatcaagaagttcttcaactaactttaataatctttccccttctttttttatataaactgaactttcctctatatcattcttattttctaatctaggtattaattctgaatatcctattatggcggttaatggggttttaaattcatgagtaacattatccaagaaatctttctgtttttgtttctcattttttaaactttcaatgtaaatctttatactctctgttgttatgttaaaagcttttgctaaatcttctatctcatctccactttcaatttctatattattattataatctcctttactaatcctttcagatgcaatctttaattcctttattggattagatattttttccgaaaataatctacttaacagccatgatataaatattgctacacaagctactattcccataattataaacatattatttataatttcttgttccctatgcaatggatatatatatcttacaccaccaatagttacattatcatcatatataggacttgaaaataatatatacatattacgatcaatttttttaacaacataagctttatttccatttatagaattctttatatcttcatcataaagactaagattgttcatatcagaatcagatattatgtttcctgttttatcataagtttgaatcctaaagttaagcttatttgataaatatgtattgataagtggtcctttattaataaaatttgcttccttagttaagttctgatccttttcaagataaccttctatatatagctgcgtattataactttctttgattaaaaaatcaacactactatttattacattactatatatgttattcattattattatatatataaaagttattaccggtattaatatccccatattcataagcataatcttatcttttatctttaaatttacttttttcacaaaagcacatccttattcttttatccgattatttacaattcaaatctatagcctactccataaattgtttttaaacattccgaataaacccctaatttttttctaagtctttgtatcaaaatatcaacagctctagtattaccttcaaattcatatccccatactcttttcaaaagtttttctcttgtaaaaaccttattacaattttccatcattaatactaatgtatcaaactctttataagtggcaataatttcttctccatcaataaaaacttttcgttcatcttttaaaactcttatcccctttattttaaattcattattattttcctttttcccattgtatttcttattaattctttttgttattgcttttattcttaacataagctctatactgttaaaaggctttgttatataatcatctgcacctagttgaagacctaataacttatcatttatttgactatttgcagtaagcattattacgggaatttcactatctattttctgaaattttcgaataacttcatgaccacttatatctggcaacataatatcaagtattaccaattctggcctttcagtttcaaatttctcaattgcatctattccattcatgcttataacaacttggtacccttcaagttctaaattcattctaatcaaattaactatacttttttcatcatcaacaactaatattttcataataatcccaccttatctaaaccttttttaattatacaataaaaatttaaattttatataatttgctataactttatgttatctattcaaatttttcacaaaacctttattctctacaaatatttcttctggttatcaggatttcaaaaaaattatatgttgaaaattctctatttgtgaataatgctaataatgtaaaaagatttaaggaaattttccttaaatctttttttaatcatgtattcttcttattattttaaataccacagaattttctataacaagtggtgcattatgtgcaaaaaatactattccattagtagtagataccacatttgataaaactaatccttcatatggatctaatacctcagctagaatatctcctctttcaacacagtctcccggatttacttttcttctaaaaattcctgcactcttagccataataggctttaaattatcttcttcaattatacttgctatatatccactatggcagttatattttattactcccattcttgttaaaaatcttaaaacagcagtaaccgcatgtctagcagaaacttcatctatctcatcagtacaattcgtatatactgaaaaagcatttgtgttccaaagctgccaattataattaagtgttgtcgtatcaaatggctttggctttcttattaaaacatattgaagcccaaataaatttgcaagactaggactttgatatcctgtctccatcatccttacgtgtggtataaaatctcctggcatataaaaacttgcaaattgaataccatatgtatatccttgaaccttctcaaatacacctgctgcaattctctgtgttgtttcaccttgagtataacctggaaacattctatttatatctgtattatctaaagcccaaaatctttttcctatattcatggcataattatttactgaaggtattataagaatctcattatttttacttatatgacctttttcctccaactttcttagtgaatctacaagctgtgaacatatatacaactgctgaatttcattacctcttattgcacctattatacatgcagctttttcaccttttccaaatctatatcctgtaacttttaactcatctctataaggtgattttaaagaaaaaataatatctttaatcattttttacacctccgataactcttgcaattaatgaaccagtataaactacaggatactctcttaaagtaaaaatcaatccatcacaaggcgcataaattttttcttcaatttcccctgtaagagcatttaatatatctcctataagttcacctttttttatgctactccaatgagttgctttaggaataaatattcctgaactatttgcatttgcaaatccaaattctctatcagttgaaataataggctctttaattacttttgtttctccagcccaaattccaatttctttcataagtctaaaaataccatcaacaagctgattgcaatatttttctgttatcctcattcccactcccatttcaacaacaagtgtaggaacattaattgaatttaaactatatgcaagggttgcttctaaaacagttgcagaaccgtgaacccatataaaatctgtatttaataattttgcataattcataagtgtatctttattattttcgtttatccttacttgcggtatttctcttaaaaaaatattacttgcatgaatatcaatgcacatatccgcacccttaatatcagatattatctgagatgctacatgctcagccatagcaccattttcattgcctggaaatattctattcatgtccaaatcaaacattggtattcctcgttgaatcgaatctataccgagtggattcaatgctggataaatatctactattccttttaacttatcaatattgctgtttatgattctatttagttcatagcatacatattgtccttcaagctcatctccatgagttcctgtaacgatacaaattctcttttcatcgcctttaatttcttctggaattaaagtgttttttcttataatcatattttcatcaactggaagaccaaccgatactactgtcttaatcataaaattgcctccttaaataataacagttttacaaaaaacaaaaaaagaaagcgaagatgtttaaaacatcttcgctttggtaaaattttatcattttatatcttttatgtcaatataactattcacttattaattttatgtacttaaatattcttatatttttaaaagttattttataggaagcacaactacatttccatttcttccacaacacttcttatatttctttccacttccacatgtacatggatcatttcttccaacaaccttgtttgatacttcgcttataacatttgcttttgcatcattggttgaaataccttttaatttccataatcttatcttattaacaaacttattcatcatttttgatgctacaaatctaacttcttcattgtctatattaataagttcaatcattttatcaacagcctctgaaggttctaattcttgaacatcaagagccaaatcgtccatcatagcaattgtcatatccttatctacactaaacatagatgtaaattctttatagaatgactttcctgctttactattgtaaacccagttttctccgttcatactcaataattcttcttttgatataactgcatattcctttatatcttctttttttatatcatttaaaacttcttcataattatctatttcattatttatgaagtaactattttcttctctaaattcgttataataatatgatgcttctctaagtaattccagtaagcttacatcagtattttcattaaatctttcaagcatcttcacggcatcttcaacttttaatataccatatgctttgttcatacctctgtatatattaatcaactctgtattaccttttaatattcgtctataatctatatcattcttatctttaataatcttttgaacaaccttaggcatcaagaacattgactcgtcattcttaactgtagggtatattataccttgttgtataaaatatgcactcttatcagcttcttcttcatctatatcatcaaaattctttacacccttattatcaatatagctctttaatattttatatctttcttcttcaaataaccctattctcttttctattagaggtttatactcttctataagcttttcagctaatttatctttatttaaaccagaaatttttgcaactcctaagtttctagctatattatatatctcatcttttgataaacattcaataagttcttttaaatcaaaagaatatacccttttgctaagcttcttctccatttttgctgcaagtttatctaactcatcctcaatatttttgcaatcttcacatatccatttttcaacttctgtattataaaaaattgcttcttcaccgcatttataacattcgtgcttttctttcttatttatatccatttctataatattattatcagttaattttatatctttttctttcaagtaaatgtctcctttttaatctattttttaatctattttttaatctataatcatcaaataaaaaaacattttgctaaaatgtaaccattaaccatttaatcataccctgttcttaattgcaacaaaaagctctggaccatttggcttccagagcttatttttaacatattctttattttataatattaatataaaattgtaaatataaattttatgcttattcacagacctttccaggatttaaaatgtttttagggtcaaatgcagattttatacccttcattatttctatacaatcatctggtaatgatgattgtaaataagatttctttgcaaaccctattccatgttcaccagaaacttgtcctcttaaagattgtgctttatcatacatcatcttcattatagaatgtattttttcatcccactcattgtcatttaactcatctcttaatatataaatatgaagatttccatcacctgcatgaccaaaactctttatccttacgccacttgtagcttcaagattatgtgtaaatgtaacaaactgatctatcttatttcttggaacaacaacatcaacttcgtccatttctgttgttaatgctttaatagcttcaagaaaacatcctcttgcagaccatattgcttcttgtctttcttctgtatcagatataaatacatctatagcaccagattctaagcagatatctgcaactttttcataatccttttctatttcttcagtagaattaccatcaaaagtcaataacaaatacgcatctgatgacttatcaggaaaactctttcctaaaaattcctctgcagctaaaatagcatctctttgcataaattcaatagctgttggtatagattttgatttaattattttaggaactgtttttattgcattttcaagggtattaaaaggtattaaaaggcttaaagatttttttggtaaaggaagtagtcttagtattgcctttgtaactattcctaaagttccttcagatccaatcattaaatcctttaatgcatatccagagctgtttttaacaacctttccacctaaatttactatattaccattaggaagaactacttcaagtccacgcacataatctcttgtaacaccatattttacggccctcataccacctgcattggtacttatatttccacctattgttgctgacttttcacctggatctggtggataaaataaatctgcttcttcaacatattttccaatttccattaataaaacgcctggttctaatgttaatgtaagattctcttcatctaactctaatattttattcattttacttaaatctataactattccgccctctaatggaactgctgccccaacaagtcctgtaccagatcctcttggagttactggtatattattatcgtaagcatatttcattatttttgatacttcatcagtacataatacttgaactactatatctggcatcttctttattccaccaagttcatcgtgactataatcttcatttacttcatctctaaaaaacactctttctttatcattgcctattaattctaatatgctttcataatcttctatttcaatgtttttgtatttattgcccatatctctatctctcctttaccattttgattttctctgttaattgtggaacgatatcatatatatcccctacaattccatagtgagaaattttaaatataggtgcttttgaatcagtattaatagaaataatacagtcagagttgttcattccagctgaaaattgaacagctccagatattccacaagttattattaatttaggccttacagttcttccacttaatccaatctgtctttttgcatcaacccatccagcctcaataagtggtcttgtacatgcaaattcagcatctaatgcttctgctaactccttaactattttcaaatccttttccgattttacgcctcttccagctgcaacaataacctctgcatcacttattccacgttctataattttttcttttatttcaataacgcttattcctgattttaatttttccttatcaacattacatgttactatttctccttttgcagtctctgatctttctggtgcctccataactttatatctaactgttgctagctgtggtcttgaatttggagttactatttgagccattatattgcctccaaatgctggtcttatctgaactaaatctgtattttctttcatttctaaaacagtacaatcagcagtcaaaccagttttaaatctagctgcaaccctaggtgctaaagatcttcctattgttgttgcaccaactagtatggctgttggcttattattgtttataaaatcttcaaatgcagatgtatacgattcaattctaaagtcttttagttcttcatcatcatatacaaatactttatcaactccataatgtaataattcttctgcttcacttaatatattatttccaataaatactgcataaacctgctgatttattttttctgccaattcaattgcttttcctattaactcataagtaacaggatgtatttttccctttacatgatcaacataaacagcaatccccttccattcatctttatctatttcctttatctgatcttcaatatattctatagcaccctttggtccttttttcacacaaagcttacacattttacatgctgcattcatctgaattttaccatcaatatattcaattgctccaaatgggcatatttttatcatttcttcaatatctttaattttctcttgattaactattaacttacccataaactttttctcctcccaaatataatctaatgaattctagaatctttattaaataaattttacttcttttaatttgtttaatatcttatctgtcaattcttccgatttacctgtccacatttctctgtctgtattaactgtaggtgggaatattctttcaacttgagtagctgaaccgtttaatccataattattttcttctttatcattaaaatcatttaaacttaaaattttaatttctctgtcctttgtagttaatttctttttatatgatggcaatcttggttcaaaaatccctttatctacggttattaaacaaggatattgtatttttattttctctgtagtttcaggcatgtccatatctactgttatagattcttcatcaatactatatattttttcaatattagccgcatgtggtattccaagatattctgctatttctgcaccaacttgtgcagtatctccatctgttgtctgctttccacatattattaagtcaaaatcacccatttttcttacaccttgagacaatgtataagatgtagccaatacatctgctccaccaaattttctatcagataaaagcacaccgtcatctacccccattgagtatgcttccttaattacacttaaagcttgtggtggtcccatgcttaaaacttttatagtcccacctttttcttcccttattcttaatgctgtttctaatgcatacaaatcgtatggattcatctttgaatctataccatctctttttagaactcctgtaactggatccacttcgaccttagaagttcctggcacttgtttaatacatactaaaatattcatacacaattcctcccatacactttaatatctaaaatataggattacagaaacgcaaactatttctgttatcacaatataaaatacgcacaatttttatactgaatataaaatatcctcaacataattggtattaccacttacaagtataattataattccataattatacattgtaaataattgttatttttttaacagtaaatgtttacaagttcatttatatataataattgtaaatatagctatttcctaagtttcctatagttaaacaaagaaataaaattatattatgtaaatcaaaaaatttcctatttattattttcttaattaaatttgctttataattaacaaactatactaactgtatcttttctttttttaaataaataaaataagctgaaatcaatttgatttcagcttatttttatttatagtattttctaattaatttgaaatgttcttctattgcatcaacagccttaacagtatcatgttctttcatagcattaactaatttctcatgtatagataatagcttagctctattattttcttcataaagaattttctttctgaattcctttattgattcatccataatttgagatattactgaaattatattaattagtaatatattttttgatgccttaattagaagataatgaagttttatatctaatgctaaattttcttcttcattttttgcttgatacatttcctccattatttcacttattgtttcaatctcgctttcagatatatttcttactgcaagctttatacaataactttctaaaatttctctcaattcaactatatcgtctagagaatttttttgaagcataaacataactgaaataggttcaaaaagtgagtcatcaaaattagtttttatgtaatttccagcaccttgttttctttcaataagtccaataacttctaatgctctcattgcttcccttactgatgtacgcgaaacagaaaataattcaaccatatctctttctgatggtaatttatctcccttttttagcttaccagtttttatttgatttttaatttcttcaattacttgttcatatacttttgaatttttatcttgctctaacatatttcaatgccctcattctaacttatagtatcttttttacaaaaaactacgaattttctccttatcattaattatcaaattataaccattattatatatttctttaagtttattcttatctctttcaaatctagatacatccatttttactgtaggtcttattataatagcatcgccatttttttctaattcttcacaaaattttatctgactattatattctgaatacctattatttagtacatctgcaagcttaggatatttatttttataaagtttatatgttaatttattagcttttgactgtttttttacatatccttcatttctagttaatacaattacatttttcttattaccatctactatggatttttttattggtatagaatcttttaatcctccatcagcatataatttaccatttatctttgcaaatggaaacatcaatggtatagcacaacttgctcgtaaaatcatatttttatcatcaagtgaatccttatcaaaatattcaacttttcctgtttcaatattaaaagctcctacaagcatttttccatcataactatagaaagtatcgtaatcaaaaatacaatgtttatttggtatctcatcaaaaacaaaatctaaatccataattgatttacatcttattaaatttccatatccaacataccttttatggtccaagaacttttccataatctctaaatttcgtcctttttgctttgatatatatgaatatgcatttgttgcaccagctgatacccctacaacgtatttaaaatcagctcctatatccaataatgcatctaaaacacctgctgtaaataaccctctaaatgctccaccttctaatacaagacctgtcataaccaaacctccttattgtatatcattatattataacttattttaatattttagtcattttttactataataatcactttaatatcaatattgtccttatttgtaattttattatataattgtattaatatttaactctaggaggaagtaatgaacagtatcattgaaaaagctaaatcaactcatgatttaagcgaatttgaaattttaagtctattacaaaatgattctattaatgaactgctttttaaagctgctgatgatattcgtgaaaaatatcttggtaatatggttcatttaagaggtcttatagaattcactaacatatgtaaaagaaattgtatgtattgtggccttagaagagataatgccaatttaaagcgatatagattaacagaagaagaaataatagattttgctaaaaaagcagttcaatatgggtataaaacattagtacttcaaggtggtgaagatgattattttactactgaaaaaatggtaagtatcttaaaaaaaataaaatcattaggtgttgcacttactctaagccttggcgaaaagacttttgatcaatataaagcatttaaaaatgcaggtgctgatagatacttaatacgcatagaaaccactgataaaaaactttatgaaactatggatcctggaatgagttttaatgagagaattcaatgtttaaaagacttagacaaattaggttatgaagttggtagcggtatccttattgggcttccaggacaaactttagaatcaattgcaaaagatatactattttttaaagaaatcaatgctgatatgattggtattggtccatttatacccaatgaagatactccattaaaaaatgctgaaggcggtactcttacattagcattaaaagttatggcaataacgagacttcttctacctgatataaacattcctgctacaactgctatggaatctttagctccaaatggaagaatacaagcacttcaagctggtgctaatgtagttatgcctaatgttacagaaggtgaatacagaaaattgtatgcattatatcccggtaaaatttgtactggtgatacccctgcacattgccgtggatgtattacaggaaaaattacaagtataggacgaactatttctgatggttatggttttagaggaaataaaaatactaattctcataactctcaaaaaatttaaaatgtctttaagtatttattaacttaataaagattctattattaaaatttagtatgaaacataacaagatctttcatactaaattttttatttatatttttgaattagcatatttataatcagatccaaatttctctaaaggtatattaaattcaggtattccagcaacataaggtgctatttcatattgctgataataaataattaaatttttccctcttatataaaaattttgactatctcctatacccttaaagttgtctgccgattcaaaatatttatcaggttcagcagcaatctgcttttttatttcatcattgattattgatttataatcataatcagatgtaaatagttcctttagattaagtaacttttcagcttctttatcaactgtatatgacgtccttatagttgacccatgagcccctccaagaaactcataataatcattatataaacttattatagaattattgtttattgtaactgtatatctagaataaatttcaaatggaaattgtggtttttctacatgcaaatctccataatactcagatgccgtttgttcagcttcattaactttaggaaatatatcattatttatttttatattaattatttttatattatctggattttttccattgttgaattgaggaattcttaaatcttcttttaaatactttacatctttatttattgacttttccacaagagtaataacattattaaaatataattcacatgttgtgtacaaattttgtttataacctgtgcataacatactacctataataaacattcccataaacgttgttgataacttcattacaccactcccaatatattttctttttccgatatattagtatatatatccacatttttcacatgtaataatttgtttataaacaaatttataacagtttatccacatgctattgtggataatgtgaataagttgtactacttatttattatgctatacttttctattattattctaatttatagtatatctctcattatttttctttatgtattatcaaaaataacaagttaatctactttatttttctctaaaatatattattttattgataaaattttaatacttatctatacttacatatgtaatatatatatcaaaatataggaggtttaaaattttatgaccacgaaaaataagaaccttaaatatataataataattctgttatcaattacttttttaatacttgcttatatctttatcaatggtgttactagtaaaaataataacagctctgtcaattcagataataaatctgaaaatagtgtatattcaaatttaattgaatccattgatgataatataaaaaatagatttgaaaatgtttctttaacatctaacaatatcggtattcctgttttgtattatcattcagtcgatgaaaatgcagccaatgaagttactataactcctgaaaagctaaaagaacaacttgattatataaatgataataattatgtcaccattacaatgacagaactttacgatcatattgaaaataataaaccaattccagaaaaaagtatccttataacttttgatgatggatatatgaataactatacagaagcatttccaatgttaaaagaattaaatatgacagctacaatattctgtgttggtaattcattagatggatcttattatctttctgaagaagcaataaaagaaatgtctgattacggtatcgatatagagagccatactgtaaatcatgtacatcttgatacaatgagctatgatgaacaattactagaattgaaaaattctaagaatattcttgaaaaaataactggtaaagaagtactctccttagcatatccttttggagattacaatgataatacaataaaagcagctaaagatgcaggatataaaatgggctttactacaaaattaggtctttctgatagaactgatgacatatataaacttgatagaatatatataagttcttcttatgatatgaatacgttcaaaaacctattaaaaaatacagctaaataacataagtatttatagattaataattaaaattattgacctatagactatagtcttaaaataaaaaacacattatatgacatatattatttttgtcatataatgtgtttgttttattcttctgagatatattcaggcattttttgctcatttccagaattatttataactataggtattttattttcagatataaatttatttgttttaggtaaagcaccataatctaaactctttcctgaaactgttattaaagtttttttacttgtatcaatcatttcatttgaaaaagcatattcaaatatttcttctattgcctcatctatattttcgctctcaatacttatacttgatattaaaatctttcctttttctgttggtgaataagcgtatattacttttccatacttatttacatgcattttaatatttgaagttgtttctactataactatactttcagtctttctataatcaattacagttgcacaaccaatcatcattaatatcatcaaacctattgcaatatgtattttatattttcctagtcttgtacactcttttccatctgctagttgtccaattattacttttctatttgtttttatctttacaaattcaccaattgaagttattatatatgcacttttcttaaaagactttataacaactcctttatatattgtattttttttagctactcctatgctttttactttatcactatcttctttaagttttatttttaaagtatcttgtattattttatagtttggatttctaagaatcaaatagtatgcaactatgtagtccttcatatcttcaattcgttctctatttattcgtatatctttgcataaatcttttataggaagttctttttttcgctctaacttttcacttatttcttcattttccataatgtaataagatacatttaaagatatatttctcttttcttcatttaatggataattaaccagatctttaagtataatattatatgaggacagttcttctaaaaataaagaaacctgtttacttctactatcatctacagaattgcttactaatgaaatattaggcattgaagtaaatatatatttatttttattaaaacttaagctatccatatagttaacccctctttaaacattaatatcaattttataaatttctcatactatatattatagcatagaaatttatgcatctataaaattttatatacttaaaatataaatataaaatcaatatttaggagattggtgtatgaaaaagaaaattatatacgtagattttactaaaaaacgtcgaatcaacttctttcactttacttttaataaaatgattaactattttactaatagaacaactatttctaatagtgaaatacctacaattaatacaaataacaaagctttagttaataaaatttattaattagacttaattcatatatacaggtatgtaaatgtttacctactctttgcaacttattttattcaatatattatgctaaaatatattttagaaataatatattgaggtgataaacatgagaattggaatgggatatgatgttcataaattagttgaagatagaaaactaataattggaggagttgaaatcccttttgaaaaaggtcttttaggtcattctgatgccgatgtccttcttcatgctataatggattcactgcttggtgcatgcgctttaggcgatattggaagacattttccagatacagatataaaatacaaaggaatatcaagcataaatttacttgaagaaacaggacgaattatttttgaaaatggatattctattaacaatatcgatgctacaataattgcacaaaagccaaaaatgagtccacatattgagactatgagaaaaaacatagctaaagcacttaatattgatattaaccaaattaatattaaagctacaacagaagaaggtcttggatttactggagaaatgcttgggatttctgctcaaagcatagcttctgttaactaataaaataataaaacagtaaagtaaaaaaacacctctttgacattagtcaaggagatgttttttattataatacttcacttaatcgctttaataaaatctgtctaaatttttctgcacattttttatcttttaatgtattttcacataggtttaaccactcatctattttcatacctattttactttctaattcaccttctgaattagttatagttgctgatgatactacaaaatcaccaacttcttttggagatttaaataattttatatataagaactctctattatctccaatccattttttattgaactctcttaaaaatttctttagttctctttctgcatctctagatggcatatcccataacttgctaagaaattgataatcctttttcattttatcagctatctcttttgttattttttttgctctttcaccatcttctattactttttcaacagaaatgctaggtattctagttattaatttatcttttccatgtatccatttgtaaaaagattcttgaagaaatgagtattgtaaatatcctattaagcttttcacattaggaaaatatccccatatattattcatcccatttcccttactaaatattaatgtatggaaatataaacttttttctgtaggtggtttctgcataaacatatgtcctctaatggttttattctctcggataacgttttcccagtaatcaaaagaattatagttttctctcattttttcttcaccttccctacataattttaatataatgtactataaaatttccttacttttattataaggtatattgtactttatttacaagtttagtttaccttataatttcactttattgtttatcattttaatatattgcccactttctttctattttattactattttgttaatttataatgtaagtctaaaaattgctattttattactattaaattataataataacatcaacaaattctgttgtttgtcgtaattttgattaagacaacccatattagtcttatattatattttaagcagacttatattaatttagtacagcatttaaggaggattaataattggctttatgtgaaatatgcaatgcccaagctgatatacatcatattgttcatagaagcgaaggcggttttgatatagaattaaattacaaatatttatgcccttaccatcatcgtggtaaatatggtcctcatcactgtaaagaagtagatcttaggtacaagctagatcttcaaaataaactttttgaaatgcttccaaaggattattactactttaaagagctggcttcagaattaaaaatacctaataatactttaaaaagaataactaaaaatcttaaattatataaagaaggctataaaaaaacagacataatattcaaaataatgggcgagaaattttatacagaagaaatgatcgttaatttaaccttagacaatttaatacgaaatatggaagtataatataaaaagcatcattcttaattttcaaaaagaatgatgctttatttataaaaaaatcgtacaacaaaattataagtattttgtatcagagcacttttaatttttaacaatggtgcagatgaagggagtcgaacccttacaccaattggcgctagatcctaagtctagtgcgtctgccaattccgccacatctgcataacattattatacaactctaatctttaaaatcaatgattttcgtttttactttttcaacagtttttgcctatataatttatattttttatttttttagtctacacatattgtaatgaatttataaatataataaatatatccaattacttttttgtattatattgttgacatagaaaaaatcaatcattataattgtatttattataagataacacgttgatgaggacagtaagctaaaatcttatttttcagagagagaatacactggtgtgagtattcttaaataactttagactgaaaaccacctctgagtggtcctaataagacccgttattatcacgttacgataatttcaagtgacctattttaaggtatttaactatataaattatatttttataatttatattaagtttatatctttcttcaggtaattagagtggaaccacggatattacttcgtctctatagttttagagatggagtttttttattttcattttgtaacaatatttaagtttaaacaaacttaaattaataaatataaaaataattcacttacatattgagaggagatttaaaatgattaaagttactttaaaagatggatctgttaaagaatttgaagctggtgtatcagttttagacattgctaaatcaatcagcgaaggccttgctagaaatgctttttgtggaacaataaacggaaaggtttgcgaccttagaacaatagttaatgaagatgtagaattaagtatttgtacattcgattcacaagaaggaaaggatgctgtaagacatagtatatctcacgttttagcttatgctgtaaaaagactattccctgaaactaaattagcaattgggccttctattgctactggattttactatgatttcgatagagatactgctttcacatctgctgatttagaaaaattagaagcagaaatgaaaaaaataataaaagaaaatccttcaattgaaaaatttgaacttccaagagacgaagctttagaattaatgaaagatgaaccatacaaggtagagttaattaatgatcttcctgaagatgaaattatttcattctacaaaattggtgatttcactgatttatgtgctggacctcacgttatgtcgttaaagaacatcaaagctataaagcttactagaagtgctggtgcttactggaaaggtaacgaaaagaacaaaatgcttacaagaatctatggaactgcattcttaaagaaagctgaacttgatgaattcttagaagctttagaagaagctaagaaaagagatcataacaaattaggaagagaattaaaattattcactactgacgagaaggttggtcaaggtcttccactattaatgccaaaaggagctaaaatcgttcaaactcttcaaagatgggttgaagatgaagaagaaaaaagaggttatgttttaactaaaactccacttatggctaagagtgatttatacaaggtttcaggacactgggatcattataaagatggtatgtttgtattaggtgatgaagaaaaggatgatgaagttttcgcattaagaccaatgacttgtcctttccaatatactatttacaatgctgaacaacacagctatagagatcttcctatacgttatgcagaaacttctactctattcagaaatgaagcatctggagaaatgcatggtcttataagagttagacaatttacattagctgacggacacttaattgttacaccagaacaattagaagaagaattcaagggagttgttgaattaattcaataccttatgggaactctaggaattgctgaaaagataacttatagattctcaaaatgggatccaaacaatacagaaaaatatattaatgatcctgatgcttggaaccacactcaagatactatgagaaatatattagaccacttaaaaataaactatgttgaagctgatgatgaagcagcattctatggtccaaagcttgacttacaattcagaaatgtacacggaaaagaagatactttattcacagtacaaatcgactttgctttagctgaaagatttgatatgacatacattgataagaatggtgaaaagaaacgtccttacatcattcatagatcatcaatcggatgttatgaaagaacacttgcaatgcttatagaagaatatgctggtgcattcccaacatggttatctccagttcaagctaaaattttaccactttcagataaatataatgattatgctgaaaaggtaactaaagcattaaaagataaaggtataagagttgagactgactacagagctgaaaaaattggttacaaaattagagaagctagacttgaaagaactccatatatcttagttgttggtgaaaaagaagctgaaaataatcaggtttctgtaagaagcagaaagaacgatgatgaaggtgctatggacttaaatgcattcgtagacagaatcgtatctgaagttgctaacaaagaaagataataaatttttataataatataattaaaaagaacttagtatatacactaagttcttttaattatactaatcttaaacttgctctaatgcttgttttacatctccaattatatcatcaatattctcaagaccaacggataatcttacaagccctggagttatacctgctgcaacaagctgttcatcatttaattgacgatgtgtagcacttgctggatgaagcacgcatgtacgtatatctgcaacatgaactacattttcgcataactttaagctatccataaatcttattgcatcctccctacttccctttattgaaaaagaaactactccactacatccatttggaagatactttttagctatatcataatatttattatctgaaagagttggataattaacaaactctatcttttcatgagaatttaaatattctgcaattttttctgcatttctgcagtgtttttctattctcactggaagtgtttctaagccaaggtttagaagaaaagctgcttgagctgatggatacatgcctaaatctctcataagctgaactcttgcctttgttatgtatgctgcttttccaaatttctctgtatacactattccgtgataagattcatctggttgtgtaaactctggaaattttccatttgtccaatcaaaattaccactatcaacaattactccgccaatttgtacagcatgaccatccatatactttgtagtcgaatgaacaactatatctgctccaaattcaataggtctacatagaaccggagtggcaaatgtattatctataataagaggaacattgttcttatgtgcaatctttgcaaacttttcaatatcgaatatacatatggcaggatttgcaattgtttctccaaatacagcttttgtatttggtctgaatgctttttgaatttcttcttcacttgcatctgcatcaacaaacgtacactctataccaaattttttaagtgtaactgcaaaaagattgattgttccaccatatatagtcgctgcacttacaatatgatctcctgcccccataatattcaatacacttataagtgaagctgcttgacctgatgttgtacaaagtgcaccaattcctccttctaaagaagctattttttcttcaacagctcctactgtcggatttgatatacgtgaatacatatgaccatcagctgttaaatcaaataactttccaatttcatctgtattatcatatctgtacgttgtactttgataaataggtagtgctacaggttcaccattttttggcttataaccctcatgtaagcatttagtttcaattttcatatgtttaagcccccttaaaatgttaatcatataatttttcacttcatatttttacaatgtatattaacattgtaaaaattttaatcaaattaatataattatactccaataatgaaaattagtgaatttaaaattataaatattactcaatatcgggatatatttctttgagtgtatctaaatattcacttaacttctctgcttttgatttcattaaagaaaattcttcttctttttctctaagtatttttctattattataaagatcattttcaatatctttgagccattctttaagatcagtaaatacttttaactccctttcaaaaaatccacttttcttggcttcttctataagctttatttctgattgtgccaaatttgattcatttatcatctttgatgcctgttcaacccatgtttctattattgaactttcgctacttatattattagaacttcttgattcttgcattttactcttaaattctttgtattttccataggactcaagaacattacttttttctgatgaaaacaccatatgcttaaactcttcttcataacttgcatacttttgtttcaatgttttttcctcactatttaaggcttctatattactttcaagattaagcttttcatccattatagcctctaattcattatcaatatcatttttctcattaagcttatctttataaaaaatctgtttacttttccacacttcaatcattctattgtagctatcaaaatcaattttatcgtaattaattattgaatcacttatcagaacttcaccaacaaataagacaattacttcttctaagtccctactatttaatacatcattactagatataaatagcataattctgaaagaacctgtcaaaaatttttctaaagaaagttgctctcctgtagtattataattattaactgtaatatcttttaatatttcaaaaataattccatatacaaacttgtaatcagcttcttcaccaacttcaataattattgataaaaaatcaaaaggctgtttctttatagaattttttaaagcgtgctcatttttaacatcgatctttaatgattctgtaaaataaacttcatttttaaaacttattttaacaatctcatcatatatcctatatactaattcgtcttttatctttatatttttatatctgctttttagcttttcaattacttttttcatataacatactttgatagaatgagtctttgacaaatagtagttaaaatctttattttctaataaagtaacatatgcactttgaaccatactatctacagctttaataaagttttttctattacatatatttttaatctgaacactagaaatccttaaaactttataatacaatgataatttaatttgatcatccgaaagactttttatctcttctaatgttttatttaccatatctaaaagtgattcctcattgcttcgatttaataaccactctttcgatttagatagtatatttgaattattcttattccaattgcttaccatactatacaaaattcttaatttattaccattaagatttaaaaaggcattgtaaaaatcatcatattttactaaatgtctaattctatcatcaagtattcctttgaataaagtgatttttttctttgtatcttcaattaatttattatattctgttattttattataaaatttactatcttcaaaatttaactctgaaattatttctgacttgtcattacttagtaacttttttaaattatcatcataagtaaaaattattgtttcactttcatcttgatatctattagttaaacctaaagacttttcatatgataatctaatagactcaagctgtttttcaatattatcttttcttttattaataatatcttcatcttcctcaagattatcaattattgatcttatttgttgtttatcaagctccgctcttactaaaagactttcttttttagcaagtaatctatgattctcaacacattcgtcctttactaaatcaacttctcgtatttctctttcatatatcttatgtacttcttctatttcatatttatgagaatttattacttctgtaaaaaatgattcttgtttttctaattcttctttttcttgtttaatagctattataatcctattaagttcacctacactttttgagttcattgcaagttcaataatcttttctcttaaattattaatctgattattttttaattgaatatctctctttatcttttttaattcatttttttcaaattcaatagtttttggtgccttaaaacttaaatctataaatttacttatggtttcagtttcttttattcttaaataccaacaaaaaatcctatggattaattccagaatttcaattggatgcttctctattcttttctctctgcttctatacaaggttattcctattccattcactcttattatttgaatataatcatatatttcttcaggaattgaaaattcttcattgtatcgcagcattttaaccatttgacctgtagcaatattagaattaattccataagaaattgataactcccttacaaatgcatcaactactctccttgctattattttagtcatcttaggaaaatcttcacacgcacactctgcttttaataagtattgataatatttatttaaagtagttaattttaaataagtaaaattactttcattgtatttcatagctttatttcaccttcaataatactattatttaataatttgtttttctgttataatacagtcaattttaacatcttgcttgtccataggtacttcttcaataacttgaaaatcatatgccaatgctactttttttatttcttcttttctttcctcagaaatctttttaaagtatctatcataatatcctgcaccgtaccccattcttccaccttctttatcaaaggcaacaccaggaacaactattaaatcaagttcatctggatcaatatgtggctcatgcaatgccggttcaggtataccatatctatcttttttcaaattatttaatgaattaatttttactgcatccattactttggtcttaaaaatcgttcttggaacaaaaatctttttaccatcatccaatgctttattaatgatttctattgtgtttatttccgaactgtatgatatataaataaatattttattagactttttataatactcactttttaaaaatttttctctaataaagttatctttatctttcttttgactttcattcatattatttcttatgttaagaatatcttgtctaaggtttttcttttttatataaatttgttccatagtacatactcatctccatatttatcaaatatctatagtgtttaaagacatacgtggctttttaaatgcaatttctttctttactttcaaagtttcaggatcaattgttattttataaatatctggacatccctcttctctccatttcttcatatatcttgcatcagctattacttctgtatagtaattctcatcataataatccgaaaactctaagtatgataatatactgtttttatctataattaattgattttctcccacattactacatataggtataaaaaatctaagaggaatttcataattatatcttgcacccttttttagtggttttccttcaattatagctcttttgaaaaaaatattatttctatctttttcatctactttaactttaaaaattatttttctatttttatttatttctaattttactttaatcattagctcaccatcttttattaactaaattatttatcgatcataaataaaatttcttattatattttatcattagtatatatcaactgtctaaaattatcttctcttatataaattaattattctattactatttgattcaataaatttagacccagccttaaaatttaatgctaggtctaaatgtcttataataaaaatatttttctataaaaaaataaaagcaatatgaaaattaactctaacatcatatcacttttatttctaattaaattttaatgttcttcatctgtacttatatatactaatgaaccgcctaatagtaggcctccaccaattatatttcctaaaacaacaaagaataagttcttgaatactagcgccattggtaatccacctaatgcaaaataagctatagaaaatacaccaacgttagcaatactatgttcaaatcctgcaataataaatgcaaatacagagaagaacatcattattaactttccgctttctgacttcatcttaattcctgataaataagctaagcaaactataaagttacataacaaacctcttaaaaacatttgataagctggtaactctaatttagcatacgcaacagattctatataatgctgaatcggagtgaaagaagctccacttttaataaacaaataggcaaatataataagacctactgcatttcctaaaaatgtgtaaatccatacctttaatgtagaactaacactaactttccctttaaataaccctactgccattacaaaattattacctgtaaatagctctccacttaaaaatactattaacgctatggcaaaacagaatgttgccgcaataattactttagaaacttcagggtatttaggataaagaatcgctcctgttgtatatgaaagaataattgctactaatatataaaatccagtaacaacagctcttcctaaatattttcctgtcttttcatttgcatttctggcctttttttcagccattttagtaataacatcaatatcactactatacatgtttttccctccattttatcgtgtgtaaatttatattattaaactaatttattattaaaattttgcttaataatatgtttatcttttgtactgttttctattccttttatattaataaaaacctaatttttcttaaatctttagtaatataaaatagcaacatatgtgctatttttaaagcaatcattattatcttactatatttttaatatgaaaatcaaggatttactaatttataaacacattatcatttgtaaatattgctcgatttttaaaatatattgttgtttatatcatcacttttattttaaaagaaattaaaaataatagtctttaatttttcacaatattatttatatatttttaatagaacagtattgtattataaataaaaagagacattttttataattaatgtctcttttcaaaatcaaatttatttttaaattatttattatttatttttattatttttatactcattttgtcaatatcaatttctaaagatttttcaatttgttgtccattcataatatctgttccacttaactcataagcatttataaattttttatcttcattattattattaataaatactacaatatgctcatcattataatttctttcaaatgcaataagattatcttcacagcaaagttctttatactctccataaataagagctttattatcttttcttatttttataagctttttaaaatattcaaacatatctttattttgattttctttttcccatatcatacatcttctattaaatggatcatctccaccattcatccctatttcatcaccataataaatatacggaacccctaaataagtaaattggaaagcaactgctaatttcataaatgtcacattatcattacattctgataaaaatctttttgtatcatgactatctattaaattccacatctgctttgtaacagaatccatatataacatcctattacttgctaaaatatctgaaaactcacagctacttattgatctttttgcaaaaaaatctgtaactgcatttttaaatggataattcataatactatcaagctgatccccctttaaaaaagaatttgcttcatgcattatttctccaattatcactgcatttttattaacatgttttattcgctttctaaatgctctccaaaaatcatgtcctatttcatcacatacatctaaacgccatccatctattcctatctcttttacccaatattcacctacttttaataaatactctttaacttcttcattattagtatttaatttaggcatattaaaatgtctgtgtccaaatgtgtaatagttttcattttccattgaaacaggatagctatcaataaaataccaatctttatatttagatttcttctggttttcaagtaaatctttaaatgcaaagaagtcttcaccagaatgattaaacacggcatcaagtattattttaatccccttttcatgagcattatctactaattcccttacatcatcaacagttccaaattgcggatcaatattgaaataatcactagtatcatatttatgtgctgttttagatttaaatattggtgtaagataaattgtatcaattcctaattcctctaaataatctaatctttttgtaattccctttatatctccaccatatcttgaataatagtttaaattttcttcctttccccatggaagagtaccttctggatttatactttcatctccattacaaaacctttctggaaaaatttgatagaccacagactcctgcatccattttacatcctcataaacatcctcagttgctatatatggaaagatataaggatatattaagctgtcatcatcctttactcctcgttcagttaaataatgtgtattttcattataatctatcattttaaaataatattgatacctatttctaaaaatacttatatcagtttgaaaatattcaaatagttcacatttagcagcaagaatcatctccttttcctcatatggactattatctaggtacttatccttataataaacaatacattttttaatatcatcttttgccgctcttactcttaaagttaatgtatttatatcctttgaatatgaatatggtgcctctgtaacatgatatactgcatatttgttcatcttttattcgcctccaaaattaatataactttggctagtatctataacatccccgggtaagaaagttactaaaccttaactgttctttatgagattattataacagatactattgctaattattgtatatatctcatataatatgtatatatacaatatgtttttatagaaataggtaaaattttgaaagaggtgttagacttatggaagatacttttttatcagatcttaatattttcagtaataaaatttcattcttaattgaacttcatgataagcccgaaattatccatatcgtaaaaactaaacataaaaacgaactcattgatgaaatatcaactaatgagaaaaaagtagaactttttatatggaatgctattttttcaaaagaagtaataaaaaatgggatagcaacaaaatacctccatcctacctataataaattttacaaacaaattacatctattaattcagtaaaaaaacttcaagaaattgaacttgaaatggtggatacttatcttaatcttttaattaatgatactgaagttactaacagttttgtaataaatcgaatactaaaacatcttcatctaaatatagaaagtaaaatttcattaaaaaaacttgcaagtgaactgaatctttctgaaggttatatatcagactgctttaaaaagcatatgggaataacaattatgaattatgcaaaaaaaatacgcatagaacgtgcagaagttcttttaaaaaccaccaatgatagtgtattagatataagtcttcgtcttggtttccatgatcagagtcatttctatagagtattcaaacaattcacaggtgtatccccttcaaaatatagaaatgaaaattttggctaaaaaatacctcattaagcgagaagcttaatgaggtatttattatttaacctatattataggttattaaaattgtagccatgaattgagttctttacaaatgttaattagctttttccaatatgcattctataaattataaatgccatatatcatcattgtattgagctattgtacggtcagaagagaagaatcctgccttacttatgtttattaatactttcttattccaagcttctctgtcttcataatccttaaatactctatccttagtcttaatataatcttcaatatctaataatgtcataaaccaatctttgtttattaactctttatgaagtctagttaagttttccttatctccaacttcaagcatttcatcacttataatgaaatcaactaattctttaatattttctttttcatagtattcttttgaaacataatctgcattcttataatgttctataacttcttctgaagattcaccaaagatatagatattatcatctccaactaattgatgaatttcaacatttgcaccatcttctgttccaagagttaatgcaccatttaacataaacttcatgttaccagtacctgaagcttcttttgatgcaagagaaatttgttctgaaacatcacatgctgggattaatttagaagctttagttacattataattttcaaccataaatacatttaaatatttattaacttctggatctttatcaattatttcttgtaaacataagattgtatgaataatatcttgtgcaattacataagctggtgcagccttagctccaaatatcatagtaattggagttgtaggtattttaccactcttaatttctagatatttattaattatatataaaacattcatttgttgtctcttatattcgtgaagtctcttaatttgaatatcaaatatagagttttcattaagttctaaattttgagtttcttttaaatatttctttaaagcaattttattgttctttttgatttgttcaagtctagttaataccttcttatcatcaatgaatttagataattcttctaacttatcagcatttttcttatagtcatcaccaataagctcagttatgaaatctgttaattcattattacagtgtaataaccatcttctaaatgtaataccatttgtcttattgttaaatctttctggatatatatcaaagaatggctttaattcttcatcttttaatatttctgtatgaagtgctgcaacaccatttacactatatccgtaatgtatatccatatgagccatatgaactcttttttcatcatctataatataaactttttcatcgtcatatttagcttttactctattatctaattctcttattattggcattaattgtggaactgctttttctaagtagtctattggccatttttctaatgcttctgcaagtattgtatggttagtataagcacatgtcttagtaactatatcaatagcttcatccattcctatacccttttgacctaataatcttattaattctggaattaccatagatggatgtgtatcattaatttgaactgctacatgttcatgtaatttatgaagatcatatccattttcttcagcttcaagtaatattaattgagctgcattacttaccataaagtattgttgataaactcttaatattctacctgcatcatcactatcatctggatataagaataaagttagattcttttctatatcagtcttatcaaaatcaattccttctcctacaagagattcatcaactgtatctatatcaaataatcttaatttattacaaggcttgtcatatccagttacatcaatatcgtataaagttgaagatactttaaatcctccaaatggaacttcaaatttaatatcagttttatttagccagctttcatctgttaaccatgggttcttaaaagctttttgcttgttgtcttcaaatacttgttgaaataatccaaaatgataatttagtccaacaccatcaccatttaatcctaaagttgcaattgaatctaagaaacaagctgcaagtcttccaagaccaccattacctaatgaaggttctaactccatttcttcaatttcagttaaatctttaccattttcagataatacttttttaacttcatcatataaccctaaatttattaaattattagataataatttaccaattaaaaattctgctgaaatgtagtataattttttactacctttatttgtacctttttcttttgattctgcttttgttaaatgtagtaatgcagagtaaatttcctcattagttgctgtacttaatttcttatcaaatttctcatttaatattttttctaaattcttttctaccataattaatctctcctaacttctatacttttctatcttaaatactatttttttctaattaatgaaaacgcttgcgtttaatttcaactttattttatcaattaatttccataaacatttgtacattttttattttttttgtatataaattatgtattttttattttaataaaattgttatatggtaatgtacttttaaaaaaaatattgatatagtgtatatataattttacataaactgatatattaaaatttcttctgtaatgtggaaattttataaagtgatgaaaggagctaaatatatggatattttatctaaatttacagaacaattatgtggggaatttaacaatgacaatcaaattattcaagaggaaaaacaaggtaaaataattcatcccaaagcaaaacatataaatggaatttgcaatcataaaattaataatcttcctaaagatttcaatggatattttattattgaggaaagttactacgaacaaggaacttttaaaaatatacttccacatcttttcctttttacacttaatgaaaataaaaatatagttttgacttcatatgaacttccttctggaatttcaaaagaggattttagaaatgataaccatgacttaactatggattataatcaacttcaaaaatctgaaaagtttactcctatgatttatacagaaaataatggagtttttactggagaaagtataagcttttttacaccagaaactaaatttgttttaaaagaaacagttactaaaaatactctatctgtaagtgaagttttttataaaaatgataaaataacttttggatttattgatccaatagtatatgataaaattaaataataaataaaaatagcatgtgttcttacataaattaagtacacatgctatttttaagtaatcaatactttaataagctataaacaaatttttatttattatacactgccttgcgtatcttcattcttttctggaattgaaactatatcacaaacaggtttttgttgtttgacattaaaattatataataccacggtatcacataacatatcatgtaatgctctttttctattatctatcccaataaaaatatatcctatacataaaatcagactacttaaatatcttccaattgtttctctatatattacatctataatagaaagtctttcttcattttctttataaactcttattttcataaccattttaccaaatgtagcaccatatctataagtcataaatataaaatacgaaacagtaaataaataaatagctatatcaattatagaaaacctaaacaatatatgtttaaataaaaaagcatctggatatattaaagcaattataaacattggtattcttattacaagcattgcacatcctacaataacgcagtcaataatatatgcccataaccttacaaaaaaacctgcatataaaacttcctgattattattgttcagcataatacatcaagcctccattacctgctttttctaagtaatctgaaattacctgtgcatcagatttactctttattccttccatctttgaaaataatgatgaaaatacattttcttgaacttctggtgtatataccgtaacgtcacttccgatatagtcaagcatatccttttgcatattatcataagtatcaacattatcaattaatcctaattgaagtgcttgatttgctgagtagacacgaccgtccgcaatcggttttacagtttcaatatccatatgtcttccttctgctacaattccagcaaactggtcataagcttcatctacaagactttgaagtatggctctttgttcatctgtcatttctcgacctgatgatcccatagctttattaggaccacttgtaatatctatttcttctattccaagtttatcatataatccttttacatttacaagtgaagtaataacaccaatagaacccgtccagcaatttctatttgcataaatcttatcagaagccatagaaatataatatccacctgaacatgcacggctgctcatatatgtccaaactggtcttcctgtcttttctttatactcttttaattttagataaagctcatcagattcataaactccaccacctgggctatttacatataaaattattcctttattgctatttgatttaatcattgaatcaatataacttaaagtttttttatgattgtacccttgtggtgtagagaatatactatcactccctgatgaactttgaattgtaccttctaccttaacaactcctacaaattcttctgatggaagacttacatcgctagataacgctactgcttttagtgattcttctgattcctttgcaatattgctcgaatatgaatttataagtacacttgatccgcttacacagataaatgctactgctgccactataagacctataatctgtttcttattcattaagaaaatccccctgttactcttattaactaatccttatataattataatcaaagtattgcaaaatatcattaaaatttgaataaataaaaaattttactaaatatgagcaaaatttaattatacaaaatataagtacacttaatattaattatggtataatatgtttaataaatttacgtagtctcaaaattcacactaaaattatataaattagttaaatttatataaaaaaatctacatttttgctataaaggagaattaaaattatgaatgaaatgctaaaatacaacaaagaatttgttgaaaaacgtgagtatgaaaaatacaaaacaactaaatatcccgaaaaaaaaatagcaatattaacatgtatggatactagattaatggagttacttccagcatctttaggatttaaaaatggagacataaaaataatcaaaaatgctggtggaataatttcaaatccttttggtagtgttgttagaagtttattaatagcaatatttgaacttggtgtagaaaacattatggtaattggtcatactgattgtggcgttcaaaacatcaatagcgaaagtatgattaaacatatgcttgatagaggaatctcacaagaacaaattgatatgattaaatattgcggaattgattttaaccaatggctacgaggatttgaatctgttgaagtatctgttgaaaaaacagtagaaatgttacgtatgcatccattaattccaaaggatatacatgtttcaggatatgttatggattctattactggtgaaatgaaagcagttgatgtctgtgaagaataagtaaactaattttaaggctagatatttttgaatacaatatctagccttttagaattttgcagcttttgaataaaagaatttaattttatttcacataaatcttataagatgctgaaaattcttttccttcttctaatttaacaattccttctttatccttaaattgaccattaaaatcaacataatcagcatggccaaaccaaggttctatacaaacaaatggtgctcctttttcaggcgcccatattgctatataatcaaattcaccaaaatctacagttaaaactttattattatttttcgattttattgatatcttatttgatttaagattatcaaaagttaatacaccttgtttaaataaatctttagataaattaataatactagattcatttaatatgtcttttctgttatgtaaaaaataagcctcatcattgaccattaatgctgatattgtttctttttcattaaattcaagataacaatcttctagtttatcttttacttcaataggacacataaatgctggatgtcctcctacacagaaatatatttccttattatctaaatttttaacattataagttgtgataacaccattatccttaattgtatgagttacttcaaaactaaatttatatgggtatactttaagcgattcatcacagtaatctaatttaaaactaatagaagaatctgttttttctactaactcaaattcagataccctagctattccatgtgctggtaattggtatatgttatcgtcaattctatatttagaatctacaaccttaccaactatagggaataaatgcggtgaactatatttccagtatttttcgtctctgttccataaatattctgtattatcttctttgtgtgttattgaatgcaattctgcaccatgagtacttgctgttatcttaatttttgaattttctaatgaataaatcatgtgaaacctctccaatactttaaactttatatttaaactacaataataatttaatatttatttttccataattttatttacttcaaccttatcaaataattctttaactacactttcagaaacaaccccagtttctttttctaatgcattagctgttccacatgctgatgcaagttttagtatatcctttacatcatattttctttgaattccaattgcaattcccgcaacatatgaatcacctgagccaacaggattaactgcttctacttgtggaaatgtaactctatataattcattgtttattccagctatagaaccatcttttcccaatgaaattataacaaactttataccctttttatgaaattcttttatttctcttacggcatcctctactgagctaatctttcttcctgttaacgcttctatctcatccttgttaggttttataaaataaggttttccttctataccttcttttaatgcttccccactagtatctaataaaaatttcttattttgtgcattagctagttcgattaaatttctataaaaagtacttggaacatttttaggtaaacttcctgaagcaacaatgacatcgcaattatttataagttctatatatttttgtaaaaattcctgttgttcatattcactaactattggacctggctcaagtatttctgtttgtacaagatcatctgttataaatgctaaacattctctagtttctccttttatttttacaaaatcttgatttataccataatctttaagtttttcctctataaattcaccacttttacctccaacaaacccagttacaatgcaatcttcttttaatattgttgatacatttgcaacatgtattccctttcctcctggagtattctctacacttctagctctcattaccgtatctttttttatatcatttaactcatatcttttatctacagatgcatttaaatttaaaactaatatcattaaccttcctcctatttatttcttatgcttaaattttatttttttacttaatattaattatttaatcttcaaatataatttttaatagtgtatttaaaactatactttaatctgttgtgacattttataaaaattattttcaatcataataaacattaagatttttattaattttgtaaaagcgtaggatatattatttcccacgctcttatatttttaatttaccatctattattattttattttatttgatataatagtaattacattttaaatttattttaaatttattttttcttaggtttagtgacattctattcctaagattttttttcatagtggacttttttgtctctatctatgaatatattaatatctattttcacttccacatactctgattttatgttcaacaatctttttcattgcctcttttcctggtgtcatatattttctcggatcattagattttggattttctttaaaatactcttttactgcatcagaaaatggaacttttaaatcagttgcaatatttactttacatattccaagtgaaattgctttttctacaagttcatctggtacatctgatgccccgtgtaaaactaaaggaacattaactttttctctaatttcttttaatctctcgaaatcaagcttaggctctcctttatataatccatgagctgttcctatagcaattgctaaagaatccacccctgttctatttacaaattcaagtgcatcgtctggatttgtgtacattgcatctttagcatcaacttctatgtcatcttctcttccaccaagttttccaagttcagcttctacaactgcatcaaatttatgagcatattctacgacatcttttacgatttctatgtttttttcaaattcatattttgatgcatcaatcatacatgatctaaatcctatatcgatatcctttttaattgcctcaacattttcaaagtgatctaaatgtatggctattggaatattgtatttattagatgctacttctgccatagccttaatataatctggtcctgcataatcttcaattgttgatggtgttcctgctataattacaggtgatctcatttccattgctgtttctgcgacaacttgtaatgtttctaaattatgaatattaaaagctggaactgcatatccttctttttgtgcttttaataacatctctcttgttgataatatcattcttgatacactccttaatattaaaattctacctaataaattaattagtcgtgatattctcctctatcccatttttctagaaattcatcaaagaaatgatcatttttaaattggtcatcttttctttttgctattgaatctattttttcaataattttcttatcctcttcagttggttcgaatttagtctctaaaaatgcatcaattatattttccattaatccaacaccagtaattcttccaccaaatcctataacatttgcatttaaatgttttttagcatatatagctgaagatacatctcttactaatgctggtcttgtaccaactactttagctgttgatgttgttattccaactcctgttccacaaagaactactgctaaatctgcttctcctgaaacaactttttcagctgcttttttcccaaatatagcataatgagttcttatatgatcataagttccacaatctataacttcatgcccttttgctgttaaatattcaactatgtgtatttttctatctgtaactatatggtcacatgccactgatatcttcattttatattcctcctacttttcctataacattttatttaacatatctactcttatttgatgtcttccaccagcatattctgaagttaaataattatctactaaagcttctgctaattttgttccaacaattccagatcccattgctataactgaagtattgttgtgacttcttgtcatataagctgaatgttcatctgaaacttctgcgcatataatccctttgtgcttattagctgccataaaagaacctgctccatattcatctattagtattcctctatctccttcattgtttaatattgctttgcagactctatcagctgaatctactaaatcaacttcatcttctgtcttgtctataacttcataacctttacttactaaataattctttaaatgttcttttaatattgatccttttttatctgctcctattaaaactttcataattaattctccaatctgtgatgttattaatttgacactttttcttcatattctttgtttctcttcttcatttgatttgcataccacataaataatcctaagtatacaactaatgtaacaacaagaattaaagtattttgtaaatttatattttgaccaaacttaccaacaactattgcaacaaatttttctattggtccttccaaagttgaatgagttattagtgtagatgcatctaatcctgctgggaatgctcctactttttgtgctgtaaaggtaacaaattctgaaattgcagttccagaccataagaatgttggtaacatcaatgctccaatgattatcattcttataagttttcctctagtaacaactaaaagtgctggtgtcatacccattgcaattattcctgcaagtggtaaaattttatttcctggtaaaacaactgcttctaaaagcattactggtgcaagtatattagctgctgcccaaatttctgctcttgaagctataaatggccagtcaatacctatattaaactttctacctgcaaatttattactcataaaattggttattccttgtgataatggttcaacagctgctataaaccaacttcccattaatgagaataattctaagcacataccacctgtaaatgctaaattaaatatactttgaggtgcttgtttacctaaaatacctacaaagacacctaagtaacatcctattgcaaacttacttccccaaaatccaattctattattcaaagtagctgcatcaaaatcgtatttatctatgaaaggtaaaaatttactaaacaacttatcaaataccattattattggatttaacatataattcatatgtgtagttgtagtaggatttgattcaggcatattcaataaatcattaaatgttggcttcattaaatctgcatttataaattttaaaactcctataaaaactactaataatgctgctaaaaataaatttttagagtagtacattactaaaagtccaactatagataaatgccaaacatcaaatatgtctacatctaaagtatctgttttctttaaaattaacattgcaatatttacaagaactaaaataaacaagaaaaataatgtatatggtgatccccatgttattgttgctaaaggagcccatccaacatcggttactgatagttgaattcctgttgatttaacgaactgttgcaatgcaggtgaaaaagcatttgttaatattcctattacagatcccatacctgtaagtgcaattgccaacttgattccaccttctaatgcctttgaaaacttaaccttcattattaatgctaataatgttaatactattagcatcattggagctgctcctaaattaattattggttgaaaaattttattggctaactctactattgtactcatcaaattaatccccttttatattaatttttatttaaacttttaataactctttcaacctcgtcaaatactggtttactcatcataggcatcctatataatattggtcctgcttcgacaactggtatttttatttcaaagctagtatctggtttagttataggtgtaaagatatcatatttagttaacatttcctctgttaaatcttttatcattactgcatcggcaatgacttgataacctctcttcttcatttcttcctcaattgcatctttaatttgatggcttgaatttactcctgcaccacaagctgctaaaattttaatcataataaaattcctccttatatatataaatatttttttaaactatgcatttagtttattaactacatcataaattgaatctaatgaatctgatgcagctaacatacttatattttctttattggtagcaaactccattatctttgctaatatattggattgttctccaccatctttatttaatatcataaataagtatttaacatttaaatctttatcaggattcatcatatcttttgaaactatatctctttcaagcttgataacgattactttggttgcattacaatacttactttctgtatgcggtattgctatattcggaaaaccttgaaatacagctgttaaatcaattcctgttggataatttttttctctttccattagtgcctctaaatacccttctttaactagtcccctttctaaaaattttttgctcaaacatttaaatgcttgatctaaactcacaaaatcttctttgaatattaagtctttttcaattaagttcaaacctaatcctcccctttatgtattttaaaatataatttaatattatatttctaacattttaatttttttacttagtatatagcttgtactaaattgctatatactaagtatttatatacttttaagtattattgttctatactgtctattacattacatatttttaaatatttatcttttaattcttttgatatatttgaatcagttattatcgtaacatctttatttaatttataaaaagtacaaaaatcctctaattcaaatttagttgagtcacataaaatatatggtttttttgatttttctaaaattatattctgacaaattccttcatcttcattacgagttgtaactctattatcaagtattccattagtaccaacaaacgctaaatcaacaatcatttttttgcaaatttcattggcaaaattccctataaatgtgttacttctatgtcttagttttcctccaattaaaataacatcatatctactatcatctttaaatttctcaaatacacttaatgaattggttactatttttgcatacgatacatttaaataatcatatataagttcatttgtagttcctggccctatataaataatgtcattttcttttactaaacttccaacaatctttgctatttctaatttcttatcaatatttatatttcttttttcacttagagataactcttctttaaaactatcattgcttctagcaccaccatgaattcttataagcaatcctttactttctagatatgttaaatctcttctcaaagtcatttcagttgcttctaattcatctactaaatcacaaattttgattattttcttttcatttaccttatttaatattattctatgtctttcttcctttaacactaatgtttacctccatccccaaatataaaatttcaactatttaattatacattcattatatataaaaacgttaatatttaaattatcaaaaatttatactttcatcttaagttttttcaattacaatttatttttaatatgtaattatcgtttttatcttttctttgttcgttattgtttgttttatttcttttttgtttgtaatttcattatatatacatatagcaattttttcaaattcatttatagccattttattctatataatacatatttaagctatatattgagaatatcacttaatatctaatttttactgctatttacgcctatttatatacatatattccttagttgtattaatttaacatatctaaacgtagtttttcgaacaataataaacaccatagtttaacaaatactatggtgtttattattttaattccttttttatttaatatacggaaaattttatactgtgtttcttttaaatattatttcatcttataaaaaagcctatacattttaaaattacttaaaatgtataggctcatattgattctattaactttttatataatactatatgctataacatagtattatttaatctattaaaaattattcaactgtaactgatttagctaagtttcttggtttatcaatatcgcatcctttagctttagctacataatatgagaataattgaagaactgcaacacttaatacaggtgcaaacatatctaaagttctaggaatgtagattatttcatctaatacttcttctaatcccttagttccttcataacatattcctgtaactttagctcctcttgctttaatttcaacaacattacttaccattttttcttttaaagcttcttgagttaataaagttattacttcagtaccatcttctattaatgcgattggtccgtgctttaattctccaccagcatatgcttctgaatgaatatatgatatttctttaagctttaaagaaccttctaatgcaactgcataatctatacctctacctaaatagaacatatcatcttctttatacatcttttcagcaatagctttgattttttctttatcttctaaaactagttctacctttcctggtaaatctaataattcttcttttaatttatctaatctgtcactctttaactttcctaatattttagcaaaagtcatagctatcatatacattcctataatttgagttgtataagccttagttgaagcaactgatatttctggaccagctagtgtatataatacatgatctgcttctcttgaaactgaacttcctacaacatttgttaatgcaactattgtagcaccaattgttttacagtttcttaaagctgctaatgtgtcagcagtttcaccagactgacttacaacaataactaaagatttatcagttactaatggatttctgtatctgaattctgatgcaatatcaacttcaactggaattcttgcaagtgattcaattacattcttacctacaagacctgcatgataagcagtaccacaagcaactataaatactctatctgtattttctaaatcttccttagttatttttaaatcatctaatatcatgctcttttccatagaaattcttccagccatagtatctcttatagcctttggttgttcatgaatttcttttaacatgaagtcctcaaatccacctttttctgctgcatcttcactccatgtaacatgatatatatcttttgttatttcatcaccatctgtagtgtaaagtttaacaccattcttatcaagaactgctatttcatggtcttctaaaagatatacatctcttgtgtagcttaatacagctggaatatctgatgctataaatgattcaccttttcctaaacctacgattaatggacattcttttcttactgctattaatttatctggttcatttttgcaaacaacacctaatgcatagctaccttcaagtttcttaagtgccttagtaactgctttaaataagtcaccctcataataatagtcgattaagttagggataacttctgtatctgtttcagatttaaaagtataaccttcaccttttaaccagtttcttaatggtaaataattttctataataccattttgaactactgcaattgtttctttactatttaaatgtggatgagagtttacatctgatggtgcaccatgagttgcccatcttgtatgaccgattcccatagatccttcaactggatgttcttttatattttctgctaaattagctaatcttcctttaaattttcttacttcaatatttccattattaacaacagcaacacctgctgagtcatatcctctatattctaactttgataatccgttaattaaaaacgatgttgcttttccgcttcctaaatatcctactattccgcacataatctaatcttccttcctcaattcagcttatatttaataagccctttaattcttaatttttatctaaatctaatgctttgatacggctcataaaattatttgtaaaaatattttatgcataaaagggcataataatcccgtaacctaaaagcataaatttttagaaggttttaacaccaaactggatttgtactttaaatcactttaaagttttgccagctgttaacggtagtgctataccgtggggcacccgccgaagtttcgataactccccaacctcgtcaacttaagtgagcatccaaatctatgatttggttagtggaacttactcagcgaacgtatgtgagtcgagtttccttaaaaaaaactctaaacatccacattcaatcaactaaagtaatttacttaagttctggcgctttaaaaattttcactttaaataatgtttacctatcaccatcacacctttcacgcgacattttataccctgcatatattttatcatataaataaattttgtctataatatataatattgcttttttcttaaatttccacaaaaaaaataaaaagaaatatataatccacaattttagtaaatcaatcttgatttatccacaattatttcctatatatctctttatatgttgataacttataactctaaactttaatgtaatactccattttcatctaaactatatccatctataatagtattagttgcaagcattccatttgaatataagtaataccagtttccatcagtattaatccatccagttttcataatgcaatcttcaccaaaataataccagttattattatacttaaaccatcccattacttcatatcctgaatttcttttataatgccattttgagttattatctttataccaatatccaccctcataatattctgaaatatcattttctttatcattattataatcaagatattctgttttattcaaaaaataatttgaagatgcagatggatactgagttttatcccacgtaaatccattttcaatcatataatcatcactttttaacaagtatttatctctaacaatattatcattattagtggaatctaaatgataccacactccatctatttttactagattccatgcatgacttgtaccacttttatcaccatttataattctacaatcaatcccaaggatatttaacattttatatacagtcattgcatacccctgacaaatagtacttttagttgtcaatgcagtataaacattatcagattttaatgtatcatcatacttatatatcttcacaacataattatttatagcttcaattttttcttctgtagacattctagaatcaattaaattattcacaattcgtgacaattctgaattaatgtaatcttcctgctctttattagttctatactgtatttctgcttcaaaaaaatatccagcttttcttgttttatatactgctatagaacgttctaaataatcatcttttttagccacttcttgtagtaaatcaagtgcactattagagtaatatgtgaaataaaagacattatctctattaatcatatggttatatatttcattttctaacttatcattacttgaagtatcagcaaatgcagtggtactacaaacaaatgctaatcctaatgaaagtatagttgcttttcctatattcttcatacacacgacctccacaaatatacatttatgccatgaaatcattataacatgtattataactttataatataaaaatagactagctacaatattaaatatattttagctagtccagtttttctttactatattaagataaagctatccatggtttttctaattgagcttttaaagtgttataactattgatagtactctttaattgattatttaatgtttcgctttcacttacactcttgtcataatcaagttttgtttttaatcctaaatcgtaattaatcttatttattctaagctgtttattactaagttcaacattagaatttaacaaatcaatgcttttttcaatattaagtaaattagtgtacattgttcttaatgcttttttatattgatctttagtttcatttaattctaattcacttgttgtaactgatgatttattttgtaagtaattcattctagctccaatcattcctgtataatatgatagcccattagtataagtgctagatttacttatatatgtttctattgctgttattttttcatcataactttgtccttcttttaaataatcacttaacttaggaggtgtgctatctttcattgactcataaaactttttagcatctgaaaccttatcatttcctaccttattatcatcatcattccaaaaatctttattaagatcattaatttcttgtgtatatgaaacatactcgtctataacaccatctaaatattcatctaaagaaccatctaatgcaaattttttatattcaattttatcttctaaagtatactgatcaacatcttttcctgttaatactttaaaattttctttatcatcttttaaagtgttctgcttgttatctaaatcatttacgttcttttgtaatccaagattaacttgatcaatatttatatcagtaacaagtcctaaactttttttcaaattatattgttgaatttcagttttctgtaattcaatatcattttttaactgacttatttctaattgacttattattaagccattatatgcattcgtaacactttgacttaatttatcaaccataaagtctcttttttgttccaactgatttaattgaagttttctcttatcttcatcataatctttttgagtatcagttaaaccactaccactatcatcactcgaattaacaacatcatcttttttatcactaaggctatttatattctgcattaaccttatattttcatctaatatagctatagtattactgcatgattttgctccatttatagcatcttctaaagttaatacttgctttgcgttattttgatttgtagaatctgaattagcatatgtaactttagtatctgccattacaggaatagcaagtccactaatcacactaacaccaattgcaaatgcaacaattttatttaaattttttctcattactccacctctttatttaattatattttcataactatttctaataaataattttaccataaaatgaactaatagtcatttaaccatgaagaaagtttacaaaaaattcttcatggctaaattttatttcttatttatttctttaaatctgaatcttcttcatgtgactcatcattttttgattcttttttatcctcaatatctttagataatatgtttatgcccattttagactttttaggcccaatatgaggaatttttattttatcaaatatttgtccaaatttacttcttaatgaattttcaatcttatcaaatattaagtatactgttggtattaatactagtgttacaagtgttgatactgaaaggccaccaataattacaactgcaagaggttgcatcatgtctccaccttcaccaaatgccaatgcacttggtatcataccaacaacagtagtcattgttgtcatcaatactggtctaagtctagctgcacatccttttgcaactatatcttcaagtgttccttgaactttagcctctctaagctgaccaatatagtcgattaaaactataccattattaacaactatacctaccagtaatatggctcccagcattccaactacatttaatgaaatacgcgaaattactaatgcaatcactactccaacaaaagcaaaaggtatactaaacattattataaaaggcttactaaatgactcaaattgagctaccattaccatataaacaagaattaatgctataaccattgccattacaaggctactcattgattcattcatcatttcagctgatccaccaacatcaatactgtaatctctaggcatatcaacttcatttactgcttgagtcaacagtcttgatgctgtacttgtatccatattatcagcttttgccgtaattgatactgaatagtcaccatctgttcttgatattgattttaatccatcagccattttaatttctgcaaatgcatttaaaggtacttgctgaccgcttgctgatgttacttttatttgtccaatgtcatctatactatttatgcttgaatccttgaattttaaatttacatcataatcataatcatcaattgttactgttgtagcatctgatccactaattgctgtacgtaatgtagatgctattgacgatgtatttattcctaataatgaagcttttcttttatcaatcttaaattgagcttccttatttgaatccgcaagagaagtttctatatttctaaatccagatactttttcaacattagcttttgcttgattaactatttcttctaatacatctaaatccggacctttaatatctacttgagcatctccgcttccacccatagacatactactagtctgacttacattgatttcacagtcaggtattacttttaatctttctactacatcttgttcaatttcatctgttgttctctttctttctttagaagatactaaatccaaacttatacttgctgtagaaccacctgaccccattgctgaacctgatcctatttgagttatcatggtttcaatttcaggaatatcagatactttctcttctgccatagatacataataatcacttggttctaaatctaagccttctggtaattttatagatatactaaccataccttcatcaccacttgacataaagtccatgcctattgctccagttgcacctaaaactattgctccaataaacatacctacacttattaaaataactactgctttatgttttaatgctaaaactataatatttttataaccctcacttattttatcaaatataggagatggtttttcctccatctttgcaccattcttaccaccactaagttttgcaaatatacttggtactaaagtaagtgcaactattaatgataaagttaatgcaaaaataagtgttttagccaatgaaccaaacattatctttgtaaatccttcagtaaacaatattggtaagaatatagctactgttgttaatgttgaagccattacagcagttgaaaccgtatttgtaccttgaatagctgcttcttctaaagataaattaggatcttttctatacttaaatatattttcaataacaactgtggcgttgtcaacaaccataccaactgctattacaagggaacttaatgttaccatgttcaatgtttcacctgtaaaataaagtaatgcaattgcaccaattattgatgttggtatagaaactgcaacaacaaatgaagcccttccgctctttaagaaaagtaatataacaaagaaggcaattactgcacttaaaataagattcttcattacgtcatttattgagctatttatatattcactagtatcattaactatttttaaattaaattgtgaattctcattattaagttcagatatttttgaattaacatttttcataacctgtacagtatttgcatcttgctgcttctgtacatccataactaaactttcttgaccattgtatctataaattgattgcttatctacagtcccatactcaactgtacatatcttatcaagacttacagtttcaccatttgacataggaatttgaattgccttaatatcttctaaagcttcaactttatcaacacttctgataacaattttgtcatctccttgagttattgatccataaggataactcttatttgttgccgataaaagacctttaattgtatctaatgatacaccgtaacttgaaagtatagtaggatctgcaatgacatttatctgtgtcttatctccaccattaatatccgctgaagttataccatctatagattctaatttaacctgaactgtatcttctgcatatttcattatgtcatctgaactaccctctccacttacaactatctgtgcaatggcctgtgcattcatatccatttttaaaatacttggtgtgtcaacatcatcaggaagtgtcatttttactgtatctattttacttcttatatcattaagtttttcatcaacatcagttccatattcaaattgtgcaacaaccatcgatacaccttcactagacttggaaacagttgtctttacatttgaaattgacgaaagacttttttctatgggttctgatatttgatcatcaatatcttccggaccagctccagaccattgagtcattactaaagcaactggtacatcaatatccggcattaagttagcaggcattttactatacccaattccaccaaacattaatactactaaaaataccattattattgtaagaggacgtttaacggaagtttttgtcatactcattatattagtcctcctttactacaggaaataactttgtgttgtctgaaatcagtgataatccgccaataacaactgtatcatctgattctactccactctttatttctactgtatcagctgtttcaatccctgttgatatttcctttttaacagctctgttatcatcccctactatgtagacatatttatttccttcttcttcaagaattgcttttttaggtacttttacaacattgctttctttttctatactaacttcaacttccgcagacatacctgatttaaattgtccttcggaattatctataagaacttctaccttataaagtgaacttgaagcatctgctactgttggtacataatttactgttccatcaataacttgttcatctatctttacactaacagtttgtccttctgaaaacttgcctatatcagcttgtgtaatactaagatcaatttgcaaaatatcaggacttgaaattataaatgcaggttgtccttgcgttgccatttcatttacatcaaaattctttgctgtaataactccatcaactggtgattgtaaagtaagcttgtctctattacttaatgcactttccaaacctacttttgcagattctatagctgcttttgcagattctctatttccaactcctgtatcatatgatttttgagctgcatctaaacttgcttttgcttgatcaacacttctttgtgtctgttcaagattcgcctttgcttgtttataatcattctctgaaattgctcctgcttcataaagctgagttgtattatcaaattgtctctttgtttcttcataccctgaaactgctttatcatatgctacttttgcattagtaagtccactttctaactgattttcagtatttgccatggatacatcactatcattatatgcagcctgtgctgaatttactgcagcctgtgctgattttatactgttttctatatcagttccttttatctttaatagtgtttgtccttttgttaccttttctcccaactgtacattcatttcttcaatagttccacccatttcaactgttacagctgtctcatcctttatcttagttgtccctgaaaatatgtttgtattttcaatatctccacccttagcagattgtactgaaactgctatagccttttcttcttgtacaggctctgtactcccacagcctgtcagcatgaatgtacttactgttaatagtaatgcgattaaatactttttcattttttcctcctctaaaatttagtaaactattattaaattttaattacactatattattcaattttattaatataatcctaataataactattataataatataaaggtttcattttcttactgttttcttaatttaagcttaattaatttacttatttttcttaatatgtaaatcattaaacttaagagttaattaaaaactcttaagttgtatttaattataaattcagaactattctaagtcaataacttttttcttgtttaaaatttatttttaagctataatatttaatgaattttataactcgaaaggaaactaaacatgagtgattccaaactttataaaacaagttgtatgctattagattttttgtcattggttagagatggcttatttatagaaaatgatttcacaaaaaattttcctataaattcaaatgaatttcagacaaaaatctgctccttatcaatgcctccatctcatataaatgttattttatatttagcaaaagttaaatcatcgcccatatcacatattgctaagaaattaaatatatctaaatcaaatatgactcctataattgataagcttattgatttagaattagtacatagatatacagatagtaaagacagaaggattttacgtgtagaattaacacctaaggctatagaattatttgaatatgtagaatctgctgcaaaagatgctataaaaaataaaatttcaactttatcagatgaagacttaaatgatcttacttcttctttagatactttatcaactattttcaaaaaattaaaataaatatataaattaaagcagcatgaattacttactaattcatgctgcttttacttaacatttaaaaatctatttctagttcaaccccataatggtcagatattatttctttgtttactccattaaaaatcaccctagcatttttaactttcaataactcattacttaaaattaaatctaatctaagtttttctttattttcatcccaaccatcaatttttccctttactgtagcactacactcttcttctgacttatcagttttcaaatatagatcattcaaatttttatttattaaataatcatatccttcatttcttacaaaagcattattattaaaatcccccataaaaattgctgtttgcttactgtttactgtatctaataacttatctgcctgataagtaaaaggctcttcatcgtccttccaccatccaagatgacatgaatagaaatcaacttctttattattaatttctattgaactcttaattatctttcttgtcttccagtaagttctatccgtacttttggtaatgaaaaatgattcactatttataaacttatgtctagtcattatagctaatccttcttcataaatgtcatatcctatatgagagaaatcccaataaaactcgtaattacttttagtaaacttattaagctcttcttttagtagaacaataaaattatcttctttcaagatgccatctattattttgcaatctattgactgactaacttcttgaagggctataacatcataatttttttcacttattacttttgctaaatatttaattttatctaattgattttcttcttgccacgaatgacaatttaaggttaatagtttcacttttactacactcctaaaatatcttgtatgtctgattttaacacatctgctttaggtccgtatattgcttgaattcctttatccttaaccactaatcccatagctccattttgcttccattccttttctcctgcaactagagctttatctttaacagtaactcttaaacgagtcatacaagcatcaacatctacaatattatctttttctcctaataaagagattatttttacagctaaatcatttcccgaaacttttgtaactgctgcttcctttcctgtttcttcttcttcttctatataatttcctctacgacctggtgttgctaagtttaattttttaattaagaagttaaatacaaagtagtttaatccaaagaatataactgcacatattacaaaattaactacatccattattatacctgcttttgcaaacatcggtatacgagttaaaaattcaacaaaaccaaaagcctgaattcttacatttattaaatctgcaactgcaaaacctataccagctataactgcatatattccatataaaataggtgatacaaacataaacatgaattcaagtggttctgtaacccctgttaagaatactgcaagacctgctgataaaaacattgacttatactttttctttttatcttcatctacatttctgtacattgctaatgctgcacctattaacgaagcacttgaaagaataacttgaccaaatttaaatcttgctggtgtaacagttgctaataaattattatatgctgctgtattacctgttccctttaagttaattaaatctgatacccatgcataccataatggatcttgacctgatataatgcttcctgcattagctccagtcattatagtatacgttccacctaactctgtatagtttactggaattgtaagcatatgatgtaaaccaaaaggtagtaataaacgttctaaacatccataaataaatggcgatataattggcgctgtatctttagactttgcaagccacataccgaaagcatttaaccctgattgagcaaaaggccaaactattgcaagaattatagctgtaacaactgaacctgcaataacaacaaatggaacaaaacgttttccattaaagaatgataatgcattaggaagcttattaaagttataatacttgttatataacgaagctcctaagaaacctgaaataataccaacaaacacacccatatttaatgctggatttccaagaatagatataaagtaattctcaacaattaacttttgtccaaataaagatgtaacagtagcatttggatctgaaagcatctttgatgttactccaaatatagatcctgtagtaagatttataagaataaatgctataagtgctgcaaatgctccaccagcacgttctttagcccaagaaccaccgattgctactgcaaataaaacatgaagattaccaataataccccaacctaattgttctacaacgtttgcaactgtttttaaaagagataaatctccacacattccaattaattttccaatacaaatcataagacctgctgctggcattactgcaacaacaaccattaaagccttcccgaacttttgccagaattcaaatgaaaataatttacctttactgttccccattacatttccctccattttacattacatcgtatacattatttttttttaattagacttcataaaattatgaagtctaattattcatcatttgtataacacactcatctgtatatttctatattttttctaattgtttattttatataatctacattcccatggcttcaattcaaaactatgactttgagaatgtttatctactttataatttgaaatcaataagttatctgaatcgagttgtaattcatcatagcaataattcacatagtcatttgataaattacataatacaaggtacttttcctcattttcaactctcatatacgcatatatttgttcatgttcttctaagatcaactcatatttaccgtatattaacgcttcatttgatttcttgatttttattaaatttttatagaaattcaatatagaattatcatctttcaattcatcttctacattaatttctaaataattttcatttaaaccaatccatggtttattatctgaaaaacctgcatactttgaactgctccattgcataggtgtacgtgcattatctcttgaaatactccatacatgttctagtgcattttcttcactttcaccactttcaaccaactcattatatatgtttatactcttaacatcatcataatcttttatagaatggaatttaacattagtcattccaatttcttgaccttgatatataaatggtgtcccttgttgcataaaatacattaatgcaaaggctttcgcacactctgatctatatttgtcatcatttccaagtgttgatataacacgtgatatatcatgattttctacaaacagagcattccaccctattccatataaactatcctgccatttacttaaagcttttttaagttttattatcttagatattccatcactatcgtccgattcccataaatcaagatgttcaaactgaaataccatattaaagcttccattttcttcaccaacccaaagttctgcatctacttccgctttcactccattagcttctccaacggtcataatatcatactttgaaaaagtctcttgttttaattcatttaaaaacatatgtattcctttataattcatatgcttatcaaaagattccacatagtcctttttatcaggattaggaagatcttcaaatgtttgatctttcttaatatgacttatggcatctactctaaatccatcaattcctttatctagccaccagtttatcatctcaaagatagcttttctaacttcaggattctcccagtttaaatctggctgttttttagtaaacaagtgaaggtagtattcttctgtaatgtcatctttttcccacgctgaacctttaaagatgctttcccagttatttggctctgcaccattcttaccttctttccaaatataccagtctcttttaggattatcttttgatgatttagattcaataaaccacttatgttcatcacttgtatgatttacaactaaatcaattattaatttcatacctctttgatgaacttctcttagtaattcatcaaaatcttccattgttccaaattcttctgttatatcttgataatcactaatatcatatccattatcatcatttggtgatttatacattggacaaatccatataacatctattcctaaatcctttaaataatcaagcttagatattattccttttaaatctccaattccatcaccgttagagtctttaaaacttcttggataaatttgataccctatagcttctttccaccaaacttttttcatacgtactcctttgcaagcgattgcgcttttgtttataaaaaatatttcacttaaaaaaaagtaaaatattgcagtaatctttgtatttttcttattttatgaattaagtatatcatttaaagaaaactattacaataattatttttttgaaattgttttatttacgctatgttttcatattttttctttaaaatgctccatcttagtaagtttcttttgcaatcgcttgcactaataagagaatcattaagatagtatttataatactatcttaatgattctctttctatcaattttgaatctactatatagtgattatcatcaacattattattttctaaatattctataagtacttttgctgcataataaccaagttctgatgcgttaatatcaactgatgctaacggaggctcttgaaattctgctaaaggtgtgttgttaaatgcaacaacagaaacattttcaatacctttatcttttaatgcttttagtaatccgaacgcaagcaagtcgtcctgtaccaaaactgctgtaggattacttttatcaaataattctaatgcaccattaaaaccttcctcttcattgaattctgtcttcataattatatttttatcagcacatgtcaatccgttcatttcacatgcaaccttatacccttttaatctatccttggttacagttaattcttctttagctcctaaaaaagctatatctttatgtcccttttttattaaagtattcatcaaattatatgttgatttaaaattatcattatcaacccataacatactttctggattttcagggcgccctataactacaaaaggaaaatctgctctttttaaatattctatacttttatcatctgtccttagtcttaaaaggcagattccagcaattaaattgctagttataaaatcttttatataatttacttcttctttttcattatcactaaaggcataagttatataatatttctttttctttgcataactactcattccttgcatagcttttaggaaaaatggattgaaaaacaaatcctgagcttcactaggtagaactacaccaattattcttgtctttttattggcaagactccttgcaattgcattaggcttataatttaatctcgttataacttctcttactttttcctttgttttttcgctaatttgaggactatcagatataactctggaaacagtagatgttgaaacattagcttctttagcaacctctttaattgtaaccttcattttctcctcctaataaaccaataaactttatactaattttatacccaatttccctttttaggaattatatatgtatctttttttatttatctacaaaatattctaaaggtattaatcattctaaaattaataatatatgcttcaacaataaatctcaagtaaatatagtattttaatttattttattaaaatagtctaaatataattttaaaaaccatatctagactaatttataataataaaatatattaaactgcttcgatattttcttctatattatcctcaccagttttaatttcttctttttttgtacatcttccatatatctcagtcaaactgtatatacgttttgctaaagcatcagtaaatgcttcacctttagctctccatttccaattgcatcctaaagtagaaggcatattaattcttgcttcattacctaaatttaagaaatcttgcatttgtgctattgaaacattagctacactactccatattccacgtataaatccccagttatatccttcttcttcatttaaattcaaatactgtattgctttttcaacttgttctttaggtgcagttttttcaatccatcctcttactgtatcattatcatgagttccagtatatgcaataaaattcttttcataattatgaggtaaaaatggattatcgctaccagaatcaaatgcaaaagtcagtattttcattccaggaaatttattgtcatctcttaattttattgtttcctcggttaatgttcctaaatcttcagcaattatattaacttctccaagagactttcttatagcatcgaaaatttccattccaggtccctttacccatttaccatttttagctgtaggctcaccatatggaatagaataatatgattcaaatcccttaaaatgatcaattcttaaccagtcatatattttcaaactttctcttactctatctatccaccacttatactcagtttcgtgcatatattgccaatcgtatataggatttccccataactgacctgtagctgaaaatatatctggtggacatcctgcaacttttttaggttttaatgtttccttatcaattaaaaatgcatctggattactccatacatcagcactgtcttcagaaacatatattggaatatctcctattatctctataccaagttcatttacatattcttttaacttgttccactcttcaaaaaattcatattgaataaaattccaaaattcaatttcatcttttaatttttctttatatagagcaaccgcctctggttttcttaactttatatcttcatcccattgttgccagctctttaaatcaaattcttctttaactgacatatacaacgcataatcctcaagccaaaatgaatttttatttttaaattcattaaacttattttttatttcagattcttcacttatatttgtagcaaacttattaaatgctactcttaaaaccttcatcttctctgtaaagattaatgcataatctatttcttcattattttctccaaaatttatattttcatattcctctaagtttaataagccctttttatttaaaacatcaaaatctataaaatatggattaccagcaaatgctgaaaatgattggtaaggcgaatcaccaaaacttgttggtcctaaaggtagtatttgccaatatttttgtccagacttttctagaaagtctgcaaacttatatgcctcctcacctaaagttcctattccatattttcctggtaatgatgcaatatgcataatgataccactgtttctttccataaccgtctctccttcttcgcttttgatcatatgctctaagcaatcgcttgcataaattgatataactgccttatattttttagtttataagcagctatatcatatacattataaatattattaattttaatcttctaatttttatctgttattattcatcttttgtaaattcatgaacttaacttttaattattttatagaaccttgaacaatacctgcaataatttgcttttgaacaaagaaatagaaaataacgattggaatgatagctaaaattaatgctgccattgcaagttcccattgtttagaaaatgcaccaaagaagttgttcatagcaagtggaattgtatttaacttaccgtttattgttaagaaaggtagtaaaaagtcattccatatccaaatactatttagtactgcaacagtaactgttgttggctttaataatggtaatactattttagtatatacttgccatttactacatccatcaattattgctgcttcttcaatttcttcaggtataccctttatgaatccatgatataggaatatactcatacttgctccaaagcctagatacataaacattaatccatagtgtgttcctaacatattgaatccaccaaaattaattttacccatccattttacaagtggtaacataacagcttggaatggtacaatcatacctgctgtaaaaatataaaaaacaattttgctcttagtagatttatcacgaactaaaacccatgctgccattgatgaaaagagtaatatcaacaatactgatccaacagtaattattattgaatttgtaaacgcagatgttattcccattctatccatagcgtctgcatagtttttaaaattccatgcacttggtaaacctgttgtatttgcaaaaatttctcttcttgttttaaaagaatttataaacatcaagtaaaatggtgtcatataaagtattagtaaaagccacgaaaatccttctagtactttagatttggtagtatagctatccagagtctttaatttttttgatgcttttacatttacttctgctggttctgaaattttaacttctgccattatgcttctacctcctttttcttgttaaagtaaacctgagttaaagaaattgttgttactaaaataaagaatataactgcctttgcttgaccgatacctagattattaactacaaatgcttctttataaatgtttaatgccatcatttctgttgctttagcaggacttaatgagaagtttaagtcaaacattttgaaagaatttgcaagtgttaagaataaacatattgttataccttgtctaaccattggaattgttatatgtttgaatgtttgaattccattcgctccatcaatatgtgcggcttctattaaatcatttggtacattttctaatgctgatacataaataaccattatatatcctgcatactgccaagttgatactataagcattgcaagtacagctgtacttggttcttgtagcattgatgttgaaagaatactacttccaagcttttgaccgattcctgtaaatactgaattaaacatgaactgccatataaatcctaaaattaatccaccgattaagtttggcataaagaaaccagttcttaaaaaattctttgtttttagatttcttgtcactatatatgctaaagtaaatcctataacatttattgtaattacacttgcaaatgtatatataagtgttattttaaatgaataaataaactgagcatctttgaatatatataagtaattactgaatcctacgaaatcatatgctggatttgctccattccagttagtaaatgtatagtaaattcccatgaaaaacggtattactacaaccataaaaagagcaaataaacaagggccaacaaacatccagaaatctctattgtctttgcttctcttactcatcctaaactccccctttttaatttatgcagatatccataaaacatttcattttatggatatctgtattgaaaatttaaattatttacttaataaaattatttagcttgttttggagatgcatcttgaatattttgtaacatttctttcttagctgcatcacccatatctgtatttaagaatttagagaatacaggtcctatatcattcatagtaaatccatctgggaaattagtgaatgcccattttaatgtcttaccagaattgttgtattcagtaattgatttatttaaagtatttgaactttcagctttgaaattagtaaacgctggaatcatattcatatcttttactaaagcttcttgaccagtttggctttcaaccatccaatctaagaattcttttgcttccttattaactgctgaatccttattaactacccaatacattggaactccaactggaattgatgtgttagccttatcattagcatcattatttaaacacattggaatgaatcccatattaaagttagcacctaatgaatttaaatcagaagcaacccagttaccttgttgaataaatgcagttttttctaatgcaaaattaccaacttggttactataatctatagtttcaaggctcttacctccgccgtatttgcataatagccctactaaattcatccaatcattgaattctttattattaacaatatcagcttttcctgcaacatattcatctaagaatttatctggatcctcttgagctgcaaatggaatattaaatgtatgatttcctgtaacccaagtttcctttgttgtataagaaacaacattttcaagacctaattcagctttcttactatctaaagtttcaaatgctgctttcaatgcatcaaatgaagttatagttttgggatcgataccagctttatctaaaatatctttgttatacattaatccatatccttcagttgcagctggcataccataagttttaccatctatagttactgtatcaagtgtgccttttactgcattgcttatccaaggctgatcacttaaatcatcaattttatgtttccaaatttcataatctcccttaccagcaaccataaatatatctggttcagtacccttttggaattctgcctttaatgatgcaccatagtcagcaccaccaccaactgatgtaatttcaacttttacacctttttctttttcatattcttgagctaatttttgaagagcatcattaatttcaacttttaattggaataccttcactgtttttccacttccatcagctgaagttgctgaacctgaagtttgagctgttcctccacatcctgataatgttccacatgctaatgcagaagctaaaactgttgctaataattttttctttttcataatatataccccttccctcacaatgagtactaaaatattatagttattatttaaaattgctttaaattataatgctgactaattaaatatatgcaatcgcttgcaaaaaaattcagactatgcaactatgttaatatgtttataaggatacttttttgttttgagcttcatcactcatacttttatttccatatttaaagtatatcagcttaagtaaacttttacaagactaatttttcccaaatttcatactaaaaagcttgtttacttttgcttttatatgattttcttcattttacaaccgttttcatgatttttgagttttgttattattttttatcacatttttgcatgttctcaattaactttaatttattaattctcgaatatttttttatttcatattctcttctcatagcatcacgcttatcattaaattcttcatgatataccaatcttaccgggcctcttcctctcgtatattttgctcctgttccattgcaatgctgttctatacgtttatctaagttatttgtccatcctgtatacaatgttccatctgaacattctacaatatatacgtaattcatcatcttatccttccattcattaaaatcatactatcttctatctataataatacaatatatcttatacatatcaaaactctatactgaaaattctattcatttctattagatataattaattcaattatgaatacaaaacttaataatatttatatttttactcaaaaaagagagtgaataaaaaatattcacccactatctaaaatttttcttattcttcagtcattatttcatcaataggagcacctggtgctaccataggaaatacttttttatctgaatcaattacataatctattaatacaggaccatcacaataatctaaagcttctttcaatacatattcaatttcatcagccttagttattctaaatccttttccaccaaaggcttctgcaagcttcacataatctgttggtctatcaagagttgtttctgaatatctctctccgtaaaataaattctgccattgtctaaccattccaagacaattgttattcattataatttctactaaaggaagtttattcttaacagccgtaacaaactcattgcagttcattccaaagctaccatcaccagctatatttataacttgtctgtctggtctacctacttgtgctccgattgcagcaccaagtccatatcccattgttccaaggccacctgaagttataaatgttctatgatttttaaatttaaaattttgagctgtccacatttggtgttgaccaacttctgtagaaataacaaaatttccttctttatttaaatcatttaatttcttaaacaataattcaggacttgtacaatcacaattaatttgcttatttaaaatcttcaaaccttctattttatcaagccattcttgatttttcttattatctactaattgtataagtttctctaatactacttttacatctccaataatagctgcatctacttttatatttttattaatctcagcaggatctacatcaatgtgaattatttttgcattcttaatgtgattttgattgctaataaccctatcactaaatcttgctcctaaagttattaataaatcacattttgttgctgcaatattagatgcttttgttccatgcattcctatcataccagtatataattcatgatcattaggaaattcagagttagccatcaaagttgttgaaaccggtgcatttatcttttcagcaaatacaacaagctcttctgtagctccagatattcctattcctccacctgcataaataaaaggtctcttacattcattaattaaacttacaacctgttcaatatcagaatccttaattctttcagtacttcttgtaatttcttttggaataatctttttatattctgctttattagcagttatatcttttggaatatctattagtacaggtcccggtcttcctgactttgctatataaaatgcttcttttattatatcttgaagctcatttacatcacttacaatgtaattgtgctttgttataggcatagtaattccttttatatcaacttcctgaaagctgtcttttccaagaagtggtgttgtaacattccccgttatagctaccataggaacagaatccatatacgctgttgcaataccagttaccagatttgttgcacctggtcctgaagttgcaatacatacacctacttttcctgttgccctagcatagccatctgctgcatgcgctgctccttgttcatgacaagttaaaacatgatgaagcgtatccttatatttataaatttcatcataaatattaagtacagccccacctggatatccaaatatcgtctctacattttcatcaattaaagactttattagtatttcagcccccgtcaataacattttattcactcctttgctcataaaatgatttcaattcatcacttactttaattttctatataaaaatactttctacgaaattttaaaaatttacataatgtatgtaattcaaaaaatttcgtagaaattttctcactaactgttaattgttaactgataactgttaactatttaagtattgctccttctgctgcagaacttacaagtttagcatatcttgctaaataaccttctttaacttttgcttcaagaggtttaaaattctttcttctttcttctaattcttcatcgcttaatttaacttcaagcttattattattaatatctattgaaattatatctccatcttttaataatccaataactccacctgctgctgcttctggagaaacatgacctatagatgctcctcttgttgcaccactaaatcttccatcagttattaatgcaacagaatcatctaatttcataccagcaattgctgctgttgcttgaagcatttctctcataccagggccacccttaggtccttcatatcttattacaataacatctccagcatttatctttttatcaaatattgctgcattagcttcttcttcagaattaaatacctttgctggaccttcatgaactaacatttgtggtaacactgctgctcttttaacaactgctccttctggtgctaaattccctctaagtattgcaattccacctgtttcactgtaaggattatctattggtcttattacttcataatcttgaacagacgcaccttctatattttcccctaatgtttttcctgtaacagtaatgcaatctaaattaagttctacctttttagataattcacttaacactgcttgaattccaccggcttcatataatctttcaatatgaatattagatgctggcgcaagcttacaaagatctggtgtcttagctgataattcatttattatatctaagttcatattaacctttgcttcatttgcaatagctgtaatatgaagaacactattagtagaacatccaagagccatatctgctcttagtgcattcattatactcttttcattaacaatatctcttggcttaatatctctttcaagcatatccataactgccatacctgcttgttttgcaagtcttattctttctgaataaactgctggaatagttccatttccaggtaaagcaatacctagtacttcacaaagacagttcatagagtttgctgtaaacatacctgaacatgatccacatgttggacatgcgcatttttctatatcacataattctttttcatctattaatccattttcataagatccaaccgcttcaaacattgtagaaagagaaatagcattacctttatgttttcctgcaagcattggcccaccacttaccataactgatggtatattaactcttaatgatgccataagcatccctggaacaatcttatcacagttaggaattaaaactaatgcatcaaatgcatgtgcttttgccatacattcaattgaatctgcaataagttctcttgttacaagagaatatttcataccttcatgtcccattgccaacccatcacaaacacctatagctggaaccacaagtggagtaccacctgcaagtgttatacctttttttacagcttcagttattttatcaagattcatatgtcctggaataacatcactttgtgcagatacaactcctattattggtctatttatttcttcatcagttaaacctaatgctctaagaagagatctttgagctgcctttccaggaccttttttaagtacatcgcttttcatatgtttctacttcccttcaacaatttttttacaaacaagatcacccatttctgttgttcctaccttgtttttaccttcgctcattatatctccagttctatatccatcttcaagaacttctaatacagctttttctatagatttagcttcttcttctaaattaaaactatatctaagcatcatagcagttgataatattgttgctaatggatttgcaattcccattcctgcaatatcaggtgcactaccatgaattggttcatacattcctaaagtgccatctccaagtgatgctgatggtaacattccaatagaacctgtaaccatacttgcttcatcagataaaatatcaccaaacatattagaagtaacaattacatcaaattgagttggatccttaacaagttgcattgctgcattatcaacatacatataattaacttcaacttccggataatcattaatcatttcaccgataacttttctccaaagtcttgaactttcaagaatgttagctttatcaacacaagttaatttcttatttctcttcatcgctgtttcaaaagcaattttaacaattctagttatttcagttacattatatctttcagtatcataagctgattctactccatcaactgtttctcttcctctttcaccaaaataaataccaccagttaattctcttactatagcaatatctattccatctccaacaatactatctttaagtggtgatgcattttttaatggtgcatataatactgctggtctaaggttacagtaaagattcattccgcttcttaatcctaataatgcttgttctggtcttactttagcatctggatcatcccatttaggaccaccaactgctccaagtaacactgcatcatttctcttacatatttctaatgtttcttttggaagtgcttctcctgtcttatcaattgcacatccaccggcaatagcatattcatactcaaatctatgtccaaatttatctcctactgtctttaatacctttattgcttctgctattatatctggacctattccatcccctggtactacagctatattacatttcattttactaacccccatttttttagttaacagttaacaggtgtcagttaacagtttatttgaaaactactttgtagtttctaatttagtaatgttactgcacttgttaattgccaacttatttttatacatttagctttattttttattcaaatttgtatcttaaataactgttacttgttaactgttaactgctaactattcttaatgtatcctataagaccatcattatcgatgattttctgcatgaattctgggaatccttccccttgatattcttgatttttagttaaattcttaattaatccactcttaaaatctacttctaattcatcaccagcatcgatattctttacagcttcatcacattctaatattggtaatccaatattaattgaatttctatagaaaattcttgcaaatgtagatgctataacacagcttacacctgctgttttaatagctaaaggtgcatgttctcttgaagaaccacatccaaagtttttatttgcaacaattatatctccatctttaacattctttacaaaatcagcatctatatcttccatacaatgtgcagcaagttctttagcatcagatgtatttaaatatcttgctggaattattacatctgtatctacattatctccatatttgaatactctaccttttacgctcattactaaataccccctacactaattctggatcagttatctttcctgttattgcagatgctgctgcaactgctggacttgcaagataaacttctgattcaacatgacccattcttcctacaaaatttctgtttgttgttgatacacatctttcatcttttgctaagattcccatatgtcctccaaggcaaggtccacatgttggagttgatacaatcgcaccagcttcaattaaatctttaattattccttcttctaaagcttgaagataaatcttctgagttcctggaataacgatacatcttatagttttatcaacttttttgcctttaagaatatcccttgctactcttaaatctgaaattctaccattagtacatgaaccaattacaacctgatcaatctttacatcaccagtattatcaattgttcttgtgttatctggtaaatgtgggaatgaaactgttggtcttaatgtacttaagtcaatttcataaacctcatcatattgtgcatcttcatctgcctcatactttttccattctcttttagcatgatcttttaaatattcttcagtcttttcatctactgggaatattccattctttccaccagcttcaatcgccatattagccattgtaaatctatcatccatagaaagatagtttaaaccatctcctacaaattccattgatttatataaagcaccatcaacaccaatcattccgattatgtgtaaaattatatctttaccacttatccattttgctggtttgtttttaagaacaaactttaatgctgatggaactttgaaccaacacttacctgttgccataccagctgccatatctgttgaacctatacctgttgaaaaagctccaagtgctccataagtacaagtatgagaatctgcaccaattactacatctccagccacagctagtcccttttctggtactaaacaatgttctattcccatttcaccaatttcaaagaaattttcaatttccattttatttgcaaactctctaatatactttacttgttctgccgcttttatatccttattaggagtaaagtgatctggaacaattgctatttgacttttactaaataccttatcagttccaaacttcttaaattcatttacagctactggagttgtaatgtcatttcctaatactaaatcaagatctgcttcaattaattgtccagcttttacacattctaatcctgcatgtgcagctagaatcttttgtgtcattgtcatacccatttctaatcatctccttaaaaatatgctttaacttttctctctatatcttttaataatttatactctattgaatctacaagtgctatccaactagcttgtattacgtctctagataccccaacagtactccatgtatcaattccgtcagttgattcaattaatactcttacttttgcctctgttgcactttctgaatcaagaactctaaccttataatcaacaagtcgtgctttttttaattctggatagaagacttcaagtgcttttcttatagctttatcaagtgcatttacaggaccttctccctctgctgctgtcatttcattttgctcatcaactgtaatatttattacagctgtcgatgaaaaagcatcagatccatatggttgttcaccaattatcttaaaatgattcagtttaaagaaaggtttatatttaccaataatttttcttattattaattcaacagtgccttctgcaccttcgaactgatatccttcatattccaattcttttaatctatctgtaattttttgaactgctacatcatcttttgatacattaggaaaaatctttttaatttcttgaagtatcatactttttccacttacttctgaaactaaaaaccttctcttattacctactagtttcggatcaatgtgttcatatgattttgagcattttgttactgcatcgatatgcattccacctttatgtgcaaaagatgaatttcctacaaatggactttcatcatataaagtcatattacatatttcagctataaaccttgatgttttagttaatccaaaaagatcaattccatctaaaatattcatttcaagtttaagttttaaaattggaatgattgagcttaagtttgcattaccacacctttcacctatgcctatgaaagttccctgaacctgctttgcccctgctttaacagccataattgaatttgcaactgccattcccatatcatcatgactgtgaatgcctacttcagcatttaccttttcaattactgattttgttatttcatatatttcaggtggtaatgtccctccatttgtatcacataatacaacggtttctgcccctgcttgctctgcagcttttattgttgccattgcataatccttattagatttgtatccatcataaaaatgttcagcatcaaaaattactcttctaccctttttctttaagtaatgaattgtatcacttatcattttcaaattttcttcaagtgatgtttttataatatctgtaacttgaaaatcccatgacttcccaaatataataagtacatctgaacctgatgagagcaaatcttgtatgtttttatcttcttcagctttaatattaggtcttctggttgagccaaaagctgctatttttgaatttttcaattctatttcattcagtcgtttaaagaattccatatcctttggatttgatcctggatttccagcttcaataaaatcaatatgcatatcatctagaatcttaacaattttaattttatcttctaaagaaaaagaaattccctggccctgagcaccatccctcaaagtagaatcaaatatttttacctgattctctgccatatgttatccccctttatattattccattgcctattatgcttacattgtttttactgccattgctttgtttaaatgcccatttttttattcattgcttattctactgctctttttaattctctatagtattttttatggttttttcacctctttgaagcgctgtaactccagttcttgcaacttcttctattccatattctttcatcagattaatcaatgctgatatcttctcttcatcacctgttaactcaattgttaatgtgtctgttgaaatatctattattttacttctaaatatttttacagtttcattaattgctgccctgttctcagcgtttgctcttactttgattaaaactaattccctataaacagattcattaactttaaaatttacaactcttataacgtcttccagcttatctaattgtttttttacctgttctaacacatcgtcatcagccataagtgtaattgtcattcttgaaatagatgggttctcagtacttccaacagttaaactgtcgatattatatcctcgtcttgaaaacaatccactaactctgcttaaaactcctgatgaattctttactaaaacagataatacatgcttttccattgcttgccccccttaaaaatagttaaaaaaatccacccttaatgatataaatcataagaagtgggataatattccgccttattaatatcactaggttctaacaaacccttgcatataacggatgcacaccggatatcttttactcaagaacatataattctctttcccgattcagctcaggagtgataattaaaaaactaaagtatcgattcacaccaaccatcgactctcttaaacttttttctgtttgataactgtctccttcttagcatttacaagctttaaggacatattcaattttcctgttacagtagattttactctcgtgttttaccattgtcaacattatattatattttttaccattcttattttttaacatatttttagaattaactttttattattttattattatttaaggtatttttttatcattttatcatcgtattcttttatcatttgacacattgtttttaattttagttatataattaaaataaagtatttgcactaatctatctctccataagtttccataatatcaattggttctacatctgatattaataaatccaaattattatcataaatattaaaatcaatgtctgcttcacatagtctttctactatctctttcttttctgtatcgaaaactaattcatcactaattttatttattacctcctcagttttatataactcacattttccttcttcaacgccaagtttagtgcatatgtttattcttgtatctcctgatccgatttcagtcatgtcattttcatcatcatcatcaatattttcatcaattgctctttcataatatatatttatatatgctttcgctgactcaaaatcattaaatcccttacaagtaccttctggcataattaataaaaattcattatatggttctctattcataaactaatttgcgcctcctaatacattaagtctgtcaactttatatatcccctactaacgcttttgttattcagtaacattataattaatagaaaataaaaatacacttttcacttggataaattctattatccaagataaaaagtgtatctctataaaattagttatataatttttaattatgcatattttctttgaattaaatccgctaatccatgtgccattttatctatttcttcttgattttcaccttcaagcattactcttactaatggttcagttcctgaaggtcttataagaactcttccaactccatttaatgcttcttctatctttttaatctcattctgtatttcatcatcagttaagtataagtttttcttttcattaggtattgtcgcattagctaaaacttgaggaagctctttcattatagaacataattctgataaaccagcttctttctttttaactattgatgcaatttgaagagctgttactaatccatcacctgttgtattgtaatctaaaaatataacatgaccagattgctctccacctaaaacatagttgtccttaatcatttcttcaagaacatatctatctccaacacttgttttaactatattaataccttcttttttagctgcaatgtctaaaccaagattactcattactgttactactaaagtatcatctttaagcttaccaatttcctttaaatatttagcacataacattagtataaagtcaccattaacaaggtttcctttttcatctactgctaaacatctatctgcatcaccatcaaatgcaaatcctaaatcgcatccttttttaaccacatattccattaattcttctggatgtgttgagccacagttttcattaatatttgttccatctgggttatcattgataacaaaaacctctgcacctaattctctaaatgcttttactgatgatttatatgaagctccattagcacaatctaatgcaatttttaatccctttaaactataaggaattgtttctttagcaaattcaatatagtgatctaaagctgaagtttcaattgtttctttaccaatatttgttcctattggacttggaacaccttcaaaatcgctttcaataactctctgaatttcatcttctaattcatctgataatttatatcctttgtcattgaagaatttaataccattatattctactggattatgtgatgctgaaatcataacacctgcatcagctccgtattttcttgttaaataagcaactgctggtgttggtacaactccaagtacaacagcttctgctcctacagataaaatacctgctattaatgctgattcaagcatatctcctgatattcttgtatcttttgcaactaatattttaggtttatgagcaccttcagttaaaacatacgctccagctcttccaagattatatgcaatttgtgctgttaactctgtattggcaactcctcttactccatcagttccaaacattctacccataattttacctcactttttttattctgttattatctccgtatcaaatatatctaaaaatatatacatagagataatatatatagttctttcattattatactatttcaattaagcaataaaggatatcaatttttataatttatacaaaaattcgccttaaaatagtataatctttttctcaaagatttacaatcaaatatatatataaaatactatttttcaacctaatattcttaattacgcatataattaattattttcatccatgctatcttttagcttttccaatactaaattatatccatcactaccataattcaagcatctatttactctgcttattgttgctgtacttgcacctgttatttctgcaatttctgaataagtattcttctctttaagaagagttgcaacatgtaatctttgtgctaaagcttttacttcatttatagttgctacatcttcaaaaaatttataacattcttctatattatcaagttttaatattgccttaaagaataaatctagttccttgcttttaatttttgattctaacgaactcattttctcacctcatttatctattctcccctcttcattataactatcatctttacactttacaactttaatctaatatagcattgaatttataattaatcttcttctgtattcattctatgttgagattttctcatttcatttaaccctttactttttaaatcactataaacgctttttgttggaacaagccatacttctcctgatcctctataaacattaacaagaccttcaccactagtaacagatccaacaattgattttgacgatttttctactgtaaactctatattgccagtccttaatattgcaaaatttccatcaacttttaaagtgtcatctattaatatgcatttaaatatttcactttcaggaactggtatttctaatgcaactataccactaccacttattttagtctgacataaagtctcatctcctaaaagtgctgctgataagtttcgctgaatagtaactccaacttcaacgctactttcacatgcaaaaaacaatccatcatctacaattatttcatcatcttcaagttcaattaaagcaaaatttccaaaggatggttctaaaaaaatttctcctgtaccgctataagttggtttaaaaacagtttcaccagtaagcttgcttgaaataagctttttaccaaatcctagtacaccacctgttttactacttatctttatatttcctttcatataactcaaagctcctggctcaagtatcacactactattttctaaagctattctaatctgtttaagctttatcccactttccctaattatgtttagtccaaatgctgattctacatctgtagcaccttctaaattttcgtattctaatatttgaaatattgagtcattctccatctcagcaagcttgcttaacttatttgtaaaatttaatgaacttctcatagttaaaactccttctaaaatatagcatattgcttagtaacttaaatcctcaattaaggttttatatgataattttaacatatatactactatctactgtaaaattattacctaaaaataaaaagctaaaccaaacatattaaattgtccagtttaacttttaaaatgatacttctattctattgggtttgaatctataaattcttttactatttcatcatgatatccatctgtattagatatagttacagaatagtaaattccatcattctcccacatatatcctgcatctcttaaatcagaattgtttccattatcataatatttactatatcttaaaatatctttattatctattttaatactttcaacactaactttatcattatcataaaaatatccttttgatttcgcattagtatacttatttaatatatcatgcctgctctgagtaaaaagcaaaatactattttcattataactataacaattgtacatttcataatttatattattttcatctacattagaatctgttgtaaccgacagttcagcaaattcaattggttctccattaatttgcagtggcatatttggattaaacccaagtatatcactggcatatcttaaatcttctttatcatatatatctctcaatattccagctttctgttgatttttcatattaaatttataatctatattatttaactcatccaaattcttaaatgattcaactatttttttaatattatctaatgatatgctattttcatcagttatctctccatttatctttgttagctgataatactttatacagtagcaaagatctccatcattccatgaataatatttccttattctttcaaaatcatcatcaacaatagtagttgtaatacattttccatacaatccatcaattttatcgaaattttcttcaatattaaattgataatccaatgatagcttatcaagttgaattctttcattaaatgttgatttttccacccctgtcaaaccttctaatacatctccattaaaaatctgtaatgtaaatgaatctttactaatatcataatccttattatagaaaaatatcttaactgcatttttattatcatctatctttataagttctttcatcttaggtaatgtttctaacgtaaaatcaggcaatttgaaattttctccaaacacattattcaacctatctatatcattataaatctttgtatcactatcaattagaaattcatgtttatcatctatattagtctgtgtaactttttctgtatctatttgattattacccttcccctcattatccaaattcaatgcatttactttaataccagttgtaaatagaactgttgtaactaacatgcatcccaaagcggttgctagagtaattttatatgatccacccttaaacctttttatcatctctattctctccctaattttattgtttcctttaaactccaatctagcatttaaattattcttattaaaaaacattttagataaatttataattgtcattccataatcaatactgctatcttcccctaaaatctcaagaacacttaaatcacatgcacattctctataaatcttcattttacctatcaatatccataccaatgggttaaaccaatgaaaagcaagtaaaattcctgataaaaaattaatgtataaatctcttcgcttatagtgcataaactcatgaagaagtacatgtcttattgtttccttatcaagcttaaaaatatattgtggcaaatatattttaggtttaataattcctattatgcatgggctatccattccgttgcatatataaataggaatatttctttttaagtttttattttttattaaactgtacatatattgttcaatttcattattattaattttttctgctgactttgaaaatattttaaatttaataactgacatattaaatactaatgctactattacaacacctaaactccaaatcaaagtagatatatacaatatatttacagaatgattatattctttaactccatctgaatttgttaaattattttctaaataaatattattgttttttttaatttcgtctgattttaaaatatcattggatttcaaggcattatcatatggcattcctttaaattctctatcattatattcttgagtttctttaacattatcataactacgcaataggtgtgcaaaactaatatcaatgtatggatttataggcacaagaatccgtaatagtatcaaaaagcataatatatgtttaatccttacattgatctgcttattgaaaattttaaatataaacaaaacagttaatataaaaatcgtacctgttaatgaagtttctaaaaaattcaagaataattgctctaaaattttcaatagtttacctcctaactattggctaccttatttctagtctatagttttggaattaataaattcttttgctatttcatcatgatatccatctgtattgaatatagtcagagtataataaatatcatcttgctgccaaaaataatctacacttattgtttccttagaattttcttgatctacatctttttccagatttctatatacttcattaccatctatatagattttttcagtattaatattagtttcatttatataaatatatcctttatccttagcagtagcatatctattaaaagtatcatgtttgctttgactaaatgtcatcatatttttatcatcttcataaaaattatttagttcataatttatattattgttttctacatcagaatcacttgtaattcctaccattgaatcttgtatatttatgctattaatagttaatggcatcttcggattaaatccaagtattttttgtgccttattaagatcatctttatcataaatattcattattcctgtctctgttgataattcctcaggaactactgataaatagtcaacatcttttatttcatctatattctttaatgaactagctatcctatctaattcttcattttcaaatttattatcttgtttaacttgtccattgatttcatatctatttgcatatggtatagcataaaatattccatcattctcccatacaaaatatttaccttcatcaattgactcaggaactatctgattatctatagctctttctggagtagttatttttaaagtaatacttttaccataaacacttccaacattcatttgttctttgctagcctcaattttgctattacttctaccaaaacgattatggctttcgtaaattttgcttaaagcttcaactggatcatctttaaatatttctaatgtaagatttttattactatcgccatctctaaaatgcgcatctattacattactatcatctgaaatctttataacctgatatattgaatcaagtttcccatctcctaacgaatagtctggaagtttaaattcaaatcccgaaacttcttttactttatttaaatcatcatatgactttaatgtactatcaattaaaaattcatgtttattctctatgctagtctgattataggtattctgactagatacactgtttacatctaaggcattaacagtaataccatttgtacatacaactactgccgccactagacatcctaaagctgctttagctgaaatcttatatgaatcatttttaaaactttttatcatttctattctccccttaattaagttatttctttcaaacccaagacctaactgaatatttcttttattagttactattttggataaattgataatcgtcatgccataatctacatttttttcttccccaagaatttgaagtacaaaacaatcacatccatactctctataagtttttaatttctttagcgctatccttactaacggattaaaccaatgaagtaatagaataatccaacaaataaaattaagatataaatctttccttttataatgcattaattcatgtaataagatatgagaaatcatatcttcatcaagttctaaaacatagtgtggcaaatatattttaggtcttataaatcctaaaatacacggactctttttctcatcacatatatacacattaatattacttttcaaatttacattccgttttagcttatttagtatttttataatgttcccatctttaattctttccatattattggattctgttttaaatttaattaatactatcattaatatacacgttagaattcctaccccaccacaccaaattattgctcctgcatctacaatattttttaaaatatcatttacttgattctgaacttgatcattctttacatttaatttgtcatgattacttgtaatgggttctttattgattgttccaatctcatccttcttaatttttgaattactagtgtattcctctgatgatttattttgattatttccttgaataatctttagaacttcacttatgtttatcttaagattggtttgtgttgttacaggtactacaagcctgattagtatcaaactcatcaacagatatttaactcttatattcagattattgttaaataattttaaaatagcaaaaattattaatatgataattccagctgttaatgatgtttgaaacacgattaagaaaatctgttctaaaaatctcattatataagcactcctcttatatcccctattaattatccctcaaattttcctctttcttttccttaagtattctttcaagttcttcaatttcatttgttgataaagtttcctcttctaaaaagttacttaacaacacacctaatgatccactatagactttttgtaaaaaggatttattctcatattttctacagtctttctcatcaactaaaggatagtacttatatattctgccttctttttcataccctattgcagcttttttagttaaacgtattataaatgtctttaccgtttgctttgtccacttcttatcctcactgagacagcaaattatttcctcggatgttaatgggctcttattccagagtaatttcataacttcccattccgattctgatattttaggaatttcagtcatatttacacctctttactttttagtttacaattgtaaattatatattcagtttacgtctgtaaacataaattgtcaagaatatttttacatttattttatttaattccataaaatttataaatttaatagtaaataaattaaagcatagtagtataaattttttatactactatgcttatacaacctctattgtttaacctaatcaatttcactcatcgctacatacacaaaatgagttctgaagttcaatatattcttctctgctcaatgattttaaaaatttttcataatgctcctgattacaaaacttccctactttatttgatacatatttatcatccaattgttttttacaatataaacatttctccataatatgctccaatataattgtatttttaattatcttttctaaatttaaaagtattatacatcaatagttcttaactttactttcataagcaccattgaaataatcattgctacaaattcagataatggaaacgaaatccaaactccatttattccaaaaacttttgcaagaattattgctgctggaattatgataactagttgtcttaacaatgttatagttaaagatcgcatcccatcaccaataccttcaaatactcccgaaaacactataggtatagctgaaaatataaaacctgtacttataatttttaatgctgggatacctaatgccattaggtcactttctgcattaaacatttttaatatataacttgggaaaaatattgaaatacagcttcctaatatcataatcataattactacagcaatacttgtttttattgtttttaacattctctctttctcttttgctccataattatatccaataattggtctcataccttgtagtaatccatttgctggcatatatacaaaagtttgaagtttaaaataaattcctagaaatgcaactgcactttgagataacgttactaatattccatttaaaacacttactaataccgatgggagagccatcataattgacgatggaagaccaactgaatataaactcttaactatctccttatcaaatttaaatcctttgaaagatactattattccatgattattttttctaaatataattacatatattatgaatgcagacatctgtcctataacagttgcaatagctgctccaacaactcccatagctggaattccaaaccctccaaatatgaatataggatctagaactatatttataatacaccctacaatttgaagtaccattggaataatcatacttcctattgcctgatacattttttctaatacgagctgatacaatattcctattgaacaacacattacaataactccatattcatatccccatttaaatatctctgggtcatttgtaaacattcttaaaaaaggttttgttaaaaacattcctactaaaataaatattattccatgtattaatgtcaaaattattccattagaaactgctctgtttattttttcattattctttgcaccaagattaatagctatgcatgagtttaatcccacaccaaatccaatggcaactgctgaaaccatattttgaaggggaaatatcaatgaaactgctgttaaagccttttctccaatttgtgctacaaagatactgtcaacaatattgtacattgattgtattagcatagagattatcggaggtaccgacattgtaagaagtaagcttaatattggttttgattccattacatttttacttttgttcatattttcttcctttccttacattaatttttagaagcgcaaaaaagagctataaattcatctgtttgaatcagaaacagaaaaatttatagcccttaggcatcttattcacttattaattatcttatcaaatttataaatttctttcaagttatatttcaattactaatgcagtaatattagccataatatgtattgttttatgataatttaaacgaacttatcatttcatccatattttctgatgaatattctaacgcatttgtagcattgtttaactgtttaatttctaaaagtatatttttaactacatttagagattcttcgcttttatttgaactattttcagtcgcttcattaactttatcagccattatactgacattattcattacatcacttacatcactactttgagttgaagttatttgtgctattgtgctcatagattttgatatcatatttatatcttcatttacttttataaatgattcaattgattctgaaacatttttcatagaaacatcaactttagaattgatatcttctgcgtattgaaacgcacattgtgtctgttcctgaattgaatttattatattatctatagattttgttgcctgctgactttcagttgctaattttgatatctcactagcaactatggaaaatcctcttccctcttctcccgctcttgcagcttctatagtagcatttaaagctaacaattgtgtttgttcacttatatcgctaattaaattcattacatttgttatttcttgagaattcttctttagattttcaattgctaaaactgttttctttattactgtttcaagttccttcatattatttaatactccagtagaagattcatttgcttttattgaagtatcatttgtttcttgtacaatagatgaaatatctaatattaaactatccatttcttgaatagatgcagttatatcataaaatttgtctctagtattttgaaataccgaattctgttctttggaattttcaagaagatttacaactgtatcttctattttaaacataccatctttaacttcatttgttatcttagatacaattccaaccgaatttttagtagtttttactgatttctttactcttcctaaaatagtcatttgactgtttataaatttattaaaccatctagataattctccaatttcatcattagaaagcttatctactcttttagttaaattgccttctccctcagctatttcttgtaatatattaagagtcttatttaatggtgattttatgtatttattacatattactactgataatattgatattatcagccattctaaaactactgctaatatacccatatcaggtattatacttcttaaaacttccgtaccaaataatagaattgctgatattagtgatatgtatcctggtattttaaaatttatgcctttaaagtcataaatttcatcaatatcgccttcacacatcatcccccagacttcatcacaattaggaggtgtaattattgtcccctttcctcctaccataatatgcctataatctggataacctggccaacagtctaaattttcaccattctttatagtattcgctacaccttgatgaagctcattagttgccggatctttaaatattatttcaaattcagtatgcttttctattttaacttttccccactgttttgtattcactccatctttaagattttcacctaaagtaaaagtattatcttcaaagcggcttctggaaatagccgttcctggttctatacctctattagacttaaccataaacaaataattatcaccagaatccttatatatatgagtatcttcatcttgaataacattactcatatcatcatttaatgtcctacagcacaatatccttgattctccatggtgatttttacatacacatgaaaacataagtgtaacttcatcaacgaaacttttttctctaatatcaatttctaatgttttttcatctatatatggcccatacattaatgatctattttcttttcctgccatatagttaggaagatagctcatatctaaacctacatgcttgctacacgaagacactgttacaattccattttgatctaatataaatatctcacaaaaatcttcatattcttgaactaacttatatagatagttattaattatctcatcactattctctaatgctgtaagagaattttttatattatctatctgagcccacttatctataaaccagttatctaatgccttttttcttccatttgaaattccttcaaatgccttcatagaatgtttttgcaattttcgattcattaaatatttcatttttatattcatttatcagaccccccaaaaaaataaagtaccaaaaacaaatattcaatcttttaaatttgaatatttactcttagtactgccatagccctatttattaaatttattaataaattataccatttgaattaatttttgtaaataatttcgttctattctttactaaattaactttctcaatcacttattaataaatgttaaaaaagctattatactttctaattaaagtataatagcttctaattttatatatttataaaatacaactaattttaactattagttatttattaacttgtcgttttcgttattccagctgtaaagtttacggatttcttctccaactttttctgactcatgttcagcagctaactttctcattgccttaaagtgagcttgtccgcctgcttcagacatatctaataagaaatcttttgcaaaagttccatcttgaatatcctttagaacttgtttcatagctttcttactttcttcagtgattatttttggtccagtaatataatcaccatattcagcagtattagatatagaatatctcataccagcaaaacctgattgataaataagatctactattaatttcatttcatggatacattcaaagtaagcatttcttgcatcatatcctgcttctactaatgtttcaaatccagcttgcattaatgcacaaacaccaccacaaagaactgcttgttcaccaaataaatctgtttctgtttctgttctaaatgttgtttcaagaacaccagcatttgccccaccgattgctgatgcatatgcaagagccatttgtaaagccttacctgtagcatcttgatgtactgctactaagcatggaacaccttttccttcttgatattcacttcttactgtatgtcctggtcccttaggagcgatcattgttacatcaacatccttaggtgcaactatttgattgaaatgtatattgaaaccatgagcaaacattaacatatttccagcttctaagtttggttcaatatctttcttatacattgatgcttgtaattcatcgttgataagaaccatgattatgtcagctctttttgctgcttcagctgctgtaaatacttcaaatccttgatcttcagctctagcccaagatttacttccttcatataaacctataattacattacagcctgactcttttgcatttaatgcatgtgcatgtccttggcttccgtaaccaataacagctattgttttaccatctaataatgataaatcacagtcttgttgataaaaaattcttgcgtctttcatgtttatacaacccccaaaaagataaattattattgtcttaaatttgcattacttacagcttttataatagatattgtaagttctgtaactttaaaatcattgcttaaatttcaatataagtattaaattaatagtaatttaataactttatttttacttttttaacgattttctatcatttcgttattatttttagtataacaatactggttgtttttgtcaatgtatacttaatttaaaaagatgattaatatttaaaatacttcacataattagtatatattctaaaattcattctattatgatacttactttttagacaaatttaacattattattattattcaccgtattttttttcatattattaaatttgataaaagtgatagttatatttaagattttaataattagtagctagaattatcaaattcatttttataaattccattttttcctattttaaatggcaaaataaaaattcaaaaaaaatacatacttagtaataataacactaagtatgtatataaaattaaaattaataaactttagccttttcttctccatcaagaactcttatagcaccttgagctaaagctaacaattcatcttctcctggatatactgttactggtgcaatccattcaacattagcttttaaatctggtacaagtgttggagaatatgcaataccacctgttaaaactatctgatcaactttaccatttaacgcagctgacatttctccaattgcttttgttatttgatataagaaagctttatatatgttttcacattccttatctccagcttccatcttatcaatagttccttttacatcattagtatttaaatatccaacgaatccacctttaccaactattttgctgtatacttctgattcgctatacttaccactgaaacacattttaattaaatctccagctggaactgatccagctctttctggagaaaatggaccatctccatcaagtgcattgtttacatcaacaacttttccatgattgtgagctccaacagaaactccaccacccatgtgtacaacaacaagatttaaattttcatatccttttccactttcttttccatatctctttgcaactgccttttgatttaatgcatggaacttactttttcttggaatatctggtgtaccagataatcttgcaacatctgcaagttcatctgtaacaactggatcaacaatgaaagatggtactcctatttcatcagctattgatcttgcaagtatacctcctaagttagaagcatgaggtccttgaactcctacctttaaatcttctaccattgcatcatttacagcataagtaccaccttcaactggtttaagcattccacctctaccaacaacagcacttaatgtttttatatcaaagtttttttcacttaaaacttttaaaattacatcttttctaaattgaaattgatcaaaaatcgcatcaaactgctttaattcttcatttgtatgtcttaatgtttcttcaaataattctttttcatcttcatatacacctatttttgttgatgttgaacctggattaattattaataatttgtaagccattttctttcctccatattttcattaaaatctatctacactgtgatttaatataaattcccaagaattatatcctaaagtttacatttaatattctactatttatttttagctgcaactaatgctgctaatgcaattgaattaacttttgtttcaaaagtatctgctcttgaagtaagaattgctggtgctgatgttccaactaaaagacatccattttttgctggtgcaaaataagttaatgttttatacattacatttcctgtttcaatatttggcatcactaaaatatcagcttgtcctgcaacttcacctttaacgcctttatgttcagctgcttctaaagatattgcattatctaaagcaaatggtccatcaacaacgcatcccttaaattgtcctctatcgctcatttttgcaagtaatgctgcatcaacagtcgatggcatattaggatttacaacttcaactggacatacaaccccaacctttggcatatcaaggccacaagcatgtgcaactgaaacagcattattaataattgtaactttatcttttaattctggataagtattgaatgcaacgtctgttaagaagaataatctatcccatccttctatttcaaatacagatacatgggacattactttaccagttctaagaccaacctctttatttaatacacttcttaaaaatgtagctgtatctattaaacctttcattaacatgtcagcattcccgcttgatacaagcttaactgcctccatagttgctttctttggatctttaacatccattatttcaaatttagttaaatccatatctattttttttgcaatttcatgaatcttatctttatctcctactaatacagcattagctattcccttttcattagcttcttttacagcttctaaaacaggttcgtcttgagctactgcaacagctacttttttagtttcaacttcttgtaatcttgaaaataaatcatcaaaatttttactcatttcttgcacctctttatttaaatttaattacttagcattgttaaaattatatcaatcaaatttatgtcaataatttctttataatactattgtaacaaaaaataactttaaatgctaaattttctgaaaatttattttaatatttctgtaatttttatgtatttttttattaataatccaaataaaaagccgctatctttaaaagataacagcttttatattacacaaaaaaattaataattaattttacacaaaacagagtgtaattattttaacaattttttcatactatttttgtggagccctatatttatttattatatgttctgcaacctttattccatcaactgctgctgaaattattccacctgcaaatccagcaccttcacctgtaggatatagaccttctacattaatactttctagagtttcatttctgtgtattcttactggtgcagaagttcttgtttcaattcctgtaagcaccgaatcatcatctccatacccttttatttttttatcaaaattctgtattccttctttaagtgcttctataacataatctggaagacagtctttaagttctttaaacacataacctgccgtataacttggttttacttttccaagcttagtagatactctatcattcatgaaatcacccacaagttgaactggtgctttgtaatctcctccacctaatttaaaagctaagctttcataatgcctttggaattccattcctctaagtggcgaatctccctcaaaatcttctggagatacagtaacaactaaggctgagtttgcattttcaagatctctagcgtgatagctcattccatttgaaactaatctttcatgttctgaagatgctgcaacaacaacccctcctggacacatacagaatgaataaactcctctttttaaacgttcgctttgatatgtaagcctataatctgctgaatgtaacttaggatgattatagctttctccatactgactaaaattaattacttcttgtggatgttcaattctaactccaatagcaaaagcttttgcttccattgaaactcccttttcatttaacatttcatatgtatctcttgaactatgtcctatagctagaacaagtgcctgacaaggccttttttcaccatttacaactatatatttaagttttccatcttcatactctattttttctactttagaactaaaatgtacttctcctccaagactcttaatttcttctcttatatttttaacaacatcttttaaaagatcagttccaacatgagccttactttcatatttaatttcatctggtgctccagcttttattaattcatcaagtacaaaagtacatctaaaatcttttattcttgtagttaattttccgtctgaaaaagttcctgctcccccttctccaaactgaacattagactcagtatctagcttaccagttttccaaaacttatccacagtttcagttcttttatctacatcttccccacgttcatacacaactggtttataaccttctcttgctaacgttaatgcagcgaaaattcctgcaggaccaaatcctacaactacaggtcttgattctaattctatatctcctttagttattagttctctttcttttatttcttcaaatttaacgtccttatcatgtatttttgaaagaatttttttttctttatcacatattacatctaaacaataattaaattttatatcatgcttttttcttgcatctatacttttttttataataatcaatttatttatatcatttttatctatctttaacttcttacatacctttttctctaaaatttcttcactatcatctaaatttaaagttatattatttattcttatggccatttacaatcaccgttttcctttcaaattactataaaatgagttacataattatatcataaatcacacttatcatacatctgtaaataagccttaaaataacaataggtggatataaaatatatccaccattattataattattcaactttctttttaacaacaacatctacattttcaattgtacttactgttgctgttgtaggactattaaatgatacttctggcttgtatgaatatgaaccctcttctgtagtactcgataaatctacagaagcctttaatgacccttctgtaattttatctaattcagacttaagcccagatattgtaacattaactttctcagatgatgattctaaaagtagtccatctttcaaattattataatgaactgctatacttaaatttttacttatattttcttcagttacattctctacaggcttattttcctttgcttgtaaaattacattgactttcacatattcatttccactagctacagttacaccttcaggaactattaatttaacattaagctctcctgttttttctaatttagatatatcaacagcctcagtatcaattgactgaacttttgataaagcatctccaactccagtaatatttacataattagaacttaattcgtatccttttaattctagcccagctttgagttctcctgtagtttttaaatttattggaacacttttcccctttgaaacttcaactgatagttttgcagtatcaatactagatgtaacgcctgtaacttctgctccatttgagtcaattaattttatatcaaaactcttttgaaaatttcccgatattccattttcctcgccaactattacagctgagtttattctgccaacattactgttggcgccttcaacagttaccgtatcaggagctatttttttactcatttcgtatatattatctttataatttaatttaacttttgattgtattgaaaagttttttgtaactaattcctctagattaacttttatgcccaaaaagccgttattttttataataatattttcaggataagttattatttgtactggtactgtgttttctcctaccttcaatgcataagtagacatatctgctacaatcttaaaatcttccggctttactttagcaatatccgttgatggtccttcaagttttaaatcaacagtaaagttctgattacccgaaacagcaaattttgaatttttaagactatctaaattaaccagttcaacaggaatatttcttacttcatatgttctcataggattttcaacatttgatatataaatccataatccaagcgaaagtaatagacttatcaatttaggtatcagcgttttatttttatgtttgattttatccataacttcaccttctccctagccgtcttaactctctgtttacttttatatctattttcaattacttttactaaaacagtatttaatctctctctttcatatcctctagttatttttccattcatagctaaagatattattcctgtttcttctgaaacaattattattaaagcatctgatacttctgataaaccaattgctgctctatgtcttgttccaagttttttatttattgtattattatttgttaaaggtaaaacacatcctgacgcaaatatcctatcatttctaattatagttgcaccatcatgtaatggagtatttaccacaaagatattttctagaaggtttgaggttatattcgcatctattaatgtacctgaagatactaattcatttaaacctgtactctgctctattactataagtgctccggtttttgtttcagcaagattctctactgcatgtgtaatctcactcattatcttatgtaagatttcttcatcttgaattccatgaatatcatcaaatgcagatcttcccaaatgttcaagcgctcttctaatttcaggttgaaatataattactaccgataacactccgatagtcaatgttttatttaatataaaataaagcatatctaattttaataaataacttattggtattagaactattaataatattaatccctttaacagttgttctgctcttgtttcttttattaacatatatcctttataaaatatgtatgataccactagtatatctaaagcagaccacaacgacatatgtgaaaaacccttttgtatggcacttattaattcattcatttatctcacctctcttctattcttccaataaaattatacaacaaatctcattcccttacacacatacaaaaaactattttattactttttaattatttttatcctaaaactttcttaaatacgtttgtaatatacaaaaattaaatagaataaaatcatctaaatttagtatttcctttatttttataaattatattttttcacctaatcttttatttctgtatttattcattagtttataaaatatgaccatgtatataattactttctttggtaataatattatttgtcgcatataccaaaggaggttttttatgaaaaagacatgtagtatttttgttattgctttaatactatacctttccgttattaacataagaccagtttatgctggcactttaggtgagacctataatgaaaattcaaataataaaatagtccaaaacagttcgactgagaatatacaatatatatcactaaatactcaagaaacagatgaagttttagaagtttttaaacataataatcaacaattatatataacgggagaagatatagacttaatggcaaagctggtttcagctgaaagcataggtgaaccatatgaaggaaaagttgcagttgcatcagtagttttaaatcgtactcttgatccaagttttccaaacacaatacaaggagttatatttcaaaaaaacgccttctcatgtgttaaagatggtcagataaatgctaaaacaaatcaagattgctataacgctgtatatgatgctataaagggttatgatcctactaatcaagcattgtttttttataatccaagtacagcaacttgtaattggatgaagcaaacacctaaatttaatcagactacaataggtcatcatacattcttcaaaattaaaacttagtttaacttactaaggagcttatcacttatatgatagctccttttatttatttttaataatatttactgttcaaatgtcccttttacaactgcttttcctttttcaactacctttttgccatttgcaaaaacaatatctatctctaaattgtcttcatcaacaattacaagatccgcatcttttccttcttcaattctacctttattattcaattttaataattttgctacattagatgttataacagaaatagcattatctatcggaacattaaattcttttatagcaaattttacttccctatataatgatgaaactgaacatattccgagacctgcaagattaccattcttatcaaatctaggcatgcttccatttccatcagacgaaaaagtcatgtgttcaatttccattcccttctctaaaaatacacctaatccttctcctgctcttaattcaccattttccatatgttctaaatcacaacttgttgttaaatcaatatatccaccttttttaacatactcaagccccatttcaaacaaatcactatttctatttatatgtgttggaaggagctgttctgctggtatctctgtctgttcaataagatcaaaaagatattttagtcttctcataccctcgcctaaatgaacatttactattcctgctttattagataataatccaccaactctactttgagctactaaatttacgaaaccatcaaaactgggctgagaacttctatgatctgataacgctatttccccaacacctattatttcatctattagcataagatcactttttattgattcagttgctgttttaactggtacttcatatgatccagtataagcatatgcacttatgccttcttcttttaaagacttaacttttgcaattaatgagttcatatctctacatacaccatctgtaccaatacatcctacaactgaagttatcccactttcaatcaaacttgatagctgtatctcaggtgttctagtatgatatcccccttcacctccgccacctattatatgtacatgtgaatcaataaatcctgggaacattaattttttatttccatcaataatattaatctttaataaatcatcttttagttctatattgtcatatattccttcaattttacctcctgctaataatacgtctttaataccaatatcatttggagaatataccctacaccccttaattaaagatatcataactttttcacactcctcatcaaaagtttaattatatatttagcttatcctatgattaaagttaatataacaaaatctcaagataaaataactattaatctcgagattttattatgtcttctatttaattttatttactttactatatctctaatataatcatttatgtatagcgaatttggataattatttacaagctctcttgcatattcttttcccatatccttatttgttgtatttgttagaagcgctaattcatacaacacgccttctatatatgcaccttttggatataaactataatattctttataaagttttaatgcttcagaattatctccaagttgagatgcagtacttcctttataaaatacaatatgctctttcaagtcacttttatcacaatatttataagctttttctaattcaatcttagcagaattataatttccattattaaaataccatactccatattcataaaactttgaaactccatttgtttttaataactcaattgcattattataaagttctaaatcctgacctgaaagtgtttctttattaaccatatttatttcatcatatagtttatctacatctttatttttcaataataacgctacattttcattattgaatattgtttcttttttatcagcttgttcattttctaagttctgattttctttatctgaatatgaatcatttgtatccttattgctatcagaatctaataattcatccttttttatatcttcttcagtattcgaagatgaatcttttgaacttgaattatttaaacttgtttttgtatatatagaatatccacctacacaaatagctccaataataaataaaacagtaataactgataaaacttttttagaaactctattctcgttcgaatataaacctaaatttatcaaatccttttttaatgcattagctgtcaccgcttcattatctatatgtaaagccttgtctataaattctttcgccctgtaattgtctccttttctcatataacacattgcaattcctgtgttaacttttatggaattaaattcactttccatacattctctaaacaacatcattgctttatcaatattcatattttttaaattatattcagcatctttgtatttttctattctctcatcatcacttttacagtcttctatatactttttagctacgctatcagtattaatatcacaattaagcttccagacaatctttgcttcttttaatagacccttctgatataacataagtcccttcaaatttaaaacttctgaacaacttaaatcattagctaatatattttcacatatttctaaagctcgattcatttgaccattattgtaaaagttcatagctttattgtactgttttatgtaatcattcttcataaatatccccttaccattataaaaataacatgattttattatatctcatttttagtgagtaagtaataattaaaattaatctaacccctgtattaaactaatacatgttagtaatatatatttttacttcaatatcttataaactaacatctattagttttacatttctataaatacctataattacaaataaaaatagccatcctttttggatagccatttttattagttagcaaattatcatttaattatgtttaccaactttatataattctaaatactattcttgatctaacatgatcttcttagcatttaatattgatgtagcactcattgagaattcatctaagccatattcaactaatgttggaatagcagcttcatctcctgccatttctccacacattccaacccatttaccatgcttatgagctccatctatagtcatctttattaatcttaatacagctgggtgcattggattataaaggtatgatactttttcactcattctatcagctgctaatgtatattgaattaaatcatttgttcctattgagaagaagtcaacatgtttagctaattcatcagcataaactgctgctgctggaatttcaaccatgataccccattgaatagcttctgagtattctttaccttctgcctttaattctgctttacattcatcaacaacttcttttgcttgtaagaattcttcaagacctgaaatcattgggaacattacgcaaagatttccgtatatagaagctcttaataatgctcttaattgaaccttgaatatttcttttctgtctaagcaaagtctgattgctctgtaacctaagaatggattcatttcttctggtaatggtaaatatggaagagtcttatctccaccgatatctaaagttcttattacaacttgtttaccattcattttttcaagaacgtatttgtaactttcaaattgttcttcttctgttggagcgctttctctatccatgtataagaattcagttctgaataatcctacaccgtctccaccatttgctataacaccattaacatcttctggcttaccgatgtttccgcaaacttctattcttctacctgatttagtagtagttttaacatctattaatttctttaattcttcttgttcagcttggaatttttccttcttagctacatattcagctagtacttcttctgaaggatttataataacatccccagtaataccatcaactataactttatctccacttttaacagaagtagttatgtctcctaatccaagtacagctggtatttctaatgttctagccatgatagctgcatgagaagttcttccacctatattagttataaatcctacaactttgcttctatctaatcctgctgtatcagatggtgttaagtcatgagcaactacaattgtattattttcagtaattgcaaaatcatctccgccttttcctgcaaagtttgataatattctctttgatacgtctttgatatctgctgctctttctctcatatattcattatccatagattcgaatatagcaacaaatgtatttgtaacactttcaatagcctttaaaccatttatactgttcatttctatttcattcatcattgcaccagtaaattctgggtcatctaataatgttatgtgagcttcgaatacttctgccttttctgctcccatttcttctgcagccttagctttgattgcttctagctgagatctagaattatctaatgctttttgcattttttctttttctgcagctacgtctgtaattttagcatctgttataacgatttcttcatgttcttgtaagaatactgtacctattgcatatcctttagaagcagcaataccttttttcataatatgggattcctccttgatagttaattttattataaagtttttgtttttttcctcatcatatttgtgagtttttatttgagtttaaaccattaccattataccataattttatgagaatttaacttgatttgtagttttttatataaattcttcgtaaaaatccccaaaaaattttggatatattaacattatatcactttcccattattttacattggttttttatagatcatctactaatgttgcagcttttgcataagctgttgaacgagcctcaaaaaaatctgttttaacagaatttgcattagattgtctatcaacccacggtgctggatttacatcatgtccttcaaataaaggttcaagatttatttcctttaacctcttatttcctagatattttatatattcctcaattaattttttattaattccttgaatcttatcaccgataacataatgtccccaaagaatttcctgttcaactcctgttttcatcatctctctaagttcattttttattttctcagtgaataattctgcattttcattttgaagttcctttataatatttctaaaaagccataaatgggtattttcatctctatttatatatcttatttcttgagctgatccaggcatttttccatttctctctaagttgtaaaagaacataaatcctgaataaaaataaattccttctaaaatataatttgccataagtgtctttaatagagtctcttctgtagggttatctataaattcattatataagtctcctataaatttatttctgtttagcaatatctcatcatctttccattgatacaatatttcatttcttttttcaggagaacagatactatctagcatataactataactttgtgagtgcacagcctcttgaaaactctgtattgtcaagcacaaattaacttcacttgctgttatatagttatttatattgcttaaatttgctgtttgtattgaatctaaaaagatcaaaaaagataatattttatcatatgcaattctttcttcatctaataagttttgataatcctttaaatcttgagataagtttacttcctcaggaatccaaaagttattcatcccctgtctataccagtctgaaacccatgtatacttcatattattaaaatcatttaaattggttgtattaccatttataagtctcttcttagtgatttccctatctccaaattcattaaaaagaggtttcttgtttatactcattattaatactcctattcattgatgtattttattcatgtattgaaaaatgaagtttctaatttcaatattcttgttattttttctattattattatttcccaagaaatttttttgtattttaaatgaatatcatgtcaaattaagaaaggctaagcctttcttaaaaaacatataaactccaatgaaactttcataaatatttcatacaaaactgttaactaaattaagctgagcagctttcacattcagtaacttctagtgatttagacctaacatagtaaattgattttactccacatttacatgcttcaatatataaattcattatctgtctcattgtataattattggttatatataaattaaaagattgaccttgatctatgtgtctttgacgtattccattcatttgaacagaccacccttgatctatattatatgctggattatagtaccaataattatcatcattaagatctggagctgttttaggaattatacttccctttttttcttctaaataaaatcttgccattacaggatctattccttctgatgttcctgctatggttgcagtcgaaccgtttggtgctactgctaagagatatccatttctcattccattttcttttatctcttttcttaatgcacaccatttttcatctttatatcctcttaattcaaaataatctccattatcccaatcagattctttgaataaattatacgcacccttttcttttgcaattttcatacttgcttttactgcataataattaattctttcatatacttcatctgcaaagtctttatgtttttcttctgtccaatggattctattattcgctagcatgtgatgatatccactggttccaagacctattgctctatatttcttatttgtaacttctgcaaaaggaacggaataataattcaagtcaattacattatccatagctcttatttgagtttcaacaacatactctacttcttcttcactacatacatctatatttcctaatactactgatgaaagattacaaacaacaaaatctcctggaattatattctgagttactatacatgaaccatcttcattaattatttctgatttatttatttccatagggctcatattctgcattatctctgtacataaattggacgaataaataattccattatgtttattaggattcattttattaacagtatctctataaaaagcaaatggagcaccagtttcagctgcacttttaattataagcctaactatgtcttttacagacattactcttttttctattctttcatcatttacacattcataatacttttcttcccactcatctccataaaaatcttcaagtgaataaccctttatttctttaatctcatgaggacacatcatataccaatctgagtctatattattttctgccaacttccaaaataaatctggataacacaaaccagggaaaacatcatgtgctttttttctgtcatctccattatttgttcttatctgtaaaaactctggaatatctttatgccatgcgtctagccatatagctactgatccatttctaactcctagctgatctacagccactgccgtatcattaaataattttacccatggaattattccacctgaagcacctttaaatcctcttattgaagaacctagtgctcttacttttcccatatatattcccattccgccaccaaatttagatacttgagcaaaattatcaagtgacttataaataccttctagactatcttctacagtatcaataaagcacgagcttaactgataaaatggttttcttgcattagacatagtaggtgtcgccattgttgcttttaatgaacttaatacgtcataaaatctctttgcccagtacactcttttagacttgtcttccggaattgcaagatgcatagctatgcccataaacatctgctgaggcaattcaacaggatttctattataatcttgaaccaaatatctcttagatagaagatttattccgctataattaaaaagaaaatctcgttctggttttattgtcttttccaattcaagtatatcttcctttgtgtaattatctaatatatattttccgtaaagacctctatctgttagctgagatataaaatcataatagtttttatataaatcttcactgctatttaatcctctgttttcccttacttcatcataaagctcatatgtatatattttagatgctgcaaattgccaatttggctccatatctgtagttaattctaaagcaacctgaataagtgattttcttatgtgtttttcactcattccatctcttattattaaatttaatgcctctaatagtttattttctgaataaactccttcttcatcttttatactagaaacagcatctatacataattcatttaaagctgacatattatcttccctccactatatcttgtgtctatatataaatatattaatatcctcatacaacatatcgtatattatagtagttaatatattaattgtaaaacttcaaatttataaattatctatacaaaaaagtagttaatcttttattttctacagattaactacctaattgataaaatttatttattaatattttttattcttccaatggaagctttacataaattttaaacatatcgccttctcttcgtatttttataatacctccgtgaagctcaactatacttttagttattgcaagacctaatccagaaccttctattttagaatttctagatttatctccccttgcaaatctttcaaacatctcctcttcactaaagtccatctcataatttgctatatttttcatagatatagtaacgtagccttcatttttttctatctctatatacactcttgtgttttcaagggagtatttaagagaatttattataagattttctatagcccttgatatcatttttccatcaagagccatatatatagcatcttcctcacatgtgactttaaaatttatatttttttcttcataaagactgctatattcacctacaccttgatgaacaagagataaaatatctataagctctttattaagtttaagcttaccactatttatctttgacatttcaaataaatcttcaattaacgcctttaatttaagcgattttttttctaaaatttcaatataatctgaacgttcctcttccgttatatccttactttttataatatttacataattaattattgatgttaacggtgtttttaaatcatgggatacatttgaaattaactcagtctttaatttctcacttcgtactccttcttctagtatctccttatatccagcttttattaaatttatattatgtgcaagttctctaatagctggtgaaccatcaagtattatgtcatcctgaagatttccttcatttacttttctaagtgcttcattaactacacttatatctaaagttttttttgctccatagatcattgttaaaaatagtatcatgatcataaaaatactgcctttaaatggatatgtctgaaagaatctaacaaatatattattttcatatccaccagttgccagaaaatataagtacgtcacaagagttattactccaagtattattgaaactaataatgtagttctcgtttctttatatttaaaacccttttttaaaacaaaaatgacattattgattatattagatttaattttaggtgatctgggatttctttttataaccaacataatctttgttataaatattgtatttataattattagtgtaataagttcctgtgtattttcctgtatctcttgtactgctaactggtgctgagttctatttacctgtgcataatctcctaatattgaaaatagcattagtgttattattgaaataatcagaatatctataaaataaatgctgcttatatatgaattaatcttccttttcaatcttgtagccaatcccccacaccaccttaatatattcaggctccttcgtatttatttctatcttttctcgtattcttctaatatgaactgttactgtattttcgcttttataaaaaatttcttcccatactttttcatatatttcttttattgaaaatacttttcctaaattggatgcaagaagatggagtattttatactctgttgcagtcgccttaatttcttctcctcttactgttatttttttagctattgtatcaataaccaaatctttaacctttattatgtcttttccttcctctacattcaaaggcttttcatatcttctaagctgagacttaactctagcaactaattctaaatgattaaatggtttagttatataatcatcagcccctacatttaatcctaaaatcttgtctgaatcttcaccttttgcagaaagcattattataggaagattctcagtttcccttatttttaggcatgttcttattccatcaagtttaggcatcattacatctaatattattaaatgaaccttctcttcttctaatatatctagggctttgagtccatcctcagcttttaatacatttaaattttcacctcttaaatatatttctattgcatctcttatttctttttcatcatctactaccaacacattaaacattactttacctcctgctccctatgttatattaaaatataactattacaatctcatgtcattttttattcttcaataagatttttaaattccagtgaatttcttactggatcaaaatccgattcattttttgcttcttcttttactgcactatccatattaatagctttagtcaaatactctatagtcctattaacatctcctcttcttccgtatatagatgcaattccataataggtccatacatattcttcaacttcaagagccttattataccatttaagtgattcatcaaactgattgtataactcatatgtaagtgctttattaaatcgcccatatccataatcagaattgatatccaatgatttatttatatctgacattcctccgtcaaaatcaccatcataggccttcgctatgcctcttatattatatcccatataactattaggaaattcttctactaactcatttgctttatttatagccattgcataatcccctgaaaaaaaggttgtatatgcattattatataactctctttctctttctgatatatcctgaacttcattattcttaatattttcattttgagattcagttataaaatcattattcttttcagatgctcctattaattgttcattactgatattgttaatatctttattagtatttttattttttgtattattaataaattcataaatcaatattccaattgaaattaatattaaaataaataaaataattcttttattttttgcttttcctggcaatgatattctattcatactcattctccttatattgcaattactgttgcctatcatttaattgtaactaaagtaaatatagcatcatatatattcattataaactaaatgttcattaaattaataatgaacatacattattcataaataatattttaaaaataagcacataaataataatatgtaaattacgagcctaatactacatcctatattaaatatattatcacaaaaaaatattaatatgatatgtataaaaagtgctaaaaattattttcatatttttagtcatacttttttattaataagttaattacttttttgtttttttacataatttgctgtacttaagatatctcattaaaagtattttttcattactgattttacaattttctaagggttgaattttagtttataaaatgtcttaatattatagagaattataacttaaaggagtataccatggacacatattacaaatacagagctaatatatttgatgtattaatcatatttttaggttgtattattgcatctctaggcgttaatgtttttttatctcatgcacagcttttaagtggtggtgctactggtctaggattacttgttgaatatactacaaatattccagcaggtattacattattcttaatcaatattcctctactagctgtgagttttaaaaagcttagtagatcattcactatttatactactatcggaatgctttcactatcaatttcacttatgataactaaacctatagcttctgctataaatatcgatgggcttgatttattgctctattgtatatatggtggtgtactttgcggaattggatatggacttgtttttttgagaaatggttctactggtggtactgatgtagtaacaatgctaattagaaaaaagcattctaattttaatattggaagtttaggattttctcttaacgtaataattattataatcggcgcatttatattcggacttcctcaagctctatacacattgatttctctgtttattcaaagtatagtacttgataaaatgcttaaaggatttagtagtaaaaaattacttcttatacttactaaaaaagaagcagatgtaattaattatgttataaaagatcttcatagaggagttacatcattacttgctgaaggtgaatatacgcatgatagaaagaaaatgttatattgtatagtaactgcacgccaaatggttgaattaaaaaatacaatatatcagatagatccatcagcatttataacaattgttgatatatcagaagtaagaggtaaaggctttatgaatatataatctattcataactgaaattttatccacaattattttatgaaataaagaaattattcacatttgtttgtaaatcatgtgaataattataattacatataaaaagctcaaagaagaaaatttcaattatctctttgagcttttatttatcataatagaacttatttagaatttaaacctacaatgttttatttaacctaaaattcaattttttcaatatatataatgcaaattactttattgtactcaaataatctttctggcctaattcatacagattgtttccttctgaatctataattactactaatggcatatcttttacttccattcttcttatagcttcagcacctaaatcttcatatgctataatttctgattttactatgctttttgcaataagtgctgctgcaccaccaatagctccaaaataaactgaattatttcttactattgcatcaattacttctttatttcttgcaccttttcctatcattccttttaatccaagatccattaatctgggagcataggcatccattctataacttgtagttggccctgctgatcctataacacttcctggctttgcaggtgatggaccaacataatatatagtctcatcttttatattcaatggaagttccttaccctcatctaataaatcaataagtcttttatgtgctgcatctcttgctgaatatattacgccacttaacagtatactgtcccctgcttttaaaccttttgttttatcagctgtaagaggtgtatttaactttatttccatgttttatcccccaatctatgtaatattcaatttaattcattattcaaaattgaaactttctatattattgcttctttatgcctagtagcatggcaattaatattaaccgctactggaagacctgctatatgtgttggatatgtctcaatattcagacctaaagctgttgtctttccaccaaatccttgtggtccaattccaagtttatttattttttctaataactctatttctaaatccttataaaattcatctttgttacttgtgtttattggtctaattaaagcttttttagctaaatatgctgctttatcaaatgttcctccaatacctacaccaacaaccataggaggacatggattaggtccagctgcttttactgtttctataacaaaattcttaactccttctaaaccatcagatggtttcagcatacctattttactcatgttttctgaaccaaacccctttggagccaaagtaacctttactttatctccatccacaatatcataataaattactgctggagtattatcctttgtgttaactcttcttataggatcatctacaactgattttcttaaaaatccatcttcatatcctcttcttacaccttcatttatagctgcttctaaatttccccctacaaagtgtacgtcttgtcctatttccaagaatacacatgccatacctgtatcttggcacataggcattttttctttgcatgcaatttcagagtttaaaatgattttatcaagaacttgtcctgctagttcgtatgtttcttcttttcttgatttttctaatgattcttttatatcagcccctaaaaaataattagcttctattgataacctttttacagtatcagtaattaaagctacatttacttcgcgcattataacaactcctctacttattactctatttaagtttaaaattttttctctgtatttacaacaataaaatatttatttaagatgagattttatgtttttaatttcatatttataaaaatttgatactatatttaaacataagcaatatacataggaaaggatttatttttatgaatgataacaaattaaatcaactactaacatttattatctatgcattaaccctctgcttaatatgcctaataatatataatgctttcttgttatttaatggcgattatttttccagtaatccacctagaaatagtattaaggttggacccatttctattgattgtttaaaaacctcttgtatataaattaaattaatgtaatctcttttggtattattcaaaaattaaatatgtaaaactcaaaagcaattacattaactcaattgagttttacatataattaaaaaataaatttataaataatagtttctaatataaaactacttactttcaaagtacttatctaaaccacttttgattccttctgttaaattttcttgatgttcatcagactttaatctttgctcttcctctgaattagataagaaaccgcattctactaaaatacaagctccatcataaccatcccttaatattttatactgatcttttgcagctttagctattcttttattattatccttaatctgctcttttaatgattcctgaattccttctgccaattctttgctcttatcatttgatgcataccacacctgtgcaccaaaacagtttgcctgtggaaacatattctgatgtattgaaataaatacttcacattgagtttctttttttaattgacacctcttggttaaatcttctactttctttttagctaactgagaatcatcttctcttgtcatatatactttatatccaccatcttcaagctttttctttagttttgatgctatagcaagatttatatctttttcgatagttccattttttgattttgctcctccatcaatcccaccatgacctgcatcgattaatattatatgctgatctttttcatcttcagccttaacttttataggcatggaaaatataataagcaaaatacacattaaagataaaattcttctaaacttcattattacttctccttctaataaaattatcctctagaatattgtctgcactaaggagtaatttattcataaataaaatgaaagtagccctttctttaaattatcaatatttctaaataaaaaatagcttaataaaatttatttaaaatcaaaaaagagactccttcatttggaatctctttttacaaattattaattaacgtaattttctaatacactctcagtaatattagttgaatgatctcctattctttcaaaagaacttattaaatctaagaacacagcacctgcaaatgcattacatttaccatcatataatctttgaatatgcttttctctataagttctttgatatgcatcaatcttatcttcaacatcgataatactctttgctttagtaatatctcttgttacataagaatcaatagctatttctaatgcttctagtgttgagttataaatttcatataattcatcaatagcatctttactgtattttaaatttttatttatcttttcaatagttaaatctgcaatattgtctgcatgatctcctattctctcaatatcaataattacatggaatgttgatgcaacaatacctttttccttatctgataaatcacacttagcaagtttcactaaatattcagttatgctttcttcaagtatattaattattttttcattttcatacaccttttcaattagtgattcatcaccatcaacaaaagccttcatagataattcaacattctcttttgctttattagccattcttatagtttctttaataacttgtccggctgcaataactggagtttctaaaactctatcatcaatatattttggtccagctttttcaatattttcttcacaaggaattgccttgtttataaatttaattatgtaattagtaaatggtaaaagtaatgctgtattagcaacattaaataccgtatgtgcattcgcaatctgtctgcttacatcatctggactgacatgctgaacaaactttgctataagtcctataaaaggtaggaatacaattgttccaactatattaaatactaaatgtaataatgctgctttatgtgcagttttgttagttcctacacttgcaagcatagctgttatacaagtacctatattacatccaaaaactattggtaatgctagtcctatatctataagtccagttgatgctaaagcaatcaatataccagttgttgctgatgaactttgtaatatggctgtaatagcagcacctgctataattccaataaaccaattatcccctattgctaataatacgtctgtaaacattggcgatgatgctaatggcttcattgctccactcattgcacccattccagtaaatagtataccaaaaccaagtattatatttcctatttcttttctttttttagctttagcaaacataactaatgcagcacctacaaatacgaatacaggagcaacctgatctagcttaaaagctacaagttgtgctgtaatagttgtacctatattggcacccattataacacctgccgcttgtgctaatgtcataagacctgcattaacaaatcctacaaccattactgtagtggcactactactctgaataacagctgtaacaatcgcaccaattccaacccccataatacgattgcttgtaaccttttcaaggatagtttttaaaccttcccctgctgcattctctaatccatcccccattaatttcataccataaataaatagccctaatccacccattaattgaataataacctttattgtatccacaatttattctccttcggttaatttatttattatattacatattaattttatcttatttttaaccttatgttaatatttttgcttgatttttaacctatttttaatataacatgtattttttttacattttaagcttatgcttacatgtttattcctataaaactttccttaaaatattaattataatattaaaggaaataatatgattgtaattttataactctagctccttctgaaaagaattttaaattcatattattatcctataaaaaaaatacaaatactcaaaactaacttactgataacatagattaattaatctcaccaaagagaacttttataaatttccacaaaaaaaatcccacaaacataatgtttgtaggatttctgcatagctccaaactatctctttgagaattgagaagcctttcttgcttttttaagaccgtatttctttctttctttcattcttgaatctctagttaagaatccagccttctttaattctgattttaaagcttcatcagatttaactaatgctctagctataccgtgtctgatagctccagcttgacctgtgaatccaccaccatgaacattaactaaaacgtcaaacttatctttagttccagttaaaactaatggttggtttacgataactcttaaagtttctaaaccaaaaaagctttctatttctcttttatttacaacaaccttaccatttcctggtacaagtcttactcttgcaactgatttttttcttcttccagttcccatgtattgaacttttgccatttttattcctcctcccgagtatatattaatatcttaactcaagtacttctggtttttgagctgcgtgattatgttctgcacctctgtatacatttaatttctttaacatttgtcttcctaatacgcctgttggaagcattcttcttactgcttcttcgaatgcgaattcaggtttcttatctaatactactctgtatggagtttcttttaatccgcctgggtaaagactatgctttctcattaatttttgatctaactttttaccagttaaaactaccttttctgcgtttattacgataacgaagtctccgcagtcaacgttaggtgtaaaagttggtttattttttcctcttaaaattgaagcaacttggctagcaactctacctagtggcttaccagcagcatcaacaacataccattttctttcgatttcacttgctttagcaatgtatgatttcatctgtttccctccctgaacttacattaatatttacttttaatttaaagtaaaattgtttatgtcaagacccggggctagtggatcttatatacataaatgttttaacaaacatacattattataatacacgcttacgggcgtgtcaacaattttttgacatttaataaaaaactttttctaggactaatccattaggtggaactaccattccagcacgttttctattaccttcacgtattatatcctgaatatcttccggttttaactttttatttcccaccttaattagagtaccaactattattctaaccatattatataaaaatccatcagcacttacaaaaatcttaattttctccccattttgttctatatgcaaatctgttattgtacgtactgttgtttttatagaacttcctggagacataaaggctctaaagtcatgagttccaataaagtatttacaagcttctctcatgttatcaatatctaaatcatgcctccaatggtatacatactgatgaccaaaagatactctctcatatctatgaattattgtatatgaatatgtttttccctttgatgagtaccttgcatgaaaatcttcagatacctcttctgaccttattatagacacatcctttggtaaacgtacatttagtgcttctctaaatttatcacccggaatcgtgctattagtgaagaaattagctatcatatccttagcatgaacccctgagtcagttcttgaacttccattaataataatttcttcaccagtagccttaaaaattgcttcttcaattactttctgaacagttcttcctttgggctgcttttgccagccacaaaattcactaccatcaaattcaattgttaattttatatttctcatcttaatcctcttgttaattaaattttaataatattatatatagcatcttatcactaataaattttctctgcctatttaaacatattaagtatattacaaattaacgaaaaataaaaataatgatgctttaataatatttaataaaatcaaagcatcattgttaaaacttattagtttaattaattcattatataaaaatatactgagaatagttctaactaaaaccatccctaatattaaaggataaatctaactactaacgaccatactattattaatgtagctacgataaaagcaacagtatccttagatgtaaatttcaaaactttcattcttgttcttccagccccacctctatatcctcttgcttccatagccattgcaagttcatcagctcttctaaaagagcttatgaatagtggtactaatagcggtacaagactttttgccttctgtataattccacctgattcaaaatctgcacctcttgccttctgtgctttcattattttatctgtttcatcaataagtgttggaataaatcttaacgcaatagtcatcatcatagctaattcatgagcaatttctttgccaataggtcttaaaagtttttcaatcccatcagtcaactctattggagatgtagttaatgtgagtattgatgtgcctattattaacagaattaatcttattgccataaatgctgccgtcttcacaccttctacatatatagataagaacccaatcttgtatagtaatgtatctggagtacctttaatcataaaaatatttagtactgctgtaaatactactaataaaaatataggctttaatcctttaactatgaatctaaatggaatttttgcaactaaaattactgctaataggaatccaataaccacagtgtatccaataaatttattcactataaacaaacatattataaatattagagatattaatatctttgttctaggatctaatttatgaacaaaagattcacctggtagatactgtcctattgtaatatcttttaacacgactacttatccccctttatactatttgaagcaaaaatagatagaatagcccttttagcttcttcgatagtaaatatactatctgaaatatcaaacccttttgctcttaaatttcttattaaatacgttacttgtggtactgcaaggcctatactctcaagcttatcaacttctttaaatacttctgctggagtaccttcaagagctaccttaccatggttcattacaataaccctttttgcaatatttgctacatcctccatactatggctaacaattattacagtcatattataatccttatgtaacttcttaatctgccctaatatatcatccctaccctttggatctaatcctgctgtaggttcatctaatatcagagttgttggttccatagctataacacctgctattgcaactcttcttttttgtcctccacttaaatcaaacggagatctatctttataagtttcataatctaaacctaccatctccattgattttttaactcttctagttatctcctcttcagataaccctagattcctaggtccaaattcaatatcctttgaaatagtttcttcgaatatctgatattctggatattgaaatactaaacctactttttttcttatatcagttaattttacatttttctctgttatatcaacaccatcaacaattatctttccgctagatgcctcaagtaatccattaaaatgttgtataagggttgattttcctgaaccagtgtgtcctattaaagctacaaaatcaccatcttcaatttctacggatacattatccaaagccactttttcaaaaggactcttaggcatataaatatgtgttaaattttctgttttaattgacataattcattcaccatctcatctacattaagtattttttcatttatatctaaaccagcctcttttaattcataagcaagttcagtcacttgtggaacatccaaaccaatttttttcatatgttcaacctgtggaaatatttctcttggaataccttccatcattacgtgtccaccatcaataacaacaattctatcagcttgagcagcttcatccatataatgagttataagaactactgttatcccatgcttttcattaagctcttttatagttttcataacttcttttcttccagatggatcaagcattgctgtaggctcatcaaaaataatacattcaggctgtatagcaagaataccagctatagcaactctttgtttttgcccaccagataataaatgaggtgcatgtcttttatattcactcattcctaccttttccaaactttcatcaactcttcgacggatttcttgtggttcaatacctaaattttcaggaccaaaagcaacatcttcttctactattgtcgctacaatctgattatctgggttttgaaataccattcctgctttagctctaacatcccatattctttctggatcttttgtatcaataccatcaactaacacggtaccttcggttggaatcaccaatgcattcatatgtttagctattgttgattttccagaaccattgtgtcctaaaacaactaaaaattcgccttttttaacttctaaattaacatctttgactgcatatttctcttcagttttaccttcttctgtattttttatatatttaaaagatacatttatgcattgtaccattgcatccttcattacctaacctccatggttcatatactaatttattatacaaatctctctttattctgtataaattttcaattaatagtttaattatatactaattttatatattttcaataaaaagtgaatattttatcaaattaaaaaacatctctataataaattagtaaattactaatttatcttaattttaaatatcttcaacttaaatgtatatacatatgtattataacataaaaaaagaaaatatatttctatatattaaaacagggattaagtttccttaatccctttagtattatactaattcaagtattactatttcagctccgtcccctcttctaggaccttttttaatcattctagtatatccgccgtttctttcagcatactttggagctacattgtcgaataagtttttaacaactaattcttcttgaacgtaagctaatacttgtcttctagcatgaagatcccctctcttaccaagagtgatcattttttcagctatagatctagtttctttagctcttgtttcagttgtttcgatcttaccatgttttaataagctagtaacaagatttcttagcatagcttttctttgatctgtaggaagacctaatttacgataacctgccatggatttacctccttactcttcacttaactttaggcataaacctaattctttaagctttctttcaacttcttctaaagatttctttcctagatttcttactttcatcatatcatccatagatttagtagcaagttcttgaactgtatttattccagctctctttaaacagttatatgatctaactgataaatcaagttcttcaacagtcatttctaggactttttctttcttatcttcttctttttctaccattacttcaatatcattagtattatctgttaatgacatgaataatttaaagtgttcgataagtatttttgcagataaactaatagcttcatctattctgattgttccattagtccaaatttctaaagttaatttatcataatcagtaatttgaccaactcttgtgttgtcaacagtaaaattaactctttttactggtgtatagattgaatcaactgcaattgatgaaattggtaaatcatcactcttatttttgttctgagtaacataacctcttccattattaactgtcaattccatgtaaagtctaccatcagaatctaaagttgcaatatgtaaatccttattgacaacttcaacatcaccatcagtctttatatcagctccagtaacctctcctggtcctttagcatcaatataaataacctttggcccttcaccattcatttttaaagctaaagattttatgttaagaattaattctgtaacatcttctttaacaccttgaacagtagaaaactcatgtaaaactccatctatcttaacagaagttggtgccactcctggaagagatgataataatattcttcttaaggcattccctaatgtaataccatatcctctttcaagtggctcaacaacatatttaccatatgtaccatcttcattagattctatacattcgattattggcttttcgatttctaacattgacaaaccctccctatattataaatggcaaccttattatgagggcaactgattctatatttgcatatattgtgataaatttctctaataaaaacaaatatattaatattatttactgtataactcaacaataagtgtttcgttaacaggcacatctatttcttctcttgatggcactgctacaacttttccttcaaagttatcaacatttgcttctaaccaagctggtaaagtttttggattttcagcgaaagttttgaacttttcagaagctctactcttttcgcatacagtaattacatcgttagctgatacgctgtatgaacagatgtcaacttttttaccatttactaagaaatgaccatgagtaactaattgtctagcttcatttcttgatgcaccgtaacctaatctataaactacgttatcaagtctcatttctaataatttaagtaagttttcacctgaaatacctttcatgtgttcagctttttcataatatgctctgaattggctttctaatacaccatatattctttttgctttttgtttttctcttaattgaactccatagccagagatcttctttttgtttgctccatgttgtcctggtgcgtagcttcttctaacaaatgcacatttgtcagtgaaacatctatcacctttaaggaaaagtttcataccttctcttctacataatctacatgtagcgccagtatatcttgccattaaattacacctcctattacggttagactagactcttcttctctttggtggtctacaaccattgtgtgggattggagtaacatctttaattaatgttacttctaagcctgctgcttgtaaggatctgatagctgcttctcttcctgaaccaggtcctttaacataaacttctatactttttaagccgtgctccatagctgctttagctgcagtttcagctgccatttgtgctgcaaatggtgtgctctttcttgatcctctgaatcctaatgcacccgcacttgaccatgataaagcattacctactgcatctgttaaagtaactattgaattattaaaagttgacttaatgtgcgcagcaccatgctcaacattttttctttcttttcttcttctagtcttcttgactttttgagctgccattatcttacctccttactatttcttcttattagctattgtcttcttaggaccttttctagttcttgcattagtcttagttttttgtcctcttactggaagacctcttctatgtctaattcctctatatgatcctatttctattaatctcttaatgtttaaagcaacatctcttcttaagtcaccttcaacgattaagttcttatttatataagttctaatttcattaacttcttcttcagataaatccttgattcttgtatctggatttattcctgttgtagctaagattttttgtgaagttgataaacctactccatagatataagttaaacctatttcaactcttttttctcttggtaggtcaacgcctgctattcttgccattgaaatttacacctcctgatgattgaaatgtgttattttttaatttatttatatatattaaaattttaggccaatagattaaaccattgtcagccgccctaaaataattttgattaattaaacgactatataatcatatttgacttttgctgaaatgtcaatatcatttattacaaaataatactgttaaagtgattgttagccttgtttttgtttgtgcttaggattttcacagattaccattacttttccttttcttctgataactttgcacttttcacaaataggcttaactgatggtcttactttcatagctaaccctcctcatattacttttgtggtagatattaagtaagtaactctaccttatttagctctccatgtaattctacctcttgttaaatcatatggtgaaagttctacagtaactttatcacctggtagaattcttatgaagttcattcttaatttacctgatatatgtgctaaaatcttatgcccactttctagttcaacttggaacatagcgtttggtaatgattctagtactgtaccttgcatttctataacatcatcttttgacataaggtaatcaaccctccttaacaatgcctctaacttttaggaatctttttatctttaaatctgtactcttatcgcatgattttatcaatgataataattcttcatctatattttctaaaataattaagtgtttaatcttttttttcttaggcatatcaattgattttgtatccccattagcaagcaatacataatcattatctatctgcctaacaacaacatataaatgattaatatctcttcctgcttttgaaagtactacttttccaatcaagtcattgttttgcaaatttttcacctctatgattaccttagtataaattaacactaccacaatggtattatgcaaatttataactaagcaacactcttttttctacttaatcagtgtcaatatttcaggtccatctgataaaattgcaactgtattttcataatgcgctgataagcaattatctgctgtcacaactgtccatctatcttttaacgttcttacctgatgagttcctgcgttaaccataggttctatggctaataccattccctcaactagctttggacctctaccggatttaccgaaattaggcacattaggatcttcatgaacattacgtccaattccatgtcctacaaagtctcttacaattgagaaacctgctgcttctacgtagctttgtatttcatgagatatatcacttaatctatttcctatctttgcatgttttataccttcaaagaaactttctttagtaatatctattaatctctgagcttcacttgaaacttttcctactggaaatgttctagctgcatctccatgaaatccatttatgcatgctccacagtcgatactaacgatatctccttctttaagaacataccctcctgggaatccatgaattacttgctcgttaactgaaatacacagtgacgaaggaaaaccatataagcctttaaatgaaggttttgctccatgcttagttataaattcttctgccattatatctaactcggcagttgttataccgggttttacctctttttcgagcaatagcaatgtttctcctactattttgcctgcttttctcattagggatatttcatcattatttttataaataatcattagttattccccaatatttcgcatattcctctgaaaacttcatttatagctttagtaccatctacttctgaaagcaattgcttattaccataaaaatcaattaatggttgtgtttctttttgatatacatcaagtctttcctttacagtttcaactgtatcgtcttttctttgtataacttcacttccacacaaatcacattttccttcaactgatggaggattgaattttacatgataacttgctccacatgatggacatactcttctaccagtcattctttctaagataaactcattaggtacctttattaataaggcagtatctaattgttcccctctttcaataagaaaactgtttagagcttcagcctgagccacagttctaggaaaaccatctaataaatatcctgctctacaatcatcttgttgaagtctgtctttaaccatgttaattgtaacttcatcaggaactaattgtccgttatccatataactttttgcttctacccctaaaggagtgttttcagaaatgttttttctaaaaatatctcctgtagaaatgtggggtatagaatatttattactgattgatttagcctgtgttccctttccagctccaggaggacctagtaatactatcttcactggcttcatctccatttatttaaatctatttaagaaatcctttatagtgtcttaccaccatttgtgattctacctgtctagtaaaatctaatgcaacatttataacaattaataatgctgttcctgaaaaagctgtattttggaatgctgtataattttctatcattactggtgttatagcaagcattgctgctaatatacctccaatgaatgataatctattaagaacattttcaaaatatctttcagtttcttctcctggtcttacacctggcacaaatccagcggatttatgtaagttttcagccatttcatctggtttgaaagtaattaaagtatagaaccaattaaagaaaactgtaagcactgcatataataccatatatgaccagcttttagagttaaatacacatgttggattagttaaaatccattttgcccattctttatcgccaccaaacaaggttgctatagtctttgggaattccattactgacattgagaatataatcgcaagaactgctgatccaataatacttaatggaatattcgaagattgagattttaccattgcagcatttccaccaccgaatttccctgcatattgaacaggtattcttctttctgatagtgagaaaaataaaactgcgcctaataaaaacacaataaatactccaaataatactatttcaacaatactagcacttcctgcctctttaagagtcatcattgaagctattgtagttggaattctcgaaattatattaacgaaaatcaatattgaagtaccattaccaattcccttaactgtaagttggtcacccaaccacatacagaatgttgtacctactactaatgagaaaattacaacaactttacccatagtatttaatccaactgctcctccactattagaaatcatagcaaatgttccataagctaaaacaaaagctattgcaagagatgcataacgagttaagttttgtatcttctttcttcctgtttcgccttctttagaaagctgttctagttgaggtatagcaacagttaataattgaataattatcgatgcattaatgtatggcataactcctaatgccaatatactagatctactaaaagcacctccggaaatcatatcataaaaacctaataaaccacccgattggctcaaactcttaagatattcagagttaattccaggaacaggaatatgacttcccatcctgaaaactgcaactagtaatattgtccataagatttttttcttaagttcaggaactttaaatgcattacgtagggtttgaagcacgttacatcacctcaacttttcccccagctgcctcaattttttctatagcagacttagagaacttacatcctttaactgttaagcttttttctaatgttccgtttccaagaatctttactccgtctaatactttacttacaactcttctttcaagtaaaacttctggagttatttctgtaccattttcgaagatgtttaatctgtcaatgttgatacaaacaaattccttgctgaaaggattagtgaatcctctcttaggtagtcttctgtataaaggcatttgacctccttcaaaaccaggtcttactccaccacctgatcttgcgttttgacccttttcacctttaccagcgtttcttcctaatcctgaaccagtacctctaccgattctcttaggtgcttttctactacctgctgctggttttaattcgtgaagtttcattctagtgcacctccttgtttattatacttcttctacctttaataagtagtctatctttttaatcataccgttaattgcatcgttagtttcaacttcaacagtatttcttatctttttaagtccaagagcgtttgcagtagcaatatggtctttctttctacctattaagctctttactaatgtaactcttactttagccattctgcaaaacctcctaacctaatatttcttctacagatttgcctcttaatttagcaatatcttctgcagttcttaaacttgctaatccattaattgtagcttttaccatgttgcttgggttgttagaacctaatgatttagctcttacgtcttttaatcctgctaattctaatacagctcttgctggaccaccagcgataactcctgtaccttctttagctggcatgattagaacatcagctgttccaaacttaccgtgtatttcatgaggaacagttgttccaaccattgaaacacttactaagtttttcttagcatcttctattccctttttgattgcttctggaatttcgatagatttacccataccaacgcctacgtgtccgttttcgtctccgacaacaactaatgcgctgaatctgaagtttctaccacctttaacaaccttagtaactctgtttataaaaacaaccttttctttaaggtctagtgtactaggatcgattctcatttatttccctcctcgttaattagaattttaagcctgcttctctagctgcttctgctaattcttgaactcttccgtgatatacgtatccacctctgtcgaatactacttcttgaattcctttttctacagctcttttagcaactgtttctccaacaagtttagcgccttctttgtttccgcctttagcagcgaaatctttgtctaagcttgaagcagctactaaagttacaccgtttatatcatcaataacttgtgcgtatatattcttttcactcttaaatactgaaagtcttggtctttccgcagtaccagatactttcttacgaactctaaggtgacgttttgctctgcttgcttttttgtctgcctttttgaacatatagagtcactccttcctattatttcttaccagttttaccttctttacgtctgataacttcgttttcgtacttaatacctttacccttatatggttctggtactctccattttcttatatcagctgcagcgaatccaactttttccttgtcgattcccttaacaactactttagtagcagctggagtttcgaaagtgattccatcgataggttctatttcaactggatgtgaatatccaaggttcattacaagcttcttaccttgtaattgagctctataaccaacaccaactaaatctaaagtcttttggtaaccttctttaactccaattaccatattattaattaatgctcttgttaaaccatgaagagctctatgttctttttgttcactatgtctagtaacaattacttcattgttttcaactgctatgcttatatcgctatgcatagttttaactaattcacccttaggtcccttaactgtaacaacgttgtctggtgttacagttacagttacatcagcaggaatagctattggtaatctacctactcttgacataattgcacctcctgtattatttaaaattgcttttacatacaattatatttacttaaaatttatataaatactaccaaacgtagcagataacttctccacctaaaccgttctttctagcttctctatcaaccatgataccttttgaagttgaaacaacagcaatacctaatccattaagaacctttggtacttcgtctctcttacagtaaactcttaaacctggcttagaaattctctttataccagttataactctttctttgttagctccatatttaagagataatcttaacattggaacaacaccgtcgttatattcgtttatttcttttatataaccctcttgtaataatatatttgcaatttccttctttacatttgaagaaggtacttctaccacttcatgtcttacagagttagcatttcttacacgagttaataaatctgctatcggatctgtcataaccatttaaatgtgcctcctttcgttacattgttgtattaccaagatgcttttctacaacctggaatttcgcccttatacgcaagttctctgaaacaaatacggcatactccgtatttctttaatacagaatgtggtcttccacatattctacatcttgtataagctcttgttttatatttaggagttttgctccacttttcaataatagccttacgtgccattgtgttccctccttaattattgagcgaatggcattccaaggaatcttaataattccctagcttcttcatcagtgttagctgatgttacgaagattatatccattcctcttactttatctattttatcatattcgatttctgggaatattaattgttccttaattcctaatgagtagtttcctctaccatcaaaagccttgcttgaaactcctctgaagtctctaactcttggtaaagcaatactcattaatttatcagcaaattcgaacatttgagcttttcttagagtaactttgcatcctaatgccatgttttctctaattttgaagttagctacagatttcttagctctagttaatataggtttttgacctgcaattagagttaagtcagcaacagctgattctaaaaccttttggttttctttagcttctccaactcccatgttaattacgattttttctagctttggaacttccattatgtttttgtatccgaacttttcaatcatagctggaactacttcttttacgtatttttcttgaagtcttgtcatattagttacctcctttcaaaaattagaatgtttctccgcattttttgcaaactcttactttagtaccatcatctaaaactttgttactaattctagttgcatttttgcatttgttacaatataacataacttttgaactattgatagctgcttctttttcaattatagcgctttcaagttgacttctgttagctttttgatgtttctttactatattaactccttgaacaagaacttttcctgtttttggatatgcttttaaaacttctccagtcttgcctttatctttaccagaaacgacaataactgtatcattctttcttacatgtatcttcaagttagccacctcctcttatagaacttctggtgctaatgataatattttattaaattctttatctcttagctccctagcaacaggtccgaaaatacgagttccttttggttgcttatcgtccttgattataactgctgcattttcgtcaaatttgatgtatgaaccatccgctcttcttacacctttaactgatctaactacaactgcttttacaacttcaccttttttaacaactccacctggtgttgcacttttaacgctagctactataacatcaccgatgttaccaaactttctcttagatccacctaagactctgatacacataatttcttttgcacctgaattatctgcaacttttaataatgtttgttgttgtatcattaagttaccctcctttcagctttacgcttatttagctttctcaactatttcaacaagtctccatctcttatctttagataaaggtctagtttccattattgatactctatcattaattttagcttcattcttttcatcatgaactttgaacttagtagttctattaatagtttttccgtatagtggatgtcttaccttagtttcaacagcaactacgatagtcttttccattttatcagaaacaactctaccgattctcttttttcttaaagctctttccattaggaaatacctccttccaaatcttattgttccaatgctcttaattcttcttctcttaagatggtttttatttgggctatagacttcttaacttctcttattctcattggattttctaattgtcctgtagctaattggaatcttaagttgaatagttctcctttaagatctcctaatttaactgctaattcttgaggattgcttgattttaattcttttaattctctagccttcattatctttcaccacccatttcctcaaaatctctctttgtaacaaactttgtttttacaggaagtttatgtgaagcaagtctcattgcttctcttgcagtttcttctgcaactccagataattcaaataatactctacctggtttaactactgcaacccagtattctggtgaacctttacctgaacccattcttgtttcagctggcttttcagtaactggcttatctgggaaaatctttatccaaagttttcctcctcttttgatgtatctattgatagcaattctggcagattcgatttggttactagtgatccatccacaagtttgtgcttgtattccgtaatctccataagctaagaaattacctctagtagccttacctttcattctaccacgttgtaccttacgatgtttaactcttttaggcattaacatgacttattcctcctttcctatgcgttagcctcttccttttctactactttcttagttggaagaacttctccattgtaaacccaaactttaactccgattttaccgtatgttgtatctgcttctgcaaatccataatcgatatcagctcttaaagtttgtagtggaattgttccttcatggtattgttcagttctagcgatttcagctccgccaagtctacctgaacatgcagttttaacacctttaataccatgtttcatagctctttgcattgtttgcttcatagctcttctgaaagatattctcttttctaattgtgctgcaatgttttcagccattaattgagcatctgcttcagcactcttaacttccacaatgtttattaaaacattcttgttgcttatatactgagttaatttaccctttaaagcttcaattcctgctccacctttacctataataactccaggttttgctgtatatatgtttaacttaactctcttagcagctctttcgatttctattttagaaataccagctgagaatagttcttttttaacaaattttctgaccttattatcttctataagattatctgcaaaattcttcttattagcataccattttgcgttccatcctttgatgacacctactctaaggccatgaggatttactttttgacccacttgcgtttccctccttctataaactaagctctttctttaacaactactgttatattgcttgttttctttaatattttaaatgctctaccttgtgcatgtggttggaatctctttaatgttgatccttgacctacgaaacactcagaaacatataagttatcagcatttaattctaaattgttttctgcgtttgcaacagctgactttaatactttgttaattactactgctgcttctcttggagtatattgtaaaatagcaaaagcttcattaacattttttcctctgattaaatcaagaactactcctacctttgttggagacattcttatatattttgctatagctctagcttccatttaatgatcctcctttccaggctatctctttgatgttttatcgtcgtgacccttgtaagttctagttaatacaaattcacctaacttatggccaaccatatcttctgatacatatacaggtacgtgttttcttccgtcatgaactgcaattgtgtgtcctatgaattgtgggaagattgttgaacttcttgaccaagtctttacaacctttttatctccgcttgcgttcatttcttctatctttttgaaaagtccttcatgaacaaaaggtgctttttttgttgatctactcactaaatatgcctcccttcataaatacgaagtcctagctgtgaagagaattcattctcctcacactattttcttctatctttgataatgaatctatcagaatacttcttattctttctagtcttatatccaagtgctggtttaccccaaggagtaactggacttggtctaccgattggtgacttaccttcaccaccaccatgagggtgatcgttaggattcataacagaacctcttactgtaggtctgaatcccatatgtctctttctaccagctttaccgatattaacgatatcgttagtagcatttgaaagtgttccgattgtagctctacattcgattcttacgtatctcatttcacctgatggtaatcttagagttgcgtaatctccttctttagccattaattgtgctgagttacctgcagctctaactaattgaccaccttttcctttttgtaattctatgttatgaattactgtacctactggtatgttctttaatggaagagcattacctgctttgatatcagcgtttacacctgattcaattacatctccaacttttaatccagctggtgcaagaatgtatctcttttctccatctgcatatacaactaaagcaatatatgctgttctgtttggatcgtattctatagtagcaacttttgctggaataccatccttatttctcttgaaatctataattctatattttctcttagcaccgccaccacgatgtctaacagtgattttaccttgagcatttctacctgctttgctctttaacgcaacaagaagtgacttttctggtgattgtgaagtaatttcttcaaatgtaggcatagtcatttgtcttcttgatggtgttatagggttaaactttttaactgccattgtaaaattccctccttctttaagcttctctggtgattattcaccaataatggctttgataatactattgcattccttcgaagaattcaattgcgttgctatcttcttttaaagtaatgatagctttcttgtagtcagctctctttcctacatgtacgcccattctcttagtttttcctaaaccgtttatagtattaacagcttcaacagttacgttgaatacttcttccacagctctctttatttgagatttgtttgcatcagcatgaactatgaaagtgtactttttatcggccatagatgccatagtcttttcagttataactggctttctgattatatcatggcttgttaatttcattatgcgtacacctcctcaatttttgatacagcatctttagtcatgattactttatcaaactttaataaatcataaacattgatgttgtttgctggaataacacttactccttggatgtttctagctgatttgtatacagcttcgtttgattctgcagttatgattaaagccttaggtgcttctaaagcatttaacattgctactacatttttagtctttggagcgtcgaagtttaatgattcaagaacgatcattgagttatcttgaactttgctagttaaagcagacttcatagctacctttctcatactctttggagtagaaactctgtaatctcttggctttggtgcgaatactataccacctttgatccattgaggtgctctgatagaaccttgtcttgctcttccagttcctttttgtctccaaggcttaattccgcctcctctaacttcagatctagtcttagttgattgagttccttgtctcttgttagctaataatgcaactactacttggtgtaatgcatattggttaacttcagttgcgaatacgctttcgttaagttccatatctgaaactttttttccttctatattatatactcctactgtaggcattctaatttcctcctttcttcactaattaagctctaactgtgtttttaattactactgtacctttgttaggtcctgggataccacccttgattagtattaaattcttttcagctattactttaactacttgtaaattaagtactgttgtattaacagatcccatatgtcctggcattctcttgttcttgaatgttctagatggatctgatgaagctcccatagaacctggtgctctgtggaacttagaaccgtgagtcataggtcctctttgttgattccatctcttaatacatccttggaatcccttacctttagatacagcagatacatctactttatctccagcttcaaatacatcagcttttatttcttgaccaacttcgtaagaagttatgtcttctaatctaaattctttaagagttcttcttacagaaactcctgccttagcgaattgaccttttcttggcttattagctaatttttctcttatttcttcaaaaccaacttgtattgcttcataaccatcattttctaatgttttcttttgaacaacaacacatgggccagcttctactacagttacaggaactactttaccattttcatcgaaaatttgagtcattcctattttctttcctattatagcttttttcatgtatttacacctcccaaactaattagcggattgaatccaatcataaatagtcgtattaattaagtttccagtattatagtttgatttctatatcaacaccagctggaagatttaatctcattaaagcatcaacagtttttggtgatggattaacgatatcgattaatctcttatgagttctgatttcaaattgttctcttgaatctttgtatttgtgaaccgctcttaatattgtaacaacatctttttcagttggtaatggtactggacctacaaccttagctcctgaagtttttgcagtttcaacgattttttcagcagattgatctaatattgtgtgatcaaaagcttttaatcttattcttattttttgctttgacatttcatttccctcctttttatgtacgttttacttctaacgcacaacagcggttatctgtaaactgttccaggtgtttcataactatccgaacaaatttacgagtccctgtcgtcggattctagatccaaacttactcatcaagaattacccggaagtccggcaacctcttgaatcttcgctgtatgctatgcaacttctttattatactattcttctttactcttttcaagtttttttttagactttttttaactttacaaatttattttttattttatttatttttttattttaatgttattttataaaaaattcaacaatctcttttaatcttttcactcaatttctcataaaatatatatgcattctataaagttatgtatttttctcaaacacgcttattacattctatcatgtatattttggtctttcaatctataaataatacataattgtttttttataaattagcataattgtttttatttttttgcttattctctttattaatacatttacttcattataatcttataattcttcacagatttatctctaaaataattttgataaattgtttaatttttcaaaataaaaaaagtagggataaatccctacttttaaatcacatcaaagatgtgtattattactattcaactatactagtaacaactcctgaacctacagttcttccaccttctctgatcgcgaatcttaatccttcatccatagcgattggagtgattaattcaacgttcatgtcgatgtggtctccaggcataaccatttccataccatctggtaatttgattgatcctgtaacgtctgttgttctgaagtagaattgtggtctatatccatcaaagaatggagtatgtcttccaccttcttcttttttaagtacgtatacttgacctacgaacttagtgtgtgggtgtactgagtttggtactgctaaaacttgacctctttcgatatcagttctttgtactcctcttaataatgctccgatgttatctccagcttgtgcttcatctaataactttctgaacatttcgattcctgtacatacagtcttcttcttttcttcacttaatccaacgatttcaacttcgtctcctacgtgaagtactccagtttcaactctacctgttgcaactgttcctctaccagtgattgtgaatacatcttctactggcattaagaatggcttatctgtagctctttctggtgttggaatgtagctatctactgcttccattaattccatgatacatttgtttgctgcatcatctgttgggttttctaatgcttttaatgctgatcctgttattactggaatatcatctcctgggaagtcatattcgcttaataattctctaacttccatttcaactaattctaataattctggatcatctaccatatcagctttgtttaagaatactactatgtattctataccaactcttgatcctaataagatatgttctcttgtttgaggcattggaccgtctgcagcagatacaactaagatagctccatccatttgtgcagctccagtgatcatgttcttaacgtagtcagcatgtcctggacagtcaacgtgagcgtaatgtcttgtttctgtttcgtattcaacgtgagcagtattgattgtgattcctctttctttttcttctggagccttatcgatatctgcgtagttgaacgcgtctgcgaatcctttatttgctaatacagttgtgattgcagctgttaatgttgtcttaccgtggtctacgtgacctattgtaccaatgttaacatgtggcttacttctttcaaatttctcttttgccatttgaatttcctcccttatagacataaatttttataagaatgtttcgtaattattataacttatagatatactaatatccatatttaacattcatttttttatatttaatttaaaaattaaatatttatttataataatgatgatatagtgatattttttattaaaatatcactatttcattatatactaatttaaaaatcaaccagttaaaactatttaacttttttaccagcgatttcttcttgaatattcttaggaacttcttcgtagtgatcgaataccattgagtaaactcctctaccttgagttctagatcttaatgaagtagcatatccaaacatttctgataatggaacgaatgctctaacaaccttagcaccattaacatcttccattccttcaattctacctcttcttgaactacagtctccaataacatctcccatatattcttcaggaactgttatttcaactttcatcattggttcaagtaatactggttctgctttagccattgcattcttaaatgccatagatccagcaattttgaatgccatttcagatgaatcgacttcatggtatgaaccgtgtactaacttaactttgaagttaataacattgtatccagctattataccatttttagaagcttcttgaatccctgcatcgatagctggtatgtattcttttggaatagctcccccaacgattgcattttcaaatacgtaatctccatcagttggttccatttcaattacagcatgaccgtattgtcctttaccacctgattgtttagcgtatttagcttcagctttaactccttttcttattgtttctttgtaagaaacttgaggagctccaacattacattcaatcttgaattctctcttaagtctatcaacgatgatatctaagtgaagttcacccataccagcgattattgtttgaccagtttcttcatcagtccaagttttgaatgtaggatcttcttcagctaatttagctaacgctaatcccatcttttcttgagcagcttttgatgctggttcaatagctatatcaataactggttctgggaattccattgattcaagaacaattggcttatcttctgaacataaagtatcaccagttgtagtattctttaatccgataattgctcctaattcaccagcttcaagtgtttcaacttctgatcttgaattagaatgcatcttaactagtcttcctattctttctttcttacccttagttgaattaagaacgtaagaaccactattcattacacctgagtaaattcttgtataagccaacttacctacgaatgggtcagtagcaatcttgaatgctaatgctgataatggttctttatcatcagcttctctcttgtcttcttccccttctaaagttgttcctgttacagcaggaatatctaatggagatggtaagaaatcaacaactccgtcgatcatttcttgaacacctttgtttttgtatgaagatccacaaatacatggaacaatttcattagctatagtagcttttcttaaagctatttttaactcttcaactgttaattcttcaccttcaaggtatttttccattaaagtttcatcagtttcagcaatagattctatcattgctgctctatattcttcagcttgatctactaaatcatctggaattgcttcttctctcatgtcttttccaagatcatcatagaatacgaaagcaacgttctttataaggtcaaccatacctttgaagttatcttctgcacctattggaagttgtattggaacagcattagcctttaatctatctttaactgtttgtatacatcttaagaagtttgcacctgtagcatccatcttatttacgtaaatcattcttggaactccgtatttatccgcctgtctccaaacagtttctgtttgtggttcaaccccactcttagcatcaagaaccgtaacagcaccatcaagtactcttaaagatctttcaacttctactgtaaagtctacgtgtcctggagtatcaatgatgtttaattcatgacccttccattcacatgaagtagcagcagaagtaattgttatacctctttcttgttcctgaaccatccagtccatagttgattctccatcatgagtttcacctattttatggttaactcctgtgtagaataatatacgttctgtagttgttgtcttacctgcatctatatgagccattattccgaagttacggaacttatctaaaggatattttctagccattatattcttcctcctctcagtgagtaaataattattttataatttgacaaaactgccttagcatgaagccaaaacagttttgttgtagatattagtatctgtaatgagcgaatgccttattagcttctgccatcttatgagtatcttctcttttcttaacagctgctcctgtgttgttagatgcgtctagtaattcaccagccactctttcacacattaacttttcgcctctttttctagctcctattaacatccatcttattcctaatgtctgtcttctttcaggtctaacttctattggaacttgataagtagcaccacctattcttctagcttttacttctagtaatggcattacgttattcatagcttcttcaaatacttctaaagcttcttttccactcttttgagctataatttcaaatgcatcgtagcatattttttgggcaacacccttcttaccatcttccattatgctgtttataaacttagttactacttttgaattataaactggatctggtaatacatctctttttgcaatatgtccttttcttggcacttttcttccctccttaacattttgaatttaagttcatcggtactcggtattatttactataccgcaaagtgctatctttacatctatatataaacttcatttcaaatctataatttccgttgaagatgagcactattaatagttaagatcctatagactattatttagctttaggtttcttagcaccgtactttgatcttccttgcattctgttagctactccagcgcagtctaatgcacctctaacgatatggtatctaacaccaggaaggtccttaactcttccacctcttataagaacaacactatgttcttgtaagttgtgacctactccaccaatatatgcagttacttcatatccattagttaatctaactctggcaatttttcttaacgctgagttaggtttcttaggagttgttgtcttaactactgtacatactcctcttttttgtggacactctttaagtgctggtgcagttgatttaactacagttgtttttctgccttttcttactaattggctaatagttggcattttttcacctcctgaaatttatttatctattttttaattaagataaaactattttatggtagtacattaaaatttaatgttcaaccagactatttatatataaatactaaaactcaactcaagttataatatattatatccatttttacacaaaaacaatcgtgttgacattaatttatgtaatttgatatcttaaatcacacaaaatgtattttatcatttatatatacacatgtcaacacaattaaattctattattctacagtttcagttatagcttcttctactacttcttcaacattatctactttaagatctctatatctcatcataccagtacctgctggaataagcttaccaataattacattttcttttaacccaactaatggatcaacttttcctttaattgctgcttcagttaatactctagtagtttcttggaaagatgctgctgataagaaactatcagttgctaaggctgccttagtaatacctaataatgtttcttcacccttagcttcttctcctccaaattctctaactctagcattttcttctctaaagtcaaacatatctatcattgtacctggtaataaatcagtatctccagaatcagttaccttaatctttctagtcatttgtctaacaacaacttctagatgcttatcgttgatatcaaccccttgaagtctgtaaactttttgaacttctgaaagtaagtatcttcttgctccatcaattcccttaatactcatgatatcatgtggattaacagaaccttctgtgatttcatctccagcttctatattatctccatcagttacttttaatcttgaaccgaatggaatatcgtagctacgttcttcaccgtcagcagtcattacaacaactgttctctttttcttagtttcttccattttaactgtaccagtcacttcacttactattgcaagaccctttggttttctagcttcgaataattcttcaactctaggtaaaccttgagtgatatctgcaccagtggcaacaccacctgtatggaatgttctcattgtaagctgtgttcctggttcaccgattgattgcgctgctatgataccaacagcttcaccaatatcgattttcttagcagtagccatattcataccataacagtgtgaacatacacctactttacagttacatgtaaatactgatttaatcttaacttttttgatacctgctgctacaactctttctgcaatatatggatccatatattgattgtttgcaacaataatctcaccattttcaggattaattatatcttcagcagtatatctaccaattaatctttcttttaattcttcaacaacttcgttgccttctttaatttcacttacatataatccatcatcagttccacaatcttcttctcttacgataacatcttgtgaaacgtcaacaagtcttcttgttaggtatcctgaatcggcagtctttaaggctgtatcggcattaccttttctagcaccatgtgtagatgagaaatattctagtacatctagaccttctttgaacgatgctctgattggtaattcgataatcttaccagatggacttgccataagtcctctcataccagcaagctgcttgatctgtgacttagaacctctggctccagagtcagccatcatgaatattggattaaacttatccatactatccattaatgcatcggcaacttcttctgttgtcttagtccatttttctataactctctcatatctttcatcatctgatatgaaacctctcttatacatcttttcgatcttttcaatagtttcatctgcttctttaagtaactcaaatttttcaggtggtactttgatatcagatgttgctactgttacagctcctatagatgaataatgatatcctaatgcttttatattatcaagcattatagaagtctttacaggaccatgttctaagtaacagttatctataatttttcctaaagattttttagtaactaagaaatctatttctaagttaaacatttcatcttcattttttctatctacaaatcctaagttttgaggaactgattcattaaatataagcttaccaacagtagtcttaataactttatgtctaacaactccatcaatttctctaaacattctaacattaattttagcatgaactgcaatagctttactttcgtatgccattatagcttcatctttacttgagaatgtcattccttcacccttagctccatccttatccatagttaagtaataagaaccaagaaccatatcctgtgtaggtacacaaactggtttaccatctgaaggttttaatatatttgtagctgcaagcattaaaaatcttgcttctgcttgtgcttctactgaaagtggaagatggacagccatttggtctccatcgaagtcagcgttgtacgctgtacatgctaatggatgtaacttaattgctctaccttcaacaagtattggttggaatgcttgaattccaagtctatgtagagtcggagcacggttaagtaaaactggatgatcagcaataacttcttctaacacatcccaaacttgtggttgaactctttctaccattctctttgcactcttaatattgtgtgcaattccatcttgtacaagcttcttcataacaaatggtttaaataactcaatcgccatttcttttggaagaccacattgatacatttttaattctggaccaacaactataactgatctaccagagtagtcaactctcttaccaagtaagttttgtctaaatctaccttgcttaccttttaacatatccgaaagagattttaaaggtctatttcctggtccagttaccggtctacctcttctaccattatcaataagtgcatcaactgcttcttgaagcattctcttttcatttcttacaatgatatctggagcacctaaatctaataatttttttaatctgttatttctattaataactcttctatataaatcattcaagtcagatgtagcaaatctaccaccatctaattgaaccattggtcttaaatctggtggaataactggaattacgttaattaccatccattcaggattatttcctgattttctaaatgattcaacaacttccagtcttcttataattctaactttcttttgacctgtactttgttttaattcttctttaagttcctttgaacctgcttctaaatctatttctgctaaaagttcttgaattgcttcagcacccatactagcaacaaagctatcttcaccatatttatcacaagcttctctatattctttttcgttaagaagttgtttctttaataaaggtgtttccttaggatctgtcactatataagatgcaaaatataaaactttttctaaagctcttggtgacatatcaagaattaatcccattcttgatggaatccccttgaagtaccaaatgtgagatactggggcagccagttcaatgtgccccattctttctcttcttactttagcttttgtaacttcaacaccacatctgtcacaaactatacctttgtatcttactctcttatattttccacagtgacattcccagtccttcataggtccaaaaattctttcacagaataaaccatctctttctggctttaatgttctgtagttaattgtttctggtttcttaacttctcctcttgaccaagctcttatttgatctggagatgctaaaccgatttgtattgcatcaaaattatttaattcaaacaagggtaagtcctcccttcaaaattagtgttcatcattaaagtcatcaagttctaattgaccttcaaactcgtcgatatctgcattttcgtcataatctatatcgtctaaatcttcttctttattttcttcataaccatcatctacgatttctggttcagcaactacagaatcttctgcaccttctatattaacttctaaatctgccacgtctccatcagcaaattcttttaattcaacttcttcattatcatcatttaataccttaatgtctaaacataaagcttgaagttcttttataagaaccttaaatgattctggtacacctggttctggaatattttcgcccttaacaatagcttcatatgttttaactctaccaacaacatcatctgatttaacagttaatatttcttgtaatgtatgagcagcaccatatgcttctaaagcccaaacttccatttccccgaatctttggccaccaaattgagccttaccacctaatggctgttgtgtaactaatgaatatggtccagttgatctagcatgaatcttatcatcaactaaatggtgaagttttaacatatacatgataccaacagttacttcattatcaaatggttcacctgttctaccatcatataaaattgttttagcattagcattaaatccagctttaatcatgcattcagttatttcatcttgagttgcaccatcgaatactggtgtagatatatgccatcctaaattacttgcagcccatcctaagtgaacttctaaaacctgaccaatgttcatacgcgaaggtactcccagtggatttaagcagatttgaagtggtctaccatctggtaagaacggcatatcttcttcaggtaatattcttgagataacccctttattaccatgacgtccagccatcttatctccaactgatatttttctcttttgagcaatataacatcttacaagttcatttactcctggatttaattcatctccattttctcttgtaaagactttaatatcaactattatacctgcttcaccgtgaggtactcttaaagaagtatctctaacttctctagccttctcaccaaagattgctcttaatagtctttcttcagcagtaagttctgtttctcccttaggagtcaccttacctactaatatatcgccagatctaacttcagcaccaattctgataatacctctatcatcaacatccttaagtgcatcatcacttacattaggaatatctctagttatttcttctggtccaagcttagtatctctagcttcacattcatattcttcaatatgcattgatgtaaacacatcttctctaactaattcttcagaaataagcatcgcatcttcgtagttataaccttcccaagttatgaatcccattctgatgtttttacctaaagcaatttctcctaaatcagtagaaggaccatctgcaattacttgatttttaaatacaatttcacctttatcaactataggtctttgatttgcacaagtacctgcatttgttcttttgaactttaataatttatatacatcagttcctccatcagaatctctcttaattctaatttcgcttcctgatacataagaaacaacacctgcatttttagcttttggtaaaactcctgagtctaccgcagccttaaattctataccagttccaacaactggagcttcagtttttaataatggaactgcttgacgttgcatgtttgatcccatcagtgctctagtggcatcatcattttcaaggaaaggaatcattgcagttgcaacagaaaccatttgtcttgctgatacgtctattaaatctacttgattagatggaataaataaaacatcttccaagtatcttaccattactttgtcttctaagaactttcctgtttcatccataggagtcttagcttgagcaattaagtattggtcttcttcatctgctgtgaaatatcttatttcatcagttgctcttgcattttctttatctacaattctatatggagtttcaataaatccatattcattaactttagcaaatgtagctaaagagttgattaatcctatatttggaccttcaggtgtttcaataggacacattctaccataatgagaatggtgaacgtctctaacttcgaaaccagctctttctctagaaagacctcctggtcctaatgcagataatcttctcttatgtgttaattctgataatggattagtttgatccatgaattgagataattgcgaacttccaaagaattctttaatagcagctgcaactggtcttatgtttattaacatttgaggagttatcgcttcttggtcttgaatagtcattctttctttaactactctttccattcttgataaaccaattctaaattgattttgtaataattcccctactgatcttaatcttctatttcctaaatgatctatgtcatcaacgtaacctattccatatgctaatcctaattcataactaatagttgcaaatatatcatctcttattatatgtttaggaataagtctatgaatatttttcttaatttcctttttaatagtgtcttcatctgagaagttatctaagatttcttttaatgttggatagtgaactaattctttaattcctaatcccttcacatcgaaagaaacttgcttgcttaaatcaacaaagttattactaattacttttataactttatcttcaactaataaatctacagattttataccactattttggatgtcttctgccattaatctgcttatcttttgaccttcttcaaccataacttcaccagtttgagggttgattatgtctgtagcagccacttgattagctattcttaaagctaatgcaagctttttattgaacttatatcttcctactcttgataaatcatatctttttgcatcgaagaataaagtatctattagtgatatcgcactatcaactgtaggcggttcacctggtcttaatctcttatatatttcaagtaatgcttcttcttttgtctttgtattatctttttctatagaagctctaaatctttcttcttctccaaagaaatctattaattcttgatcacttcccatacccatagctcttgctaaaatagtaattggtagctttctagtcttatcgattcttacataaataatatcattagaatctgtttcatactccaaccatgctcctctattaggaattacagttgaagaatacagctttttaccactcttatctatagtgtagctgtagtatacacctggagatcttactaattggctgacaataactctttcggcaccattaattaaaaatgtaccttgttctgtcatcagcgggaaatctcccataaaaacttcttgttctttaatttcacctgtttcattattttgtaatcttaccgaaacttttaatggtgctgcataagttgcatctctatctttacattcttccactgaatacttgatgttttccatatcaagtttatagtctacgaattcaagcactaagtttccagtgaagtttgtgataggattaatatcatcaaaaacttcatgcaacccttctcttaaaaaccattgataagaatctaattgtacttcaattagatttggcatttcagtaacgtcattaaccttaccgaaactcattcttgttctttttccaacttggacaggatgtaccatgaattttcaccccttgtataaaataaactaaaatagccaaaagcgtactttccctaaggactttagctttcggacagcatctttattatagtataaccattattcgccagattatactacatctttccaccatgaatatatactattccatagtgaataatacattatattataatatcatattacaattttattgtcaattatttttttactcttttattagttataaagctatataaaatacctattttttaaacaagcattttatatagctttataaaaagagtttaaaaaaggtgctttatataaagcacctttagttaagtagactatttaacttctacagtagctccaacttcagctaatttagctttcatgtcttcagcttcttctttagaaacgccttcttttaatgtcttaggagctccatcaactatttctttagcttcttttaatcctaatcctgttatttctcttacagctttgataactttgatcttgttatctccagcgttagctaatactacgtcgaattcagtcttttcttcaccagcagctccaccagctacagctccaccagctacaacagcagcagcagcgcttactccaaattcttcttcacaagcctttactaattcgtttaagtctaaaacgctcatttcttttattgcttgaattatatcttctcttgtcattttaatagcacctccgaaaatttttctaaaattatttaatctttaatattattctgctttactttcagctattgcattaattacacgtgcaaagcttgagattggtgacttgatacttccaagaagttttgcaataagaacttcttttgatggaatagtagcaagttgtttgatcttgtcagtgtcgtagatttctccttctacgataccagcttttaattctaatttcttatgatcttttgcaaaatcattaagtactcttgcagctacagttacgtcttcgtatccgaaagcgatagctactggtccttctaagtattcaacaataccttctaaacctaattctttagcagctaatataactaaagtatttttgtatactttgtattcaacaccagcttctcttaagttctttcttagaactgtatcttcttcaactgttaaaccttggtattggctaagaacaactgaattagctttttctaatttttccttaatttcagcaacctttgcttctttaagtgatctgttattgttcattactacggtccacctcctcatagttttaaatcatatttatcaaaaaagatctccccgtagacatagggagatctataatatcatctattatatatccctcggcgggtagttaccttttatgctttcgcacccactgtctacggaaaaaactatttttcaattttcacaacatcaaatattatattacaatattatatttatgtcaatactaatctaacgctcttgttggattaatttttgctcctggtcccattgtgcttgaaacagaaactgactttaagtattgtcccttagcagctgctggtttagctttaactaaagcttccattaatgctgtaaagttttcctttaatttttcagttccgaaagatttctttccgattggacagtgaacgatagcagttttatcaactctatattctactttaccagctttgatttcttcaattgccttagcaacgtcgaaagttactgttcctgattttgggtttggcattaatcccttaggtcctaatactctacctattctacctacaacacccatcatatctggagttgcaacaactacatcgtagtcaaaccagttttcgctttggatctttgtaactaattcttcagctcctacgaaatctgctcctgcagctgtagcttcatcagctttagctcccttagcaaatacaagaactctaactgttctaccagttccgtttggtaaaacaacagctcctcttacttgttggtcagcatgtcttggatctacaccaagtcttacatgtaattcaatagtttcatcaaagttagcctttgcagtctttaatgtaagttctaatgcttcatttggattgtataatgcacttttatcgataagctttgcgctttcaacatatttttttcccataatttgcctcctctgtggtagtaacggttttgacctcccacttatttttacgaaattgagttagttgatattattcttcaactgtaactcccatacttctagctgttccagcaatcattctcattgctgattcaatgtttgcagcatttaaatctggcatttttgtttctgcaatttttctaagttggtcttgagttaagtttccaacctttgttctatttggtactcctgaaccgctgtctaatcctaattcttttttaattaaaactgcagctggaggagtctttaatataaaactaaatgatctgtcttggtaaactgttataactactggtattattaatccagcttgattagcagttttagcattaaactccttacagaatcccattatgtttacaccgtgttgacctaaagctggacctacaggtggagctggtgttgccttacctgcttgaagttgaagtttaatcattccagttactttcttagccattttgttattcctcctattactgtggtaaatacgaactttttgttctcccacttaattaaaatcagttgtatattaaactaatttttctacttgattaaagtctagttcagcaagagtttctcttccgaacatatctactaaagccttaattttacgtttttctaaaactatctcttgaattgttgccactgaatctctaagtggacctgaaataattttaatactttcccctacttctaaatcaatatcaactggcatttctaaaacacccattgattctacttcttcatcagatagtggaactggtttagatcctggtccaacgaaacctgttacgcctcttgtatttcttacaacgtaccatgattcatcactcattaacattttaacaagtacatatccaggaaactttttcttcaatgagactttttgttttccatctttttcttcaatcacttcttccataggcacttgtatgtcttggattaatgattcaagatttctattttcaattgctttttctaagtttgctttaaccttattttcgtatccagagtatgtatgtactacataccatcttgctctatcactcatacttgttaggtgattataacaaatcaccaaacctcccttttacttcaattttaaaatcatttcaaagaggttgctgaaaataaaatccaatccactaactaatacaatatatattagtgcgaatataacaactgcaacaaatgctttttttgtctcatctttagaaggccaagttattctcttaacttccgccttaacctctctaaaaaaaccaaacaagccatttttcttaacagctttttcagtttttgtttcattttttgctgacatattttcacatccttaaatcaaattgacatatgtcattgctatgcggctaattatttagtttctctatgaagagtgtgctttttacagaatttacaatactttttcatttctaatctatctggatcatttttcttgttcttcattgaatcataatttctttgtttacactctgtgcatgctaaagttacttttgttctcatgactgcacctccagttttatatatattaaacaaaagagtttttcttttgtttcattcaaatttattgccttaaaaatgtcacttttaaacaatagcatagaatatgtaaattgtcaatcttcctttaaataggactaagtccaaaaacttagtccatataaacatattaactatctactattcaactatactagtaacaactcctgaacctacagttcttccaccttctctgatcgcgaatcttaatccttcatccatagcgattggagtgattaattcaacgttcatgtcgatgtggtctccaggcataaccatttccataccatctggtaatttgattgatcctgtaacgtctgttgttctgaagtagaattgtggtctatatccatcaaagaatggagtatgtcttccaccttcttcttttttaagtacgtatacttgacctacgaacttagtgtgtgggtgtactgagtttggtactgctaaaacttgacctctttcgatatcagttctttgtacccctcttaataatgctccgatgttatctccagcttgtgcttcatctaataactttctgaacatttcgattcctgtacatacagtcttcttcttttcttcacttaatccaacgatttcaacttcgtctcctacgtgaagtactccagtttcaactctacctgttgcaactgttcctctaccagtgattgtgaatacatcttctactggcattaagaatggcttatctgtagctctttctggtgttggaatgtagctatctactgcttccattaattccatgatacatttgtttgctgcatcatctgttggattttctaatgcttttaatgctgatcctgttattactggaatatcatctcctgggaagtcatattcgcttaataattctctaacttccatttcaactaattctaataattctggatcatctaccatatcagctttgtttaagaatactactatgtattctataccaactcttgatcctaataggatatgttctcttgtttgaggcattggaccgtctgcagcagatacaactaagatagctccatccatttgtgcagctccagtgatcatgttcttaacgtagtcagcatgtcctggacagtcaacgtgagcgtaatgtcttgtttctgtttcgtattcaacgtgagcagtattgattgtgattcctctttctttttcttctggagccttatcgatatctgcgtagttgaacgcgtctgcgaatcctttatttgctaatacagttgtgattgcagctgttaatgttgtcttaccgtggtctacgtgacctattgtaccaatgttaacatgtggcttacttctttcaaatttctcttttgccattgaaaattcctcctttaatcttgtaataaactttgcctagcgttttttatttttttattttggagctcacaatcgggattgaaccgacgacctccaccttaccaaggtgacgctctgccaactgagctatgtgagcgtttcgaaatcatatcgttccttgatataccaattataaagtttactattaatttttttgtttgtcaatataaattatcactttactttcaagcatttttctaattttcttttcactctttgaagtgcattatctatagatttcgcatgcctttctaaatcgcacgcaatttcttggtacgatttaccatccagataagatgttaacacctctttttcaagctcagacaagactttcgaaattttatcctctataaaatgcatttgttctttactaatcatcaactcttcaggatcagatatttttaatccagataacacatccaaaagagttctttctgattcttcttcatatatcggtttatttagtgatacataagtatttaaaggtatgtgcttttgtctagtagcagttttaatggctgtaataatctgtctagttacacatatttctgcaaaagctttaaaagatgtagatttttcaggattgaaatcacgtatagccttatataatccaatcataccctcttgataaatatcctctttatcagcgcctataagaaaatatgatttagctttagcttttacaaaattttcatatttggaaattaaatactcttgtgctttgttatttccagctttagcatccataacaatctcttcatctagtttgtctttaaattctaaaaatccttccaactataatctctcaactctcttctaaaattaaactgctataccttttaaacaattatactctagaaaaatcgctttcgtcaaccagttctacttacctctgcgcatttcctctaactttttaactatatcttcatttatattatcagctacactatttttctgattaactttaattttacttgtttttatgtttatactcttttctacctttagaatctcattataaaattcaatagatgacattctgactgctcctctttggaaaactgtttgttgttccaaattatccgaggttacaaccactacctcatgttttctccctatttcatttacatgtctctctatataagcatcagcagtttctccatctttggtaaatacaacacatatatttttattaatttcttccttcttttctatgcttccttgaactttatgtgcatcaaaaactaatataattctgcaagccttaaacactccataattatgtaacttatcaataagactctgtcttgcaccttcaaaactaacatctttcttttcttttaagtctggccagctatttattacattgtatccatctacgaaaatatttttcatagtatacctcttatttaaagcgaccttttaatacttcatacatcattattccacctgcaactgatgcatttaaagaatttatttttcctaccataggtatttttataagcttatcacacttttgaacagtaagctttgacatacctcttccttcatttcctattacaagagcacaaggaccactataatctacttcatgactatattcttctgctcttatatcggctccataaatccagactcctttttctttaagttcctctattgttgaatttatattattcacttttgctactttaacatgttctattgctccaacagatgatttatatacggttgcagtaacagatgcacttctcctctttggaattataataccatgtacaccaaacaattctgctgttctagctattgatccaagattatgagggtcttcaacctcatctaatataacaataaatggtgcttctcctttttgttctgctagttcaaatatatctgacacttcactatatttaaacggagtaactttagctattacaccttgatgcgtttcaccatcacacatactatcaagctttctcttatcaacttcttttataagtattttctgctcttttgccattcccataatagcatttatggaaccttcaagcttattgttagatacatatatagcttctatagttctatcacccttcaaagcctccataacagcatttcttcctataacaatatcttctctttcttcctgacatgttatacttttattttttttcaaaggttcattttttctatcttttttaacagttaaattactagtcttttttggtttattctgcatttcaagacctcccttacttatcttttgaatttattccatcatctctatgctcttattaaatataaattccagtctatccttttttcccgataaatacaaataccctactaaagcttcaaaccctgttgccattctataatctcttacatctgcattcttaggaacagttgctgactttgcattacgtcctcttttataaacagcttcttcatcttcttctaaaaatccttctattttatgcattatagacgcctgactttttgccttgacatactgtattgccttaacatgaattttatttgctgataaagctgtattattagctagtatatagtttctaataaaaatttcatatactccatcaccaattaaagccaattgaagtggattaagcatcctcgcttccatctctgtaaattctcttattctaaaatcatctaacattaataaattctcctttaaataagggttgcaaatcatgcaacccttattttaattaatcaatctttttccatctaacaccttgtggtgtatcttctaaaattatatttctggcttttaaatcatctcttattttatccgccaatgcaaaatctctgttttttctagcttcttgtcttttgtcgattaattcttggatttccacttctagagatttctcttcagttttttgaagaattccaagagggcttcctaattctcttattaaatttaaagcaccttcacacaattcagatgatgaatctatacttacattattgtttatatcttttatcaagtcaaatattaccgaaataccatcagcagtattaaaatcatcatccatcttctcaatgaacttttctctgtgtttatctaaagattttaagtaagctttttctgaatcattagcttcttttctattaacttcattgattaaattttcaagattatttacgcaattgtataatctttcaaccgaagatttagctgaatctaaaagttctgcactaaaatttatttgagttctataatgtccagataacattaaaaatcttattacatctgaattatatttctttaatgcttctcttgcagtgacaaaattattttcagatttagacatcttcttattatccacattaacaaatgctgcatgcatccaataattagcgaatttttgccctgttacagcttcactttgagcaatttcattttcatgatgtgggaattttaaatccattccaccaccatggatatcaatagtgtctcctaataatttctttgccatacatgaacattcaatatgccatcctggtcttcctagtccccaaggactttcccatgctggttcacctggcttttgtgatttccacactgcaaaatccattggatctttctttctttcatcaacacttattcttgcacctgattgtaaatcttctaaattctgaccacaaagttttccatactcttcaaacttcttagtactaaagtaaacatcgccatcaatttcataagcaaaacctctatctattaaatccttaacaaattctacaacttcatcaatatactcagttgctctaggattaatagtagccctttttacttgaagtccatcagcatcttgataatattcatctatgaatttatcaccaagttcctttactgttataccttctgcatttgctttattaatcattttatcatctatgtctgtaaaattttgaataaatgtaaccttgtatcctctatattctaaatatcttcttattgtatcgaatattataaatgttcttccattaccaatatgaaaatagttatatacagttggtccacatacatacatcttaacttcacctggaacaataggaacaaattcttctttttgtcttgttaaactattatatagtctcatcgaattacctcctaatacttatcttaatttcatattatttttttcaaattcaccttttactatattgcaaacatcacttattttaattacttccatatctccatctctaagcttaaattcaacttctccatcagtaatttttttaccaacagttactctcattggtattcccataagttctgaatctttaaacttaactccagctctttcatttctatcatctaaaagcacttcgactcccatagaaactaattgatcatataattcagttgcaatttttacctgttcttcatctttaacatttacaggaattactgaaatatgatatggcgcaactgataatggccatattattccattttcatcatgatgttgttcgattattgaagccatagttcttgtaactccaatcccataacatcccattacaaatggtttttccttaccatcttcatctatgaaatttgcattcatggcatctgaatacttcgttccaagcttaaatatatgacctacttctgtacctcttgcaatattaattggagctccacaacatgggcatttttcaccttcagttacatttctgaaatctccaacagttccttcaaaatctcttccatagtttacattttcaacatgatatcctgtttcattagcaccagctataaaattatacatattagcaacttcttcatctactaacagtatatccacttttattccaattggtcctgcaaatcctacagctgcacctgtagcattttgaacttcttcgttacttgctaaatcaaagttcgtaacttcacctatggcatttgcaaccttaacctcgttaatttctctatcgcctctaaccattactgcaactatctttccatctgcattaaataaaatagttttagcaaacttctttgaatcagccttaaagaaagcagcaacttcatctattgttcttgaatttggtgtttcaactttgtttagttcttttaattctgtcttttcttctttttctggatttgatactgctttttctatattagcagcataattacactcactacagaatactacatcatcttctccaacttctgatttaaccatgaattcagcagagttagatccacctattgcacctgaatcagcttcaacacatttggcatctaatccacatctattaaatattttaacatatgcatcatgcattttattaaatactatgtctaatccatcttgatctttatcaaaactataagcatctttcattataaattctctagatctcataactccaaatcttggtctacgttcatctctgtacttagtttgaatttgatataaattaagtggaagttgtttatatgacttaatttcatttcttgcgatatctgtaaatacttcttcgtgagtaggccctaaacagaaatctcttgcgcctctatctttaactctaaacatttctgctccataagcatcccatcttcctgattcctgccataattcagctggtatcatagctgatgcaagaaattcttgtgctcctgctgcattcatttcttctcttacaatatcttctacatttttaagcacttttaatcctaatggcatataattgtatattcccgcagccatctttcttatcattcctgctcttaacataagcttatgactatcaatttcagcttctgctggtacttctcttaatgtagagattaacatatttgacattttcatattaaaattcctcctactaactttatgtttttatttataacaatgattaaatgttttacgattttaatcactaaaaatatcttatgtgtaatttgctcaaaagtaatatttaaaaatgtccatattacatataaattatagttatcaaaaaacacttaaaatataagtatttatacattttgaacaataaaaaaattcgccctaataatatatattagggcgaatcaactcgcggtaccacctaaatttgttctctaaataatgataacggtattaaaccgatagttttttcctactgctccgaagctggttcaaagtctattaaaagtcttacagcctaaggactttttctcttaaagggcgacttctactattctccatcattgctctaaaatttcattttattttattttattataactttttaaaaattaactgtcaatatattaagattcgaccaaatattgtgccaatattaaatcttctggagttgttattttaatattagtatattcaccttcatatagataaacatcatttccaaaaagttcaacaaccattgtatcatccgtaacatccagatgtttttctttaacttttttatggcacccaaatataatattataatcaaaaacctgtggtgtctgaacagccacaagattgtttctatctggagtttctaaagaaaaactttcttgattttttacttttatagtatccttaggcattacacctggagctgctgcaccatacatacgtgcatatttaattccttcttctataattctttcagatacaaaaggtcttgcaccatcatgaataagaactatatctgatccatcagctttcttcaaaccattatacactgagtcttgtctttctttcccaccaaaagcaattgaatctatttttaagttatatttatctaaaacttcgttcctacaaaattctaattcatcttcaggaattactaatataactttatctatattcttattatttataaaatgattcagagtgtaataaagaatgggctttccattcaaatctatgtattgcttgctttgaacagagcccattctcttacctcttcctccagctaatactattgcactaaccatttagaaaagtctcctttgtttttaatttaattttctttaggtttagcaaagatcattcttcctgctgctgtttgtaaaacagatgtaactagcacatctgttgttttacctatgtgttttcttccaccttcaacaacaatcattgtaccatcatctaagtatgctacaccctgacttgattccttaccatctttaactatatcaactaccatttcttctcctggtaaaactactggttttatagcattcgataattcattaatatttaatactggaacgccttgaaattcagcaactttatttaaattatagtcgttagttattactttaccattcattttttgtgcaagcttcaaaagctttatgtctacttcaggtattttagggaaatcatcgtctactattctagtttcaattgttaattccttttgaatcttattaagtatatctagacctcttctccccctatttctttttagtgaatcagcagaatctgatacgtgtcttaattctactaatacaaagttaggtataattaatggcccctcaataaatcctgtttcacaaatgtcaaaaattcttccatcaattattacagatgtatctaagattttaggaatttcacctttttcttcttttgctacttctttagatccatccttaacttttttttctttattgattggcctttttatatttactagtaatgaagtaatatcttcattctttttcactaaaatttcagctccaataaaagcagctaataaatttaataaaactaaaagtataggtccataaaatttatgaatatcatttattggcttagcaataaatgtcataataattagagccataacagcacctacagttccatagattatttctgttatactcattttttgcatacttttttcaatgtattcaatcaagttagaaatacccttatatattgcaggagaaataatatataatataagtccaaatataatagaaagaataattataaagctgattcgtgaaacactttttgaaaaatatgacaactcagcaatttgtggtatttcaagtaaagtttccgctataatataaccaatacttaatcctattgcggaaaatactccttttgttagcttctttaacatctatttcacctccttctaaattatttacacattttcattgttttaatcccttttttaaaaattacactatattgttaattataacatacaatatctttatctaaaatgaataaattattaagtttaatttattagtccccctattaatttcattattttttttgtattatatttacatatttcaaatcaaattattgccgatatttaattttacttatattgtctttctctattttaatttagttaaggagctgaaaaatatgaaagatataatatttgatgattttcaaaattgtgtgaatgattcattaatacgtcataaaagtattttagatatactcactaaatatagtgaatctacttccaaagtaaataggtctgttgctaaagctgtaactcaatgtggttgcataaatatttctgctcagaaacaacatattccacaagagccttctgattctgaagtagacttgaataactatctaacttctcatctcaatggtaacctttgtgataactgtcgtgaaataatagaaagagaaattggcaataatttattttatcttactgcattatgcaatcatttagatattaatctatatgatatacttcttaaggaatataataaatcagttactttaggcaaatacaacctacgctaatttaaagtataaaaaaattcagaaaagtaaaatgagattaatttatccattttacttttctgattaaatatacataattataattctttttttaataaaacctgttcttttatacgctttaaaccattttttattgctgtagctcttgcttcaccaataccttctactttatctaagtcatctatatcagcctcaattatactacttaaatcttcgaattccttaataaggttttctataacatttgaaggtatccttggaactttacttaaaattctatatcctttaggcgatattaaagtatccataagaggtattcctccataccctaaagtttttgctatggcatccaaatcaggaagttcagaagaattaagtctttgaatatgttcataaacatcattgtgttcaaatccttcagcacaataatcttgtattaacaatataccatctctttctatgtgcctaacaagttcattaagctgcatagaaattaatcttccttcatttccaagttctaaaatatacatatttatttcttcaacaattctcattaccatctcagtcctttgaatcgcactaactacatcaaataatgtggttaaatcctgaaattcaagtaaattcaaattatttattacacgttctaaaacagctacgtatttttctagtgtttgtatagcttgatttgctttacttaaaataacactactttctctaagtacatattttatatcacctttgtacatagttattatatttcttctttgagatattgcaataacaatattattagtctgttttgctactctatgtgctgttctatgtcttgttcctgtttcataagttggtattgatgagtctggaatcaactgagcatttgcgcaaacaattctctttaaatccccagttattactatagctccatccattttcgctaattcatagacatatgaaggagtatattctgaattaatataaaagccgccgtctacaagttccattatctcttcgtcatcaccaactactataagtccacctgttttagctcttaatatattttctattccttctcttagctgagtgccaggacatattatttttaatacatctttaatacttgttcctttttctaatctcatacactcaccccttttcataataaaatatttcaaaatttataaaaatataatttatggatatataataagtccattttttaatatgtagtaacagttaaactctaaattctataatactatattaaatttgtactctcaataataattctaattatttaaagcttcgttaataatattcatttatactttatcagaataattctaaatatacaatcatttcctatgttatatttaattacgcatatacatgatttataacatttgctaatgttttaagctgaacgatatcaataccttcaatattaggctttttgataaatgaatctttaggaacataaactcttctaaatcccattctagccaactcttttattctgctttctaacgatggtacttttttcaactctccagttaaccctacatctgcaataaaagctatattggattcaattccttgttgttttactgatgaaacaatactcattataacagctaaatttatcccctgttctcgaatttttatgcccccagtagtttttattattacatttttatcaaaaagatttattccacctctttgttctaatatagatatcaaagtatttagcttatcttttccaagagtttcaccaatacgtgttggataaggtgtaaaacttttcgaaacaagactttctatttcagttattatagaacgtgtcccttcttttataaccgtcagtgcacttccagaaacaatttccccttcatcacgtttggtcatgaaaaattccgatggattatctattgatattattcctctttcacacatttgaaaaaatccattttctattccaccaaatctatttttagaactcaccaatactctaagttcttcatcattgtcgtcttcaattataagaacagtatcaacaagatgctccaatgcccttaaccctgcaagttcatcatttttagtcatttgccctacaataattactgctctttgtcttttttcattcttagcaacatttagtaaagcatttgcacattccatagtctgcgttggtgatccagctctagctggcattgcattctccattgtaaatgtctgaatactatcaattataactaaatcgggatcaatttcttcaattgcatctaatacattgtcaagactagtttcttgaagcacccatatattttcatttatcttatcaagtattctatctgctctattttttatctgactatcactttcttctcctgaagcatatataaccttaagtccacgcttagatacttcatttgaaatctgaagtaataaagttgatttcccagcaccaggccttgctgtaattatcgatattgaatcttttacaattcctcctcccataactctgtcaaattcatttataccagtaattatcctatcactcttatttgatactacttcatttaatttttttaatggctttttagttgcttcccttacttttgctgctttagtatttttatcagcaacaacaacttcatctaaagtattccaacaattgcatgtaggacatttcccaagccattttatgctttcgaatccacaatttgagcatctatacactgtttttttcttcattaaatgtctccttagaaaatttatatcaaaatcttaaccttattaattattataccataatacactcttttaataattcaatttacttacattaaaagtatttaataaattcgtaattatatttattatttttagcataattaaggcatttattacaaaaactatagtaaataattttgaggagttgatatttatgataagtaagaattatcttgataatattcccgaaccaacatcaaatattcttcataattcttatgaaaaaaatctgacagatttatcatctacaaagtgttctgagggccagtttaataatttagtcttcaattctaaccttgatgattctaatattataaaataatgaattatagtctattgtattaaaaatagtctagctttaactaagttatgaaataaatcttaaataatatcatgtttattctcttgcttgcatattaaacctatactataataataatcataaaataataattattgattaaggaggtgaaaaaactattgccacataaaatcattatttttatatgcacgcaatagttttcttatgataaaagtatatactacagattcgtgtccttggtgtgacaaggttaaagcttatttaaaatctcaaaaccttgagtatactgaattaaatgtccaagacgatatggaagcaagagaagagatgattaaaaaatctcgtcaaatgggagttccagttttagatattaatgataatataataataggatttgataagcctgctattttaaaagctttagataaataaattcatataaaaaaggagcctattgaatagctcctttttttatatgaatttatttattatccttattttttaattgctttatctattaatgccctattaaatcctacaattatgtttccatcgcattcaataacgggtactgttctctgtccagatactcttaatacttcctctctatcttcctgtttatctgcaacatttatttctaaatattctattcctttaaaatcaaaatattttttaacctgcacacattcaggacaccaagatgttgaatatacttttatcattttttacttcttcctttctaatatatacttttctgcatttaatagagctatagttccatcagatacagctgttgtaatctgtctatattttttctctcttacatctccagctgcatatacgccttttatattggtttccatatcttcatttgttattatgtaaccctgctcatttatatttaaatattttttaacctcttccgttttaggttcagttccaatatatccaaagactgcgtctacttttaattcagaaactattccatctaaagtattctttaatacaacactatttaaaaaatcttgtcctttagcttctattacatcttcatttaataatacttctatcttaggatgattaaacacttcatctataactgactgttcacctttaaagtagttatatctacgaattaaatatactttttcagcaaactttgtcaaaaataaagcttcttcaagtgctgcatttccacctcctacaactgcaatatttttcccttcatacatagcaccatcacatactgcacaataatgaataccctttccagcaaaattcttttcaccttttatcggtaatttccttggtatagcaccagtcgcaattatcactgcttttggcttatatataaaagtttctgtctcaataactttttcttcttctgaaagatctattttttcaattaaatcaaattcatctataactgctccaaattcagcagcttgttcttgaaataaatcagcaagttttccaccttgaatattcttaaatccaggataattttcaatagtgaaactatttctaacctgtccacctaagattttattttccaaaagtaatgtatttaattttgctctacctgcatatatagctgctgttaatcctgctggacctccacctattattattaaatctaactctttaatttctttaaccataacttctcctaaccatttggctcagtaatacaaactgtaaatgatatattactacttttcatataataccattacttaagattttacaaattatcaggaacagttttaatcttgaaccaatcatttatatctttgtattgattttatcactaacaagttaatttgtgtataattatttttatctaataataatattcccttaactttaatcaactatactagtttaaatacaagattttatcaataaaaaagttaattaacacaataaaatttaaattaatattttatataaaactttctactaatacgatctttttccaatgtattaattataataaatagactgttttaatagttttatacatttctattaaaacagtctaaataattatattaatttgctaaaaataagtttatcgtctaaattacttactttaactttatctccaatttgaatatttccttgaagaatttcttcactaagcctatcttctacttccttaattagaattcttcttaaaggtcttgctccattctcaagatcaatccccttatttaaaagaaattccttactattatcttcaaaatttaaatatatttctctatgttctaatctatctttaatagactttaacattaagtccataattttatctaaatcttgatcgttaagtttatgaaatactatagtatcatctattctattaagaaattcaggtttaaattgtttcttaagttcacctaaaatattttctttcattttttcataatctgactcctcattttgagcggaattaaatcctatagttttctgtttcttaatttgatgtgctccaacattagatgtcattataattattgtattcttaaagtttacaacctttcctttaccatcagtaagtcttccatcttccattatctgaagaagtatattaaaaatatcttgatgtgccttttcaatttcatctaacaatacaattgaataaggttttcttcttactgcctctgttaattgtccaccatcttcatgacctatataacctggaggtgcaccaattagtttagcaactgaatgactttccatatattctgacatatcaactcttatgatgctattttcatctccaaacatagcttctgcaagagcctttgaaagctctgtttttccaactcctgttggtcctaggaaaataaagcttccaataggcctattaggatccttaattccaactctagctcttctaacagctcttgctattgattttacagcttcattttgccctattactcttttatgaagaatatcctctaaatgtagtaatttttcactttcagattcagtaagtttctctattggtatattagtccatacagatacgacattagcaatcttctctttatctacaattaaaagcttgcttgaactttgagcattccattcttttttcttattttctaattcagttttaagttctttttcattatccctcaaattagcagctttttcaaaatcttgtatcattatagcatcttctttttccttatctattaatgctattctttcttctatctcttttaattctggcggttcagtcaagctttcaattcttaccttagctgcaccttcatctattaaatcaatagctttatctggcataaatctgtctgttatatacctatcagataagtttacagccgctaccaaagcttcatctgttattttaactctgtgatgagcttcgtatttatctcttagtccttttaatatctctaaagtatcttcctttgatggttcttctacagttacaggttgaaatcttctttcaagcgcagaatccttttcaatatacttcctatattcatcaatagttgtagcacctatacattgaatttctcccctagctaaagccggtttcaatatattagaggcatcaattgcaccctcagctccaccggcccctataattgtgtgtatttcatctataaatataataacgcttttatccttacgtatttcatccattgttttctttaaacgctcttcaaactctcctctatatttagcacctgctatcatagatgttaaatctaaagatataactcttttatttttaagaatttctggaacattaccatctattattctctgagcaagtccttctataactgcagttttacctacacctggctcacctataagacacggattattttttattcttctacataatatttctaatactctttgattttctatatctcttcctataacaggatctaaagtaccttcctgtgctagttgagttaaatctcttccatatttgtctaacataggagtcttttcttttttagtgttatgttcgctttcattatcaagggctttatcttcatagtttccaccagataaaaactgagttaattcttctttaatattatcaaagtttaattttaaactcttcaatatagtataagccattccctcttcttgagccactaatgcaagcaatatgtgttctggtccaacaaatctatgatctaattttttagcttcagaaaaactttcatctaatagtcttttagttctaggagttaatagaatatcatcaccagttttagtaatatcaccatagcccaagtatctttgcaacatttctcttatattctctagatatattccatgctttttaagaagtgttgccgagtaaccattttcctttaatatgccaagtagtatatgctcagttcccacataaccatgtttaaacttttctgattctccttctgcttctaaaataactacttgagctctttctgttaatttgctatattccatttcttctaaccctcacaatcctacttatattaataattttctaactatattagctctctcatactttatttctttttcagtcaatcttcttcccgatatattttcaatggatgaatctttaatatttacaattaatttattaatcttttctttattaatcggtattagtgataattctactcctaatcttactttagatattaaatctaatgcttctttaaaatctagaagtactgcatgctgtaaaatagcaagtgccctatatattttatcttctagttcgtatttacattttcctgttagtatctctctaaacttgtattcatccgcaattaattttaaaacttcttctttcattgtgcatataatattttcttcagtaacacccaaagaagctttattagatattatatatatattacctaatgaatcagaaccttccaaatataatccttttatttctagacctttattgtttaacctctttgaaagattttcaacttcttcactcatagttattgctggcaaatgaattaatacttgaactttcattgcagctccaacattttctatacgtgaagttaaatatccaaattcctcatcaaaagcatactttacattcttctctatttcttcatcaattttaactacattctgtaaaacctcttccaaattcaatccagaagtaatacattgtatttttatatgatcctcttcatttatcatgatactcatagtttcatccctatttaaaatgaaagatgccttatccgaattttttaataaagtatcacttattaaattcttatctaaatattcattaaaaagtcttttatctctttcccagatttcatataactctaaatcatcactttcaaatgaatcctttatagaattatatattgtttcaacattttttcttccatcagcaacagtaagtttctcaggaaaaggtattttttcaatgtttcttgaaagttgaatctttgtgcttataactatgtcattttgattacaattaagaatccagttgtccattacaattttcctccttacaatcctgtttttcagaattaatattactctctattatatataattccatttctcttatttcatctctaataattgcagctttctcatactcttcatctgaaactaatatttgaagttgttgcttaagatgcttcaatctatctctttgataaaattcattttgtattctcttcggaattcttcctttatgagttttttcaccactagtatttttaattattgccttaattgactttttaaatacaaaataacagttagaacatccaactttttttgtttttttaaagtcatcataagtcaatccacaagtagggcatactggtttttcttcttttacgttgttttgtgcattttcaacacctgttaacaacccatttaaaacttcttgaaatggaaaccctgctccttctggaattgaacttaaaaatggtatattagatatatttttagcacattcttcgcataaccatatctgttgtttttcaccattaactattttaactaaatttattctagcttcattttttttacatttttcgcataacatacatatccccgcccttaagataaaattatcataatcatgccttttaatatatcggctcttactttatttctattttctgatgacgcaaggctcctatcatttactgccatcttcattatttcacattctcgtttatttataatttctgattcatgcaaatgatctaatagtgcactagcattatgatatgttattgtatcaccaatactttcatttattacttcttctctattattaaaacaatctttttcaagttgtttaattgcaatatgaccaccaccacctcgtttactttcaattaaatatcctttttcataagtaaaccttgtagttaatacataatttatttgtgatggtgcacatctaaattgatctgccaattcatttctttgtataaaaataacattgttattactattgttattaaacatttcttttatgaattcttctattatatctgaaagtcttgccataacatcacctacttaaacttttaataaaatatttgtttttgacttactttgactttatataattatactattattcttttttcttttaaagagtatttaaaaaatggattttgattaaaactctctttattagtcaaaaataataatagctttaatatttaatattaaaatccatactatatttatatgtataaacaggcataaatttatacatataaatatattttatttcacaaattattattaacatatttatagtatttaaacttggaggatatttatgcagttaatttggtacggtcattcatgttttatgataaaaacaaatgaaggaaaaagaattctaattgatccgtttaataaatcattaggttataagatagatttccctaagtgcgatttaataaccataagccactctcactttgatcactcttctataaatccaataaataatgatacaaaagtcattgatacctatggtaattttaatttagattttctacaattaaaaggattcaattcctttcatgatgattataatggacttaaaagaggaatgaatacaatttatatatataaatttaacaatttaacattagcacatttaggagatttgggtcatattcctgcacaacctatattagatgaacttaattcattggattttcttcttattccaattggcggaaatttcactttagatggtaaaaaggcagcaaatttgtgtaaattgctaacgcccagatatattattcctatgcactataaaacaccggttacagactttgctttagatgattgtaaagattttataatatctatgaaaaaagtttcaaaagtgaatactaactctatagatttattaaaattagatttaaaaacaaaaagtatggagactattctattacaacctccatactaaacattttattataagctatttttctaatataattttataagaaaaaaagactacaaacgtagtctttttttactattattcttgtactggagctccaactggacaaacattagcacagtttccgcaatcgatacaagtatctgcatctataacgaattgagtatctccttgagtaatagcgctaactggacattctccagcgcatgctccacaactaacacatgaatcattaataacaaatgccatttcagaacacctcctaataaattgtagtaattaacctcttacattttatcatgtatcataatgtttttaaagtattttatattatgatttccaaaatttaatcaatatttataattattatttatattactaaatatcccaagtcttctattaattctattattttctctattttaattgataggtcatcatatactactgttacttccttttttattaaagatgtctgacttgctataacaccagtgctatgtattaaaatattttgaatcttttttgagtctttctgtgaattcatatttaatatttttattactgacttcatagaaatccccctacttttcatttataagattctttataagcttcttatcttcttctgattcaactattagctttatattattttcatcaatagtatcttcatattctcctgtaactaactcaacatctataattttgaattcttctactacttcttcgtcgccttttttcaatttaacttttaccatttctttcactattgaattacctataactgaaccatttccatattcagttttgacaatagatccaactttgggtagtctctttctaatttcttcataagtgttttgttcataatttaagcaacacattaaacgtccacatattccagaaatttttgtaggattaagcgataagttttgttctttagccatttttattgaaacagatgcaaaatcacctaaaaaagttgaacaacacattggtcttccgcatggtccaagacctcccaccattttggcttcatctcttactcctatttgtcttaattcaatccttgttttaaagatagtagctaaatctttaactaattctctaaaatcaactcttccatctgctgtaaaataaaatattactttattattatcaaaagtgtattcaacatctataagtttcatatctaacttatgctcttgtatcttttttaaacaaatttctaaagcttcaatttcttttgctttattttctttatgtttaagaatatccttttcatctgcaattcttataacacattttaatggagaaacaatctcttcttcactaatttcctttattccaattacacattctccaaattcaattcctcttgcagtttctactattacatactgtcctctttttatatcaagatcagtcggactaaagtaataaattttacctgcttttttaaatctcactcctattacttttatcatttattatacctccgcaaatcccatcagcattacactaacggtcattgaatagtttgtattactattaaaatttattctagcttcttttatgtattctaacatactattaagttttttataagttattcccattgatatatctataatattatctattttatcaaagttaacaaccaattctttattattaagttccttaaataccataatatctctaataaataaaattaatatatctagaagatcatacttttcatctttgaaattttttaataattcttggtattttaatactaatccatgttctcttttgagaatatctgaaaatagttctacacaagtatttcttaattccttcaatttttgatcattaataaacttatctatctttccaggtatacccgtactaaatgctaatgctgcatgcctatcattagactctatatctgggaaattagtttctatatattctaatatctcttcttttgaaaggggtgttaacttatatacctgacatcttgattgaattgtatctaaaatagtttctaacgaatcacttaacaatattaaatatacgcctactggaggctcttcaattgttttaagtaatgcattttgagcctgagtagtcattttatcacatttatataaaattaaaaccttcttatcaccttcataaggttttttactaacttcatctataatatgccttacatcatctaccccaaaagatgatgaagaaggataatatcttactatatcaacactttcagcattatctctaggctctataatattattcgaaagatactttgcaataacgctctttccaattccatcagcaccaacaattaagtttgcatgagaaaatgaattatttaatttccttttattaattccatttataataccttcatgtcctagtatcttcctcaaaatcttactctcctaatattatatttttataaattgatctacatcaattacaaaaacagtagctcctcctacatttatttgtacaggatactgttgcatgtatgcactttctcctccactcaatgttgttggcgtagctagtatttcttttctttttttgcatatatctttaattatatctataacccctttaaccttttcttcttcaacccctaccataagtgtcgtatttcctgatttaagaaatccccctgtagtagcaagctttgttactctgtattttccatctgttaaagcatctatcagatccattgaatcttcatcttctacaatagcaattactaatttcatcacaaatcccaccctttaaataataaatttatctcttatttaataaaatattagatattctttattttaccacaaataggatgtattttatattgctttgattattagtaaatttacttttaaattattatttctttatatattatagctgaaaaaatttattttctagtatcttttttatttcctttaaaacattctctttagattgttctgcatttatttttactattctatgtctgttttctttataaactttattgtatccttctcttactttttcatgaaaatctatcttttctaaatctaatctattaatttctctttctccactggtacttattctctctaaaccaattttaggttctaaatcaaataatatagataaatcaggcatatattcacctatagcaaatttatttatgctcataacctcatctattcctaaccctcttgcaaatccttgatatgcaagagatgaatcaataaatctatcacaaagaactacatatccctcatttaatgctggaattaccttttcgactaaatgctgccttcttgcagctgcataaagaagcgcttctgttcttccatccatcttagtgttgtctttgtctaaaataacttgtcttatttcttccgatatttttataccaccaggttctcttgtttttatgcactttaaatctttttcttgaatccaatcatatattgattcaattgctgttgtttttccagttccttctccaccttcaaaaactataaataaaccttttttcatatatacctcactttattaaaagataaactagagaaatatattaaagtagataaaaagtaatatttatattttagcagaataaactatttatccttcatatatatattattttttgcattcatcaaataaaattatttttattgaatctttaagttcatcataatccgaatcatctacttttgtatttacaattttttcttcacaatttctgcaaatcatttctccatttattattataccatcacaattaatctgtccacatataaaacatttttttattgagttttccacaactaatcccccttttacacatataaaattaaatctatctagattatttcctcaaatataaaatttaatacaatatattatataaattatttttattttattggtaacactaaaattaatagttaaatattttaagaaaggagacgttacgaaaggcttttcctacattataaataaatatgagtcttcgtaacaaattaaattcatgaaacaagaaattatctcttttttatctacatgtgaggatgatataaaaaatttagcaacttacttatatgaaaatcctgaaataagttataacgaatataattcttcaaaatatattggtgatctactaaaaaaatataattttaatgttactgaaaaatttgtagacatagataatgccttttttgcacaaaagggcagtggatacccaaaaatttgttttctttgtgagtacgatgctatagaacacgatggtcacttaacaggtcataaccttgtaactacaatttcagtggctgctgccatagctttaggtagtataattgacaaaattggtggttcttcaatattaataggatgccctggagaatatcttggagggacaaaaggaacaatggtaagacaaggtgttttcgaagatatagatgtagttatggttgcacatccagatactgagacatgtgaaagcggttcttcttctgcaataattcctcttggtctaaaatttattggagataaaggcctacgttttttaaataaaaaatctttcacatctttagatgcagctttacttacactaaatataattgattctataaaaaaaggatttcctgataacttagaaattaattctataatatcaaatggtggttttactccattacttttaccagtagaatcagaaatcaaattctatattcgtgctttaaatactaagcttgctgaattaggtgatgagaaaatcagaactattgctaatcatgtaagtgaattaacaaatattgatcatgagtttttcttatatgaatgtcctaataaagaacttataaccaatagaactttaaatagattatttagtcataatcttaaagagaatggaataattcatattaatccacctaaagatatttatgcaggtttaagtattggagatgtaagccataccgtaccttcaatacatccttatatatctgttttaaacgaagaaaatcaaaacataaagtatggaagtttagaatttgcacagaatacaatttcagaatttgctctaaagcaatgtttaactgctgccatatctcttgcaagtacagcaatagatttaatagaaaacgaaactcttttacaagaagttaaggcagaattttataacaatataaaaaaataaattcaagtcccattcagtttcttacagaatgggactttattaaatacatttcttctaggcatttaaccttatataatagtataataataaaagaactattaggaggtgtatctattgattcaaatttataaaagtgagagtgaatctaactgcaaactaaaaacacttgatactatagaaaatggatcttggataaatatagtagctccatcagatgaagaattaattctaatttcaaagaaaacaggagtaaatttagatctactaaaatccgctctagatgatgaggaaacttcacgtatagaaattgaagatgatgctttgttagtaattgtggatattccctttactgaaatggaagataactctttaacttatgatacttatccattatcaataatacatacagaaaaacaaataataactgtatgtcttaaaaacagcaaaattttaacagactttgctaatcaaaaagtgaaatctttttatacatttaaaaaatcaagattcatattgcaaattttgaacaggatatcaacatactaccttatttatttaagacaaatagataaaaaaagccttatgattgaaaaaagattacataaatcaatgaaaaatagagaacttatccaattgcattcacttgagaaatctcttgtttatttttctacttctttaaaggctaatgaaataacactggaaaaaatgcttaaacttgaattaatgcaaaaatatgaagaagataaagatgttttagaagatgtaattatagaaaacaaacaagcaatcgaaatgactgaaatttatagtaatatacttgcaagtacaatggattttttcgcatcagtaatatcaaataatcttaatatagtaatgaaagtgttggcttccgttactatattacttgcgattcctactatcgtcagtggtatttatggtatgaacattgattatttaccattctctaatggaccacactcatttgctattgttatgacaataatagctggaatagccaccttagtagcatttatactatataaaaaagatatgttttagcaacatatcttttttgttttattatacaatatatggtattttttcttactaatattaaataatcttatataacaaaaaaatctgaagtaaaaacttcagatttttatttggaggcgccacccagatttgaactggggaataaaggttttgcagacctctgccttaccacttggctatagcgccatatatggtggctcgaactggaatcgaaccagtgacacgaggattttcagtcctctgctctaccgactgagctatcgagccatcttacctcgcaacttcctactcttccacacagtctcccatgcagtaccatcggcgttatagaccttaactgtcctgttcggaatgggaaggagtgttacctctatgccatcgtcacgagattttaattgaaaaaactattgttctttcaaaattgcatattaacattatatactatacatgattattggtcaagccctcgacctattagtatcagtcagctaaatacgttaccgcacttacacctctgacctatcaaccttgtagtcttcaaggggtcttactagcttatgctatgggaaatctcatcttgaggtgggcttcacacttagatgctttcagcgtttatcccttcccgacttagctacccagctatgcttctggcgaaacaactggtacaccataggtcagtccatcccggtcctctcgtactaaggacagctcctctcaaatttcctacgcccgcgacggatagggaccgaactgtctcacgacgttctgaacccagctcgcgtgccgctttaatgggcgaacagcccaacccttgggacctacttcagccccaggatgcgacgagccgacatcgaggtgccaaacctccccgtcgatgtgaactcttgggggagatcagcctgttatccccgaggtagcttttatccgttgagcgatggccctcccacgaggtaccaccggatcactaagcccgactttcgtccctgctcgacttgtaggtctcgcagtcaggctcccttatgcctttacactctacgaacgatttccgaccgttctgagggaacctttgggcgcctccgttacattttaggaggcgaccgccccagtcaaactgcccacctaacaatgtcctgtcaccagtttcatggcatccagttagaacttcaatactatcagggtggtatcccaacaacgactccattaaggctgacgccctaatttcccagtctcccacctatcctgtacagacaataccgaaattcaatgctaagctacagtaaagctctacggggtctttccgtccaatcgcgggtagcgagcatcttcactcgcactacaacttcgccggattcacagttgagacagtgcacaagtcattacgccattcgtgcgggtcagaacttacctgacaaggaatttcgctaccttaggaccgttatagttacggccgccgtttactggggcttaagttcacaccttcgcttgcgctaagtgttccccttaaccttccagcaccgggcaggcgtcagcccctatacatcagcttacgctttagcagagacctgtgtttttgttaaacagttgcttgtgcctattctctgcggcctaccagatggtaggcaccccttctcccgaagttacggggtcaatttgcctagttccttaactgtgattcttccgtcggccttaggattctctcctcatctacctgtgtcggtttgcggtacgggcactacttctctttctagatgcttttcttggaagcatgaaatcagatacttcggttccgtagaaccttccccatcacgccctaggattgttagaacggatttgcctgttctaactccctcaacgcttagaccagcatccaatagctggcacatcctatccttctccgtcacaccatcgataataacgattatagtggtattggaatatcaaccaattgtccatcgactacgcctctcggcctcgccttaggtcccgactaaccctgagaagacaaactttactcaggaaaccttagatattcggcctgtaggattctcacctacatctcgctactaatgccaacattctcactcgtaatcagtccaccgctccttacggtacgacttcagcccgattacgacgctcctctaccgctcatacaaagtatgaacccgtagcttcggtggtaagtttgagccccggacattttcggcgcaggatctcttgactagtgagctattacgcactcttttaatgagtggctgcttctaagccaacatcctagttgtcttagaaatcccacatccttttccacttaacttacactttgggaccttagctgacgatctgggctgtttcccttttgaccatggaacttatctttcatagtctgactgccgtgctgatagtatctggcattcggagtttgataaggttcggtaagcgctatgccccctagcctattcagtgctctacctccagtactcacatttcacgacgctagccctaaagctatttcgaggagaaccagctatatccgagttcgattggaatttctccgctatccacagctcatcccatgctttttcaacagcaacgtggttcggtcctccacgaggttttaccctcgcttcaacctggccatggataggtcacccggtttcgggtctacagcatgcaactagtcgccctattaagactcggtttcccttcggctccgtaccttaagtacttaacctcgctacataccgtaactcgttggctcgttctacaaaaagcacatcatcacacacataaggtgctttgatcggttgtaggcacatggtttcaggttctatttcactcccctcccggggttcttttcacctttccctcacggtactgcttcactatcggtcatcaggtagtatttagccttgggaggtggtcctccctgcttcccacaaggtttcacgtgtctcgtggtactctggtgcagaactgatcattatgacttttacttacaggactattacctcctacggtccaactttccagttgtgttcggttaatcataatttcacgttatgttctgtccgcaaccccagagataaatctctggtttgggctctttccttttcgctcgccgctactaagaaaatcgatttttctttctcttcctctaggtacttagatgtttcagttccctaggtgttccttcataaagctatgtattcactttacgatgcatgaggtttctcatgcgggtttccccattcggaaatctccggatctctggctatgtgcgcctacccgaagcttatcgcagcttatcacgtccttcatcggctcctgatgccaaggcattcaccatgcgccctttgtagcttgacctttttaagttttgatatacaaaactggttatattaatcattcacaaagaatatttattcttggctttgttgtattatatacaattgttaatatgcaattttcaaagaacaatatggtgggcttaaatggactcgaaccatcgacctcacgcttatcaggcgtgcgctctaaccagctgagctataagccctcatggtggagataaagagattcgaactcttgaccccctgcgtgcaaggcaggtgctctcccaactgagctatacccccatgagtattttgaaggaagatccctcaaaattgaacagatattaatatctattaagtaacctttgagcaagttgtaatttttatagatgctttgcatctttgtactagtcaaacgccatgtttgctagatttctccatagaaaggaggtgatccagccgcaggttctcctacggctaccttgttacgacttcaccccaatcgctgaccctaccttaggtcgctgcctccttgcggttagctcacgaactttgggtattgccaactctcatggtgtgacgggcggtgtgtacaaggcccgggaacgtattcaccgcgacattctgattcgcgattactagcaactccagcttcatgtaggcgagtttcagcctacaatccgaactgagatcggttttatagttttgctcactctcgcgaggttgcatctcattgtaccgaccattgtagcacgtgtgtagccctagacataaggggcatgatgatttgacgtcatccccaccttcctcccggttaacccgggcagtctcgctagagtgctcaactaaatggtagcaactaacaataagggttgcgctcgttgcgggacttaacccaacatctcacgacacgagctgacgacaaccatgcaccacctgtcttcctgccaccgaagtggcttcctccattacagagtaattcaggagatgtcaagtctaggtaaggttcttcgcgttgcttcgaattaaaccacatgctccgctgcttgtgcgggcccccgtcaattcctttgagttttaatcttgcgaccgtactccccaggcggaatacttaatgcgttagcggcggcacagaggtcatgacaacccctacacctagtattcatcgtttacggcgtggactaccagggtatctaatcctgtttgctccccacgctttcgagcctcagtgtcagttacagtccagaaaggcgccttcgccactggtattcttcctaatctctacgcatttcaccgctacactaggaattctcctttcctctcctgcactctagatatccagtttggaatgcagcacccaggttaagcccgagtatttcacatcccacttaaatatccacctacgctccctttacgcccagtaaatccggacaacgcttgccacctacgtattaccgcggctgctggcacgtagttagccgtggcttcctccttaggtaccgtcattatcgtccctaaagacagagctttacaatccgaagaccgtcatcactcacgcggcgttgctgcatcagggtttcccccattgtgcaatattccccactgctgcctcccgtaggagtctgggccgtgtctcagtcccaatgtggccgatcaccctctcaggtcggctacgcatcgtcgccttggtgagccgttacctcaccaactagctaatgcgacgcgggtccatctcatagcggattactcctttaattgctgtaccatgcggtactacaatcttatgcggtattaatcttcctttcgaaaggctattcccctctatgaggcaggttacccacgtgttactcacccgtccgccgctaatccactcccgaaggagcttcatcgctcgacttgcatgtgttaagcacgccgccagcgttcgtcctgagccaggatcaaactctcaataaaaagtttaatcttagcttactcaaaataaagaattgctggtttacttaaatatttatatcatattctgttcaattttcaaagatcttgtcggtctctctcgaccgctttattataataccatcatcagctttcgttgtcaacatttattttaaataaatttttgaacttcttagctgattttgttttttgttgttggcgtttccccctgacaacgaatattatgatatcatgttttttataattaattatatgtatatctccaatctatataaattacagttgtattgctaataatttcatcgtaataatacgtttttcgatataggatacacgtggctaagttatcatttcaaaatgagtttttctgtaatttttacgtctattagtcattataattactagctatatactgttttatgtgaaaataatctatgaatattgggatataaaattacacttctctacttttttctttataatatatattaagaatgtacttattatttaatatataagcttattactatttagtattatacatttttatacgacatttatatagaatctataacttattgtttataaactaaatatttgtatatattgcatttaaaagatagtatttaaaaaaatatataattcagactttgattatggggagatttttaatgaagaaaaaaataatttgtataattttatctataaccttacttaatatagttggatgtggaaaaactgatacagaagcaactaactcaaaaccaaacacacctgctagtacatcaccaataacagctactagtactacatataatgctgataactctaatgattttaaaattaatggagaatcatattatttttgtccttttatatttaatggcacagatttaattttcacaaatcctgatgaaaacaatagaatttcaataattccagatccacttccagagaatatattagaaagtcaatcagtaaaagattttattgattattcatctaataacatagggataattggagaatacctttatttcgcaaatagttctgataacaatagtttgtattcatgtaagctcaccaacaaagaaactgttaaattaaataaccactcagtagatcaaatgattatagtaaaaaatctaatttattataaaaataaagccgacaagaacaaattatacatatatgataccgagacatcaaaagcttcactcgtaacttctgattcagttggacaatacatagttaatggtgattatattatttatcaaaacttaaacgataattctaaattatattctataaaatcagattatagtgacaaacataaattgaccgattataccgctaacagttttataacatataaagatgaaatattattttttaactcttcagataacaacaacctttatgctttaaagccaacaaatctagaaactagaagattaaaaattatgaatggatttcaacttcaaactattaatgacactatatactttataaatggtgatgatattaataacctttactcactatctattgatgcttcaacttcagagattacattaaaaccagaagtatctttcggaattaattcttatcatttaactccatcaggtatattttatagtcccagcctaaatgtaaataatatttactataaaacattctcaaataaataagacaaaggcatgtagatgaaactctacatgcctttgtcttatttacagtattaatttttagataatcataacattataaatacataatctactacaatttataacgcattcacaatctttttaaatgtattacctctaaccataaaattagcaaacatatcaaatgccgcacaagcaggtgataatgttacaacatctccgacttcagcgattgatttacatatagatacagcctcttctaaagtattagctctttttatattagttttaatgcctttttcattttcaagagctttaaacacagcttgaattttatcactagtagctccaacaagaattaattcttttatatatggatacccttcataagcaagtggttcaaaaggtatatgtttatcataaccaccagcaattaaaataacctttttatcaaaagcttttaaaccagctaatgttcttgtgggactagatgcaattgaatcattataatatttaaccccatcaagttctcttataaactcgcatctatgttcaacgccagcaaaagtttcagcaacttttttcattacctctatagatacttcatcctttgttgcaataaaagcagcaagataattttctacattatgcataccttttataactatatcttcttttctacaaacttcttttccttctaggtaaagaataccgtcttcataataagctccattttctatttttcttttagaactaaattctcgtacaataccctttgcttctttttcaaattcatatgttatttcattttctctgttaacaaccaacacatcatttgcagactgatataaaaatatgtttttcttagaatctacatattccttcatatccttatgcatatctaaatgattaggtgctaaattagtgcatatagcaatatctatttcttcactcatagtcatcaattgaaaacttgataactctaaaacaactttatcttcatcttttatattttctatttcagaaaataaaggcgtacctatgtttccaccaacccaagtattatatccttgttcttttaataatttagaaattatagttgtcgttgttgttttaccatcactgcctgtaactgcataaatcttccctttggtatatcttacgaactcttccatttcagaagtaatatatgctccttcacttttagccctaactaacgcttcactatcaatcctcattgatggactcttaaatacaacttcatatccaatcaaattatctaaatacccttctccgagttcaagttttacaccttttgcttcaaaatctattgcaacctctccaagatcttcttttgtctttctgtcaaaaccagtcacatgagctccaagctgtaaaagaaaatttatcaatggaatattactaacaccgataccaactacagcaacctttttatttgatatataatttttaaactctttaaaatcctttttcattatttttcctccaacaaaattaatagtaccttctacgttattatctaaaatctatctaattttaattatatcactacaaaaaaccttcttctaccaaattagcaatgtattcaatttttttcctatttatcttatcacaagtatcttaaatatataaaaaagtgtttgattatgctttcaattctatcaattagctaaattcaatactttaaacattatcctatcgttgtaagttcccatacactaaaaaatatgagcttactgataaattcatcagtaagctcatagctatattaaaattctaaacttttttgaatatatgattcaagttcacttatcttaattctttcttgttccatagtatctctatttctgatagtaaccgcttcatcttctaatgtttcgaagtcaattgttatacagtatggagttcctatttcatcttgtcttctgtatctctttccgatacttcctgtttcatcaaagtctaagttgaatttcttgcttaagtcagcataaacttctaatgctctttctgaaagtttcttcgaaagtggtaatatagcagctttaaatggagctaaagcaggatgtaagtgcattactgttctagaatctccaccttctaattcctcttcatcataagcttctattaagaatgctaacgcaactctatcagcacctaatgatggttcaattacatatggtatgtatttttcattagttgtttgatctagatagcttaaatcctgtcctgaatgctcttggtgtttatttaagtcataatcagttctatctgctattccccataattcaccccatccaaatgggaataagtattctatatcagatgttgcatttgagtagaatgataattcttcttctccatgatctctcattcttaagttttctggttttacatttaagttaagtaagaaattccagcagtaatctttccagtacttatgccattctaaatctgttcctggcttacagaagaattctaattccatttgttcaaattctcttgttctgaacgtgaagttacctggagtaatttcatttctgaaagacttacctatttgagctataccaaaaggtactttctttcttgaagttctttgaactgctttaaagtttacaaatataccttgagctgtttcaggtcttaagtacatttctgacttagcatcttcagtaactccttggaatgtcttaaacataagattaaactttcttatatctgtgtagttcatcttaccacacttaggacatactatgttgttactttcaatgtattcttttaattgttcattagtccatccatcagcacttgctacttctgcaccattagctgtcatatgatcttcaacaatcttatcagctctaaatctagctttacattctttacaatccatcaatggatctgagaatccaccaacgtgtcctgatgcaacccaaacttctgggttcattaatattgctgaatccaatcctacattgtaagggctttcttgaacaaactttttccaccatgcttttttaacattatttttaaattctactcctaaagggccgtaatcccatgaattcgcaaggccaccatatatatctgagccagggaatacaaatcctctattcttacaaagagctacaatcttatccattgttttttctactgccataatttttccctccaaaatatatttttataaaataaaaagacccacatcacaaagggacgaaattataattccgcggttccacccttcttgacttaagtccatctttcttgctcacactcaaaagttcctttcatttaaaatcaatgataatttccaccgcacattatctctctaaaattgatttttaaactactcttctttatcaacatgcattttcaatttatacatttaattttagcaaaatgtttttatatgtcaatataattatttgcataaataatttttttaaacaacaaactactacatttcaacacgtaataatattttatataaaaaaatccgcataattaacatgcgaaatacaataggtatttattattaaaaaaatataaaaaaaaatggctccgcgaagaggactcgaacctccaacctatcggttaacagccgagtgctccaccattgagctatcgcggaacgtcattacttaatctattataacaggtttttcacattatgcaataccttttttaaattttttctgattttttgaatataagtttctatttatgtccataattctaatatcttgaagcaaactggaggtttatgttatgaataaagtatatctaattggtaggattgctcatgattttgagttgaaattctttgataacggtaaaagatgttacatacaattccccttagctattaataactacaataaatttacaggagagaaagttacagatttcattgatattgtggcttttgataaaaaagctgaaataattaatgaatatctttctaaaggaagtcaaatttctattgaaggtcatattcaaatcggaagttatatggataaacaacaacaaaaaagatattcaacaaaaataattttagaatcctttcaatttatggataaaaagaatactgtataacctatgtaataatgagctattaaaattttaatagctcattattttttaatataaaattaatcaactttattactcaaaattaaatataagtattaatagataccagatatcgtaatctattatataaataaaaatgctatacaaacttgtatagcatttaaataaaaaaaacaaaaacctcgcctactttaagcgaaataaattaactattcactaaaaaaagcaaaaaaaatggctccgcgaagaggactcgaacctccaacctatcggttaacagccgagtgctccaccattgagctatcgcggaacgtcattacttaatttattatagcaggttttttatattatgcaatactttttttaaatttttttaaatttatttttatgattctatattgcagtatgtatagctaattataaaactctaatatagatgttaaatcattaaataaataattaaactatgtttttatatttatttaatttcacattttacaatatattaatcttctctaattttgtatagtcataaaatatatttaaaacaaaaaaatcccatatactaattatacgggatgaaataaccatttatattaaaaaaatggctccgcgaagaggactcgaacctccagcctatcggttaacagccgagtgctccaccattgagctatcgcggaacgtcattacttaatctattataacaggttttttacattatgcaatacttttattacattttctttgcttattgtatacttctttatttctttaattcaatataaagaaaagtctgcataattccaatgcagacttaacataattaacttttatatataatataaatcaattttattttactatttttgtggcttcattgttgggaataatataacgtctcttattgatgctgaatcagttaagaacattataagtctatctatccctatacctaacccacctgtaggtggcatacctgtttctaaagcactcatgaattgttcatctaacatgtatgcttcatcatcacctaattctcttgcattagcttgttgttcaaatctttctctttgaactataggatcatttaattcagaatatgcatttcctaactctctaccaaatacaaatgcttcaaatctttcagtaaattcagcattacctctcttcttcttagtaagaggtgaattttctactggataatccattatgaatgttggttgaatcattttttcttcaccaaactcttcatatagagcatttaacacttcacctttagttactgtatttaatggcttagggaattctaagttcttctctttagctatagcttgagcttcttcatcagaattaattgtagtaaaatccacacctgcatattctttaacagcatcaaccatagttattcttctccatggtggcataaagtctatttctgttccttgatatgtaactttagtagttccatttatcttttcacaaacataagcaaccatgttttctgtaatttccatcatgtcattataatctgagtatgcttcatataattctattgcagtaaattctggattatgtctaacagacataccttcatttctgaaatttcttccaatttcataaactttttcaaatccagcaactattaatctcttaagatataattctggcgctattcttaagaacatatccatatctaaagtattatgatgtgttacgaatggttttgcagcagctccacctgcaattggagaaagaattggagtttcaacttctaagaatcctctattatctaaaaattctctcatagctgatataattctacttctcttaacaaaagtatctttaacttctgagttagttattatatctaattctctttgtctatatcttaaatctggatcttttaacccatgccacttttctggtaatggttttaatgacttacatgttaattcaaaagaattaacattaattgatatttcacctctttgagtagtaaatacttctccagtagctgctacccagtctccaatatcataagtcttatattcttttaaattttcttctccaaccttatcaatctttaagaataattgcatcttaccatctttatcatggatatctgagaatacaacctttccttgacctcttttagacattattcttccggcaattgttacttctttaccttctagttcttcataattatccctaacttctccagttgtgtgagttctatttaccttataaacatcaaaaggatccttatctgctttttgtaactctgctagtttctctcttcttaaaccttcttgttcactaaattgagactctaactcctgcatactcatttcttctgttgacattattgtacctccaattaacttctacttattcctaatatttcaaacttgttcacaccatctggaatttgtacttctactatctcgcctatcttcttacctattaaagcacttccaactggtgattcatttgatattttaaaattcataggatctgcttctgctgaacctacaattgaatattccacttcttcatcaaattcataatctttaactttaacttttgaacctacagaaacaacatcttttggtatttctgattcatctacaacaacagcattctttaacatattttctaatgtaacaattctaccttctgtgaatgcctgatcgtttttagcttcatcatattcagagttttcacttaaatctccatatcctaatgctacttttattttttcagttatttcttttcttttaacagtttttaaatattctaattcgttttctaactttttaacaccttcgtaagtcattacatattgttttttattttcgctcatatgctgtactcccctttaaaacctctattatttatttaatatctgctcctattttaaaagagcattttctaattaactcatataaactctgtttaaaaattaaaaacagagtttcttacataatatttccgtcaaaacaactaaaatagccttacaaccttgaaatcatttaactaattataaatcagcatatatgatatgtcaataaaagcaagttaaactaatcactcgttctaacagttaaattatgcttaatttcactcttctatagtatagcatctataatgaaacttatactatctatattaccaatactaattaaataaaacttaaaatctcatttaatttataaatgttctttatattcctttaaaatatcaataaccttactactatcatctaatacatttatttcatttctgatatcagtacactttggcaagccttttatataccaagaagcatgttttctcatttcccttatcgccttatattcaccatcatattttatagctaactcataatgtctaaggcacatttctacacgttctttatttgttacttcttgtggtatttttccttcaagtacatctttaatctgtctaaaaagccacggatttccttgactacctcttgcaatcataattccatcacaattagtaagttccttcattcgcaatgcatcctctggcgaaaatacatcaccatttcctataacaggtatagaaacattttcttttactgactttattatatcccagtcagcctttccttgatacatttgttttcttgttctaccatgaatagcaacagcatcagctcctgcttgttccataccctttgcaaattcaactgcatttatattttcttcatcaaagccctttctaaattttacagttactggctttgttgaaacttcttttatttttcttactattgtatatgctagttcaggttctttcataagtgctgaaccctctccattttttactatcttagttgctggacatcccatatttatatctataatgcatatatcatctcgatgattaaaatgctcttcaaccattttagccattatctcaggctctcttccaaatatctgaacagccacaggcttttcctcttcagcgattcttaataactctttagtattttcacttccatagtataatgcttttgcactaaccatttcagtatatacaagcccgcatcccatttctttgcataatcctctaaatgatatatctgttacacctgccataggtgctagaaatacattattttcaaaggttaaatctcctatgttcatttatactttactccttattcttatagtataatatctttaacccctctaatgttaattctgaatcaactttatcaataacatccgtttccttagctataagattagctaaaccaccagtagctattactaaaggttcctcattagttttaagttttctcatttcttctttcattttctttactatatattcaacttgccctatataaccaaataaaataccagcttgcatacttgtaacggtattcttacatattatattttttggtacttctaattctactcttggcagttttgctgctctttcaaataaagcatccgaagatattcttatccctggacatatgcaacctccaagataatccccattttctttaactgcacagtatgtagttgctgttccaaaatctattattataaccggtcttttatacatttcataagcagcaacagcattaactatcctatctgctcctacttctcttggattatcatattttatatttatccctgtttttattcctggtccaactattattggctcatgacaaaaacactttctaagcatattttctagagaatgcattatattaggtacaactgatgaaactataactccttctatattttcaggatcaatattgcttaaattaaaaagctgcataacctgtattccatattcatcagaagtcttatttccttcactggaaatacgccagcttgcaatataatcatttccatcatgtacacccaaaacaatgttggtattacctgcatctacaagtaggatcattaaaagcaccaccttaatatagttaaattaaaagcagccccaagagctgctttaatctagaaatttcttaaaaataacaatttaattttaacaatttctgcttatttgtcaatagtttcacgtatattttagaataatcctacaatttctccactcttaagaacatccattttattagctgctggtgtcttaggtaatcctggcattgtcattatatcacctgtttgaactactacaaatccagctccattagaaactcttacttcttttacagtaatttcaaatccttctggttttccaagaagacttgcattatcagataatgaatattgagttttagccatacatacaggaagtttatctaaattaaatttttctaattcagcaatttgtttctttgctgctggagtataattaactttaatagctccataaatttcttttgctattgttaaaactttttcttcaattgttgctttttcatcataaataggagcgaattcagaagtgtttgtttctaaaatatccattacgatatttccaagttcaattccaccttctccacctttagcccaaacgtctgataaagcaactttaacatccattttgttgcagaaatcttttatgtattcaacttcttcatcactatcagaaacgaatctatttatagcaacaactggtgtcacattaaatttctttatattttcaatttgcttttctaaatttgatattccttttgctaaagcttcaacatttggagtatttaaatccatcttagccactccaccatgatgtttcaatgctcttattgtagcaactataactacacattcaggctttaagttcccatatctacattttatatcaaagaacttctctgctcctaaatcagctccaaatccggcttctgtaatagcaacatctccaagctttaaagcaagtttagtagccataatagaattacatccatgagctatatttgcaaatggacctccatgtattaatgctggtgtattttctaaagtctgaactaaattaggtttgattgcatctttcattaataaagccatagcaccttgtacttctaattgtttagcatataccggttctccagctaaattatatgcaactactatatttcccattctttcttttaaatcttctaaatcacttgctaggcataatatagccatgatttctgaagcaacagtaattgtaaaaccatcttctcttacaaatccattaacttttccacccatacctacaactatgtgtcttaaagatctatcattcatatcaattactcttttaaataatattcttcttgaatcaatttctaaaacatttccttgatgaatatgattatctattgctgcacttaataaattgttagcagaagttatagcatgcatatccccagtaaaatgaagatttatatcctccataggaacaacctgagcatatcctccacctgcagctcctcccttaataccaaaaacaggccctaaagaaggttctcttagtgctattacagcattcttacccattttatttaaagcctgcccaagacctactgtaacagttgattttccttcacctgctggtgttggattaatagctgttactaaaacaagcttaccatctttattatcttttactttatcatatacatctaaagatattttacatttatatttaccatagtactcaacgtcatcttcacaaagccctagtttttctgcaatatttttaattggttccatttttgcttcttgcgctatttgaatatcacttttcatataattactccccctgatattatagaatatttctataatagttctataattaattgtattatcattatatcatttcgctatatattttaaaagcaattttcgaatattatatttataatacgccaaaatattcgtgttatttcacttttaatcgatatatcttactatattatttcataaattataatttttcattctttcaaatttcaatcatacaaacaattctttttaatttataattataagaaaagacttgctagaattccagcaagtcttttcattaattgttcgcaaatatttcttcaaattcatctgcatctaatttttctttttctatcaaagcttgagctacagcatgtagtttatttaaattttcttttaataactcatgagctttgtcataagcttcatcaataaatctttttatttctttatcaattttagcaccaatttcttcactaaaatctctactctttcctaaatccctacctaagaatacttcgtcatgacctgaaccatatgatatagtaccaatttcatcactcattccatattccataaccatgcttttagctatattactagctctatcaatatcatttttagcaccagtacttatatctcccatgattaatttttcagccactcttccaccaagtaatccaaccatttcatcttttaattttaacttagaagtatatgatgtatcttctttaggaagatgcattgtataccccccagctcttcctcttggaattatacttatttcatgaactggatcacaattaggtaacaatttcataacaaccgcatgaccagcctcatgataggccgttaactttttatcatgctctgtgattactttactcttcttttcaggacctgcaattactcttgtaatagcttcttccatttcttccataagaattgcttttttacttctacgaactgcaagtaaagcagcttcatttgttaaattttctaaatctgctccacagaatcctggagttctctttgcaagaattttcaaatctacatccggaccaagaggtttattctttgtatgaactttaagaatttcttcccttcctttaacatcaggagccccaacaagaatttgtctgtcaaatcttcctggtcttaataatgcaggatcaagtatatcaggtctattagttgcagcaatcattatgatgccttcattaactccaaaaccatccatttcaactaaaagttgatttaaagtttgttctctttcatcatgaccaccgccaagtccagcacccctttgtctacctacagcatcaatttcatctataaatatcaaacaaggcgaatttttcttagcctcttcaaacatacttctaactcttgaagccccaacacctacaaacatctcaacaaaatccgaacctgatatactgaaaaatggtacaccagcttcaccagctattgcctttgcaagtaatgtcttacctgttcccggaggacctactaataaaattcctttaggtattcttgctcccatttggatatatttagctggcaactttaaaaaatcaacaatctcttcaagttcagctttttcttcatctgcccctgcaacatctgcaaaagtaacggtttggctatctggagtcatcattttggctttgcttttaccaaaattcataacccctcttcctcctccgccaccttgggactgttgggtcattacaaacataaataataagataacacctgcaaacaatatgcaaggcagtaccactggcatccatgttgaattactagaaggtgcttcaaacgacaccttaacatcttcatttggtttttgttctattaatgaattaatcaattgacttggaacatatgtagtgaaagatttaccatcactagttttaccttcaacagtcattttatcttctctaacaataatgctttgtatttcttttgaatcccatttttgaatgaatgtgctataagcaatatcactagaagtctttccattctgccacatagtaagtgctgctaagaccaacataactgtacatacaatccacacagccgcacttgaatatttcttcattcagggcccccctctccaaatttactacaattttaataccaatttaataaaaatttatattttatttttcatatatttcaggttttaatatacctatgcaaggtaagtttctatacttttcagcataatcaattccatatccaactatgaaggcatcaggaacttcaaaccctatatattttactggaagttctacctttcttcttgctggcttatttaataaagctactatttctatacttgcagcctttctagccttcaagtatttaagaagataacttaatgttgttcctgtatcaacaatatcttcaacaattaatatgtgttttccttcaatactattatctaaatcttttaaaattctaactactcctgtagtttctgttgaatttccatagcttgaaacagccataaagtctaattcacagtaaatatcaatattttttataagttctgctgtaaacacaacagatccctttaatattccaacaacaactagttcctttcctttataatccttacttatttgaactgcaagctctctaaccttttcacttaatacttcttctgaaaatagtacttcttttaaatcttccctcattttatttttcctttctttcaacaattactcttaatatatttttagttttattagtaatcttatattcttcagaaactctaattccaactatccatgaaatattttcatcaaaacataaaagtggtatacaatctctttcttctttaggtactttcatatcaataaataaatcttttatttttttacttcctttcatacccaaaggaattatcttatctccattttttctctttcttaatgagatactatcatttattttatcaaaatcaaaatactttatgaaattattttgatttaaatctaaatttgaatcattttttaatactgaaaattctatgttttcatcattaaaaaatattttcttgccatttatctcatttttgttcactactatttcttgttttacatcaatattattaatatttattctctcttttatgtatatgtccccatatatgttttcagcataaattttattcggtaaatctatagctttacccgaattattttttgcaagattgcagatttcatatatgtgtttcatttcaaaatcataatgagttttagaaaagttagtgagggcatatctgataactctagtaacaactgcttctttgttatcaaacatttccttttttattataaaatagtctgactgttctatacaatgtttttcataaaaacttcttgcagaattttctataaattcgttatctttctgtaataatacagacatcctatttaatgtctgtattatatcttcattaaaattctcctttatatacggaatcatatctaatcgtattttatttctattatatatcttttcaaaattagttttatcaattctaggttttaaattatttatttctatatattcttcaacttcttttcttgataaacataaaatgggtcttataattttatctcttcttactttaattccacataatccttcaattccacttccacgcatcagcctaaaaagaatagtttcagcctgatcatttgcattatgcgcagtagcaatcttagtatacccttcatcttttacaatatcatcaaaaaaattatatcttgcgtctctccctgccatctcagatgacatctttttatcctttgaatatttatttatatcaacgcgctttacaaagcaaggaatatccaaacttttgcatagagtctttacatattcctcatcttcaaaagcatccttatctcttaataaatgattcaaatgagcagctccaatttctatatttagctcagcttttaaattatataaaatattcaaaaggcatacagaatcaggtccaccagaaagagctaccaaaaccttatctccagatttaattaaattattgtcttttatataagacattacttttttatacaataataaacacttcctattacatagtactgtataatatattttacgtatttaatattaaaatgtaaacattattgttcaaattgctaccaaatcactataaactaagcttagtttttctatttttatataacttctagcttgctagataaactttcgaaaccactacggtcatatcatccttaactgttcctccacttaattcttttgctttacttaatattctttcagataactccctaggatcagaattagcattactcaaataatcctcaacccatgttttctcttcaatgtttgatttatctatatctaaaattccatcacttacacttactatgatgtctccagcttgaagttcttcttttataacttcaacatcaacttcatcaactagtccaaaaggtaaatttttggaattgattatttttatttcatttcctctcttaataaaagttggcgctgcaccaatcttaacaaaaacagcttcaccactatataaatctactttattcaaatcaagagtggcatatttttcatcctcagcaaatctcattcccattattgaatttactgtattcactgttatattttcatcgaagcctgcttctataaacctttccactaaatcaactgttgctttgctttcctgtcctgcttcaggaccgaatcccatcccatcacttaatatagtcatatagcatccatctttagtattaccaaatgtataactatctccaatctgattttctccattcttaggaaccatagaattataggaaaccatataaaatgtagcttcttcctgaatacttataatatattcatcattttcactattaagtctactttcttcttcacatacacataatttttttcttgtaagactatttaataatggtattactttcttatttaaatgctcatctcccttataatcatccatactgatttttatttttatctttccattgatatctgtataacaaaagatatcattataatttactgactttttattaagagcaagccttactcttttctctaaatctgtatttactatcacctgctttttaaaatcattcaaaagatcatctaatgtatttgaaatactatcaatatgataggataataattttctaccttctgcaagcctttcttttattgtttcatttaccgtattattatcaactatattttctacatttcttaaaagtgtaaaactttgaacacacttcttttctaaatctgctggcatacatatagtattctcttcataactttgtataagtgcttgaaaagaattatatgtctgcgcaaattctctatcccaacacgctggtctattttcacacttagaacaacatctatctgctaaattttctactaatgcacttccctttcctttcataagaagcttttcattttctgttgctgctccaagacaattagataccgtaccaagtacagttgtcaattctcttagtttaaacgtaaactcctctcttatactatttagttttccttcatctataaattctctttttctatctggatttatttcaacttcaatacttttaaatgcagccctaggaatacataaaaataaagcacagctggctaatacttctactccaaatttaaaactcaaaacattagaatataaacctaatgcaaagtaaataattattcctgcaagtattgaaaatattttccctgtatctttaaaaattcctacaataagacctccaacactaaaaaagcctatggaccacatcatatcatttgatgccacacctaatataactcccattgacacccctatcattgcaccataagctgctccacccaaataagccacacacaaaactaataataatgcaaaaatattttttaaagagtagtccattatagtaacatttcctattccagaaactatcaaacaaaataaaatccctatacttactaattgttctgtagaaaatagatatttataatcaaattcttcgattgaatcaaccgcgtatttaattacataatatataggcataatcataacggtctcaataagacataatgtaatatttacaccaacttcatatttatttaccgtcataccatatataaagaaagtagataaaattaaaacaaaacccaaaatttcctttctaatttttttgctggcaggaataatgagataacttaatgttaatactcctattgaaataagatacatatttccatcacttaataaactattaacagtaagataccctaatagcactccaatcccagcactaacatctttctgcttactattccttacagaaacagccattaaatatgctattccaaaaggagcaatgcccttactatcagattgatttaataagagacttactcttccaagcaaaattcctattacaaatattaaagttaaattaactataggtaattttaaatttaattttccttttgttttttgaagacttttaacttcctcatacttatttacatttaattcatactgcacgttctctcgccccttctaccaataatgtaactcgattatagcactgcagttttacgataaatgtcataagatgtactatccatctaactttcgtaggacaacttcatctaaaattctctaatatttatttttattttttcaaattcaaatttgaatattattttaaaaatccacattataatggtaactattcagaaacaatctatttcttttttgatgataaatttgtcgctaatattaatttattagaactttatatataaatattttttcataaatttacttaccactgcatattaattttatttttaatgcttttatgatctcaaaaccattgcaaaaaaaatatccctaatttgaagtacttgaatagcatcaaatcaaggataatttaattgtttatgaagcttagttaaatataacataattgtttcataacaaagatataaatgaatattgtcaaaacagaaaacattgatgtaaatactacaagttgtgctgctaattcgccatctgcttccatctgttccgccattgtaaatgatgaaactgccactggtgctgaaagcattatcataacacttgcaagttctatacctctaaatcctaaatatatagcaataggaataaatataagcggtacaattattaatttgcctatcactccaataattaatggttttaaatttttatttatcttttctattctaaaagatcctcctaaaactactaacgctaatggtgtagctattttagacatatctgaaatagttttttcaaaaattgtaggtagctttatttgtaatactagcattaatatacctagtaaagatgctagtattaatgggttagttattattcccttaattatagtttttaaatttaaatttccacctctaaaaacttccaaaactattactgctaaaaaattaaacatgggaactataactgctattaatatagaagttattcctgcaccatcttctccaaatagtgatagtactactggaaggccaaacaaaacaaaattacttctaaatatagcttgtactacaacacctctctttttactttcctttaccataaaaggaactatagcacatgcccccaaacaactcagcaatatacaagttggcgcaaatatcattagtcttacgtctattgctccctctatgttagtactatatacattaaaaaatagtaacataggtagaaatgttttaaatatcaaattattcattttctttagtgtatattcatcaacaagatttattcttctaataaagtacccaaacattattgttaaaaataatggagccacaacatttatagataatataaaattattcatttcctactccttgcaaaataaatattaaattttataatataatctaaataacaaaaaagacttaagtaaaattacttaagtcttggtgccgaagaccggaatcgaaccggtacggtgtttaaccaccgcaggattttaagtcctgtgcgtctgccagttccgccacttcggcatggcaatataaaaatggttgcggaggcaggacttgaacctacgaccttcgggttatgagcccgacgagctaccaactgctccaccccgcgatattatgttttatatatatggtgccgaagaccggaatcgaaccggtacggtgtttaaccaccgcaggattttaagtcctgtgcgtctgccagttccgccacttcggcacatattggtagcggaaataggacttgaacctacgacacctcgggtatgaaccgagtgctctagccagctgagctattccgccatattaatggttgcgggggcaggacttgaacctacggccttcgggttatgagcccgacgagctaccaactgctccaccccgcgatattatgttttgtatatatggtgccgaagaccggaatcgaaccggtacggtgtttaaccaccgcaggattttaagtcctgtgcgtctgccagttccgccacttcggcacatattggtagcggaaataggacttgaacctacgacacctcgggtatgaaccgagtgctctagccagctgagctattccgccataaatggttgcgggggcaggacttgaacctacgaccttcgggttatgagcccgacgagctaccaactgctccaccccgcgatattattttatcatatatactggtgccgaagaccggaatcgaaccggtacggtgtttaaccaccgcaggattttaagtcctgtgcgtctgccagttccgccacttcggcatatccttttgttgaacacgactgtcaacaacaaaactaattataatgcatattccctatactgtcaacaaaaaatttaaaatatttttcatttagttaaattcagctttatgtctaaggtttataagcataaataatgtagaatagataattaattaactactaatttccacctattctacacccaaaataacctattatttaaaaagtctatataacttttaagaatattagcagccttttcttccacctttacccttaaattcttgatgtttttttacatcctgcattctttcttcactatcttttaaaaattttgacattatatcttcaaaatttccagttgcttttttcttttcagatacattccaatcaacttctgctggcttaactgactttttttgaatgttagcctgctttattgaaagactaatcttcccattatcatcaattgaaataacctttacttttactttatcttgctcattaagatgttctctaatgtcttttacataagaatccgctacttctgagatatgaactaatccagtctttccttcaacttctataaaagctccaaaatttgtgatgtttatcactgtgccttctactatgtttcctgccattaaggtcatgtttaaaagattcctccttaaatttaaaaatatattttatatttattataagaacgaccttttacagctgttctttaatttttaatactcacgtattattaattgttttgtgcaccataagtttatctataaaataaatgttaattcggattagcttctttttcatcactactattaacaactttctctcctggtttaatcataccaagtcgttctcttgctaatttttctaagtaatcagctgaattagaatttattttttctacctcttcttgcagtctttcattcttttcttgaatttcttccaattgagattgcttattttctatttcactttctatcttctttgttgttattaactgatttatataacttcctccaaagaaaataacaaaagcaaaaattatcagcttttttattattaatttctttttcatccatagaacctctattttacaaattctcttaagtctattgtaaacactaacttattaatattcaagtaattttttatcatttacttttatctgtaactttatatataactatttttaaaggatacatgatatttttgaatacaactcttaatatcttatacattttttgagcaaaatgtttctcaataccataaaaaaatctactaaaaaaccttagatatattcccagtgaaattaccataaatacatatacgtacagagttaaaaaagcataattcatatataataaaaaagtaaatataattagcgatgatagtgaccaaaataataaatcttctattattgttataactttaattttattcatacctctaaatattctatatatatcaaacagaattcctgtaatgatacctgcaataaaactatatataacaatattaacctgcatatttatttctaacggcatatcaatcacctacttaaaaagtttatttaataaactttcgccattttttttgcttacttttccattataaaccatagaagatatattaccaataattataacatctccattttgaacatccagcttattcatttttaactcttcaccttttatagttaaattaccaagtttagttgttagatctattttctcttcatcgaaactcataacctcaacaactccacttaacgttaacttctttctatcttcaaggtttaaactagatttattatcttgtacgctattatcagctctcttttccatcaaaaaatcctccacaattattgtttatatacaataaatatatgtattataaatttcatttagaagattgatgtacatgataaatagttatattatgttttattaaaaataaatttctaatatggattgtgaaatttaaataaaaattttctaaaaaagtagttaactttttaagccactactctttatcttcttcaccttcaataattatatacatttcttttgcatcttcttttctaacatgctctgctatattaactatttgggcttttaatattctatttgcaaatgtaatttctattatatctccttctttaattttagtagaaggctttgcaactttatcatttatgtttatacgaccactttcacatacttctttagctacagttcttcgttttattatacgagatacctttaagtatttgtctaatctcataattaactcctctatcaaaagaacccgagataactcgggttcatattagttagttaacggtatcttacttgttaactttatctttgaattctttacctgctttgaacactggaacagttgttgcaggaatattgataacttctttagttcttgggtttcttccttctctagctgctctttctctagtttcgaaagttccaaatccaactaattgaactttttcaccattttctaatgcttcttcaacactttcgataaatgattttaaagctaattctgcatcttttttagttaatttacttttttctgccatactagttattaattctgctttattcacaataacatcctccttaaaatccagttatataatttttaactgctttctaaattatgtactaaattgcacttctttattatatatcctctttagctaacagtctatagaaaagtctttattttcctagatataactaataatacataaagatttacaatatagttctcaataaaatattattcttcacaaactagaaaattcctttattttattgatattattctagtttttttgcttcctcccatagtttatccattttatcaagatttacatcttgcaaatcttgtcctttgtcctttatttttccctcaatataagagaatcttttaataaacttgtctatagtagcattcaacgctaattcttcatcaacatttaaaaatcttgctacatttacgcaactaaacagtaaatcgccgacctcatcttttatcttatccatattttttgtattatatacatctattacctcttgaatttcttcttttaacttatttatagcagaatcaatatcagctaagtcaaatccaacttttttagctttattttgaaccttatgtgctcttaaaagtgatggaagtccttttgttacgcccttcatttcttctgataaagtttcatatcccttttcttctttctttaattcatcccattttgtaagaacatcgttagatgtattaatattatttaaagttccaaaaacatgtggatgtctacttatcatcttattacatatacctgtaataatttcatttatatcaaaatatccatcttctttacctatagatgcatggaaaacaacttgtaatagtacatctccaagttcttcaactaatccattgtcatcttctctatcaattgcatctataacttcataactttcttctactaaagccttttctaatgatttgtgggtctgttctctatcccaagggcatccgttttctccccttaaaacttctacaatttctaaaagatcattaaaatcctttttattatttaaatctttaggaatatatatagatgtaagataatcaatatcttcttgcatatctaattcatataatggtatgtttcttatactttcctcacctttaattccagcagctcttacataaaaaatttcagtttcatcatcatattgttctaataattttagttttacttcagatgctattaatggattataaacttgagttattattgttcctattctcttatcaagaatttgattatttatatcaaatgcatcaattactttcaatccttcaataggatctatcataagactttccatcatagcatcaataaaacttactgctggaataactttatattctatactatttttcttacattcatcaattaaattaaatactgatttttcagctactagaggatgacctggaactgcataaatcaaatctcctaattgactatgtttttctactaagtccttagctatatttgaatatacctcatcaaagctttccatagtctcataaacattatcataagtattaaactgtatatttttttcatttaaatattctacagtaggatgtttttcagttctcaaaaatatattttcactactttcaagttcccaaacagttcctatagtcaacgcttcttttgctcctggtcctaatccaactattttaatcattaggtatctctccttttaattctttctttttaatctcttctttatatcagatactttaaataccttaaatacaactactaatatcatatatactatcatacctaaaaatattgataataagcaagcgactccattacttcctgtatttttatatataatattataactcaatattactgaaatcatcataattgttgtcgcatatgctggctttattaaaatatcataaaaattcaattttattcttaatgatagtttaagagtaatcagatttaataatgtagcagttatatatgcacttacacttgcaattacagctccataaatattaatactgttgatagaaacaagcatacatgtaagaataaccttaacaatacatcctataagtaaattaattactggcttaatataatttccagttccctgcaaaattgatgttgttgtctgagtaactattataaatggtatggacaatgatagatatcttaatatttctccaccttcagatcttcccggaaatattaattttaatactggatttgctagaaagaaaagaccaaatgcacaaggtaatgcaattacaattgccattttcattgctatatgcatcttctcttcaagttccgcatgttttttcaaaacaaaattttcagctattataggtatcaaagatgtgcatatagccatagaaagagtgagtggcacatttacaataacagatgctttacctgtaagctgagcataaagcacagtagcctcagtatttgttaatcctgattgcaataatttttgtggaactagaattgaatcaattaaattcataatacttccaacagttgtccctaatgatattggaattgctatctttaaaattgtatttaacatttctggattagtttttactttttttattccatattgttttcttacttttttatattttgcatataaataagatcctcctagaacagctccagctgtggcaccaaaggctgctccacctgctgaatattcaattccttttggtaataagaaaacagctagtccaactccaacaactactctaccaatctgttctaatatttgagatattgctgaaggagtcatattttgaaaaccttgaaaaaaacctctgaatatagtaataaatgaaattaccattggtgcaaaagaaatccctattaatgaataataagctttagaatcccattttaataatgatattataggatttgcaaaaaagaatagtgataatgttgttcctatacctatcatcatcatcagtaatgtagattctttcattacctgaaaacttccctcaatatcatttactgcatttctctctgatatcatcttagacatggctactggtattcctgaagccattgcaataaaaaacatatataaaggatatgacatttgataatatccaattccttcatcaccgataagcattattaatggccatctaaaaaataatcctaaaaacctagttaatattcctgcaacgccaagaataatacttccttttactagtgactgtttattcataaaatacctccaaacttaacacgttattactaatttttatgtaagtttggaggtattatgacacatatttatgtttagataaagttatcttgtttctgtaacgtttactctaattatgaataaattattgctccatttgtttgcctaaaaaagcagctgctgtttcaactaatttagtttcaacttcaccaagttcaacatcttcttcttttgacaatataataactgctccaatttcatctccttctgctattattggagctataacttgactattatatgatgtttcttcatcatcattatgtagaggaattactgtattatttgatttacttaataatacagtctttctatcatccataattttttctagttcactacttacttttctttctagatattccttcttagttgcaccgctaactgatacaaatgcatccttatcacaaattaatacaatgtgtccgattacttgttgtaaactttcgcaatactcttttgaaaaatcagtaagttcttcaattggagaatatttctttaatattactccaccatctctatctgtaaatatttctaatggatccccttctctgattcttaaagttctccttatttcttttggtattactactcttcctaaatcatcaattcttctaactattcctgttgccttcatataggtttttatcctcctttaaaactctgttaattagttgcaatattattatttgaatttttagaaattttatacacttataactaaattttatacaattaattaattagaattttttataacttttcaatacagaatttttatatggcaacaggataatttctttaatataaataaaaaaagccataaaggctttttttatttatatattaaagtttatcttcatatgttttaacttttgcagcatctttccattctgatatcttatcattgaatgctttgctttgctgttgttgtaataattgagattttatttgttctttaacatcatcaaaaggtgttacaacttcatctttaatccctgtagctttaataatatgatatccaaattgactctttattggatcagaaatttgaccttcacttaattgcttaaagccagctaagaaatcttgatcatagtttgcttgattatatgctacaaatcctaaatctccacccttatccttagttccatctgttccgtattcagatgctaattgtgcaaaatcagcgcctgcatctaatttagcttttacttcattagcttttgctaatgatgcatcaaaatctatatttccatcgctacctttttcagctattaaaatatgtgcagcattggcacctgctccaactgtatattgactatctttattttcatcataataagcctttgcatcatcgtctgtaacttcaacatcagcagtaatagcttcttgaactttttgtaatttatattgctttttagcataatccttatatgaatcttctgtaaatccatttgcttctagtacttgttgaagctgagcatcatctggatatgcctgttttaattgttcaatttgcttatctgcatattcatttaattcgtcatctgttggtgtaactcctactgattcagcatttttaagcattaacttttcatttaccatggcatttaaatattgaactttcatttgcttaagctgatcttttattttttcattatttgcataatcatcaccatattgttgctttaattgatctatagttgctttcatttcttcatccatatcagccttcgttatcttttcatccccaactgttgcataaaccgttttttgtattgcttcaggagtcttttctatcatcttacatcccataactgatattgaaagagtaaagatagcaactgctgcaattaatttttttattctcttcaaagttttcccctcacttatttattaaatttctgtataagttacataatattagtatagcaatattgaatttacaattcaaacttttcacaatattttcacacttcttatgttatatcataatattgttacaatattatgtcattaaaaacttcttttaggaactccaacttattctcctgcttaatatcttttaatttaaatgagaaatacggatttaatccaaattttaatactacactatctttatatttttcaattaaaagcttatatatattcttataatcactttcaccttctgcaaatctgaatactatttctcttggcatctcttttatttcttcaataaacagtgattttgcctgactttttatataagcaatgtccataagattacgaactggattaggtattgtagaatatctatcttctagctcttctttaatatcttcatattcatccacactatcaattgctgcaatctttttatatacttcaattttttgaatttcatcttcaatataatctgcagatatgaatgcatctactttaacatctacagttgtttctactggttctttttgaatttctcctcttataagcttaacagtatcttctaacattctacaatacaaatcataaccaatcgctgccatgtgaccatgttgagatgatcccatcatgtttcctgcacctcttatttcaagatctctcattgcaattttgaatccagaaccaagttcagtaaaatcttttaatgctttcaatcttttctctgcaacttcagttaaaatcttatcctttgtatataataaataagcatatgctattctattagatcttccaactcttcctcttaactgataaagctgcgataatcccattttatcagcatcataaacaataattgtattaacattttgaatatccataccagtttctataatagtcgtacatacaagaacattatatgtctgatccataaaattgaacatttcttgctcaagctgtctttcagccatttgaccatgtattacaccaaccttgctctccggaacaagattttgcacatacttagctatagcatcaatattttctactctattgtatacgaaatatacctgtccgcctcttcctatttctcttaaaatagcatctcttattagctgatcattctgctcaacaacatatgtctgaacaggatatctctcttctggaggagtttctataacagatatatctctaacaccacttagcgacatatgaagagttctaggtattggtgttgcacttaatgtcagtacatctacattcttcttaatatttttaattttctctttttgttttactccaaatctctgctcttcatcaacaattaaaagtcctaaatctttaaattgaatatcttttgatacaagtctgtgagtccccacaagaatatcaatatttccttcttttactttctgaagggtttctttctgctctttagcacttctaaatctacttaccatatctatttttataggaaagtctgaaaatctatttttcatatttttataatgctgttccgctaaaattgtagttggaacaagaagtgcaacttgctttccatccataactgctttaaaagctgcccttaaagccacttcagtttttccatatcctacgtctccacataaaagtctatccataggtttatctgattccatatcagcttttatttcttctaacgaagttaattgatctggagtttcatcgtatggaaattcatcttcaaattgtttctgccattgagtatcctttgaaaatttatgtccttttactgtagttctcatagcatataattttactaaatcctcagcaatttcattaatagattttcttactttcgctttagccttttgccattcagcacttccaagtttatttaccttaggactttttccttcactacctacatatttttgaattaaatcaagttggtctacaggaacatataacttatcacctttatcataaacaatatcaaggtaatctctcttatgaccagcaacttctatttgctttattcccttataaacacctattccatgatttgcatgtactacataatcaccaggttttaattcagcaaagctttttattttggcaataccttttctctttgatttagttttcttaagctttcttttagcttctccaaaaacttctttatctgatattacgcaaactttatattcaggatattgaaaaccatgaagttggttaccaaatgtaattacaacttcaccatattgaatattatcaactgtgtctttataagaactttctatacctctatctcttaaagttcctactaaacgttctcccctagcccttgttcctgataaaattactatcttgtatccttgatttttcttatcagatatttcatctattaataaatccaactgaccttgatagttatttaatgttctttctgaaatattaactgttgtatatggattaaaccatgaatttttcttaactaatccatctaaaaatacaacttttttatctttaaaagattcaattacttcctctttgcttattaaaagttcaccttgtttcggaaatatatctcccctttgagaaaatgcagtaaagttctcttcaaattctaaatatgttgaatcaagttttccttcacacctttgaacatcatcaattataaataaacaatctttaagataatcaaaaagactttctgtttctttgcagaaataaggaagataactatctatagtttcaaatgttgaagtttcttccaatgattctaagtttttatttaatatatttcttaatttttctaccctagctgaatcagtatcactttttgatatattatcaaattctttttttaacttttctttacctaaagaaatagtttcatctgttattattatttcttttgctggaaatacctctatcctcttaactttatcaatacttctctgtgattctgtattgaaagttcttatagagtcaatttcatcaccgaaaagttcaattctataaggataagccgaacatgtaggaaatacatcaagtattccccctctcaatgcgaactgcccctttccttcaaccatttcaactctctcataacccgattgtataagttttttagatacttcaatgaggtttatttcatcactttctttaaacttcattgtataatctgcaaataatttatgaggagtgtatcttgctgaaaaagcatctattgaggttactattatctttttcttcttttttaaaatttcatttataacttttagtctcgcccatcttaaatcacccgaaatagcatctatattatagaaaaccatttccttcgctggaaaatagtgaacatcattagtatataacaataaatcctcatatatatttttagcttccatatcactttgagtaactattaccatagatctatctatattttcaaagatactatcaatagtataaactcttcccgattcagcaattccatatataccaataggatatctttcgttattaatacttcctaatatattttcaaattcaacactattttcaaagggctctaataaccccttcaatctcatttcatgcaccatccttaaatacttttacttgccttgaatccattatatatattcatggctgttttaacatcattacttattatttcttttgctgcctttgttgaagcatcgatactttcatttaaaacttccatttcttcttttgtaaacttacctaagacatagttaaccaaatctacattaggttgtcctacgcctactttaattcttgggaaaatatctgttccaagatgtgctattatactttttataccattatgcccaccggcacttcctttttcacgtattctaagtcttcctacatcaagactaatatcatcatagataactaaaacatcatcattagataatttataaaagtctacaacttctctaatactttctccacttaagttcatgtatgtagtaggttttaataaaataaccttttctccatttataaagccttcaccacacacacctttaaatttttgcctgtttatttcaatattatactcttttgcaatattatcaacaactttaaaacctatattatgtctagtatcttcatactgactacccggatttcctaatcccactattaaaaacataaaaacctcctattaattaatcagacctattaaatttaaatttttaacactgcctgatttttagaattgtattttgaaagtgtaaaaataaatctaacacctattttttcatcattctcagcccatacttcttctcccatttcattaagaagcattcgtactatagggagccccaagcctgtgctgactttattagttcttgatttatcagatttataaaatctatcccatatatgtattttttcttcttctgaaagtttaggtccattattatatatttccactaatactttgttgtttttgtaatatattctgcaagttataattccattatctccacaatactttattgaattatctagtaaattagtaactacttgaattattttatcttcgtctgtatttacaaaacacttatcatcttgtagatatacctttaatattattcccttttctttcaattttctttcgctatttattatacatcttcttattaattcatttatatctacttttttaatatttaattttaatttaccagatgaaattgctgataagtctaataaatcatttatcaatctagtgagcctttgtatttcaaaataagctctttctaaatactcattttctttatcttttggaattaccccatctattattcctgcaataaatccctttatagatgttattggtgatcttaattcatgagatacatttgaaataaaatctcttctattcatttcaactttttcaagggactcagccataacattaaaagattttgcaagctgtccaatttcatcttcagactgtatagtaactctacggtttacttctccattagcaaactttttagctgcattattcaattctgcaagaggatttatcaaaaatgtttttgcaaacagtgataatactattattgaaaataaaactgtgcaaattgatcctatccaaattataagatacactttgtttaacttactatttatttcttttaaaggactagtcataattatatatccttcaaaagtcccttgatgaattactggatataaatatgtataataattaccaacatactcaacatacttaccttgtttcaataaatctatattatcttttgatacaattaaattatcattcttctccatattgccagatgaaagatacttataattattttcatcgactacaacaatgttagcatcaatagaaatacttgccatttccgtaattcttctaagatattcaagctcaaagtctgttttctttccattataatattctactgctcttgctaaataacttcctgtattttcaaatgaagtctttttatcgtcaaaaaagtttcccttaaaccataatgacaatgcaaatgcaagaaaatgcaaaataaatcctaaaattattccattaataataattaatttataaagcaagctttttctcttcatttattttacctcgaatttatatcctacaccccatactgtttcaatctgccactgctctccaccactaagtttttctctcagccttttaacatgtacatctacagttcttgaatctcctggataatcatatccccaaacttcacataaaagttgttctcttgtaaaaactttatttttattactcgctaagtagtataataactcaaattcctttggtggcattttaatgtcttttccatcatatataaccttataagatgtagaatctataactaaatcacttaatttaattacttgatttttatcgttatcaactgaatatcttctcaagacagcttttactcttgctaataattctttaggctcaaacggctttactatataatcatcagcaccaagttctaatgctaaaactttatcgaaagtatcccctttagcagtgatcattataacaggtctttctccttgttttctaatccacttaagtacatcaattccatcaacttgtggaatcatcatgtcaagcaataccaagtcaggattataatccatatataacatctttgcttcttttccattaagagctatctttgtattaaatccaacactttttagatacatatctataacttcacaaatattttcatcatcatcaacaataagaactttacctacaaaaccctccatataaatacacttcctttcaattccttatattataaccttaaaactccctctatggctataaccatcaagggagtttttattattaatgtctctataatcttatacattatttttcgtactcaaataacttgcttattggttgatcatcatatattctcttgattgcttcagcaaatagaggtgcaactgatattgatcttattttcgctgattctttatcttcacttagaggaattgtatttaacattacaagttcttctattgctgatttatttatcctatccatcgctggcccagataaaactccatgtgtacaacatgcatatacatttttagcacctaaatccttaagtgcattagctgcattagttatagttcctgctgtatcaatcatatcatctatcaatatacatcttttaccttcaacatcaccaataatattcattatttcagaaacatttgcttttggtcttctcttatctataattgctataggcgcatgtaaattatctgcaaactttcttgctcgtgtcacactaccaagatccggtgaaaccacaacaacatcatcttgatcttcaagtcctttagatataaaatattctgcaagtattggccctcctaaaagatgatcaacaggtatattaaaatatccttgtatctgtgatgcatgtaaatccatagtaagtactctatttgcacctgctgctgtcaataaatctgcaactaacttagctgtaataggatctctggatttagcttttctatcttgccttgcgtatccatagtaaggaacaactgctgttattctacctgctgatgctcttttaaaggcatctatcattattaacagttccataagattattgttaacaggtgagcatgtagattgaactataaatacatccattcctcttacagtctcattaatatcaactgatatttctccatcactaaatgttgaaacctttgactttcctactgcaactcctaagatatcagaaatatcttcagctaatttacagtgtgaatttccagtgaaaatttttatatttcttacatgacctatcattaggaagacctccttaaaatttatggattatctttatatttaaaagtttatttttttagaccctttttatctacccatccactaatatttctttgtttagctcttgctattgcaaggtctccttcttttacttcacatgtaatagttgatcctgcagcaatataagtattatcagcaacttttactggtgatacaagatttgtattacatcctataaagctatgatctcctattattgtcttatgcttttctttaccatcataatttactactactgttccacatccaaaattacattccgatccaacttctgcatctccaatgtaagttaaatgagataccttagttccatcaccaatagtagattttttaatttcaacaaaatcacctattcttgcatgtttaccaattgttgtttctggacggatatatgcaaaaggtcccactgtagtattttctcccactttactatctaatattacagaagattgaatatctacatcattcccaataatactatttgatattcttgagttttgatatagaagacatctttcacctatttttgtattgccttctaaaatattattaggatatataatagtatcctttcctatttcaacatcaactccaatatatgttgtcttaggatctattaaagtaacaccattatccatatgcatgatgtttattctatttctaagaatttcttctgcttgtgcaagttgaactcttgaattaactcctattgtttcttcaaattcagttacaactgctccaacctttttgtcttcttcctttaatatttctatgacatcagtcaaataatattcaccttgattattattattatttattttatctaaagctttttctaataattcaatatcgaaacaatagatagcagtattcatttcattaatcttaagttcttcttcattacaatccttatgctctactatctttaacacttcaccattatcatctcttactattcttccataacctgttggatcttcaactagtgatgttagtattgttgctgagttttcattgttgatgtgttcatcaaataactttttaattgtagatgtttttattaatggagtatctcctgcaaatactgcaacaacaccttttttgccatgcaaaaattctttagcacacttaacagcatgacccgtaccaagctgttctgcttgaagagaataagatacgtttttatcacttgttctttcctttacaagctctgcaccttttcctattattaaattcacatcatctatttcagcacttctaatagaatctataacatgttttaccatttctttaccacaaactttgtgtaatacctttggtaaatctgattttattctcttgccttgaccagccgctaaaactagtgcacatttatacataaataacacctcattatatattaattaaacgattaattaacttatttttcacttctaatattcatattaattatatttgaaacatacttttatttcaaggtattcatatcttgtaatatcaaaagtatcaataatagaatattaatctgcttcaccacttttcatctaatttaataaaacaaacaagaggaagatttacttcttcctcttacgtttctattgcttattcttgtggcgcttcttctgataaagctttttcatatgcttctaaaatagctgtctgaattttttctcttgcttctgtattaattggatgagcaatatctttaaactctccatctggtgtttttctacttggcatagcaataaataagcccatttgaccttctataactttaatatcatgaacaacaaattcattatcaaatgtcacagaaacaattcccttcattttaccttctgatgctatttttctaattctaacgtctgtaatttgcatcctaaacccctccagttgctttaaaataagttaatatttatataatttctccataaatttctaaattccttttaattatttaataaaatatcaataaatttatttaaaatcaaataattaacataattttataataaaaaaagaacagaaaccccactgatcttctgttcttaaatgtgtattctattataaatactattttttaatattaagcaaataattttgatggttgtattcctacaattgctgatttatctacttcttttaattcaacaatagatacatactcatctacaagtttcttttctgtttgtttattatcaactaatactccaattcctactaattcactatcaaactcctttaatagatccttaattccgatagcagttccgccacctttcataaaatcatcaataaaaatacatctgctgttatttttcattgatttttttgataatgacatctgttgaagtcttccattacttcctgaaacataatttatagtaactgtaggaccttctgtaacctgactatctcttcttgcaataacaagttgtactcctaagttccttgctacttcataagccaaaggaattcctttagtttcaacagtaataacataatcaatatcacttgccttgaaacatgatgaaagcataacaccagccttacttataatttctggattatacattaaatcagtcatataaataatattccctggaataactcttccatcatcttctaattgtttacataattctaaagcaaacgctctattactttcatcaccattacctggaatatacttgataccacctgcaacccctgcaacagtttcaatttttcccatttgaagcttttctaaaacttctcttacgactacaatatcttcacttattgtggattttgccgcatttaataattctagaaatctatttaaccctattattttattagggttttctaacaaaatcttagttatggcaactactcttttatttctagtaaatttctccatctatatcacctacacgaatttttatttgttaaattcacttaatattcatattttattctaatttcgaattaatagcaatgattttatccataaagttatattatatatataattttttcatacttccagttaaattttttaataaattacatatattaatctaataaatagataaatttattaataataaaaaattttttccataatttcttatatatttttttattttatggttgattcaaaaaaaaatgtatataattatagttaaagtgtaaaattaaaattttgaatttaaatattatgtgtaaatttagaaacatattaataataaattacaaatattattatagtatggtgtttctcctctacaatttatacaataatatcttaatggtgatattgattttatatcttaatttataaataaatattagaattagtaattctataagtagcaaaggagttgatttcgtgtcttttgatttcttaaaagatagagataaaaaaattcattttataggtatttgcggtatcagtatgagtggtcttgctgccgttctactaaacagcggtttcaaagtgtctggatcagattttaaagattcacctatcgttgaaaaattaagagctgaaggtgctgaaatttacataggtcataacaaagataacataaaaaaagatgtagatttagtagtttatactgctgccattccttccgataatcctgaaatattggcagctaaagatcaaaatatacttttaatggacagagctgaatttttgggacatataatgaaaggtcacaaatataatgtagcagtttcaggtactcatggtaaaacaacatgtacttcaatgctttctcacgttacattagctgcaaatttagatcctacaatcttagttggtggagaattagatgttatcggaggaaatttccgaattggtaacagtgaatattttttaaccgaagcttgtgaatataaaaaatcattcttaaaattcccaccttatgttggaattatcttaaatatcgatgctgatcacttagactgctataaagatattaatgaaatagcagatacttttatggccttttcaaaattgataccaaaggatggttatcttgttggttatggagatgatgaaagagttaaagaaattctttcaaatgctgaatgtaatactgtaagttatggatttaatgatgattcagatgtcactgctaaaaatatcacttttaataaaatgggatgtgcatcatttgatgtttataagtctgataaaaagctattttctctaactttaaatgtacctggtaagcataatgtcttaaatgcacttgcgtctatatgtgtttctttgatttttaacattgctgataaagatacagttgaaggtttatcaaaatgcaaaggtgctcataaaagatttgaatataaaggcgaattaaatggcgttactgtaatagatgattatgctcatcatccaacagaaataaaagcgactctaaatacagcccaaaaaatagaccataataaagtatactgtgtattccaaccacacacatacactagaactaaaacattatttgatgaattcacacattgttttaatgaatgtgatgaacttattttaatggatatctatgctgctcgtgaaaaagatactggtttagtatcttctgaagaacttggaaatgcaatacgctctaccggtgtaaattgtacaaatgttcattcacatgatgaagctttagaatacgtaaaatctaagcttggcgatggagatttattattaacagttggtgctggagatgtagttattgttggtgaaaaatatttagaaaataaataatattttaaaaggctgcttctaatatggagcagccttaattctaaattaaactacagtaatttcttttggcactgaatttaatatttcacatccatctttagttacaagcactaaatcctcaattctaacacctatattgcctggaaggtaaattcctggttcaatagaaaaaatcatcccttcttttacttctgcatgattaatagaacttacatcacctttatcatgaatctctaaacctatgctatgtccagttctgtgagtaaagtattctccaaacccttcttctgttataaaatctcttgctgctgcatctatatctgaaaatttaactccatctttaacttttgaaatagcatttaagttagcatttctaactatttcatatattcttctatgctcttgacttggttctttcccaaagaatacagttcttgtcatatctgagcaatagtgattatatattcctccaatatcaataactaaactatctccttttttaagcttagttccatctggctcatgatgaggatctgctgcattttcaccatatgcaagtattggatcaaaagagaaaccttgagctccttcattttcatatatttcagctaacaatcttgcataatacttttcagtataaccttctcttagttcactcttaagcgcttccataaccttatcattaatctttgatgattttctcataagatctttttcttcttcatctttaaccattctaagttcatcaattattcctgatgaatttacaaatccttttacggcattaagttccattagtcttataatatattgagctggccagaatttatctacacccaatgcttcatttttattaactatattacttaaaatcttaattgagtcttcactatctgtataccatacaatttcaacgcctaagtcttcttcaattggaaataacttatttactataaatttgtgctctccatttttatttaaatataaggctatcattctttctcctgcagaaatccattttccagtaagataatatatggatgcagtagatgatactataatctgagataaacctgccttctccatttcattaataacatttaatactctttgttttttcatttttagagcctcctctttatgtctattaaatatatttataaacacatcttgcttaactttaatagttttttacttattatataacttttccataaaaaatcatattcttactttaaccatgaatgatataatatatttaaagttttaaattcaaacatatagaaaattatataatgacataatttttatgcatttagggaggattacttatgaaaatagctgtaatatcagatattcatgctaatatttatgcacttatgactgttttagaagatatagatagtgaaagagttgataccatagtctgcttgggcgatttagtaggatacggtccacatccaaatgaagttgtatctaccataagaagacgtaatattctttgtttgaaaggaaattacgatagttccgttgtagataatgaattttcattcatcagagaaaatcctataaattctttttctatgccttgggctgttaacgaattaagagaagaaaatagaatattccttgataacttaccctctactctatctttaaatatcgctaacaaaagtattttgtttgttcacggaagtcctaataagattaatgaatatttacttcaagatggtgaaaatacatccgaaataatgagcgcattaaaagaggacatactcctttgcgcccatactcatatcccttgtgcaaaggaatttggaaataaactatttattaattgtggaagtgttggaaaacctaaaatcggcagaccaaacccaacatactgtataatggacatcactaattctggaggcgtaaaagtaaaaattaaagaagtaacttatgaagtgaaaaagattattaaagatatgactatgctcgattttcctcaaactttaatccattcatttgaaactggagtagaataatagatttagcattttaatattatcactatatgatacatatggttagttgcattgaccaagaaagtattgtaaaatttatttagcattaaccgtaatagtatacattgagcaatttaatcttttactttaaattgctcatatatttcatttgtgaatattgtattggctcgtgctaaaaaatataatatttttaattttttctttgcaaattttatgaaaaaaatttttcattattttgtaaaattaatcatgaacaatggaggtcatatattatggcaaaatcaactttaattagaagcctttatagaaatgctgatgatttcttatcaaaggatgtaacaatatcaggatggatcagaactttaagagcatctaatgcttttggattcatagaaataaatgatggttcattttttaaaaacattcaaatagtatttgatgaaaagttagacaattttaaggaaatttcaaaattacctataagttcgtctcttactataactggaactttagttgctacacctgatgctaagcaaccatttgaagtacaggcaaaagaaataattatagaaggaatgtcaaactcagactatcctctacaaaagaaaagacacacttttgaatatttaagaagcattgctcatttaagaccaagaagtaatgcattctctgcaactttcagagttcgttctgttgctgcttatgcaatacataagttcttccaagaacaaaacttcgtatatacacacactccaatcataactggtagtgactgtgaaggtgctggagaaatgttcagagttacaactttagatccaaaaactcctgaattaacaaaagaaggtaacgttgattacactaaagatttctttggaaaagaaactaatcttactgtttctggtcaattaaatgctgaatgctttgctttagcatttagaaatatatatacattcggaccaacattcagagctgaaaattctaacactacaagacacgctgctgaattctggatgatagaacctgaaatagcttttgctgacctacaagatgatatggaacttgcagaagcaatgcttaagtatgtaatccaatatgtaatagatgaatgtccagaagaaatgcaattcttcaactcatttgttgacaaaggattattagaaagattaaatcacgtagtttcttctgactttgctagagtaacttatacagaagctgttgaaatattagaaaaatgcggaaaagaatttgattatcctgtatcttggggaatcgacttacaaacagaacatgaaagatatcttactgaagaacacttcaagaaacctctatttgtaactgattatccaaaagatatcaaagcattctatatgagaatgaatgatgataacaagactgttgcagcaacagatcttttagttcctggaatcggtgaaatcatcggaggaagtcaaagagaagaaagacttgatgttttagaagctagaatggctgaattaggtcttgctaaagaagattactggtggtacttagaattaagaaaatacggagaaactaaacacgctggattcggtttaggattcgaaagattaattatgtacattactggtatgactaacataagagacgtaataccattccctagaactcctggaacttctgaattctagaaaatataattaaaagctgataataactcacaacctgaattattatcagcttttttatgtagtttagtataaaaatattacttttcaattgattgttgctttgatttatttaacagatatatatgaatttccttttatatagaatctccacggaaaatcaattgcttcttcagcataatcaattccaatcctcttagtttcaactatttcgaaatcactttcattagaatcttctatataaaaatccccattttcatatagctttttataattttcacttttatctattgaataagccatacataattttgacggaccatttgtaactgtctttttctttgcgttgcttaattcatcgaaattctttttaaaccttttttgtgatatatagttaaattcatttaagggctcaactgctctaactaatactccctcacccttatccttctctccacttattacattaaaacagtggtaaagaccgtatataaaatacacatatgcaattccaccttcatgaaataaaggctctgttcttgctgttcttcttccgttatatgcatgtgacgctttatcaatttcccctatataagcttctgtttcaactatctttccttttaaaactcttccatctatttttcttacaatagttttacctaatagttctttcgccaaatctaaagcacctttactataaaagcttttttctaaaatcatgtttctcaccaactttttaataagcatatgtttaaattttatccacaacatcaaaataataatccacaactatattcgttttttcataattttgtggaaaactttttgatatttttattttgtacaatactcttattgttgatacatattaattttatctagctgttaccttatacgtgcaactaaatttttcacaaacatcaatagaattaataccttctttttccgtaaaatcaccattaaagtcataataatcagcatgcccaaaccaaggttctatacaaacaaaaggtgctccatctttaggtgcccatattcccatataaggaaatcctgtaaaatccacttctaaagatttatcgctcttttctgattttatagtcattttatttgattttaaatcattgaaaactaacgcatcatttttaaaaagttctttagataaaatcaatttatttgtgtcctttaagcaatcactactactatgagataaatatccttcctctgtaagtgtaatttgcttactattctcaattttattaaattcaatataacaattttctagtaaatcgtttttatctataggacacataaatgctggatgagctcctatagaaaaatatatctttttgtcatctaagttttccacaatataagttattctaactccatcatcttctaatctatagttagactttaaagaaaatttataaggataaacttttaatgattcttctgaatatttcaattcaaatgtaatttcatcttcctttttatcaatcatagaaaattctgatacccttgctaatccatgctgtggaagttcatatacttttccattaaccctatattttgaatctgcaacctttcctacaattgggaacaatattggtgcatgatatttccaatactcaggattaccattccataaatattcttctttattctccttattcaatattgaagttatttctccaccataagtccttgacttgattcttaattttgaattttctaaaatgtattccattttccatacccctttgcacaaaatatatttaatctattattatcttaataatctagtgttactatcttaccatgatttaaactctcttttatgtctattattctctgatttgttgaacctctaaattttaaaccttcttgcatattctcttcttcaaattttccatcaacaagaacatctatattatttaaaagttcattccaaccattattttcatctttatgttctcttatatattcataagtataacctgtatagcaccatatatttaagctattgttcttaaacgcctttgccatatatgcaaacttctctgcctgttctaatggatctcctccactaaaagtcacacctttaatcataggattatctaaaactgattctatcaattcatccatattacggttttctccaccattaaaatcgtgtgtatcagggttaaaacagcctttacaattatgcttacatccttgtgagaaaaatactcttctaattcctggaccatttactaaactctcatatgctattcctgataatcgtatatctttatccataactatcaaactcccacgtacttactttactaaaattttaattttgtatttagtattttttgtgaatatatatgttccaattataaacctacatatgatataaaaaatttctcagtaaagtttttaactttaacttttcattttcacatgtcaattataatacatatctattatatcattaaataaaaaagacagattagcatctgcatattttattatgcattgatatactaatctgtcattttatttattaattcctagctattagcctttacgtaatttaatcttccaccagcttttattactgcaatttctttttctgtaagatctgctatagcttcaaattcaacattcttagttaagttcttaactatcacttttccatcaactaaggcattttctataccttcaatttttaattcgtctaataagtcaatcttatcataatcagcttcattcttaaattccattggaattattccattgttaattaagttagctttatgaattcttgcaaatgatttagctacaacacctttaattcctaagtataaaggtgcaagtgcagcatgctctctgcttgaaccttgaccatagtttcctccagcaataatgaatccaccattattatctttagctctcttagggaactctgcatctattgtgctaaaacagaattctgaaagataaggtatgttagatctaaatggtaataacttagaatttgaaggcataatatgatctgttgttatattgtcttcaactttaataactacctttccatccacatctgaacctaattcttttcctattgggaatggttttatgtttggacctcttacaacttctacttcagcattagttgctgctggttctaaaatcattgaatcatctataatgaatttttctggcatttctatatctaaatctacatcactaacaatttctcttggatcagttaaatatccattaattgctgaaactgcagctgtttctggacttacaatatatatttgtccagataatgttccacttcttccatagaaatttctgtttactgttcttaaagatattccatttgttccaggcgcttgacccataccgatacatggtccacaagaattttcaaggattcttgctccagcacttataatatctgctaatgcaccattcctagcaatcatctccataacttgtcttgatcctggtccaattactaaactcacattaggattaacttttttgccttttaaaattcttgcaaccttcattaaatccatatatgaagagtttgtacaacttccgataaatacttggtctactttaatttttccagcatcagttactttaactacattatctggcatatgtggtttagctgttaatggtttcaattcacttaaattaacagttacaacttcatcataaactgcatctgcatctggtttgaattctatccattcgtcttctcttccttgtgctttaaaaaattctaaagttctttcatcacttggaaaaattgaagttgttgctccaagttcagcacccatgttagttatagtcgctctttctggaacagaaagactcttaacaccttctcctgcatattcaaatactttaccaactccacctttaacagtaagcattcttaatacttcaagtattacatctttagcagaaaccattttatttaatgatcctgtaagttcaacttttacaacctttggagtatttatattataagctccaccacccatagctaatgcaacgtctaatccacctgcacccatagcaagcataccaactccacctgctgttggagtatgactgtcagatcctattaaagtatcgcctggagttgagaatctttctaagaatatttgatgacatataccatttcctggctttgaaaaatatactccatatttagatgcaacagtttgaataaatttatgatcatcagcattttcaaatccttgttgtaacatgttatgatcaacaaatgctacagatttttttgttttaactctatctattcccatagcttctaattgaagatatgccattgttccagttgaatcttgagttaaagtcttgtcaatctttaacgctactggttctccaacctttaattcaccttcaactatatggctttttaaaattttatatactaaattatctcccactttgatgttccccctatttcattgcttattatgtattttctaaacttaaagcacatattcattatcgaaatattactaaattgcaataatgaacgtgcctatacaacctttttttatatattgatttagtaaattaatcacattttttttcttctaattgtctatgatattccttatataattgaacaacttctttatcaaaaagagttctttttaatctcacggaagttgatctaacaagttctaatattccttttgattcatcatctgtaagagttatatcatattctgcaaacttattaactacagcagctcttcctgaatgctttcctatgagtatttgtctttcaagtccaactatatctggatcaaaagcttcatagtttttaggatcttttagtgctccatctgcatgtattcctgattcgtgagcaaacatattagttccaacaatggccttccattttggtagttcccttccagatgctcttgaaacatattcagatacttctctgaacatttttgtatttatattttcacctttgtatccacatactatcataagtgacattaaaacttcttctaacgcagcatttccagctctttcaccaaggccatttacagtaaccccaacgtgtgtagcaccgccatgaagtccagccaaagcatttgctgttgccataccaaaatcattatgtgtatgcatttctatatcaaattttgttttatcataaagatatttaatctcatctctaagactaaatggttccattattccaactgtatcacagaacctaaatctatctgctcctgcttgttttgctgcatttataaattcaactaaaaattctctatctgctcttgatgcatcttcaccattaaccgaaacatatagtccatttttctttgcaaactcaacagatttaaccatattatctaatacccattctcttgactttttaagtttgtgttgtatatggatatctgatactgatgttgaaattgccactgcatcaacaccacaatctattgattgttctatatcacttattacagctctattccaagccattatgcttgattttaaatttctcttaacaatttctgttatagcttgcttttcatctccacccatagttggaataccaacctctaattggtcaacgcctaaatcacttaacatttcagctataacaattttttcttcattagcgaaaactaccccagctgtttgttccccatctctaagagtcgtatctactatagtaatctttttgttttccttatcattaattaccatgctaattcccccattttaatattttgcttattgcataaattaatttccttttaatttacagtacacatttataatagcatattttagtattatcagacaagtattattattatttttttgcaacaaatcatacatcttccttcacagttttagatttttaaccgttttttttgctttttacttatagttattgcaagtttttttttatttattgcatacttttgattgttatgttaattcaactgcacttatttcacataattttcataataaaaaactcattaaacttaattatattaagtttaatgagttttttattaatatttttaataatgatgcttatgattttcagtatgagatattctatcttctctttcatagtattttcctggtccaaatctttcatcaagactaaggtatcctgttactcttgaaattccttgaatatcagtacttctacaatttggacattcatgttgatgttcttgtaaatatgtcccacaatttttacaatatcttatatggaaatttatccccatatagcttatattagttttcttatatgcataatttattatatccataacagcttcttctgtaggagcatcatcaacttcaatatagcttatatgaccaccattgcaaagcttatgataaggtgcttcaatatcaattttatctttaattgatattggatatgatacaggaacatggaaactatttgtataatactccttgtctgtaactccttctatttttccaaatatattcttatcttgttttataaatttacctgagagtccttctgctggtgtagcgtaacaactccaattcaacttatattcttctgttaatctatcgcaatattgtcttatgtgctcaattatttttattcctaattctctagctttctcatcttctccatgatgcttacctactaaagctactaatgtttctgccaatcctataaatccaattccccaagttccttgttttaatattggttcaatggaatcatcaggacatagtccttcagaacctttcataagaccttgacctgctacaaaaggtaaatccttaacttttaaattctttaatacattgtatctatgaattaatgattcttttgcaaggttaagtctagcatctagtatttcaaagaatttatttaaatctccttttgcttgtaggcctattctaggaagattcatagttgtaggtgctatatttcctcttcctttgcatccaggttcaccatttacattcttcataagataagttctacatcccattgttgctggaacatatcctctatcgtaatattctttattgaaatctgcatcaatattcatgaatgtaggattcattctcttagctgctactctacatgctaatttatataagtagaaatatggatctccttcttctctattaacgccatccttaactctaaatattatattagggaatataggttgttcacccctacctaatcctttttcgtattctaataggaatatttcacatacaagtgctgcatcatcactatctggtaatccaaggttaatagaactaaatggtacctgagatcctgctcttgaatgcatagtatttaaattataaacaacaccctgcatagcttgatgaactctcttattaacctttttctctgttaattcatctatcttttctgaaggaactcctaattcttctagttcctttcttacttcttctcttgtaggttctacaaaaatagccatatcattatcaaaatctggatgtgattgtcctccaaacatgtcattttgagttgactgtaataatatacatgataattcagctgctgtttctattctctttggtgcattaattgttccatatccagtattaaacccatcaactagcatttctttagttgggatatgaagacaatttacagttaaattatagctatctaaatcatgataatataaatctcctgtttcatgagccttcgctaaatttttaggcataacagcaagtgtattccatttatttgactcagatgctattcttaataacttggaactaaaattgtttcctacgttagcattgtctctatcagtttccacacctatctggcgaattgctttcattaaatctgattttatttctcttactttagttctttctttcctatatgttgaataagctactgctatatctatatgaccttgattttgtagtgctctttctacaaaattttgtatttgttcaacagttatagattttttatattctatttcaatataatctgttacctttgcaacagtagttaagacttcactttccttaagagttaaaccgatttcactagctgaaccttttattgcttgtgcaattttatccgagttaaactctacctctctcccatctctcttcacaacatatagcattattattccctccatggcacaatatattgtatatttaatactgtattattatactgtattaaatattccttcgcaatgcttttaatttttaatttttttacctctatattttaattatcttggaataggtatgattatcttactatttgattattttatatgtatgttcaatagttgacttattttaaatatgttaatattaacttatttactaatattggactgtttatttacaattctctatataaataattattttctaaataagaaaactatatcactattgatatagttatcactattgataatattatcaatagtgatataattaatttaaagatttttaaattataggagggttcttagtggaaaaaattgcattaattacagatagtgcttctgatattaattcagagttaataaaaaaatataatatacatgttctaccttttaaaatcatattttcagataaagaatataaagatggagtagatataacaccttcaatgctttatgaaaaattaccaactgaaattcctactacatcactaccaagtataagcgaattcactgaattgttagagaaactaaaatctgatgggtatactcatgcaataattataacaatatctaattgcttctcaggtacttttaatgctgctagattagcttctgaaagtgtttctgatattactacatttgtatttgattctcttactcttacaatgtctgagggtgcaatggttttagaaacagctgccctaattgaagaaggaaaatcatttaatgaaataacaaatgaacttcctacaataagaaagaaaattgatgttttctttacactagatacattaacatatttaaaaaaaggcggaagaataggtaaagttgctggaacaatagctgaagcccttaatataaagccaataataacaataaaagatgatggttttcacacatactcaaaagtaagaggaaccaaacaatctatttctaaactatcaagtatattaaatgattacttagcaaaaggtaaatgtaaagtatggattatgaatggagatgctccagacaaagcagatttactatataacactattaaggattctgataatttagttgaatgtactttaggtggaatgattgggcctgctcttggcgtaaacactggaccaggtcttgttggctttattgtagaaatggtggattaagtatgagtgaattaggtgcttcaaaaaatgattatattaagtctgaagaaaaaaggctatacgaagaatataagaaaaaaatttctgatttaaaaaaggaatcaaagaagccaaaagaatcatctgttcaaatttttaccaaaggattattacctatatatgtactatacttattatcactatcgcctacaaatggcaacgaaatatctcacagtataagtataaaaactaatggaaagtggactccaagtactggtggaatatatcctctcttaaaacgtatggaggaagatgatttaattataggtgaatgggataatcctaataagcgttttcaaaaaatatataaaattactgaaaaaggattgcatgaattagaaaataaaaaagttatcttaaaatctaaaatagaggattctctagaagtttttaaaataatatataatgatttatatttttaaattaaagagactttaatcgaaatttgtattaaagtctcttttcgtatatttatattaattttgtaaataataataaataatttaccgaattttgaaaggagattatttatgaaaaatttcgtattagactcaacttatagagatgctgtaatagttaatgcaaatgatgaattctctactacacctgcacatatattacctaataatcctataagtaagtatgaaataagttcatctcaaatgtctaataattatgtatcccataaaacgaaaaatgataatttcaatagatttaattttatagattatatctaattattgacatctacttaaaataaaaagatacacttttagtgtatctttttattttaataatgattaatcaacagaaattgcacttactggacagctttctgctgcttctttaacctcatcttcagatccacttggtgcttcatcaacaataaatcctgctttaccatcatcttcaatttcaaaacattctggacagattgatggacataatccacatgcaatgcatgtatctttatctacagttgctttcataaaaattcatcctctctttaaaaattacattattaatatttcccaagaaatattatatttatgtatttattttattaactaataaaaaagtaactacaccatgcttttagttgacagttaacagtgtggtggaaagtcaaatattttcttctaattttattttttagaaatctctttaatctactaaattcaagcactatgctataattataatttgctatgaataaataaataccctcgtatatttcattataaaaatatacgagggtttaattatcataactatatagttgcttcttttaatataatccttcaaaaattaatgaatataaaggattttcagtaacatattgttcagcttttccttcttcaagtgcttctgtaagctctatatttattggaagctcacctaataatggtaatcctaagtactctgcattttcttcagaagattttctactaaatactcttatcttcttatcacaatctggacagttaatataggccatattttcaacaacacctttaatttttattcccatcttctgagccattataactacctttttaacgatcattgaaaccatatcttgtggtgtagatactattactatttcattaatagggaattcttgcattactgttaatgcaatatcaccagttcctggtggcatatctataagtaaataatcaagttctccccaattagtttctccataaagctgttttaaaacaccatttattacagctcctctccatataagaggttcttcttcaactggtgtaacaagattcatagacattacctttataccacctgctgtttcaacaggattgaatctaactaattcattatctaaaggttctattaatgatcttttttcatttattccaaaaaatcttggcattgatggccctgttatatctgcatctagaactcctactttgtatccctttttagataacattgtagccatgattccagtaactgttgatttaccaacaccaccttttccacttataacacctattacatttttaatattcccatatctaggcgctattttaggtatttgtgtttcacatccaccattactttttgttttacattggtccttacttggacagttatcacaacttgccatttttatcctccttttctttaccagtcttgaggcatttcatttgccccgctgacattgatgtcccaatctttataattatattctgcggttatatagtaacttttaaaagatttatctaatttattatctattgttatcaatgttttaaatgctgtactgttataacccctattttttacttttattattgtatcaaactgttctgaattattactaactaaatcaacattaggtattagcttatttagatttttcttaaattcttctaaatcatttgaaaaaacgtatttcaaacaatctacatctccagatatatctattccaaccttaccatttgatagtgaatccttatttgattcaacaacctttaaaatagattcataataaatatattcaaaatttcttggttttcttataaatgaaagattctgcattattgtattttctaaatttttaggtactgaaaatgcattttcatcatcatagaaatttccttctttattagaattagctccaactacatatgaatatttttttacttcttcaccaatccatacttcaaacatataatcaggatcaagtgagcttttttcactacattccttacctttagaaagtattttgtatatatcatttatagcctgtggatcatttactataaatctaaatccactatctcttacattctgtattataattttatcaaccttattttgttttatgtaatcaaacttttcatttctaaagttcaactttactgctacatcattaactacagagcatcctgataaaggtgtaacaagcattattaataccataaacattattactgacttattaactttcaatgctttttttctctcctttaaaaaacttgctaagattaaatataataataccaagtactaaagtaaatattgcaataaattgtgatgtggataaaagaccaacatttcctctaggatcatttcttaaatattctactaagaatcttccaacactataaatcactaaatacatccccataacttttccatttgctttttgttttcttccataatataaaaggaaaaatcctaaagcaaaatcaaaaatcgatgaataaatctgtgttggatgcaaatgaatacctgctggtgcaagagatccttctgggaaaactactcctattggcaactcggtctcagccccataacaacaacctgctaagaaacatcctatacgcccaaatccttgtgctatagctaatcctggaactgtcatatctaacatttcaataatgttccacttttttcttctgcaatatagatacattgctaatgcaccaccaccaatagcaccataaattacaaatccatagccaaagttaagtaatatactaggatcttttattatgtcctttatctccgttactataaatagtgccttaccaccgaatactccacctattacagcacaaataattaaattaagtaacgaatcttcatcatatcctctttttttacctttatttataaatatagatgctgctactattattcctatagcaatcattaatccataactttttatttgtattccaaaaagctcaaatagtactatcctcatttattacctcccttttttaactactcaaaaataagtatcaaggagaagcttagctatgcttctccttgatacttaaattataatacttatatagcgtattagcaaatcttatttattctgcttaatacttgcaattacgtctgtacaatccttgtcaaaagctttttcatatttgtcttttggtatattaaataatacttttatcatctgtccattcatacctttaatatagtaacattgatttacataactatatccatcattaatattagtattgtattttgataatacaccaatactttgagaattttcaaacggagttatttcattgttagaatattctagtgattgctttttagtatctttgtctgcataatcttttacgtcctgatttgtatttatcacctgaactaatcctgtaataatattatctttactgttaaatttaatattatagctaatgtactcatctttgttttcttcttcatctataacccactcagaaggaaatgttatagaatacccttcaaatgaatattcattatatttttgagtactttctgtaacatttactcttgagaagttatccacgaagaaaccttgtgttatggctaacaacaacattaatgatattaataatccagtaacaacaatctgttttttattcatatactaatttttattctattcagtaggaactacaatagaacactttttataatcgtagaacattagccaatatccattatttcttgttccatcattagcccaggttacaaatccagttttacctccataaggctgttcacttacatccttacttcctggaattccataaacaatatactgaagttcaccaaaactattacatttatatcctaacaaaaagtaattttccttacttatataaggataataatttaacatcggataataagctaaagtatatttatcataatcagatttattgcataaatcatccatactatttacttttactttataccatttgcaataatctatatcttgaatgttactactatattgttcaaatcccttaacaattccctcaaagtattttccttcttctccccttagcttgaaattgctatcctttcctacattttcaatagatttttcatattcctcaaaatcgattctatcaagtcttgtattttcttctattcttctactattttctaaagaagaaattatagactcttcatctcttttacatctattctcagctttaaatctcctccaattgcaattatcttctgatttctttttaataaatccacatataaccatatcttctttcatatctggtatatgaattttaatatcaagcatgcaatcttctaatttatcgtaaattttcttaatttcatcacctacgcaatattttttatctttcttttctttatctttttccttgtccttgcacttatctttatccttatctttatccttttccttttctttatcctcacattttttgcatctttcatcatcactatctgattctcttatatcagataatttagttgattctacattagtatttacttcttctgttactatgttcttttgactttctaaactcatgttctcattttcatgagatataattttaggttcaacaaccttagtttctgttattttagcttcaattattggttttttaggtgatgtattaataactggaccagaagattcttttcttatagtatctaaatccatttttttagtagatttacttgaattttcactgtccttaataaccttaaattttctccaattttcactggattcctcaccattcataaatccatgcataataaagctcatttcatttccacttaccatacatattgcagctcctgatatcttttcatacgaaattccaagaccagcaatattattcacataatactctttacttgtgtcacccttacctacttcattcacttcaagtgaacctaaatcaataagttgtttgcagtctttcttactacaaataagtatcatcgaatatttactttcttttttaaggttttgagcataaaaagaaactttgcatttgtctccttttgcctcgacttttgcataccccgacaaggctttttcattagctgatgaatatcctctatcatcttcttgtagaattataaaatttctatacaatttattatgtgccaagccaaatttcctcctacatatatttattccatatagtatatgctaggtaatcttgattatgatttcttgtttttaataaaataaaccgtacatggagtttaaaatactctcaatgtacggtttatctcatttatactattgtttcgcatcatatatacagtctgataaatgtgcaaattcttcaatagataatgtttcagctcttctctttggatcaattcctgacttttcaaaggcttcttctaacttttctttactcaaattgaatgtttttgttgcattccataaagtttttcttctcatattgaaaccagctcttacaagtgcaaacataagattctcatcttttacatttactcttggtgcttctaatctatctaatcttataactatagattctactttaggtctaggtataaagcagcttggagcaactcttctaactatacttgtattacaataatattgtactaaaactgataatgcaccatattccttacaattaggttcagcattaattctttcagcaacctctttttgtatcattatagttaatgatttaaaattatatccatcttttaaaagcttaactattataggtgttgttacatagtatggaagattagctacaagcttaacgctcggttcatctcctataagcgaattaaaatcaacctttaaagcatcattatgtattaaatcaaaattctcatgttcccctaattcctcttgtaaaataggaattaaatcattatcaagctcaattgacgtaacttttttagccttcattaaaagtttagctgtcaatgttccaacacctggtcctatttctattataaaatctttatcatcaacagatgcaccatcaacgatatcagtaagtactgaatcatctatcaaaaagttttgaccaagactcttagaaaatttaaaattatattttttaactagttcctgagttttataatcctttaaatccatctatttgttacctgcctccatttgtttttctatttcatttatagcatttgtgaattcttctttggttattccataattattcaatctagataccatctgcgccgcatttccataaccaatccctaaaatcttacctaaactttgtcttctttctttcgacgttacatctcctgtaagtttaaaataaaacatatcctgcatattaaaaaattctgttttttctgtcagtgttatttttgcagtttcaagtgcttttaatattacttctggacacgcattttcaactcctatatcaccatttttaagcccatcttctttagtgatataagcatgcttaattcctttaactctttttgagattattcttcttatcttttctcctgcaaaatctggatctgttaatactattacaccttttcttttttgagcttcctttattctagaaataacttttgcatttattccaaatccaccaacagctattatttcagcatctaaagctttttttacagcatcaacatcgtccctaccttcgacaacgataacttctttaatcaaatttatacttcctttcatctgtactactctatataaaattcaatatttaaatacagtgtactacgtattaattacattatacttgttaactcatatatctccaaataaattataatatctcttttataatattccaatattatattaattttatagtaaatgttagtctacttaaaagaattataagttgagcatctttatttttaataaaaaaagagagataacatatgttatctctctaaaaactaccattcacctggatacgcaacaactaatacagtaactggtcttctaccccagctccaacattcactagatgagttaaggaataaatcaattatatttccttttattgccccacctgtatcagctgcaatagcatatccatatccttctacataaaccttacttcctaatggaataaacgaaggatcaactgctattgtactcataccacctggatttcttacaggagatcttcctgttgcagtagttctgtctccactataagctgtcgctacacaattaagtttctctttgtagtttatgctttctccacctctactcgcatagacttgtccagttcctttgattactatttcatttttaggttccgtaatagttttagtacttgtaacatttcttgaagtttctactccatctctatatacgacttcataagtaacttccttttctccattaacaccttcactcttaaccttactaacgcttttatcaagactttcatctttttcaactattgtttcaaagttaatgggttcattttgtacaagttctttcttttcaacattaacaatttgtacacgcatgttatcttcaatttgagaatctaacgatggtgacacttcatcaatgtcttcattaaactttattccatattcttgtaatgcttcttcttcattttttagcatttctccaatagtaccgtctgcactttgtacctctaattgtacaccatttgctgtaatttctactggtatagctgactttattttgattgtttctttttcagatactttggattctagtgacggctgcactttgtctttaacacctactgcaatgtttttatcctgcagcacatcttgaacagtccccttgtaagtgacaaaagtttcttcttttccatcaatacttattgttagtgtttttctcatattcattattgttatagcagctattgctccaactgtaattgttactgcaactgctcctacaatgatttttgccttcggaccgttaaataaagatttggtggtaaatcgctttaatctttctaccattaatttccctcctttggcaagagtgtcttttgaattatatattaatttgacattattgtcaaattaacaatctcttgcattaataatgaagcacttttttaataaaattttaattgtactgaaaatattataataatttataataacgttttttcatgcttcacacttgattaatgatatgaggttaaaaagctaatttaaccttcaaaattgtaataaattaacttaattatatttgtaatttacacataaaatcttatgtgcaaaaacctacaataatataattaagttactatttttgtactgtaattgtaccttcatctttttaacaagtttgtatattcactggcttatattttatctacaataagttttattttgaaaaagtatttatgtcaatataattattttgtgtacaaaccctattttaccttatttttccaatttcatcaaccttaaaaaattctcattaaacttcatattggcctcataagggtcaatttctttgatttgagcaattttattaattatatgttcaatatagtctgatttatttctttttcctctattaggctctggtgccatgtaaggacaatctgtttctacgagaattctatctagtggaatatctctaactacttctacaacctttttggcatttttaaaagtaactacacctgtaaatcctatataatatcctaattttacacactctcttgcaaattctacactacctgaaaaacaatgaactacccctgttacttctggaaactccttcatagcctctaaagtatcttgatgagcatctctatcgtgaataactacaggaagcccaagctccttagctaaattcaattgctttctaaaaacttctttttgaatttctttagatggattctcatcccaataataatcgagtcctatttctcctattgctataattttagaattttcctttatatagctttttatttcttttaatacattatcattcatttcatttgcattttcaggatgtattcccaatgctccataaatataatcatacttttttgttagttcatctgtggctttcaagctttcataagatgaagcacagttaagtattcctattacaccatttgatgtaatctgattaagaacctcttctctatcttcattaaatgattcatcatcataatgtgaatgactatctataattttaaatttattactcataaaatttcttctcctaaaatttttttatttgacactttattgacataatttaagtgtaatatttaatttgtaaagtagttaaagcattattatttaccccttttaaccatttgttttcatatggttaaagaacgtctcattcccctaaatgagacgttcattttttttaatttttcttatcttttagtcgccctaattcttcttccgctatatttttatctattctatcaaataatatattaaaattatttattttaccctcttttatttcaataggcatccacattggattcttaatttctaaaaatcctcttatttttttcgcagcaaaaggtagaaatggttcaatcaaattacttagatttgcaattatttgtatacatgtatacatacactcagcacatttttctcggtctttttttatatttacccaaggtttttcatcatcaaagtatttattagccttttttatagctgaaaaaatatattctaatgcctttttaaaattcccctcttcaatattatctcctacgtcacaataaagtttaaacatatcatccttaaatgctttgtctactgatcctttaggtatatttccatcaaaatttttatctataaatgctaataccctatttataagattcccaaacaatccaactaattcattgttattagcatgtataaaagatttccatgtaaaatctgtatctttaacttcaggaccattactaattaaataatatcttattaaatctacattgtacttttccataagatagtcaggccatatggcccaattctttactgctgaaaagtttttaccttcaagcttcatatattcacttgaaatttctcgtatgttaggtcttttaattcctaaacccgataatattgctggaaatataactgtatggaatggaatattatcttttccatgaacgaagtatattctactatcttctccattccaatattccatgtaatcttcgcctctttcatctaggcatttcatacttgctgtaagatatcccattaccgcttcaatccatacatatattttcttatcttcaaatccttcaaaaggaacatctacaccccaattaaaatctcttgttactgctctatctcttaagccctcatttaaatatctattcgtaattttttgagcgttttctctccatccattttggcgtatatagattctcttaacatcattttcaagttttgataatgcaaaaaataaatgtttagtctcttttataacaggttctgatttgcaaaaaatacacttcttttctaatagctcttcactttcaaatatttcagaacattcatcacattgatctccaactgcatgacttccacaagatgggcactttccctcaatatatctatctagaaggtattcattacattttggacaatatgtctgctcaacttctttttcataaatatatcccttgtcatataattcttttataaattcactaacttttttcgaatgatattctgtatgagtttttgtaaaaatgtcaaaagaaaaccctaacccttcgaaacattctttaattttttcatgatagtgtaaacttgcttcttctgggctcattccctctgctttagctttcattgtaactggtgtaccatgagagtcactacctgatacaaaaacaacatcatcccccataagtctatggtatctagctaacacatctcctggaagtaatacagctattcttcctaagtgtagttctccatttgcatacggccaagcatttcctattattacgttcaaaaaatcacccccacttttttagtttacagttaacagttttgattaatcttcctatgaaacatctatatttttatttaaattcttaatttcaacatagctaatttttataaatatatattatatagaaatcttcgcagaagatttcatccttaactgttaactgttacttgctaactgctaattgaattaaacactgttacttgttaactgctaactatctaacaatgcttccgcttaataaatcacctggatcaactgcttttaatacgctgtcatcatcagttgcagcacataaaatcataccttgtgataattctcctcttaatttaactggctttaagtttgcaactaaaactacatttttacctactaattcttctggtttgtagtgtgctgctattcctgaaaccacttgtctttcttctccacctaaatctacttttaatttaagtaatttcttagctccttttattggttcacaagctaatactttaactactcttaagtctattttttcaaaatcatctattgtaatttcttcttttataggtgttatttctctcttagctggtgctggattcattttagctcttaattcttctaactcagctaatttcttatctacatctattcttgggaataagttatcagctttaataactttagttcctgctttagttccattgaattcttttaatgaatcccatgaaagaacttcagtatttatttgttcatttattttcttagctgtatctggtaagaatgctgaaatcataactgacgcaaatcttaaactttcaattaaattataaagaactgttccaagtcttgcttttttatcctcatccttagctaatatccatggagttgtttcatcaatatacttattcgctcttcctattaattcaaatacatgttctaaagctaatggaaggtttagttcagtaacagcttcttcaactttagctggagtacttaacgctaagtttattaattcatcatcaaattcacctttttcagcttgtgctgggatttctccatcaaaatacttttctatcattgcaactgttctagataataagttacctaaatcattacaaagatctgaatttattttctttataaatatttcattgttaaatagtccatctgctccaaatggaatttctcttaataagtagtatcttacaggatctactccaaattcatttactaaaacaacaggatctacaacattaccttttgatttagacatcttaccaccatcaacaagtaaccatccatgaccaaatacctgttttggaagtggtaaatctaaagccattaacattattggccaataaatagtatggaatcttaagatatccttacctattaaatgtacatctgctggccagaatttatcatataattccttattatcttgaccatatccaagtgcagttatatagtttgataaagcatcaatccatacataaacaacatgtttttcatcaaatgttactggaacaccccagtcaaaactagttcttgatacacataaatcttgaagacctggttttaagaaattatttaacatttcattttttcttgattccggttgaataaaatgaggatgttcttcaatatacttgattagtctatcagcatatttgctcattttaaagaaataagcttcttcttttgatttttctactggtcttccacagtctgggcaatttccatttactaattgagtatcagtccagaaagattcacatggagtacagtaccaaccttcataagaactcttgtaaatatccccttgatcatataattttttaaatatatcttgaacagcttttacatgataatcatctgtagttctaataaatttatcatagctgatattcatcattttccaaagatccttgattcctgcaacaatttcatctacatgttcaataggagtaattcccttttcttctgctattctttgaatcttttgaccatgttcatctgttcctgttaagaacattacatcatatcctgttaatctcttaaatctagctatagcatcagcagctactgtagtataagtattacctatatgtaactttgttgatggatagtagattggtgttgtaatataaaatggttttttacaatcttgacacattcttaattcctccagttaaatcagttaatagtcaacagttaacagtttgcagttaagaggaaattacttcgtaatttaaaaaatataaatttattgtaacttatatattttttcttaacttataactattaaaaggttgctattatattgaaaatttttataaaaaaatctctatataggtatattaaaacctatatagagacgtattatacgtgttaccactctatttcttatttacttcgcaataaataactcactaggtgactatcatcaccctgcagtataacggctgcttccgtattctcctaactaatatcttaataagctcagaaaatatactctaagaccatcttcataaaactcacaaacactgactttcagcaattatcagctctcttatagaatgtttattttactactcttcttttcaatgcatttaaattattatatttgctaatacttattgtagcgaatttttttattataatcaatgactatttaataaattaatattattttcctgtattttaagtttctttacattatttttataaaatttcttcaatcaaattgattaaatatataactttgaggaaagaatatcttatccataaaaaacatttactttattatattgaaaattaaagttttattggatattttatctttttaaataatcattattcttgtgttataattctaataaaattattaggaggtgagaataattaactcttttcaattacctaaattgggattaagaaatataaaaactgctgttgctgtttctttatgcatgatagtttttaatatgataaatagagaaaatcctttttttgcatgtatagctgcagttttctgtatgaaagatactgtttctaatagcatatatatgggtataaatagaatcgtaggaacaataatcggtggattcattggtataatattaatttatttaagtacaaaaattccttttttatatagcatcagtcctatagtaactggcatgggaatttccatatcaatatatatatgcactctcttaaaaaaaggtgaatcagttatagtatcctgtattgttataagtggaataatgataaataattcatcacagttccattcttatacatacgccataagtagaagcatagatactataataggtataattatagctattttagtaaacaaatatcttaatcctagaaaaactgttgaagttggagcataataaaatataatattttcaaatacaaatggctagtaaaataactataaaattatttactagcctttatattataatttattatatacttctattcttcaacattatctacaggcttaccaacaaaataaactactccacatgttactattgctgcaataggaagtacaatccatactgatattcctaaaccagcaggaatatatccacaaattactgtgattgccgcaactgttaatgcatatggcatttgtgtttttacgtggtcaatatgatggcaaccagcacccatagatgacataattgttgtatcagatattggtgaacaatgatctccaaatatcgcacctgttaaaactgcacttgtacttattactacatatccaaagtcaggtgatattgaataagaaagtggaatcgcaagaggcattaatattcccatagttccgtaagcagttcctgttgcaaatgaaataactgcacctaagatgaatattatacttggtagtaagaatttaggtactgaatttgaaagcatttgaactaaaaatgctgctgtaccaagttcttttattacggaacttaatgaccatgcaagtattaatataactcctgttattattaatcctttcattccatcaacccatacatctacagcctctgagaatgtaaatatttttttgccaacgcccattgctatagcaactatagatgcaaataaggctgactggaataatgctactgatgcatctgatgcactaaatgcttctcttattgctgtaaatgacattggtgaatttgtcattatagcttgtaatgctgcatcctcaccacccattattgaagtatatccactataataaaagcttattaacgctgatatcataagtgctccaattggtataattgcattccatatacttaatttcacaccttctttaggcgccatttcatcttcagcagctttatctaaagcaatttccttatttgtttctgagatttgtccttttcttgcttttatttctgcttttctcataggtccgaaatcccttaaaaagtatgatgtagctacaacaaaaatcaatattaatatgttataaaatctgtatggtatagtatttaaaaatactccaaaggcatcagcactttgtcctattgattcgaaaccatcctttattaatccaacttctaaaccaatccatgttgatattatcataattcctgctattggtgctgctgtagcatcaataataaatgataatttttctctagatattttcattttatctgcaactggcttcattattggtccaacaattaatgaatttgcatagtcatcaaaaaatactaaaatacctaataaccatgtaattaattgtgcacttcttggcgttttagctctttttgcaagtgcttccgctattgcttttgccccacccattttgcttactaaacttataactcctccgataaccattacctgaagaactatacctgcattccatggatctgctaatgaatttaatgctctttgaacaaaatctaagaaagagtgaataattgcgtaaattatattatttcctgaaatttgcaataagaaacatcctgatactgtacctaaaaatagtgaaataacaacattctttgttataaatgctaatgctattgcaactaaaggtggtaatattgttaatagaccaaacttagcagcattatcccccgcaacatcatctgatgcaaaagctgcaatagatggcatcataaacactaaaagtgttaataaaaatacataatactttctgaaatttttcatttattaattccccctattaatttttgtgaaaatttcaagatatagagtatgactatactttagattactgttgaaaatttaaaataaaaagttatttaaaagcattatttttcaataacaatctgatatagtcttccatagtaaattcaatcatgtgatcaatttaattattagacaaaaataaaagaccttgagatacacccaaggtcataaaaatagcctaaacaaaaaactaatttaaatccatgaatgatagctcaccacaaaatcacatctttgtgacagtgttatgcatattctgcataaccccagccttataactttaaagcattagttataagcttcggcaatatttcctttcttactacttcacagtgctttcctccgtagtaatactattaaatactgcgcctctacctctttcgtttattcacttttttaattttatattaatatcatactgtagttttactttttttgcaattagtttttgtcgatttttatatctttaaatcaaagttcatcaattatcttttcataaaagcttcaatctcagatacttctttcatcattcctttagttaaaacttcacatccatctgcagtaacaagaacatcatcttctattcttattcctatgctttcttctgatatatatatacctggctcaacagtaaataccataccttcttcaaatacaaaatttcttccttgtggttctacatcatgagtatcaagtccaagattatgtccaatactatgccaataatatttacttacatctttcttttctttgattattccaagtttaatacattcttctgcaattaaatcagtagcccatgcattaagttctttatatacaacacctggctttattttttcaataactgctttatttactctaagaactgcttcataaacttgtttctgtctgtcagtgaattttccccctacaggaaatgttcttgttatatcagcattatagaaattccactgagcacctaaatcaaataatattaaatcatcattttttatctcactattgttttctacataatgaagtgttgttgcattttttcctgctgctgctatggttctaaatgcaaaatccttagctccatttatcttacatataaaatcaaaatacgcttctaactcatattctttcattcctgcttttgcatttttcattaaagattcaacaccatctattgtaatctctattgccctttgcatttctgctatttctgatttagatttaatcattcttaatggtgtaatattgcttgacacatttttaattataacttgaggatatttacctttaaatacttctgcaaacttattaccattagaatcttcttcaaaataattttgtctatctaagtcaagatataaatttatttcttctgcacctttgattaatctgtttagatatccataaaattcattcatataaacagtatcttcaataccagaaatttcttttgcttcaaaatcccttaaagttttaccattccacatttctttcgctaaatctatttcttttagaaataatttttcgcttatttcattattaaattttgataatacaacaatatgattttcttcacttattcctgttagatagtagaaatttctatctggtgtaaattgatatacttcatctcctgtttttttaggtgcatttcctgcaaataatattactattgaattattatctatcttattcattaaagctgatctgtgttcactataaaccattttttccatctaactctctccttaataatataaatttgtataatttatattattatactactattggctttttattaaaaataaatctgcctacatacataagcagataatttaaatatctataaaagaaatacatttaccactaatattgacactattatagccgtaatgtctgcaaaaacggctgcccacaatgtatgtcttatcttctttacttttacagcaccaaagtaaaccgttatagtataaaagattgtttcagttgttcccattattactgatgcaataagtcctgtcctagtatctggtccaaagctctttattatatctgtaaatacacctatcgccccacttccagacaatggttttattataacaagaggaatcaattctttgggtagaccaattaaatttgtaattggagataaaaatcctgttactaaattcattaaatccgctttcttgaaaatttcaacagctattatcatagctagtatacatgggaatattctaatacatacattaagtccttctttagctccttctataaaccattcatatacctgtcttcccttaaacattccataggttaaaataagtaaaaaaattataggtattatacttttagttaaataattaatcatttacttaccctccttagaaatatctctgaagaatcttacaacatatcacaccaacaacagctgctgtagttgtagatataattgcaggtaatattataattcctggattaactgagttacatgctgctcgtatggatattattgttgatggaactaattgaatacatgctgcatttaatactaaaaacagcgacatgtcattagaagcagtacctttgtttttatttaatctgtccatttcttccattgctcttattccaaaaggagtagccgcatttgataatcccatcatattagctgtaatattcataacaattgcccctaaagctttttcatcttttgcagcatctttaaatataagctttaatattggtttcaatatttttgcaagcttatctgtaaaaccactcttttctgcaattttcattactccgcaccaaaaacacattattccagttagttcaataataaatgatacagtatttccacacgaatcaattatagatttcgatatagcttcaccactaccatttagtattcctactatactgcctaaaaaaattaaaataaaccaaatataatttatcattacacttattccagttatcaattgacataaatcagccaatactaaatgtgaaaccctatgtttaacaattatcaactttcaattatcaacataactgtactgtatcctccttaaatattattgttctttaatttatattccttgaacttataatttagtagtgataccatataattattaaacataataaattaactaaggagattaacttatgaaagattccaatttaaaattagctcaaaacgatgtagatgaggctttaaaagctgttgaagaaatggaagcttgtattactatcgacaatgattcttcaaaaaaagaattaaaggaaaaatttgttcaattaacaactaaagttcaaagattagaagacatcttaaaaagtgaaggaataatttaattacataagttattaaaaaaacacagacaaaaatttgtctgtgtttttgtaattatattttaattttctaaagctgcttcattatctagtgcatctttatctggtagtaaagttttagttgcctttaaaaatactataacagtaattatgcaagctataaaatctgaagtagcaccagctaaccatacaccattaagacctttaaacattggcataactattaaacatggtattaacaatataacctgtcttagcaaacttaaaaacatagatatctttacttttcctattgattgaaaataatttgtaactattatctgaccacctattaatggaagcatacataagaatattctcattccattaactccaatgttaattaattctggatcactattaaaaatcaaaataagtttttctgggaataattcaacaattaagaatcctattacaacaataattgttgctgaaataacacaatattttattgtttctttaactctatcatgtttcttagctccataattgtatccaacaataggttgcattccttgatttattccaaaaataggcatcaagaatatcattgataaactattaattattgtcattgctgcaactgctagatctccaccatatgtttgaagtgaattattagccactacctgtactgcgcaattagctatctgcatactaaatggacttactcctatagagaatatacccattacagcttctttgtttaattttaaatattttcttcttatcttaagtacactttttccctttgtaaaataataaacaacccagatagcacttacaaattgagaaattacagtggcaatagctccacctcttacacctaagtttaaaccaaatataaatattgggtctaaaataatatttgtaattgctccaattaacattgaaagcattgccaccttaggacttccatcacttcttattgagtgatttaatccaaatcctactatattaaaaatacaacctgcaaatattatttctatatactgttctgcatatacaataatattatcacttgctccaaatgctcttaataacggatccataaatacaaggccaactactgttagcaatatactgattataattataagtgaaaaagcatttcctaaaaacttttccgctttttctttatgatgttgcccaagacttatcgatattcttgtagcagttcctatacctataagcattccgaatgccattatgattgtcataagtggcatagttataccaacacctgcaattgctaaatttccaacttcaggtatatgtcctataaacattctatcaattatattatataaagtattaactaccataccaataattgctggtatagaaaactccaataaaagcttactaatcttaagctctcctaaacgtttttgctcattcattatatctcttcctccttaagtaaattaatattatttagtttatttaataatattataagctgttttgattcatcatttgtaaggcaactattaagcttttcttcccatgaatgtaatattctatatacttcatcttttattttcaatgatttttctgtaacgtcaatactatatgaacgtttatcatcttccctctttatcctcttaatataaccttggtcatctaacttctttaaatttcgtgctattgttgttttatctaaactaagcattgatgataattcttcttgggttattccctgattttcataaagcctaaccaacaaaaaacactggccagctccaatattaaacttgctaaacttcttagaaaaatacatcatactcattctatgaacttttcctatattttttcctatatattcatattcttcatttctatcattcatatttttctccttacaaaaaacaaaatatacacatacttgactatgttaacactaaatagttgtatatacaactatttatataatatttaactaaaaaataattaaccaaaagaaaagacatgaatttcttacttcatgtctcttcgttaatataatttactatattgtactttctctctctataagctcatgttctaagataaagtgagctttatctaaagcttgttgattaagaagttttataagcattctcattgcaactgatcccatatcatatgttggttgagatatagttgttatctttggatagaatattgatgctgcaaaattgtcattaaatcctataacgcttacatcttttggaacttctattccattatctcttaaagcatttatagctcccattgcaatatcatctgatgcacatacaacagcgctaaatttctttccagtctttattatgtttacaataccttcatatcctgtcttaacttttattgaactaagatatactaaatcagaatctatagttaatcctgcttctttcattgcattttcataacctacatatctgtctccccatgcattcatagtatctttatttgtacctataaatgcaatatcttttatacctttgtcaattaaaaatttcgtactatcgtaacttcccttaacattatcaatagttacacttggtaacaaaccatttttatccttagtttcaactaatactgtttttaaatctaattcatttataagttctaatatttcatcttgaagtgaactactcatgtagattacaccatcaaccattttttcttttaaaactcttaaatattctttttctttatctatatcaagatctgaattacataaaataacattataatcatatatgttagaaacgtcttctgctcctctaacaatttctggatataactgatttgatatatctggtactaaaatacctattgtttttgttctttgagtttttaaacttctcgcaactatgttaggtctatatcctagcttctttatagcatcaagcactttcttctttgtatcttcatttactacgtcaatatcatttaaaactctagaaactgttgcaatagacacccctgcttctcttgcaacatcctttatagaagtagccatccttattcctcctttgaaactttctagtttacttaattatactaatataatctactataaatcaataatctataaataaatagttatctttattctaatttttgtcattttccctaaataatattctcttatattttaatattaaatatttattttatacaaaataaaccgagaatccaaggtttcccttaaatccccagcttattttaattctgttacttgaattatttaacaacttctacagtcatatttaatgtttcaccattaatagttgtttctgtatactcagcttcagctccataaacaacttctacagttaaagtttctttcttgatagtctcttcaaacttctttattacatcagttaacatatcattgcctgcaacataaagtctgatcttatcagcaacttcaaaacctttatcttttctcatgttttgaatcttagaaatcatttctctaacatgaccttcttctctaagttctggagtaattgttgtatctagtacaactcctaaatgtccttcaccagcaaatgcatatccttctaatccttgcattgttactagtagactttcatttgtaagttcaatttcagttccattaacatttataacttcacttccaccattttgaatcttttgagctaattccatttgattcttttcagaaattgcttttctgatttgtggaattaatttaccatatgacttacctaatacaggtaaatttggcttaatttcaaagttaacatatttagaaaggtctgctccaagctcaactttctttatgtttaattcttctttaactatatctccatagtattctggaagaacatttgttgaaataagcatttcagaaagtggctgtctattcttaacattagcagcatttcttgcacttcttccaagcttaacaagtgtataagctaagtccatttctttttctaactctgaatttatagcatcttcatttgctaatggccatttacataaatgaacactttcaggtgcatttttatcaagattaacaactaaattttgataaatttcttctgtcataaatggtacgaaaggagctgctatcttagatatagtagttaacactctatataatgtaacataagcaccaatcttatcatcagttaagtcttgagaccaatatcttgatctgtttcttcttacataccaatttgataattcatctgtaaagtcctcaatagctaatgccgcttgagttatcttgtatccatctaagttttcttcaactgtctttattaatgtgtttaacttagaagttatccatttatccattacgttatcagacacaaaatctgcatacttagttggatcaaatttatctatatcagcatataacacatagaatgaataaacattccataatgttcctaagaactttctttgagtctctgcaacatcttcagttgagaatcttgttggaagccatggtgcacttgcagtatagaaatgccatcttgtagcatctgctccttgactgcctaatacttcaaatggatcaacaacatttcccttagactttgacatcttaagtccttttttatctaaaacgtgacctaatactatacagttttcaaatggatttgtatcaaataaacatgttgatatagccattaatgtatagaaccatcctcttgtttggtcaacagcttctgatataaattgagctgggaagttcttttcaaacttttccttattttcaaatggatagtgccattgtgcaaaaggcattgatcctgaatcaaaccagcagtcaataacttcgttagttcttgtcatttccttaccacaatcaggacaagttaatttaattccatcaacatatggtttgtgtaactcaattcccttacagtctgttgtagcttttgcttctaattcttctctgcttccaatacattctctatggccacattcacattgccatattggaagtggtgttccccaatatctatctcttgaaataccccagtcaataacattttcaaggaacttaccgaatcttcctgttcttatgttatcaggataccaatttactttattattattttcaagtaatttgtctctcatttcagtcattctaacaaaccaactatcctttggataataaagaagtggtgtgtcacatctccaacagtgtggatatgaatgcatgtgtctgtgtttatcaaataacttattattctcttctaaataattacaaatactttcatcacattttttaacgaacttacctgcccatggagttacttctggaacaaagttaccacttgcatctactaagtttacaaatgtgattccatttttcttagcaactaagctatcatcttcaccataagctggcgctatatgtactataccagtaccatctgttaatgtaacatagtctccgtgaattacttcaaaagccttaccttcaacttttgcaaaaggtaataattgttcgtatttaacacctaataattcttcacccttgaattcttttatgatttcatattctctttcacctaaaactttttctactaagtcttttgctaagatatatgtttcatcttcaaccttaacttcacagtaagtatatgctttgtttatacataatgctaagttagatggtaatgtccaaggagttgttgtccatgctaatatatatttattttcttctcctacaactttaaatttagctgtagcagttaaatctttaacatctttatatccttgagctacttcatgagatgaaagagcagttccacatcttgggcagtaaggcattaccttatgacctttatataataatcctttatcccataatttctttaaagcccaccattcagattcaatatagttattgtgatatgttacatatggatcatccatatcaacccaatatccaatttgttcagacattttttcccaaagacttacatatgagaatacactatccttacattctgtaataaatttttctactccgtaatcttctatttgttctttacctgaaatgccaagtttcttttctatttcaagctcaactggaagaccatgagtatcccatccagcctttcttaaaacttgatatccttgcattactttatatcttggaattatgtctttcataactcttgttaagatatgtcccacgtgtggcttaccattagctgttggtggtccatcaaagaaagtaaaatgttctccgtccttattagaatcaaaacttttttgaataacatctttttctttccaaagcttcgcaatatctttttccatatttacattgccttttgaggcatctactttattgtacattgaattttcccctttcattttatgtaatgtatatatgcttatcatgctaaaaaacaataattaactctcattgaacatttaatcattattatatgcccttaaaagtattttaaacgtaaaaaaactccatcctacaggacgaagtaaaattcgcaaaccacctaaggtgaacattcaatctaaaactaaatgcttaatttcaagtacatacatactctatcctttaacgcaggctcttacgtgataacttaataaacataaataatatatgcctttcagcctcaaactcctaggtgattttctctaagatttattatagctttgcaccaaacagctactctctaaaaataagttctaagatacttttcctaatcatagtcttttattgtaattattatatagtaaggatttttaaatgtcaattaatgattttacatttttcgtaaatttttcttttcattatggtaataattttatcctctaaagtaatgttataatttaagtatatttatcccttttttaataaaatttattaagcaggagtgattttttgatttgcaaatattgtgaaaatgaaatttccaaaaataccaatatatgtcctcattgcggaatgattaatagtgaatattttaaactctcatttggttctaaacttatagctcttgtttttcctattgttggggtttgcatgttttttataatgaattctaaaaacaaagctaattcacgtaaaatactttcatggactatatatggatttatatcttggattttcctatatataacaactttttttatgggaattattttagcttttcaaatttaaaataaaaaatatcgtaatccctataaacttaaggcattacgatattttttgtagaatttattgtgtaattatcacattaatattatctcacaaaaatcctattttattcatctaaatttttcttcttttaaatttatttacacaaaacactgaaattacaacaataaaaaataatcctccagtaaataaatactctttcatctttgaagcactctgttccatacctggatgtccttgattttgattatttatattatgctgattagtattttctttcttatcaacattattatccttttcctcattaactgcataattattcatttctaagttgttattttgtatatcattattctctgataccttttcagaccttttttctccatgaccttttccaccgccaatcttagatgataatgctgatgtatttattgttgattcaatatttccataagttgttgaagactgttcaccatttaactgagctaaaatactctttgttctatcttctccaaatgtaatcatttctggtatcgatgcttcatattgctcatatgtgcaaaacgctgttggatcttcctttacataatctttaataagactatcaagattatctacaagttcagcataatatccattgttgaaatattcatcagctatttcttttaggtaactgtgatataattctctatactcatcaacctctaacaacttacctatcaatggcatattttctaatgttcctgatacaggattgtcgataggaaaatttattatagttgatgttcctgatcctgaattacctccgtttgctcccattcctgagaatcctccaaatgaaagatttaaatcccaaggaagtatctgacacacaccattattctcataaagatagtagttatgatacatcgctccagaataactatcaagattaactagatatgtatttactgcaaaatatttaagaacttccttaacatctaatacctcttctaaatttgttccatcatttaagtttttgtacatatttataactttttcaaaatctttatcagtggttcttttgaatacagcactatctctaactattgaataactacttacttcatcatctatatatacaaaatcagctccctcaacatttttattcgaatttggtcctcccatttgtcccttatttgcatttccttgatttgcacctgcattattatttttttcttgattcatatcatttcctgctggtgccatattattatcttgtccaccagtagactctccatccattggaggctgattttccatgttctgttctccgcttttcacatctggtggattctgcattccattatttctattaccaccattcatatcgggcggatttccattacccattgctggtggatttccaccaccacctttagcgttgtttcctccacccattcccatagtttcaggtttataaagatttccttctgtagttccaaaattattttcaagatatcgctcatctatcacttcaatggcaaggtaaaatccccaattttcattgtttactttaatattgctataggacatttctggaactgctatacccataaaatcatataaatcataggatatatactctttcatatatgtgttatcttcaatcatattattaagaactatgctttccattccattgtatgtttgaccatcaacatatttatcaaattttattttaaaactatatctatcagtctcttcagatgatacaacactagaaagacttgagttaccttttggtcttattcctacattataataagtctctccatttatagttacattacagcttttgtattcttcattagaagcattatccataagccactgccagtctgattcatcaatatctatatttatatcagttattctttccttgtctaaaactgttgctaacgtttttgttttatcacttttagaattaattttccctgaaaaactgcttattgtaaatactaaaattatggataaaacaatagtaattatggatatataccattggtatttttcttttatcacgcttttcaccttctttgataaatctataataaaaacccaaccggcatacagctagctaggttttttatagtcttgtggagtaagttagattcgccaaatattcttcttataaggaagttaaccagctaacgctagttaactaagttcgaacaaccaaatgtaaaatttgggttctcacttatcacttatcacttaagacatataatctccattgtaacttactaatacaacatttgaaactccatctaccttcgatatttcatttacaaatcctgtagtatttttctttaatccaatttcaactgtcatttctatgccatttactggtgatacagtttttgacttaacattatacttttgtacactttttgataataattttaatgcatcattttctgaataatcattttcacaatttataactaaaatatatggattatttgttgtttttctatttacaaataacaccatcactaatcctataaatacagaactaataactgctaaaggaataagtccagcaccaattactatacctacactaattgtccaaaataaatacgctatgtcaatgggctctttaatcgcacttctaaaacgtactatagaaagagcaccaaccataccaagtgataatactacattagatgttaccgctaatataattaatgttgtaattaaacaaagtgctataagtgatattgcaaaactttctgaatacattactcccttaaatgtctttttgtaaacctgcattatgaataaacctattacaaaagctaaagctaacgctataaatacatctaaaatttgtactgaagccattttctctacgaaacttgacttgaaaatgtcactaaaatttactgttgtagaattcattttttgttcctcctgattttcattatctcaattttatttttttataattaatctttaatttattatcaattaaactaatctactaccattaatattgtttcttatccataaattcttgccgcttcatattttgatactgaagtagctcttcgttcatttacttgaacaatatcatgtattacctgtggcataaattcatcaaatttaacctctaatacaataaatttatgattaacagtttctattgttggtagattatcatcaaacatatttatgcaatttaatcctgttcttattgatttatcaaaagttatacgcacatttcctataggatatatgtatgcttctcttgtataatctacaattgtctttggttttagtagatttcccttcatttgagcatataaatctataaaaagtttttttccagactcttttaaaaactcaatatcaccattaataatttttaaacactcttctttagtaattcgctcactatctttaagacataaacctcgtatctttgattttttttctaatcttataaattcatgattgtcattataaaatctaatacgaaatttatctctttcaggaattccaataaccttttccattaatgctttatcataaacattatcaaaatataaacttcttatcctatattcattgtttgagtttgcgtttctgtctatatgcattattgttcttattctactttttatagctagataatctgagtaatttatataatgttttaactcatgtctaaactttgtatcttctgccatatctacacctccgttcctcactatacatagtataatcaagcaaccttaacgttagcttaacattaaacttaaatttaacaggcgttggaatatcagtgtttacactgttataccaacgccttcttttaaatataaatattattttgtaacctttggaatgtctaatataaattcagatccaactccatattctgaattaacttttatctttatatcaaagctctttgaaattgattttaatagacttaatccaattccagtacctccaatattctgtccccttacaaattcgcttctataaaatctatcgaatattctagatttatcttcttccgtaattcctattccattatccttgacacttattctaatgtatttttttattatctcaatttttaatataatttctccattttcatcagtatatttaaatgcattttcaagtaatatagttaatactcttttaattttagtataatcccactgtacctttgtactttcttctggccttataatgctaaattttttttcctttatttctgctaaatcagtatagaattcacttatttcatcaataaaatcatttaaatcaaattctccaatattatctcctaaacttaaatcttcttttgataataagagtaaatcactattcagcttttcaagacctcttatttcactcattatctttgatatatgctcaaaatgatcatctattctatctcctgaagcatttgctaaaagttcaagctttccttttattacagcaaggggagttctcatttcatgtgatgcatcttgaacaaaatatacttgcttatcataagcttctcttactggctttataacccttgatgctagatatgcagacatagctaaagcaattactactaaaattattaatccaaataaaatagatgttgccaatctatacatagatcctatctctgcatcaatgttggaaaaaatttgaaactctttattttcttgcttaacacttatccctctaaatttatatccattaatttctaatgaaactatcttatcctctgaatttttagggaatttaggaagattattttctgaaaaatataaattattactcatagcttgaaattcattatctttatataatataacaattaagttaggaggaactctcatggccttatcttctggtttccccttaaaattttcaggaatatgtgtattcttttgcgtactatatccatctccaccattaaatacatctccacttaatagctttttctgttccattaactgaatatcaacatttcttaataccctggagtaataaaaaatctgtgttattgctgaaaatactatcaaacataagaaaacaattgtaatactaatagctgtaatatttcttcttgttctagaaaacagatccttcttcatatttttaatcatctgcactttcatctaatatatatcccatacctcttttagttacaagatatttaccatatccaaaagaatttaactgttttctaagtctgcttatataaacttctattatttctgttgccgcatcgctattatatccacaaatgttatcaaatatctgttctttaaagagtagcacccctttatttaatactaaatattctaaaagcttatataacttttcatttaattcaatttcattatcttcaataaatatctttttagtcttcatgtctattttcaaatctttaaattctagtatgttagctgtttttaccttacccatactttttaatattgcatttatacgtgcttttaattcttccataaaaaatggttttgttaaataatcatttgcacctaaattaaatgctttcaatttatctccaagttcttctttggcagttaatattattacccctgtatttaggcatttatctgatatatattttaatacagtcataccacctacctctggaagcatcaaatctaaaatgacaacatcataattatatatttgtaaattatcaagagcatcagcaccattgtaaactgcagttatttcaaattcttttttaaaatattcttctatattcttacttatttctatattatcttctactactaatattttaaccattaacttcacctctattttaatagtattatacacaagtcagtttttcaaatccagttatataatggagttatttcttatattattcctttttttacaccaaaatttggatacccttaaataatattcattaaaataccattgaccatatttttatataatgttttaattatctaaaatacatttttaggagagaaatatggataataatttaaacgaagttgttttagataaattaacaaaaacttgccgctgtagagctattagcagagcaaaaataaaagaagctataaaaaacggtgcttcaacttttgaagaagtaaaagaaattactggtgctggtaaaggctcttgtaaaggtgcaaattgttcttatataattaatgaacttataaaaaagcataaagaagaaaatgaaatttaatatttaaatgtagatattattttgaacctatcagctatatagtaagtggtttaaaatagtatctacttttttatttgccaattattaaataaaattccaatataattgtttactgctatgtttaattatagtaaactgtttggtgttattttatttttatataagggggaagcaatcaaatgattaaacaacgaaatttttggatgtttttattattaagcattataacatttggaatttatagcttattcttctggtatcaatttactgaagatcttaatataatgtgcaaagatgataataaaccacttccaaacttttttatagtaataatactttcaattattacttgcggtatttatacattcttttggtattataatttaggagataaaatgcaaagagctggtaattcacgtggtatcttaatacctgaaagtggctcttcaatattattatggatgttatttggttcatttttatgcggaataggacaattcataggattatatcttataattaagaattttaacttacttgccgaaaattattaatcagatacactattaaataaaacaataagttgtttaaataataaataaatcacatttatttattaagtttaaacaacttacttcataggtgaaaatttaaaatgaaaaatttaaaagattttataaaaaaatatgatgtcatcttcattttacttatatttttaatacttactaaatttacttgtctaataaaattaatcactggatttccatgtccagcatgtggtatgactagagcttactggtctttattacattttagatttctggatgcatggaattataatcccctcttttggtttattccccctgttgtactttttataatagtaggaaaaaaacccttattcaacaatcacaaaaaagaaaccttatttttaatttttatcttcttaataatattctcagtttacttatatcgaatggttacgttatttccaaatattcctccaatggattataataaaaattcattattgtatactatattttcaaaaatatatagttcaataaatttaaaataggaacaaaaaaataatagttcctattttaaatcttacatatttactattttaccatccttatattcaggaacattattaactatactcttcttcatacagtattctatatcattatctagttctaatgatttcataactgaatagtgagtcgcttctttaacataacttataatatcgctattgttttcataaatcatattagctgttttagatatatctgtaagttctatattattatctacttttagcatctcatttattatgtatcctgaacaaatataatcatccatagaaaaatttccatttgttcctgcatttattatcacaacatcttcatttatttctaataatttatctgctactgcttttgcattaatcattgctgcaataataattctttttgcactattagattttgttaatgttcttgttccattagttgttgtaattaacaccttcttatcttcaacaacttcttttgtgtattccaatggtgaattagataaatcaaatccatcaatttttacagctcttctttctccacctaacatatattcttccctgtttaattcttctgaactttctaatgtttcttctatagttaaaaatggaataacttcttcacatccattgtttaatgcagttactattactgaagtagctctaaacatatctattactacggctattttattttctaatttgctctcaattatatcatctgctgatattattatatctatcttcattactataaactcctattctattaaatatactttcataatctaaacttatatttccctatagttttttccttgccatagatcattatcttcaaaagccttatctatagcatttaaaacttcccattttttcaaactccacataggtcctataagttcatttcttggtgcatcccctgttaatctatgaactaccatttcttttgggagcatagagacacttctagtaattatatctatataatcttcttgagataaaaactttaactcgcctttttcataatcctctaccaattttgtatttttcattaaatgaagaagatgtatctttattcccattgcaccactatgtgctatatgttctactgtgttaaacatatcttctttcgtctctcctggaagaccaaaaatagcatgaactacagtatctatatttcttgattttaaatttttcatagcttcatcaaaaacctctagagtatatcctctgtttatttttctagctgtaccatcattagatgtctgtaaaccaagctctacccatacatatatttttttatttatttcctctaataagtctagaacatcttctcctaaacaatctggtctagtagctattgcaagacctacaactccatctttgtttatagcctcttcatattttctttttaattcttcaactggtgcatatgtatttgtataagcttgaaaatacgctatatattttccacttttccacttatgtgccatcatttctttcacatcatcaaattgatttgagatggacataatcctgtctccagcaaaatctccagatcctcttgcactgcaaaacgtacatcctccacgtccagcttttccatctctattaggacatgaaaatcctccatccaatgatatcttaaaaactttttcaccaaatttatttcttaaaaaatagttaagactattatatctttttccattccataaattattcatattgcctcctatctcaattccttgagattaaataattaactattttaatagtttattatattgtatcacatccatattaaatttatatattgcaagatattgcatatatacatgattaaatcttactaatttacttttatgatactattgtaattttattttactatataatatgtttttactactattctaaattatttatagaataattcaaaagtaaactatatatattattaacaggaataattttgggggagaatttaattgaaagaaaatttaaaactaatttttcaagttgccacagtatttataggaacgattgtaggtgctggacttgcttcaggaaaggaaataactcaattttttactcagtatggaataaaaagttttattggaattatgggatgcggtattttttatataataatgggttcaattatttctaaaataagcattcaccataaattagattcatatagtgatgttattaatttaataagtcctaacttagtaggtaaacttacaggatttatcactactttatttctaatttcaagtgcatccataattcttgctggaagtggagctcttatagaacaattctttggtataccaagaattattggctccttaataatgatttgtatatcattattctttctacttaaaggtaccgatggattaattgaagtaaattcttttattgttccaggacttgtaactacaataacactcataacaatactttatttctgtttttctaaagatacggtttcaatgaataacattttaagttttgagcctaaaagaagcggtatatttctttctactctgctttatgctggttataacacattatcagcatcaggagtcattgtacctcttagtaatcaaataaaaaagccaaaaataatgttccttggcatactaattggtgcagttggtcttactcttttatgttcaatgataaatcttttattaactgtgaatcaaccttatatatataaatatgaaattcctttactttttgttgcaaatcgttttggaaatataattcaagcagttttactaatgataatatggctagaaatgttttcaactgaagtctctgatatctattctatatgtaaaacactggagcaaagtttcaatattaaatttaaaaaatcaatttttatagtaattacaattgctcttgtaatatctcaatttggattcggaaacttaataacaaagctttaccctctatttggattgttaagcttattatttatttctcaatgtatattttattattggaaaaataaaaaaatcctatctaagtaaacgaattttaaattattatgatatacttttattgaaaatctatataaacattacaataaatagaaaaagtaatgtttaggttttttaataagttatttaaggattgagatataatatgaactctttagatatgttaaatgaatgtacactttgtattagaaattgcaaagttaatagaaataatcacatgactggtttttgtaaggcttctgataaggttatgattgcgaaagctttccttcatccttgggaagagcctccaatttcaatgggaaaaggttcagggactgttttcttttctcattgtaattttgaatgtgtgttctgccaaaattataatataagtcagaacaatggcaaaagcaaaaataattgcgattcatcagtaataggaaaattagtttctattgaaaggctatccgaaatatttttagagcttcaatcacaaggtgctaataacataaatttagttacgccaacacattatgttccacaaataattaaagctattgatattgcaaaaagtaatggtctttcactaccaatactttataataccaacagctatgattcattagaaacaatacaatctctaaagggatatatagatgtataccttcctgattttaaatattttaacgataaatatgctattaaatattctagtgctaaaaattatgctgaaaatgcagttaaagtaattgatgaaatgataaaacaaacaggaattcctacctttgatgatactgggcgtattataaaaggtgtgattgtaaggcatttaatgcttcctggtttattatttgactctaaaaaaattattgatcttctatataacagatatggcgataatatttttataagtataatgaatcagtatgtaccaatgttcgatgcctgtaaatatcctgaaataaataagaagcttaatcctaaacattatgatagtttagttaattacgctgctgaacttggagttaagaatggctttattcaagaagaaggtgctaatacggatgtatatacacctaattttaatttagaaggagtttaataattattaaactccttcttatagcgttcatgctaaccttcattctaattatcataatcacataaaatacatatctatttattaataataaaatttaggtatttctctttcgtcacctatattaggcattactggtggaacaaataaagttttatcacaactacttctaagttctgcaatcttacttacaccaacatacacatctgatatcttataccatgtagcataatcaacaacaccagtctgtggaagactaaatacgccttgaaatacctttaccgactcagcaaccttatctgtatattgaccatcttgtggaagcttaggtattaaaggatagttctgagctattctatttaattgttcctgtatagttctcacaggctctcctgatgatcctacagttaaatcatatcctggatatgattctgggattccttcaatcttatcagctgtaacaagctctatatcatatccataataatgctgtaatatttcatatggaagtttaccttgatcacctaaatacttgcttccccattgacttaaccattctggacatttaacactttttccatcacaatattgtgttaaaagtggttgctttttaccaactcttcgtacataagtagaaaatatctcatctacaattacacttatactatcataaatgtttcttccataattaaatgcatgatcataagctgttgaacttgtaatttgaaaattcttaccttttgatctataccactctgtataaatcctattaagtgtaaatgatactatgcaaaatatattagctcttattgttgtttcaggccatgttgaatatatttcacatgatgcaacatttttaatatagtccttaaatggaaccttataattaggagccgaagaatcatttggacttccttgatgtactataataaattcaggaactacaggttttgctaacactacaccagatgttggtggtggtagtggcttatcaacttcttccggtattttgggtggataatccccatttaatgtattaggtaatatatttataatttcttgcctcatacttctagttttggattgttcctttaaattacatacctgatatgcaacttcttctggaaatacttgacatcccctgattgcaattggatcaaaaccttctctttcaactataatatcatataaactatatggtgttttattactattttcatctaatgaatattctattggtggtgcatctacttctatttcttgcgttaatcctgctgaatctgtatctaaatttatttcatttgttgtagcaaaatctcctttgcccttaattttaattttacatctatcaacaggaacgtaatcatttcctataaaacattgaacctttaatttaccaatatcagccatacaattctcctaaaaatttttcctcaaatattatatgaatataatctttaattggttacagcaatactatctaggaatcctgaaaaataaattgttttttgtaaattcatcgtataatttattaattaccctttttctaattattgaaaattcaatatatttaggatttccatctttatctatactgtctcttatttcttttaattgtttttgacttctaaaactgtcgaaaatatttttcatatctagcattccatatccccagtcaatattgggatatatatcaccttgtctcatcttagctcctctaacaacataacttatgagttttcttgctctgacctctggatcattgccattaataattgcccattgaagaattaatgcacagcatcctgcaagtacagatgtagctacagatgaccctgttgctactgttgttcctcctccaggttttggaacaattgcatttactccacctgctgctatatcaggttttatcctaccatctctcgtatatcctcttccagatttagatacagttgaatttaaatcctgattataataagctgtagctaaaactcctcttcctgttgcaggcacagttaaagtagttctttccgttggatcaaaaaaacgcgtatcactatctaaaagttcccgttgaggaagccaagcccaatatctcccatcaactattttctcgccatacaaccttatttgccatattccctctcttatgtccttaaatttaattataattgtttcatctgcgttatactcatctggatataaatagactattgttacacttgtgccttcatatataaatttataatcttctatttttctaaattttatatccagtttatctaaaatttctcctgatggtgatactattccaacttctactttatctggcttctgacaataaatttgaaaatttaaatctttttgattttttcctatttttattcttattgttttcattttttcatcttgctcaaattttccttcgatatgagtttgagtatcaccttgatttccagttccaacaactgcaactataccatttcttctaccttgaacttctaaaacaccttccatatcatcagttccatcatgagcaccagtattagttccaaaaggaaaataaatcaccattggtttttttaacttagatgatattattcttaggtaccttattgctagtattaactcaatattcccatatgctatcttatctgttgaaacccctccatatttcaatacaaaatctcctactggcttaattttcacaacaacaaaattacagttgggtgcagctccaagtaaatctggattaattcctcttccgccaataactcctgcactcattgtcccatgtcctatttcatcttttgaaggtactatgctgtatggatctccaccttccttggatatttttattgcttcattaatttgactctccgtatattctgttcctaattttaaattttcaacaggtttatctccttctatagtttgatcccatattcttaatattcttgtggtatcatcttctctcataaattctttatttaaataatcaataccactatctagtattcctactattacatctgtaccatctaataataaatatggattattgctaaataatgatacaccacttgcttcaactggagataatgatgataatgtataaagatttacattatatatgtttggaatttctttaacataaggaataagcttagaagcttctttaataggaattctaacaactgcatatgactctgatatagatattgctgatgtattaggcaacttatttatttcaaccaagtcttcttctgtataatattgtacaattaatccaataatctcatccggatcaatattttcatttttcacagcgttatttaatacatttattgccgctgaaacatttttagcaacatcatttgtttccatgtaattattactactactttctataccaagttcattatccctatttaaatttctagacattagtatatttaaatcattttcaagaataaaaaaactctcatttgcacaaattgttccatatccccatgatggattaggataacttatatccgacctactcctctgtgctccttttaccagataatattttaatctctggccaaataaataaggatcatttccttttattatgccccattcattaaaaagtgcacaaattccagcaactattggagttgccatagaagttcctgtcttagtatcatacccaccaccaggtaatggacctataacattctctccaggtgctacaatatctggtctaataagttgagtacatgatacttgttctcctcttccactatacgaagataatgtatttgttcttccattataacttccaactgcaattatattcctaacagtagccggtattcctaaagtattaaactgatttgaatccaaaaatttagtttccgagttaagcccttctgatattggaagccaaatagaatacgatcctttatagtcatttataacatcaagttctatactccatgttcctggtattaaataatccgatgatattgatgttattattatttgaatttcactttctagtccaaatggcttaggtcctgaaacatatatatcaaatctatctctaccaatatttccattaaaatatccttgagatatcttaatataaccactttgttgtcctgttggccctattatattaattgttatatcaggaagtattgatttgtatatatttataactatcatcgattcatcacttgctacagtaaatgatctactttgaatcttttgaaattcaccgccagcatgatgtcctgcatctccctcatttcctgctgcaataacaattgtaactcgttctaagttagctatagcacttatatattgttcaagtaaactcgttccattatgtgctccatcattggtacttaagcttatattaacaactataggcatatctaattccttgcttttatctagcaaaaatttaagtccaaccattatttgagaacttaatacccattttcctctactacccttgaccattattatagatgactctggtgctacacctctatatcttgcaggtattttaccacctccacatgcttctccagcaacatgagtaccgtgtccagttaaatcctgttgtggcactatgctatatggattttcagatttaattgctctgtcaatttcatttttatcataagtcttgttcccatcactcaaatcataaatatactcaattcttgtatttcctttttcatccataaatgcaggatgcatataatcaattcctgagtctataaaacctactatgacaccctttccagaaatattataacttgaatatgtttgtaaaacgcatgcttctctattgctttccaagtcagattcaatcagaccttttggtagttccatatactgtatttccgaactagttgccaaatccttcaattttattatcggtaaatatactaacgcaaaattaaaattcaaatcataaaactctcctcctaagctttcaactaaatctttcgcactctgtgatgtatatctatatagaatagttaattcaattttctcttctccataagtttgaatatttagctttccatatattctatttagtattgaccttggtacattggctaaaagtcctatagatgcatctgtttttgacgtagcattatgttctaaattggccatattatctcacatcctagaattatatctatatatatttatactaaaaaaaagagatattaatgtataaaaaaagagataactttaagttatctcttttaccattcaccaggatatgcaataatctttacttgtacctgttttctaccccaactactacattcaccttctgaattaaaatacaaatctactttattaccttttatagctccaccagtatctgctgcaatagcatatccatatccatctacatatacctttgatcctattggtattactgttggatctactgctatagtacttattccactagcatctcttgaagttctttttcctgatgatgttacaccaccaccactatatgcagttgctgaacaagttatagatttttttcctgatccatcacctctactagctgtaagtatagttccagttccttgaactacaacttgagtagtaggctctgaaatagtctttgtgcttgttacttgacgattagcttctacaccatctttatacacaacttcatatgtcacttctttttgaccattatttccttgagtcttaacctctgtatttccggccattagtttactatctttttcaactactgtttcatatgctatcgtttccatttcttttttctcttgtttttcaacattaacaacttgtattgttaaatctccttcaacctttgaatcaagctttggtgatacttcatccagtccttcactaaagtttattccattatcttttagtaaatctgattctgattctaaaacatcttttactgtttcttgtgatgtattaacctgtacctctgaattaccacaaacaattttaataggtacagctttttttagtgttattatgctatcttcttgaactttttcatttaatgctggttttatgctatctttttcttctacttttattccttgttcatttaacacatcttgaacggtccctttatacgtgacaaatgtctgctctttaccgtctacatttatagtaagtgtctttcttgttaatgctactgtcactgaagtaatgcttaataatgcaactgcagttattaaagcaattacttttgtcttcggaccattagaaaatcttttaagaataagttcttttaaattaactatgactttcccctcccctgacaacagtttcttattgaaattgtaccttatatatactattaatgtcaaattttcaaatttaattaaaattaaagccaaaaatcaatatgaaacatatcgttttttggctttaaaaataattattatgttatataacattacaatgttatttctactctctctaacttagcaattacatttatatctcttacttccattgtttctgtaagaagactaccactattgctaactaaaagtacttttgaatttcctaaaatcttaacttgtcttatctttcttttaccgttatattcaattaagaaaaatccattattactcaattccttaactatatgagcaaatgcaagatcaccctttaacattctaaatcctatcatttcatcatcttcaatctgaatataaaagactttatcttgaggatatccttctatcttattagagtgtactggcatttctttatttccattattctttgttaatgaataattatatattggaacatttctaagtacagacgagaatgcatctgtccaaacttcgttgctatcattttttcttttagggagttctttaaacatcttcttttcttccataagatcattatcagtaacaaccatgcttatatcatttaaatctgcttttaatacttttgcagccttatctataaatgattctggtgcaacttttcttcccatttcaacttcatttaaatatttctcagcaactccaagtttttttgctaatgccttaacagttaatccacttttctctcttgctttttttatattttctcctacacgactcatgctaactttgccccccttgttgtgctttatatgcttctctctcttctattagatgttctattaaataatcaaaagtccatttacttgattgctctgtaacaacggctaatactccgccttctatgaatcttcgtataaatttaatagtttctctaagttctttttcgttatatccattaaaaataagtgccttttcattttcaggcaatttattacaaggagcctccatatcattactacaaagtaaatctataattcttaatcctgcatttttgtcatcaactacttttacctttagtcttcttttttgtatcttatcaagttcttcatcacttaaaccatatgctagtatacacttataatttatagccattttaagcacctctcttcatttggccttattaaaaattatgtatattaaaatgttttttaacatcttaatatacattaattcttttatatttacttatgtattacaatttccaagtattattcttctattatttctggttctttaaaactttcaccctgcatatcaacagtcatagttttaatcacttgatcttcataaggtctgtcatatacatctctttttgatttaacaattttatcagcttcatccatgccttcaattacttttccaaatgatgcatattgaccatctaagtgtggtgcatctgctaccattataaagaattggcttcctgctgaatctggatgcatagctctagccattgataatactccttttgaatgttttaagtcattcttaaatccattagaagtaaattcaccttttatagaatatcctggtccgcctgtacctgtaccttctggacatccaccttggatcataaatcctggtataactctatggaatattaatccatcataaaaacctctattaactaaatcaacaaaattatttactgtgttaggcgcaacttctggatataattctgccttaataacgcctccattttccatagttattgtaacaattggattcttcattttaaatttctcccttcaactatcactcttaaatattagtattgtctaaaattctgctgaacattcagaattaaaatatattaatctaaaatttattctatacattataaaaatcaatttcaataaatatgattaattattctaatttaatcagaatcctacacattaattagattataacagaaatctataactttcatatcatttgtagaattataaatttcaacattacctatgttttttgaattagaaatagtccctttctcttcaagctttctctgaagctcatgagatgttccagctcccccatcaattaaaggaatttcactaccaacaacctttgctaaagtttccttgataaacggatagtgtgtacatcctaaaactattgctgctatatcatcaaaataaatatcaaatttattttttaagtacttttctaattcatcaccttcaagtattccattttctataaattcaacaagtcctgcacaaggcataggaactatatttgatccttcctgatatttaaccattaattgcttaaattttttctctcttaaagtcataggtgtagccattattattatttttccatttcgctttaatttaacagctggttttaacgcaggctcaatacctataatcggaatatcattatgtttatttctaatctcctcaattgctgcactagttgcagtattgcaagctacaacaatcgcttttacattcttttcacgtaaaaaatctactgcattaaatgtaagatgctttacttcatcaagttcttttgttccataaggagcattttttgaatctccaaaatatatataattctcatttggcattattgaaattgcttctttcagtacactcaatccgcctactcctgaatcgaaaaatcctataggactatttttaatatccaaagtgtcctcactccatcttcttttagattatctataaatattttattactttattaccaataaatctataatagtttttacttaagttataacttcatattttctcattttcaaatttcattcataaaattaatttatattatattaagaaaataaagtatcaaattactttcactaatgaaaataatttttcacaactaaaattcataagaatataaggtttcgtatataattattgacattattactgattttataatagaatttgtttatagataaatacgaatgttaattctacttttttaatttttattcgacattataggaaaggatgtgaatgttttattacagtattgtctgtaataaacgaacatatgaataatttactgtatattattgccaaagaaaatcataatgctgaggacttaaaaaaaatactaaacaatcatcctgaaataaaatttgtttcttttgtaggtattgatttatcaggtaatgatactgatgaaaaaattcctgtaaaattatttttagaggatatggaatcattcttaaagggtgttgctgttcaaacagatggttcttctgtagttttacctggtattgcaactttagataatgcaaaagttgatatggtaactgatttaaactgcaaatggtttgttgattataactatgattttatagatactgaaactgacaagcctgttggaacattaagaatcccttgtttcctatatcatgataaccttgctgttgattcaagacatatacttacttcagcagtttctacttttaaagatactcttatgaatattttcaaatctcatcctgaaaccttaaaatcatttgatataactgcaaatgatattgacgaagtagtaataacatctgcaacggaattagaattttgggtaaagactcctaacaatatagcccatgttgatgaattatctacatctcaagttttacacgaacattattggacaagaactaaaggttctgtaagaactgctttagaagaaacacttatactaatggaaaaatacggattcgaacctgaaatgggtcataaagaagttggtggtgtaaaagctaaattaaatagttcaggagaatttgatcatgtaatggaacagttagaagttgattggaagttctctgatgctgttcaagctgctgataatgaattatttgtaagaattcttgttcaagaaacattcagaagaaatggactagatgttacttttatggctaaaccaattgaaaatgttgctggttctggtatgcatactcatttaggtgtaagcttaaaattaaagaacggaaaaagattaaatatatttaatggtccacaaggacacttcctaagccaaataggatatggtgctattatgggacttcttaaaaactatgaagttataaatccatttgtatcttcaacaaacaattccttaaaaagattaaaacctggttttgaggctccaatatgtactgtaacatcacttggattatctccagaaaatccttctagaaatagaacagtacttgctggattaataagagatttaaattctcctatggctacaagatttgaacttagatctccaaatccacattctaacacttatcttgtaatggctgcctcttatatgggaatgctcgatggaataatttatgcagctgaaaataataaaactgaagatgatttacttaaagaactttcaaagaatgcaggagattcagctgaataccttgaaaaaacaagatcgtatagaactgaagataatattttcgaagactttaccgaagctgaaagaaataagtattttggaaaggctccagcaacagtttatgaaaatttatctcaattaaacaataatccatctaaaattaaagcattaaaaagaaacagtgtatttactgatgaaatcataaatagtttcaaactagcttttatcgaaagatggacaactgaaattactcatagagtcataaaaaattacatggatgaaataagatcgttcaaaccacttcattcattagacaaagttttagacttagatatttctaattggacaaatctccatgatttaagagttgaattaatgaaggatacttacacaaataaaagtttattcactaaattgatagaagcttttaataatgaggacttcgccgatgcttctagactatatttagaagttgaagataagatgagtacacttagaaaattatattcgacttataaaaagaatcttttagacatttaatatttattactaaaaaaactcatttgttggtaaacaaatgagttttttctaaataaaatcataaaaactaatgattttattttttaaattattatgtcactttatagtatttttttcataattgattataattttctatatgttttatgttataattatactaattattactatgatgatgatgaggtatgtacttatgaggctagttcctttagaatgtattcgagagaattctctacttggtaaaaatatatatactgctgacggaagagttttattaagagctggagtagaacttacaagtattcgtctaaaaaaaattaaagatttaaaaatattctctctttatataattgatgaatatagctctgccgaaattgaggatgtaataaaacctgagttaaggcaaaaatcaatttccgttataaaagaagtattttctgacattgaacgaatttcttctgttcataaattcgaaaagcgtaaacttagcgaatattctcaaaaagaacaaaactattttaatagcataaatgaggttgcagaagaactcttagaaaatgttttaagtaataaaaacgtactcttatctttagttgacataaaaaatatggataattatacatatgctcattgtgtaaatgtagctgttatctctataataattggaataagcttaagcttaagcaaacaaaacttaatatacctatgcatgggtgcattggtacatgatataggtaaagcttttattccgcacgaaattcttcaaaagccaggtaaattaactcctgaagaatttcaagttataaaagatcatcctaaacttggatatgattttttaactcaattctattcattaagtgcacatataaaattaatagttttacagcatcatgaacgatttgatggacttggctatccagatggaactactggaaataaaataagttatcttgcgcgaattgtttctattgctgatgtatatgatgcattaacttctgatagaccatacaaacgagctatgtgcccaagtgatgcacttgaatatataatgtcaaatgcaggtacattgtttgattatgatatagttaatgttttttgcaaagtaataattccatatccaaaaggtaccattgtaagcttaagcaatggcgatataggaattgtagaagaaacattaccaaacttccctttacgtccaattgtaaaaataataaaaagtgacaatcaagaacaaattggtgcagaattaaatctaatagaatatctatcaattgtaatatcagatattcgttatgaagtataaaaaggggctgtatcaaaacaattttgatactagccgataaaaaaagagaattcataaatttgaattctcttttttgcgcataatattaatatgaacactaataatattatacctatgcatcaaataggtttcccaataaatatagaaaatattatatctgatagtgattcagtaagagtgctttatgatgttatggagggattagattattcagaattaaatagaacttactctactattggtagaaatccagcacttttacctaaaactatgtttgcaattatagtttatggatatatggaaggaatatattcaagtcgtgctcttgaaaaggcatgcaaaagagatataaatttcaaatggcttttacaaggtcaactaccaccaggacacaattctatagatagatttagacgtgaacgattagctggttgtatagaaaatttatttaatcaacttgtgaaaaaacttagagaacttaatgaaattcaatttaaaaatatttttattgatggaactaaaatcgaagcatctgcaaatcgatatacttttgtttggaaaaaatctattgataaatttgaagatagactacaaaagaaaataaaagaaagcttaataaaaatgaatcatgatttgaatttatgtcttattattactaatgctaaaatatcagttcaagatgctaattatattttagatagtatcagaattatgattgaagccaataatattgaatttgtttatggaaaaggtaaaagaaaaagtaaattccaaagatatactgaacaacttaatgaatttattgaaaagcaaaataaatataatgaatacaatagcatttttaatggacgaaacagtttttcaaaaacagatcatgacgcaactttcatgcatatgaaagaagatcatatgaaaaacggtcaattaaaaccagcatataatatccaaataggggtagaaggtgaatatattgtaggagtagacatttcaagtgaaagatctgaccagcttacttttataccatttttagatagattagaaaagaatttaaatcaaaaatatgaatccgtaactgctgacgcaggatacgaaagtgaagaaaattatgcatatcttgaatctaagaaacaagaagcttttattaaacctgcaaattatgaaaagtcaaagacaaagaaattcaagagtgatattagtaagaaagaaaatatgtactataacacagatgaagattactacatttgtgcatctggtaaaaaaatgcttctaaaaggaacaaaaaagaaaaaaacaaaatctggatatgaaactactgttagcatctatgaatgtgaagactgtgatggctgtgaatataagagtaaatgtacgaaagcaaaaggtaataaacaaatacatgtggctaaaaattttatgcgtctaagaacaaattcacttaaaaacatcactacacctaaaggaatacttttaagaatgaacagatcaattcaagtcgaaggagcatttggagttattaaacaagattatggttttagaagattttttatgcgtggaaatattaaagttcgtactgaatttttgttaatggcgtttggttataatgttaataaattgtaccataaaaccattcaaaatcgtaacggtgagctgcttcataagcagcaagcttcgtaattttaaatatatagttaaaatatggataataatgtttatcctttatttgtgttatttcaaaataaaatatttggaaatatatacatgaataaaatttacgtttataagaataggctgtatcaaattgaatttaaaaaatttcaatttgatacagcccctttttattgcttaatatcttactatgtatatgtatgtataatttctattctaatttatcttacttcttctgtctgcaaatggatttaaactagctaattcttcagcttcttcaaaagtttttgctctaaaaatcaacgtccagccatttttatcgtattttccagcacacattatgtatttatcctgtctgccttttgattttacttccctatctattattaagcttctaatgttgtccatgtttttacagtttacttttacaaaaaaattacctaattcattcacaatatacatcccccttagcaaacatatgttcattaattatattatatagaacacatgttcacttgtcaataccaccgtggtaatattaccctaataaaaatgagtcatcaaaaacctgatgactcatttttattattaaatttcagctatatcaaatacttctaaatttttgttttcatcaaacttttcaagttccacatctgcaatagctcttaatgtatctaacgctgtaattacacctagatttctttcaactgctgctcttctgattaagaaaccatctctatttgaatcatttcctttagttggtgtatttataactaaatccacttctctgtgtttaactacgtctaaaatgtttggttctgattcatttatctttctaacttcttcaacctttataccagcttcttctagtaatttgcaagtaccttgtgttgctataaatgtatatcctaccttagctaattgtttagctatttctaagaactcaggtttatcatgtttattaattgtagcaagtatcttacccttttcttttgatgggtacatattagctcctacaaatcctttgtaaagtgcttccttaacatttctacctactcctaaaacttcacctgttgatctcatttcaggccctaaacaaacttctacattaggtaatttttgagttgagaatactggaaccttaactgaaactagttctggttctttatatatgtctactccatatcctaagtcagttaatttagctcctaacataacatttgtagctaaatcaactattggaactccacttactttactgatgtatggtactgttcttgacgctctaggattaacttcaattacatataaatttccttcaaattctatgaattgaatatttatcattccttttattcctatttctaaagctaatttcttagtataatctaggattctgcctttcatatcatcagtgatgttttgacttggatacatagtaacactgtctcctgagtgaaccccagctctttccaaatgttccattattccaggtattaatacattttcgccatctgaaattgcatctacttcaatttctctacccattaagtatttatctataagaattggattcttcttatctttagcaaatgcattttctaaatagaatgttaattcttcttcatcatgagttatttccattccttgaccaccaattacatatgaaggtctaacaagtacagggaatcctaatcttcttgcttcttctaacccttcttctagtgaccatatacctttaccctttggtctagttatttctaacttttctaataattcatcaaatttttctctgtcttctgccatatcaatttgatctgctgttgttcctaaagtcacaactttttgttcttttaagaagttagcaagcttgattgctgtctgaccaccaaattgaagtattactccatctggtctttctttttcaattatatttaaaacatcttcttcagttaatggttcaaaatataacttatcagatacatcaaaatctgtacttactgtttctggattgttattaacgattatagtttcaattcctaatttctttaatgcctttacacagtgaactgaagcatagtcaaattcaataccttgacctattctaataggacctgatcctataactataactttcttcttatctgatacttcaacttcatcatattgttcataagttgagtaatagtatggtgataatgcttcgaattctcctccacaagtatcaaccatcttatatgatggttttatgttccagatgtctcttaatctatatacatcatcaggactaacctttaacatatcagctattgctttatctgaaaatccttttttctttaatgcatataaccattctttatctaaatcttcaattttgcttaattttaatctttgttcttcatctataatccatttgattttttctaagaagaacttatctataccagtgattttatttatcttatctattctataatctcttcttatcatttctgctaaagcaaagattctttcatcatctggcttcataactaattcttttaattgagacatgctatgttctttaaatttcttatgatctaaagagtattttccaatttctaaacttctaataccttttaagaatgcttgctcaaaattagctccaattgccatgatttcaccagtagccatcatctttgttccaagctgtctatcagctccaaagaatttgtcaaatggccatttaggaatcttaactactacgtaatctagtgttggttcaaagcatgcatatgttttttgagtaactgcattctttatttcatctaatccatatccaagtgcaatcttagctgcaagttttgcaatagggtatcctgttgcttttgatgctaaggctgaacttcttgaaactctaggattgatttctataactgcatattcaaatgtatttggatttaaggagaattgaacattacatccaccttcaattccaactgcatttataatattgatagatgctgttcttaacatttgatattctttgtctgaaagtgtttgagatggcgcaactacgatactgtctcctgtatgtataccaactggatctatgttttccatattacatactgtaatacagtttccataagaatctctcattacttcgtattctatttctttccaacctttaactgatttttcaagtaaaacctgacctattgtacttaattgaagacctgactctaagattgttcttaattcttcttcatcatcagctattcctccgcctgagcctccaagcgtatatgcaggtctaactataactgggtaacctattttattagcaaaatctataccagcttgtaaatcagttacgatttcgctctttataactggttctccaattctattcatcatgtttctgaataattctctatcttcaccttctttaatagattcgatagatgttccaattactcttacgttatatttatctaatattccagcatcatataattccacagcaaggttaagtcctgtttgaccacccattcctgcaagtaaactgtctggtttttccttagctataactttttctaaaaactctaaagttaatggttctaaataaattttatctgcaacttccttatctgtcattatagttgccggattcgaatttacaagtacaacttctattccttctgactttaacgcttcgcaggcttgagttcctgaataatcaaattcagctgcctgacctataactattggacctgatcctataactaaaaccttttttatatctttatttaatggcatttctcactaacctcctaaagtgcatactttaaaaatttatcaaatatgtattcgctatcctttggacctgctgatgcctctggatggaattgaaccgaatatattggtaaatccttgtgcttcattccttctactgttccatcatttatattaacatgtgtaacttccatattttctggtaatgtttcaacaacatatccatgattttgagaagttatatgaactatattttcttctaaatcttttactggatgattgcatcctctgtgtccaaactttaatttagttgtttttccacctagtgctaatgctaataactgatgtcctaaacatattccaactagtggttttttaccaactatttttttaatattttctataacgaaatctaaatcttcaggatctccagggccatttgataaaaataccaaatccggattgacatttagtacttcttctgcagttgctgttgcagggaagattgttaatttacagtttcttttttggaaatttcttattatgtttgttttaattccaaaatccattattgcaacatgttttccactaccatcaatagtgtatgcttctttagttgtaacctttttaacagcttctgtatttgagaaattagctattttttcttttacagtttcatcatctaaatcttctaatgcgatgattcctctcattgttccgttgtttcttaaaaccttagttaatgctcttgtatctattccttctaaaccaattacttttccttgctttaagaagtcttctaattctaattcgcatctaaaattacttggtaaatcacatttttctcttactataaaacctctaacttttattccgtcagattccatatcttctagatttattccataatttcctattagcgggtaagtcatagttactatttgaccataatatgatggatctgttaatacttcctgatatccagtcataccagttgtaaatactacttctccaacactttctttaagataaccaaaagctttaccttcaaaaatcataccattttctaatataagctttgccttcatgttcaagcctcctacaaaatataatttgctaaaactacaccttacgaagatttttatataaaaataaaggataataaagggatacagtattctgctctcttcactatcctgtgatatatctatatatttggcttcaaaaaataagctatgaaattcaccgttgaatatttaaatatcatagttatactacctttttggcctcacaggaccaagttaaagtgcatcttaactttattttaaattttctctttctaccattctagtagatagcgtattccatgtcaagataaataaggatagttttaatactaatttttttataatcaccctattggatattttttgtacatataaaaactttatactacccttattatagcatatttattcattaatatggtataattattcatatttaatacagattttattctttatcatatacattaatattacttttgcttaaattattggataaatgtataatttcattaaactcatttataagttcttttgatatgttttctgcttttatgtaatcattgcttgatacatcttgacctgattttattctttttataatatcagctccaatattatgtaacattgtatgtttttcttctatacctttccatattaataatatctccttgttgtttggtaacatactataataaaaatgtccaaacccacatttatgagaatcagtttgtaacggtattattttccttgtatctactatgtttttaagattcttaacccatactttatgtgcttcaatagctttatttaccgtctctataaatagatcattacttgtcatataatacacatctttaaccatattacctattaatttagatgctttatctaaatcggattccatattaattacgggacttataacattgcttaatccattactaacttcttttaaatcacttgcacttccattcaaaatatctatatcattatctagttttttaatgctttgagtaacttcatctatagatgtatttatctcctcactattggcagcaagcatactcacagtttctgtaatattatttatatctcttctattttgtttacctgtctctacaattacatctagattttcatttatcttttctagtgattttacagtcttatcaacactaaaattacttgtattagatgcttgtcttatcgatgttaaaaactcattcattcctcctataagattctttgtttcatccgaaagttgtcttatttcctctgctacaattgcaaatccacgtccactttctccagctcttgatgcttcaatagatgcattcagtgctaataaattggtttgttcagatatttcatttatatctaaaataacattttgtatattttgaattacatttgtaagattattcatatcacttttcatatcagaagaataatttatagcttcttcagaaaacttctttatctcaagtaaatttctttcacttgtttttgctgactctaataaattagaagtattatgtgataatgcagttatattgtctgtcatactactatgcgctgctgtaacttcttctgaggtatgagtagtaatttcagaaacatttgaaatttcattaatcatatttactaaattatctgatattttagttataatttcttctttatcttttaattgtaaatctaaactacttaattgaataacagaatttagtactaatcttgttatctcttcaaaagtagtttttcctgtgtttattctgaaatttatagattttatcttttctagtgttttattatctatcttaaatttttcattaacattttttaataatgcaatatcattaacaacttgctctgttatattatttttaaaattaaacataataaatttctcccttttaatttaatatttttttatttaatatttgatattatttttaataaaaaataaatattttaacaaatatcgtattactaattgttttttttattaaaatgtgttattatttaattacacaaatattcagaatttttaggcagttacagtagttccattctgagctgacctaatttattctgatgacactactgttttctaaaaaagtgcctatgataaacataagcactttttttagtttggttaaattatatttttatataaaaatataatttaaaattcttttattactaattcagcagatgcaagattcgttacaactggaacattatgtacatcacaaactctaagtaatgcggaaacatctggttcatgtggttgtgctgtaagtggatctctaaagaatactactaatccaactttattttcagctatacgacttcctatttgttggtctccaccatatggtcctcctaaatattgcttaacctcaagtcctgttgcttcagaaacaagccttcctgtctctcctgttgctattaattcatattttgataatatttctctattttttttagcaaattctatcattataggtttctttttatcatgtgctattaatgctattttcattaagtcagcccccttttttcgatttttgatacgttttcataataattatactataaattttactactgttaaatgtgtttatatctaaatttttctattatatttaactttattatattggtttttataaactaaaaactaaaggattattacaataaagtataaccctttagctgtatagataataacatgtattttaactatctataaattcttatcttatttgtccattaccataaataatatattttatagttgtaagttcttttaagcccataggtcctcttgcatgaagcttttgagtacttattccaatttcagctccaaaaccaaattcactaccatcagtaaatcttgtagatgcatttacataaactgctgctgcatcaactctttgtaaaaacttttgagagtttttatagctttcagtaattattgcttctgaatgaccagttccatatttatttatatgattaatagcttcatcaacgtcttttactattttaacagccataatataatctaaatattctttgctccagtcttcctcattagccttttcaatatcattaataatagcttgtgatgcttcatcacctctaagtacaactccattttctcttaagaccttaactgctattggcagaaaatccttagctatcttttcattaactaataatttttctgcagcattacatactgatggtcttgatgcctttgcatttacagcgattttaactgccatatcaaaatcacaagattcatcaacatatatgtgacaatttccagtacctgtttctattactggaactgtagcatttttaactacagattgtattaaccctgctccacctcttgggataagcacatctatatattcatttaatttcatcatttcagtagcaacttctctgcttgtatcttctattaactgaacacattcctttggaagaccagctctttcaatacccttagttaaagctaccattatagccttatttgagttaatagcatcacttccacctcttaatattgatgcgtttccagtcttcaaacataatcctgctgcatcacatgttacatttggtctagattcataaattattcctataactcccataggaactctcttttgacctatttgtaatccatttggtctctgccacatagaaaccacttctccaaccggatcttgtaaatttacgacctcttttagaccctcggccattgcttttattctattcttatctaaagctagtctatctaacatagcctttggtgtccctttaatttctgcattttttaagtcaatcctattagcttcaagtatttcatttgtattctcaatcaattcttgagccatagccaataatgccttatctttttctttcgtagatgctgctcctaactcatacgaagcttcttttgccttttttcccattgtttctaatatactcattttatacacccctatctatttataattaaataaatccttattattctacagatttaaatcaaagatttatatgtaatttaaaattcttaaaactactttataccattaatttgatttcccaacaaataatgttcctatttcttttccgtctaatatatcccttataatatcaggttcatttccattagctaaaatcatatctacaccagcctctatagctgtttttgcagccgtaagctttgtaaccataccgcctgtacctagttttgaaccagctccgcctgcacactcttctaattcatgtgttatcttttctatttgtgataaaagttgtgcactttcattgtttcttggatcactatcataaaatccatctatatctgataatatgattaataaatctgcattagtcaacaccgaaactattgcagaaagattatcattatctccaaatctaactatattctctatctcatctattgatactgtatcattttcatttacaattggaactatcttgttttctaataatgtttcaaacgtatttattacattttctcttatatgatcatcttctattacatctcttgtaagcaacacttgtcctacagtatgactatattcactaaaaaatttactatatatatgcataagctcacattgtcctactgctgcaactgcttgtttttctcttatagttacgggcttttcttttaattttaatttattaacaccaacaccaatggcacctgatgatacaagcgcaacttctttgcctgaattaacaatatctgaaataactcgtgttaatttctctattctacacaaattaatatttccattatcataagttaatgttgatgttcctacctttacaactattctttttgcattttttaaattttcacgaaagcccattatagctacatctcctcaatattatttatttacttctatattttatcttactatagcccatataggttatcaatatagactacagtctaattatttatttagattaaatacacaataataaacatcattctttcgtttttaatatttttgtataaatacttaaaattactataaaataatactatctttttttgtttttatatattagaatagtacttattgtatatttataaagaaaaaggtgataaaaatgaataataattcaaaatgtaattatagaatatcttccttattaaagtttattattccttctttaattggagttctattatttatgacaccatttaaaatcgaaggacaattcactattccaattgcatttttatcgaataagttagtagaactttttaatgactttcttccattgattgtcacaattctaatttctatttcggctataggaagtatagtgattaaattttacaaaactgataacaaaatcttaaattcattattcaatgttactccaatatggatgactggaagaataattggaatgatcttatcaatacttacatactttaaattagcacctgagtttatatggtctgattcaacaggaggaatggttttattcagccttttacctctattagtctctgtattcttctttgctggtttatttttaccattattacttaaccatggattattagaatttgttggagctttactaacaaaagtaatgagaccaatattcaaacttcctggaagatcatccattgactgtattacctcttggcttggagatggtaccatcggaattcttttaacaagtaaacagttcgaagatggtttctatacaaaaaaagaagcttcaattataggaacatcattttctgctgtttcaataacttttagtttaatggttattactcaagtaggacttagtcatatgtttgttccattttacttaactgttacacttactggaatagttgcagccataatagttccaagaattccacctttatcaagaaaatctaatacatatattgatggatcggcgccaaaaaaggatatggataatattccttctggatatactgcatttacatatggccttgaaaaagcacttgaaaaagcagaagataattcaagtataaaaggcttttttgctgatggaatacgaaatgttatagatatgtggcttggtgttttacctatagtaatggctatgggcggtatagcattaataatagctgaatatacaccattctttgaggtattaggtacaccatttattcctcttcttaatttattaggtgtcccagaagccgctgctgcttctcaaacacttgttgttggttttgctgatatgtttataccatcagttctagcttcaacaatatcaaatgaaatgacaagatttatagttgcatgtatatctgtcactcagcttatttatatgtctgagattggaggacttttacttggttcaaaaatacctgttaaattcacagatttaatattaatcttcttagaaagaacacttgttagtttacctataattgttctttgcgctaatttaatattttaaagaaaaggtctgttgcaaaaaatacaacagacctttttattatacttatatcaaattcactttttatataatatagaagaacacacatataaaatgacacaaagtaccaaccattatgaataagtgaaatatttcatgatttccaaaagcacctattcttatcttttcatttttaaatgcataaattactccacctatagtgtacataattccacctaatactaaccaaaataaagctattgcaggtaaaacctttgacattggataaattgcaaaaatagcaaaccagcctattcctatgtacatagtactgcttaaccatttagggcatgttatccataataacttgaacccaattccaactactgcacatattgttactgctaaaaataaattgaatcctacattcccacttaatgctactaaacagaacggagcatatgatcctgctattaatatgaatatcattgaatgatccaatctctttagtacttttattactttttcactacttattactgaatgatatatacttgatgcactatacagtaaaatcatacttactccaaaaaataacaccgaataaaaagtaacaagtgaacttcctcttaaatatgattttgtaatcatcgcaattaatgctataaatgataatactgctccaatcaaatgagttaatccattaacaggttctcttaaatatttctccattcttattcctcctaaattatcccacgtagttttaaaaactaccttttaccattatagaaattatttcatataaacatctatatggcaagactgatttttatttatttttttagtatatatttattttctcctaagaatgcttgaattatctcttattttctattaatattatatttataatacaacacgtagttttaattactatgtagggagtgaaattttatgaacaactttgatattgacaattatataaattctcaaaaatcttctactaatattaatttagatgattttcctgaaattgatctttatatggatcaagtaatacagctttttgaaagtaaattaaattacacaaaaagaaatgaagatgataaaattcttactaaaactatgattaacaattatgctaaaggtaatcttctaatgaaaattaaaaataaaaagtatacaaaagaacatatgattcttattggacttatttacaacttaaaaggagcgttatcattaacagatataaaaaccatgtttgatcctataatagaatcattttctaaagatgaagattatcctctttatgatatttatgaatcatttttaaaaatttatgattcaaatctagaaaacttcgatatttcatctacaaatatttcaaatcatgtaaatgaacttatcaaaaataaagatgaaaaactaggtgactttgaagaaaaatttcttttagtatgtgcatttgtaagtatgagtaatctttatagacgaatgagtgaaaaaataattgatgaatgttttagtgagcttaagggaggaaaatagcaatgaaaaattcattagatttaaaaaaattgctttcttctattgatggaaaaagctatggttcatataaatcattagctgataaatataattttaaaaattacattttaagtatagatcatgttcaaggtgatccttttgcctcaccatcaaaaatacaaataataatgaatcaagaaacagctaaatttcctgttgaactttttgatactgattataaaaaaattgctttagaagattatcttacaaggttattttattcaaacattaataaattttcttctaaagtgtttggttcaggaaaaagcggacttataagcataagtaaatgtgatcaggaaattcttcaaagaaccgctataataatatcttccaatgaggttcaagtcagatttgaagtaggttttcctgcaagaggaagaactgttttatctagagaattagaaaaaattctttttgaatttttacctcaaataatagataacactcttatttatgataatcttaataaatcttctattaaaaatagaatagaattaagtgaagatcaaagttacataagaaaatatcttaaagagaataatttagttgcttttatcgcaaatggttctatacttcctcgtgaaagcgggatttctacaaaaccattaaaaaatggtctaaaattcagttctccgaaatctatggaaattgaaataaatttaccatttaaaggcaaactaaaaggtatgggtattaaaaaaggaataacattatttgtaggtggtggatatcatggtaaatctacagttttaaaggctttggaacttggagtatacaatcatatcgaaggtgatggacgtgagtatgttataactgatgaaagtgcccttaaagtaagggcagaagatggacgatttataactaatactgatatatctctatttataaataaccttcctaatggaaaagatacaaaaaaattcagtacggataatgcaagtggaagtacttcacaggctgcaaatataattgagggtattgaatccgatactaaagtctttttaattgatgaagatacttcagctacaaatttcatgattcgtgataatataatgcagaagcttgtaagtagagaaaaggaacctataactccatttattgaaatagttaaatcactttatgataaactcggcatttctacaatattagttgttggaagttctggtgactactttgatattgcagatactgttatccaaatggattcttatactccaaaggatgtaacatctcaagctaaagctttaagtaaaggaactgttttagagcgtatcaataactcttcgttcaatgtttcgataaatttcaatagaaaattaaagaaaggctctattttctcaggacctaagggagtaaaaataaaatctattggcaaggatggcttatctataaacaaagatataatagagttaagggctgttgaacagattgtagattctgaacaaataaactcattaggatatattatgaagtttgctgaggataatatagttaataatagtaaaactattatagatgttgttgatgaaactttaaattatatttctaaaaatggacttatttctataagtccagtaaaatatggacttggatcttttgcaatgcctagaaaacaagagataattgcatgttttaatcgatatagaaatttaaagttgtaatttgagataaaattgcttacatttaactgtatatctatataataaaagtaaaactaagtttaattaactgtaaattatcagaatctatgatataataagcaacataagctaaaaatcagttatactggtgattacaactcttcgtcagtatatgaaatataaattactatataattaagaaatgaggtagaaatagattgataaatgtatcaaatgttagtctaagatttggtggacgtaaactttttgaagatgtaaatcttaaatttactgctggtaactgttacggagttattggtgctaatggagctgggaaatcaactttcctaaaaatattatctggtgatgtagaacctaatactggtgaagtaattattgcacctaacacaagaatgtcagtattaactcaggatcactacaagtatgatgagttccaagttttagaaactgtaataatgggtaacgaaagattataccaaatcatgaaagaaaaagatgagttatatgcaaagcctgatttttctgatgaagatggaattaaagcatctgaattagaaggtgaatttgctgaccttaatggttgggaagcagaatctgaagcttcttcacttttacaaggtttaggaataggaactgaatatcactttaagaatgtatcagaattaactggaggagaaaaagttaaagttcttttagctcaagctctattcggtaatcctggaatactaatactagacgaacctactaacggtcttgacttaaaggctgttaattggttagaagacttcttaggtaactttgaaggaactgttattgttgtatcccatgatagacatttcttaaactcagtttgtactcaaatggctgatgttgattttggtaagattaagatatatgttggtaactatgacttctggtatgaatcaagtcagttagctcttcaaatgtctaaagatcaaaataagaaaaaagaagaaaaaattaaagaattacaagatttcgttgcaagatttagcgctaatgcatctaaatctaagcaagcaacttcaagaaagaagttattagataagattactttagatgatatccaaccttcaagcagaaagtatccttttgtaggatttactcctgaaagagaagttggtaatgatatattagcagttaaggatttatcaaaaactgtagatggtgttaaagttttagataatgttaatttcatagttaataagggagataaaattgctcttataggtaatgaaattgctgtaactacattattcaaaattttagctggtgaaatggaaccagacagtggagaattcaaatggggaataactataacaaattcttacttcccaactgataactcagcattctttgatggctgcactctttctttagttgattggcttagacaatactctgaagaaaaatcagaaagctatattagaggtttcttaggaagaatgttattctctggagaagaagctctaaaggaagctaatgtattatcaggaggagaaaaggttagatgtatgttatctaaaatgatgctttctaatgcaaatgtattaatgttagatcaacctactaatcaccttgaccttgaatcaatcactgctgtaaataacggattacaaaattacaacagtaacataatatttgcttctcacgatcaccaattcgttcaaactatagcaaatagaataattgatattaaagatgatggttctatcgttgacagaactatgacatttgatgaatatatagaattctcaaataaataattacaataaaaaggctggattaaaatccagccttttttaattaattactattttctaaaatttcttctacaatttcgtgtacataatcaattagattatttgcatgaggttttactaaatcttctgcttcattaaatgtataactattttttgttatattaaacatagatacatcattaaatgaatcacctacagtataaacatcatccgtattcaacttttcatcctctaatatcatcataatcccatttcctttagagcatccctttggaacaacatctataaaacattggtttctataagcttcaacataatctccatacttgtctaatattttattttttacatcctcacatttttcaattgaacccattacatcaaaaacactcatcattttatatgttccctttgaatttaatgcatctttaatttctattttactcgaaaaggtttctacaaaatcatctttaaggtttgatatatcaactgatgaattattaattaaatatgtatcttcaccattatcataatacattaacagagttccatcattgtaaaaatcatcaattataccattcttcacagtatagtctattgatttttcatgaattacttcattgtttttatttaaaacaagtcccccattacaaagaactaaataatcatactcaaaaggaaagtccttaaaaacagattcaaccccacttaatgtccttcctgtagatactattactttatgtccactttcttttaactttttaagtgcatttaaatcttttggggatatcttttgttctcttataagagttccatctaaatcactagctaaaattttcacgtatattccctccatcttccactgtataaaatttaattctaagtataattatactataataagtgttaacaatatatattagcatctgtataattacttttaatccttatattatcatacactcataatcagtgctcttacattctatcttttttaaataagttttttaacaaaaaaagcatagtctatcttgcttttataaactatgctttataactttattctaattatttagtatattttaagtgtaataattcatgggctttatgttgtcctggcattcccatatattcattatacattttcattaatgcttcatttttatgagattttctctttacagcagttttatcttgattatataaaacagatgctcttactgctcttacattagcagtatccctatccttagctgcaacatgcggttgaccaccgccatttacacatccacctgggcatgacataacttctacaaagtgatattgtttttcatccatttgtccgccctcaacaaacttagttaaattagcagaaccattaattacagcaacattgtagtttttacctccaatttcaactgtagcttctttaattccatctaatcctcttacttgtttatattctatatcaattaaatccttatcttctacaaagtccttagcagttctaagagcagcttccataactccacctgtagcaccaaatataactccagctccagtatattcacccattgctggatctgccttctcatcttctaatgtagcaaaattaatttttgcatccttaatcattttagctaactctcttgtagttaaaacagcatctatatttcttaaaccttcattttccatttctgttctatcagcttcatattttttagcagtgcaaggcattattgtaactgtataaacactcttaggatctaatccttccactgtagggtaatatgttttacttgctgctccaaatatttgttgtggtgatttagctgaagataaattacctaaaagttctgggtagtaattttctgcttgcctaacccatgcaggacaacatgatgtaaacataggaaatggtccattattatttattctttcaataaactcagttgcttcttccataattgtcatatcagcaccaaagttaatatcaaacactttatcaaatcctaattgtcttaatgaagaatataacttaccagtaacatctactccatatcccattttaaataattcacccatagatgttctaactgcaggagccattgcaactataacgtgtttattaggatcttctaaagcttctttaactctatctatatgtggtttttcatttaatgcagctacaggacatgcagctacacattgaccgcataataaacaatttgtttcatcaaaacatttaccttcaatagcctgcacttttctatctggacctttacctgaaatttcaatatttccagttccagtcttttctttacatgcagctacacatcttccacatagtacacatttacttctgtctattgttattgatttacttctgtcatctaaaaattctgtcttatcagttggtagaaatggcttatttgctttagcttttgttttgattactaattttaagaattcacatgtctctcttcgaggacatggtccacatttgaattcatgtttgtcaagtaaagctgccactctcatctttactctctcttgtgttgcctcagtattagttcttacaaccataccttcttctactttagttaaacatgcaagagaaagaaccttttttccttcaacttctactgcacagaccccacatttaccaacatttgaacactcttttaagtaacataatgatggtatgtcgattccattatctaatgcagcttgaatgatagatgtaccttctggtacttgaacatttttttcatcaataattaaatttatcattggataaattcctccatacacactactatttttttgtttttttgtaataacaatatatattttaccataatttatatacttgtaatatattattatattatttttgtattaatcttaaagaataaggagatacaaccatatttatgtatctccttgacattacatttgtattcctaaacctttaagggtaaattcaacagtttttcttattatattgtctaaatctattttttctatatgaatagattcatatactgcagcagtacataaagcgccaaagaattgatatgccataagctctgaatcacctgattctatttttccttcattcatagcctcttttatgttaacttcaatttcttttatatatccacggattttttgacgtaattcatcttgtctcttttcattcccccacaattgactcattacaactttaaagaaatccgtatatccataaagaaaacttaattgtacttcactaatttttattaatttttctattggactaatatctactttttggatatctaatacttgatcttgtagaatctgaattccttcttcaacaataaagttgaatatctcctctttgcttgtaaaatgataatatagcgtcccctttgctaatcctgcatttgaagcaatatcatccatcgtcgctcctcgatatccacaatctgaaaatattctaatagctgattcaaatattaacttctttgttctattcatatttatcgcctctttttctatatgctctaatatttttattatacactatttaatataaaagaaactatatactgattttagatattttcacaaaaatcacaaataatatttttttataattcgagtaataataacttaaaataaagaatttttgatatttattttatttatgataaaattaagataaattgtagttatattaattaagaaatggaggataatcgtcagactgagaaattataaaagtaattcttttataaggtttggcagatttttttatgattcaagtttatgatagaaaaacaaaatcttatgaggaagaacttatagctggaaaaaaatatattgagtggacatatgaatcacctattggtagaaatataactgaacttattgccaagagaaaagttttctctaaattatatggtatgtattgtgatacaaaatttagttcaaaaaaaataaaatcatttgtagatgattttgatattgatatgaatttatcaacaaagaaaataaatgagtttaaatcgtttaatgacttttttgtaagaaaacttaatgatgaagctagacctattgataaaaatcctgatattttagtttctcctggagatggaagacttacagcttatgaaaacattaatttagaaaatttagttcaaataaagggaatgacttatagtctttttgaactgattaataatgattctattgctgaaaagtattctaatggaatatgtattattcttagactttgtcctacagattatcacagatttcactttgttgactctggaatccctacaaaaactaatgctataaaaggatattattattccgttaatcccattgcattaaatagcgttccaaaacttttctgtgaaaacaaaagagaatggtcaatattacactctgataattttggtgatattttaactattgaagttggcgctacatgtgttggatcaataattcaaacatattctccaggtaagcaagtaaaaaaaggtgatgaaaaaggctattttaagtttggtggatcgactactattctatttttagaaaaagacactgttaacattgattctgatattttaaatcagtctaaattaggctttgaatgtaaagttaattgcggtgaacatattggaataaaaattaataaatagtataaatgcagcttaaattacttaataatctaagctgcattctttttaattatctaaaattacacttctgattgattttctaaatctatttatatctttatctagaataatcaaattaatattcattgcttttgctctttcaataacacattgcttacatggttcttttgtggctacaagaatcttttttactgaatttcctccaagtcttttactgtaaacttctaattcattcaaggcatcctcatcatatttttcactatccttacatgaaatacatataaaaacagaatcctttactgcaagaacatctaactcatttctcacttttctattacattctttccataaaaaaataactccacttttaacttcatcaacttctgtaatctcttttacaattgtgttagttaatacttctagccaagtgccacttttaaaaataaatcccttaagataatcatttaaaaaccttacttctatttcattacatagactgctgtattctataccaccttgttgttttaaaaataataaacatgaatttaaaatttttctgtcttcaaagtttaaattatcagtctttatagataccaagttagggttataacaatcatgtataaaaatattattattgtataatttttgtttatttttataccatagagatagattttcataaatctttttagtaattgctactatgtcacttttttcacttaaagttgtagaatctgttattagatttgttccagttaattgaagcatgttatccagacttaaatctctaaattcaaaagtttttttagtaatattaggtccaaactcatataaaaatttatttaaaacatccgcataaactgttttaaatcctaaatttaaagattcattgaaaagtactagagaataaattctttttcctcctgtaacattaactattgtttcatttacacataatttttctaaaatattttttatattaaaaatattgttcatatcaattacatgattttcaaattttattttaggatatatcttctcttcgcaagcttctatttctttaaataaactttccatctccttatctattatataaatcaccttatctggtttaattttatctatagcaagaagacttccctgattgtgtctatcaaataaattaactaataccttattcataatattctccatatcaataataaatttagtattctattgttaatttatcctcttcacaaggtattatgtgtaatatagattaaatttttattataatttatagtaaaattttgatgtacaaaaaaaggcttaatttattttaaattaagccttttccataaataaatggcagagcgtgaaggaatcgaaccctcaatgtaccgtccgtagcggtaagttatatccgtttaactaacgctccatataaaatttttacaacaatcttatcttatcataagctataataataatcaagattataatttacatatttaaaaaagtattaatatatttttccataaaaacactataaattgaaagtaattttacttatacagattactttcaatttattatttaactttaattttttaaacatatatatcagaaaattctacttcaaaaatatctaccttactacttaaatccatactatgtttatcttttttcatactatcctcaactttaactataggcatttttattctaaattcacttccaagtccctcagtacttgtcagttcaacaactcatccatgtgcctttacaagattaaaaacaagatctaatcctattccacttccagagtattcatttctattattcttagttgattgaatgaatctattaaaaatagttttttgttcattttgtggtattcctattccttcatcctttacagaaatagttatatatttctcttccttccatgtatttataaatacacaactattttctttagagaacttaattgcatttgaaattaaattcattattattctatcaaaggaactaatatcaaccgcaacaatacactcttcaacattagtatcgaatactaaagatatattttttatttttgcatacttatctattgaagatatattccattctattaaatttataatatctatattttgtctatttattttaaaatgtctttgctgtaattttgtactgtcaattatattattaataagctttaatatcttataacaatttctcttgactatattcatatgttcttctgcttttaattcatcatattcatttttatagcattgcaatatccctaatattacacttaatggagatctcaaatcatgagatatatttaaaataaagtcttcctgtgcaatcttgttttcatacaaatccatatatttttcaataacttcttcttttgataaaccttcaagctccgtctttagttttctttttatattctcttgttggttttgcttgactaactccattataacgcccctcttttttactttttttcccatataccataaatacataatatcacattgttatcatattaacaactctgtataatattaatttcgaaaattttccatattgtataagacgttataatacattttttattgctttttaattaatgcctaaatattactttgcttatattatattatttttaattttaaatacatataactataattaataaatttttacagttaactattgacgaaatatatcttatactgtatatttgtatttatcaggtagacatttgttctctacaagagtacaaattaagttaaaagggggcttaattttgaaaaatttatctttaataaaacgtatttttttagcacttatattgggaattggtttagggcttatttgtaaaagcacaaatatagtttttcccgttagaatattttcaacatttagttcattatttggaagtttcttatcatttgtaattccattaataattattgcttttatagttccagggattgctactctcggaaagaattcaggaaaagttcttttaggaactacaattttggcctatgtatcaacaattacagctggtactgttgcatttttcttaggttcagcaatattacctaagctaattacaactgcaagtttagcttctaattcaaatgttaatgttgatccttactttacaatagaaattccagctatactaaatataatgtcagcattagtttttgcttttatttttggaattggactttcaagaataaagaatagctcacttttaaaaggatttgaggaatttggttcaattatttctaaaattatttctaatatattaattcctttagttccagtatatattggtgcaatatttgctaagttaactttaacaggtgaaatatttacaacattaaaatcttttgcaagtgtttatgctgtattgtttgggttacaaattgcatatttattatgtcaatattcaattgcaggtatactaagaaaagaaaatcctttaaaattattaaaaacaatgattccagcatatcttactgctgttggtactcaatcatctgctgcaacaataccagttacattagcttctgcaaaagaaaataatgtttctgaagaagtagcaaacttcgtagttccattatgtgctactattcatttagcaggagatacaatcactcttgtgttaacatcaataggcgttatgttaatgaaagggcaggttcctacttttggtttaatgatgccattcatcttaatgcttggtgtaacaatggtagccgctcctggtgttcctggtggtggagttatggccgctttaggattgctagaaagtatgctaggatttggagatatagaaaaacctataatgatagcacttcactcagctcaagacagtttcggtactgcaactaatgtaactggtgatggtgcactagcattaattattgactattttgttcaaaaaaaatcttcaactgaagaagctttagataatactacaattaatcatgaatcacttgttcaaaattaattagatataaaaaacattaaaatataggtgtaattaagatactgtttaaacaatattctaattacacctatattttttattgctttataaatttctatcataaatccttacttatttttctgtaatatattctttatctaaatttttctcctgcttaggttttgtattatttcatatttaatgtgttttaatgttaatacaacataagtaaatgtcccgccaataaaggttaaatcaaaattaatattaggttttaatagattaaggatagtaacgataattaaaggcattgtagatgcataaataacaagtgaccataaagctttatattttacaaccattttcataaacatagatattaacaatactgctgttactataattaaataattaaaaactaaatctcttaactcttcaaatatgttcaatacaattattgctgtaactattacaattgaaaatatattagctcctgatattattctatctgagtttatgtcttctcccataaacatatcactataatttagagcatatatactcccataattattaaatgctatgccatctttcaaaattagtaaatctatcttactatcataaaaaatttctttaaaatcgatatcttcattaatcgttttatctgaatatatatatatatcactattaacatttgcaatactggaatctaaagtaagtaatccatcttttatatatatgttttttccattcgtttgtaaatattgcgtaatgatgttaagaccacgattaagcttatatcctaaaactcctccctttattattcctactcctgtacagattattagaatataaataattgattttattattccctctttagcatactttgaaaacacatttatatcataaacagaagtcataaattttttaaaaaaaccagtattatccttcattttatcctccaataatgttctttagttaaacaattccatttttctatattataacatattgaaaatacttgaaatatcaaggtttattatttgcttttattgttaatattatagataaaagttttaacttactcttttaattatattttattatattagaaatattcttaatagatattcgtctctattaattaaggagggattaatttgaaaaaattaaatggatttaatataaatattaaaatgagcaaaaaaaactataaatttatatatattcttctatcattattaatcataacatttctatgtgtttttgaaagtcacaaatacaatgtacttcttagtgaattcaaaaattattttagtaattacgactatgataaagctaataatttgttacttacaaaggaggagtacaatcccttaaaagtattcagattaaaaaatgatttaacgttatattttaattctgaaatttcaaggctttccagcgatattaataacaaaagtaatactgatgaaaatatactgctagaacttaatgaaattaagagatatgatattatatctttagataaaatatatgatttagcatcttctatagattcattaaaagattctagttctaactatgacaatggtgttaaatgtttttctgaacaagattatactgatgcactatcttattttgaaaaggtatcttcacttgatctaaattatacttcttcgttaaaatatatggataaagcacgtaataatataaaactaaatatatttgaatattgtgatgagttagttgaaaatgattattacactaaagctatatctatacttgatgaaaacagttctttaataaaagataacattgatattcaaaataaaatatctgaaattaaagataaacagcaagaatattatgataaaacttctgctactattgaagcttcttcacaagccttaacaagtactatatctcctgaaaatataaattcgctaaatattgaaagtagcactcagtaccttataaatgttgatttgacatcacagaaaacatatatatataaaggtaaacaagatgcttggactttattaaaagccttttcttgttctactggtatatctggtgaagaaacccctaaaggttcatttgtgattcaagaaaagggggattggtttttctctgataaatataatcaaggtggaaagtattggagccaaatagttggcgatatactcttccattcagttccatttgataaagataaagctacaattgttgattatacattaggtgaaccagcatcacatggatgtataagactttcaattgttgattctaaatggatatatgataatattcctaaaggtagcaaagtaattataaaataaattacttaaccctaatttaaaataaatccctattagaaatacttattattatgttatagacaaacagcttagttatcatttaaaaaataacaactaagctgttttttatatttcaattactttttctaaataaaatgaatataagtatctctttgatactttttttcctgttattttaaataccgcatcactatagtaatcaagttgctttatatattttttctgtagttctgcttcattatccttagatacatagtcagttttataatctaacagtatactttctccattatattcaaaaaagcaatctataattccttgtaatcttactttttcattttcatattcttcactaagggtattatctatatttacactacttatttcagtgtaaaaaggaagttcacgatatattttttttccttctttatgaagttcagtcatcattttacccaaatcacttttaaagaaattcaaaattttagatggattaacagctttcatttcctcttctaaaataaagtcattttcatataggtactgtatctgatccttaatttcatgtattgaagatactttatctaaatctatttttttcataacaaaatgtacagcagtacctttctccgctgcagttaagcccttttcctcttgaagaaatttaggtgtaattattgttctcttattttttgattcaacttcttcaatattaatgctctcaacattctgatcaataaattcagcatttcttttctttaagtcagaaactgaaatattactttttaatttagttgattcttttaatggatatttatatgataatctcttatctacttcaccataaacatctttatcatactcttcttctaatattgataattttacttctttttcttcttctaatttgccgtcttcattattaactacaatatcgcttctcttccataatttaatatcccatttagagttatcatctttagatatttcatttgatacagctattttttcccttaatacttttccatcattatgctgacacaaagacataccaatccaatccaaatatgattttccttttaatatctctgaaggcagtattaaattataatctaacgaagctgaagatacccacttttctatactcttctgaatattatttacagttccagttataataagtttttcttttgctcttgtacatgcaacatatagaattcgtacttcttctgataaagtttccagcttcatttttttcttaatagcttctttcgctattgttcctatacttactcttttttcaagatcaacaaaatcaggtccaaatccaagttcatcatgatatagtatatttttattaagatccattaaattaaactgttttcctgttccacataaaaatactactggaaattctaaccccttactcttatgtatactcattattcttactacatcttcattctcaccaagtatcttagcacttcccatatccccggatgactttgtaagcttattgataaaattaataaaattgaatagtcctttaaaactagtttgttcaaattgctttgctctttggaacaatatttttaagtttgcctgtcttaacacaccgtttggcatagctccaacataaccataataagctgtatccatatatagataccatataaactcatctataggcatatatatggctttatttctccatatttcaagcttttcaagaaagcccttacatcttgtaatgagttcttcagatatgtcgcaaatattcccctcggcaatatctgctatattttcataaaaatatttttccttatttttgagtcttataatacttaaatcctctgccgaaaatcccattattggagatttcaatactgcaataacaggaacatcctgcattggattatcgataactcttaacaaagacattatagtccttatttcaattgattcaaaatatcctgagccagtgtctgcatacgcaggaattccttcttgaccaagttcatctaaaaggctctcagaccagttctttgtagctctcaaaagaattactatgtctttatacttaataggcctatattcacctgtttctttgtctaaaaccttgaatacattatttcctgtagtggtcattaattctttaattcttttggcaacaatttttccttcaagattaactccttcaatttcttcattttcaaaatcttcttcatctaatttctctttatttaaatcggattcttcaatgcttttttctattatgttaacctctattggtcctcccaaaattacattttcatcttctgaattttcatatgaagcacctaaatttaaagcttcctcatcggtatattcaagttctccaaccgtctcagacattatttccttaaatatatagttaactccatctataacttctttacgacttctgaagttcttatatagctgaatctttctattattgctttcttctaatgtataattaatatatttctccatgaaaagttcaggttttgcctgtctaaatctatatatgctctgctttacatctccaaccataaatacattaggaaattcatcttttcttcttgagacaagttctattatagtttcttgaacattatttgaatcctgatattcatctacaagaacttcatcaaataaatttttaaattcaattgcagtcttagatggaattatatttccattttcatctttatcacttagtatttttaaacacaagtgttccaaatcattaaaatcgagaatatttttctcttttttcttttggctaaacttttcaccaaattctaaaacaatctctgttaactttttaatagtaggatatgcacctttaatatttataagcatttcttctggagttactgaaaaagtattgtttattaactctgatattttcttttttatatcatctcttatactctttactgtattttgaacattttcatctgaaactttatcctttttaatagattttaatcttccaaaagatattgaacataatgaactataaatatcatctaaaccacaatcaatagaattataagcattttttatagaatatagttcatttgaaaatgtttctaaataaggctccaagccatcagttaaattaattatttctattgccttttcaagcattttaatatatccttcaatttcaacttttatactgttctttaaaactaaaacccacttgctattatttaatttttccattgtctctatgttaaatgcttctgcattctctttaagccaattttcaggccatggtcctgacattataaaattatacatatttattattaattcttttaaattatcgtcatttttataagtactaaaagcttcaactaatgatgtaaactcagtatcttcttgatcatatttttcttcaaaaagtgtctctataacctcatctttaattaaaattccttctgtttgatcaccaattctaaatgaaggatctaaatctattttatgaaaattattttttattacatcaagacaaaatgaatgcattgttgttatattagctctatttaataatgtaagctgcttttgtaggttttttgatgttggttccttatcaagagcctttgatattgcagctgctattctttcacgcatctcagcagctgctgcatttgtaaatgtaactactaataacttatcaatatcaactggattatctttattagttattattcttataatcctttctaccaaaacagctgttttacctgatcctgctgctgctgcaacaagtaggttacaatttcgcgttttaattgcacttagctgctcatcagtccactttgtttcacccattcatcatatctcctctatttcttttaatctcgtatttagccttatctattattaattatcttcttttgagcctttaacatcacttctaatattatcccatatctcagttctactttttttacctacaatcttatatttattatcttttatacttgtatcaaactgacatattgatgaaaaatcacaatactcacagtaacttctatttgcctgctttgttggttcaattttaatatctccacataacatatcctcacataaagaaatcatttttctattaacatattctcttaatagtgtaaattcttcttctgttacaacatcacttgtagacttaaaatcaccatcttttttaaacgctgctggtattactaatgagtaaccttcaatatctctatccatagctttaactacctttgcatctttaagtacaagtcctttcaacttaagttcttctaaaacctcagtctcaacttcttctgttgtcatttcttttttactttttataattggatcatctactttaaaatataatactgctcctgggacaacctgtttttctaaaatatatttagaattcttaataatagcatccaagtaaactaacagttgcatttgtaaaccataatataattcatttaaatcaaatttttttgcacctgtcttataatcaataattctaatgtaagtctgcccatcaagatcaagagtgtctattctatctattctaccttgcaaatacactttttcatcatcttgtaaattaagcataactgcctcacctgttttatagttaccaaaatcgaattcagttttgaatacttcaaattcaccttttccaatttgctctgccataactgttactgatttagaaattacccttttaaatctttgtgatagatacttaaatcttttactactgttcaaaattgaatttgtctgttcactaagtctaatatctattaaatttgatactatctctttacatctttcgttgttaagttcagaccataatatgccttctttttttactctgtttgtaaacaaatctaaaatatcatgcacaaaagaacctaaatcaggaggtgtaaattcatatatctttctattcttagcctttaggccatattgtacaaaatatgaaaaaggacactccgcatatttttctaatctagaaacactgaacattaattttccatcttcatttgcatataattctctaagattatttttattaacgtgatttttcagatttgaataatccaaacctttaaatatgttctttactttgttttcgtattctggactatctttataccacttgtatacttctctccaatattcttcaacattttcctcatcacaattctttctcatagctaaaataagttcgttgaatgtaggtataggtgatataaccttatttagtttatctttataacttgataaatcatataaatcactctcttcaacaagcttaggaagtattttttttattcgtgatataacaattgatggtctcaatgatttaccttcaaagtcagccataggatatgaaatcattagataatcgctgcttattgttaatactgtatataataaaaattgttcttcaaatactttatttcttgtatttgatgctaattctatacctatctcacttagaatatttctgtcattatcagataatataccttcttccttttttgaagctggtaaaattccatcatttactccaactatatataatgccttaacatctctaccttttattcttgctacatcaccaatattcacttgatctaaagccactggaataactccaatttcttcattattaaaaccagaatttaatattttaaagaagtcatacgaatctaaatccttatctcccattacatccactgcctgatctaatatatctattacagattcctcaacttgactgtattctttaaccttatcttctaatccaatttcatcaaatttttcaatccattcatttattcgctcaaatgcatgtatatcgattaaaaattcataaatagccttacatatatgactaactttatgttttcctttaattttattatgaaaaactaaaagcggacgtctcacttcatccattatttctgaaataaatattttctcttctgataactcttcattgttgttaaaccaactttcagaaataatttcttttacagtccatttatatcccttaacaccatattctaaaacaaagttttctaaaacatctatataattattttcaattcctgtaagacctgtttttaagtatttaaacacactttcatatgaccaatctttaaacaatatttcaaaagctgatgttataagaattattaatggattatttaataactctaatttcttatctaaaaagtatggtatttcataatctttaaaaataacagatgttattttttcatagtcatctatgtttctacatacaacagatatatccttatatctatattttccacttcttataagagatgttatactctttgcaacacgctcaatttcatcataaatattattggccttatatagcttcacattttcacatttcccattaaatgaattaaacggatatgtaaaaaagtatttttctatgtgctccaattctggagcatttttaaatctattgtatccttcatttacattaatcatattcagattaattggtttatcatatgaaatattattttctttcattatcttcaaaattttattttctgtattttttatagtattaaacacatccgttatatcttgatttccatttgaattatccctattatccatgcacaaagttatgttaaccctcttacatcttcttgcaagtaatcttatgatctctaactgttgtggagtaaaagtactaaattcatcaatccatacctcagaattagtatatatatcattctctaataattttttcccaagcaaagttaattcatcatcaccatcaatatatccttcattcatttcttcattaaatgcttcatatattatcgataattctcttattttattatataaatctgattcttgaatgctttcctcaatatttcgtaaagaatcaacctcaacattatattttttaaattctgatataacatcagaaactatttcataaaatccctgctctcttgaaatttttctaaaatactctaatgattcaattttttcattaagaactttatgaattaacatatttcttcctgactcttttataatttctttaacacgtcctccacactcttcaaaaacctcatgagccatttttttaaagctcaatacttgagttcttaacaaagcaggctcacctatagattttaagattctattttctgtattaaatgtatattgctcaggtactatgaggattagtttattctcatcatctttttttatattttctgcaatactatttatgcaccatgtactttttcctataccagctcttccataaataaacctgatactcattccataccctcacctttcttactgtgctatattttcaataaattcatttttaattattcccataattattgtgtctacatactctccatcaatataacatttactttttttaattccttcctctaaaaaaccgcacttcttatagcatgtaattgcccgtatattagtacttataacttctaactctactcttacagcatttaagtcattaaataaataacttaaaagtaattttatagaatcttgtccatatccccgattccaatatctgcttccaattgttatacctatagaatatacatctttacagtaattactttctttatacgttataaatccaactaaaacttccttttcattaattatagtaagagcttttctaaaattagtattttcactattattagattcattggatattgtattgtatcttcttactttttcatcatcacaaatgttctttagtattcttacatcttttctttctaatagttttaaatatattttttcaccttttaacatattgcaccactccaatttaattatactatgaataattttattattaatatttttaatttatgttttttacttaaatttacatactaataaatcttttgtgatgaaatacattaactaatgctaaatttatttttatacaacaaaaaaacatctaacttttgttagatgtttttggcggagaatccgggatttgaacccgggcgccagttgcccgacctacgcccttagcaggggcgcctcttcagccacttgagtaattctccatgtgccctctaaaatatataatattttaatggcggagagatagggattcgaaccctaggtacgcttacacgtacgccggttttcaagaccggtgccttaaaccaactcgaccatctctccatgtctcacgacaagatttattatagcaagcataattaattctgtcaacaatttttcttaatttttttattttatttctatataaattaaactaaataaaaaataggtttttgttctttttatatttaaataaataactatctaaaatacaataaatagatgataatataagcttatctatttatataagatatctatttagtttttattataatacttaatttaatgttagaaataatatccataaacttttaaatctctaaatttgttaaattaactacagttaattattataattaatcacataaaaaaacacctagtaaaaactagatgttttggcggagaatccgggatttgaacccgggcgccagttgcccgacctacgcccttagcaggggcgcctcttcagccacttgagtaattctccatgtacctaataatattttccaatttatttttttataaaaaaaaatggcggagagatagggattcgaaccctaggtacgcttacacgtacgccggttttcaagaccggtgccttaaaccaactcgaccatctctccacgtcttacgacaagatttattatagcaatcaaaatatatactgtcaacactttttctacattttttttataaaaatattaaaaactacttattagctacttatatattaatgtttgtgaatatattcatcttaactattactattcttttagttattaatcaaatttctgcttgtaaagcatgtaaactaactaatggtataatataataaaaatgctgtattgaattaattttaattcaatacagcattttctcttaactatttaattatgcttttcccacccatatatggtcttaaagcttctggaatgtttatgcttccatcttcatttaaattattttctaagaaagcaataagcattcttggtggtgcaactactgtattatttaatgtatgagggaaatatttctttccatcttcaccatttacacgaatctttagtctacgtgcttgagcatctgaaagatttgaacagcttccaacttcgaaatattttttttgtcttggagaccaagcttctacatcaagagatttaacctttaaatcagctaaatcaccagaacagcattcaagagttcttactggaatatctaaagaacggaataaatcaactgtgttcttccataacttatcaaaccattctttactctcttctggcttacatacaactatcatttcttgcttttcaaattgatgtattctataaactcctctttcttcaataccatgagatcctttttcttttctaaagcatggtgaataacttgttaatgtttgaggaagagttttttcatcaacaatagtatcaataaatttccctatcattgagtgttcacttgttccaattaagtataaatcttcaccatcgattttatacatcatttctcccatttcttcaaagctcattacacctgtaacaacactacttcttatcataaatggaggtataacatatgtaaatcctttttctatcataaagtctctagcatatgaaattactgctgagtgaagtcttgctatatctcccattaagtaatagaatccgctacctgcaacttttctagcactatcaagatcaattccattaaacttctccataatatctgtatgatatggtatttcaaaatcaggaactactggttcaccaaacttctcaacttccacattttcattatcatcttttccaattggaactgatgggtcaataatgtttgggatcttcatcattctttctttaacttcatcttgaagtctgctttcttctgcttcaagattagctaatttttcagcatcattgttaacttgttccttaagcttttcagcttcttctttttttccttgagccattaatgcaccaatttgcttagaaacagtttttctatttgctctcaatgcatcagcatcagtttgagcttttctagcttctttatcaagttcaattacttcatcaacaagttgtaatttatgatcttgaaatttctttttaatattttcttttacgatgtctggattttctctaacaaattttaaatctaacataataacctccaaaatatttattaataaatcatatataaaaatgtataaaaaaattcgcctctatatatagcctaaaaagaccataataggacgaatagaatccgcgttgccacctaaattgtcaatataaaaacttacattaacctcttaaactatgctataaagggcataaaccttctgatttatcatcagcagctctaaaagtggaaagacttataataatcactggttcgcaccatacaccagctctctgaagatattaataaatcgtagcttttataataacgcctatttaaaatattatctaatcagtagtatatatctatttaaaaatttttacaagtatttttctatttttatcttaaatcatatacttatttgataaattaatccttttaaaaccaataatttattataacatttaactatctatttttttagtgcacactatatcaattccactattaattatattcgtacaaataacatcaccaatatctataggtgtgctaatatagattctacttaacaccttagataattctttccataactctttttctattggtttagtacttttaacagacactactttataatctggattcccttttactcttactaagcttgtaaaaatatctttatcactcatacaaatctcctcccagtcagctaaatttctgaaaattcttttattctgccaactaaaaccctagattccattgaatcatcaactatacttaaaacatccttatccatttctctcgctaatattttaataattttcatattacaataagcaccattacaacttccaagtccaattcctgtacgtcttttaactccttcaacagttcttgctccaagtggacgccttatgcaatcaactatttcgccttctgaaatacagttacagctacacactatatttccatatcttgaatctagttttattatttcatttctttcttctttagtcatatttttaaagacatacatatcacgttttttatcaacataatccttcttttctattatatttatattagtttttagtacttctcctattttctttgcaattgctggagctatagttattttagcataatgactgcctcttacttttacatatccttcttcaagcttattctcttctatacaaacgctatccttactataagtttccgtaaaaatatttgttactgtatgcttatctatatcaggtattatgttcttacataaattaagacccttttccatatctaatgaatcataccctttaattcctattaaattaccatttaatgctgtaggaatatcaatcacaaatgcactttcatcaatttcatttataattatattattcatatgattatcaagtttatcattaaataatatataattcatttttctgcttattatagaattttggttatcgtcatggttatcttcattattatccgaaaaaacttcattaggtattgtattaacaacaaatttacatgtaaatttgtttttattagtagttactttaaatccctttgaaatatttcttatatcaataaccttttcctctaatctaaaattaacaccattatcagctgctacctctgcatatgatatagctaaattataaggacatattacagctgtattttcgcaatataaagccttcgtgtaagtagcctttaaattaggttctatatcctttattgcattttcatctataatatgaacccctgatatccctctttcttttgctctattatacatattgtctaaacgttcattaccatattggctatttgaaattcttaaaactccaacctttttatatggtatatgaaatttattacaatgctcttctataagttttcttccttttttctcaagagaagccataatacagtctgaagtctctgatccatcataaattactgcagtatttacaaatgaaatatcatttgctacatcatagtccttttctattaaagctatatttatattatattttgaaagttcatatgctactgcacatccgattatcccgccacctaaaatcaatacatcataatccattgtaagttcctcctaatctgaaactataaagttcttagcctttaattctgatataattgcttcaatgtcctcacttgtttctgctgatatggtatgtagatgcactccattagttaagaccgataataagcgcccttcttgactactatatttagctataaatttatttaattcatttaaattcttaaccattaaaacaccttttatttcaccatataaagaatgttcaactataacatcttctattactccaccatattttatcacagtactcatttcatcaaacatctcagattctttatgctttacagcaattattgtttttacttttccgtcatttctgttaactatatatccatctggagttgccattatattaaagccttttgctcttaatattgctatatctttaactataacctgtcttgtgacattatatttatctgctatatcagttcctttaatgggtatagaactattgagcagtaattttactatattatctcttctttcaatagaattcatttctacttagcctcccaaatacaaacttctatttatattatactttaaaataatattttagtaacactcactctaataatattgtaatttatttttatacaacaaaaaaagttatgaattacttcataacttttatttggtggagataaagagattcgaactcttgaccccctgcgtgcaaggcaggtgctctcccaactgagctatacccccataaatggtggaccttcagggactcgaaccccggacctaccggttatgagccggttgctctaaccaactgagctaaagatccctttaatgacctggcgacgtcctactcttccacacagtctcccatgcagtaccatcggcgctatagaccttaactgtcctgttcggaatggaaaggagtgttacctctatgccatcatcaccagatttactacagtttatattttataacaaaacttacattttgtcaagctttttgaaagatttttttattctttcaaaattgcacatagtttttaatgtatttacaacttgattatattggtcaagccctcgacctattagtatcagtcagctaaatacgttaccgcacttacacctctgacctatcaaccttgtagtcttcaaggggtcttactagcttatgctatgggaaatctcatcttgaggtgggcttcacacttagatgctttcagcgtttatcccttcccgacttagctacccagctatgcttctggcgaaacaactggtacaccataggtcagtccatcccggtcctctcgtactaaggacagctcctctcaaatttcctacgcccgcgacggatagggaccgaactgtctcacgacgttctgaacccagctcgcgtgccgctttaatgggcgaacagcccaacccttgggacctacttcagccccaggatgcgacgagccgacatcgaggtgccaaacctccccgtcgatgtgaactcttgggggagatcagcctgttatccccgaggtagcttttatccgttgagcgatggccctcccacgaggtaccaccggatcactaagcccgactttcgtccctgctcgacttgtaggtctcgcagtcaggctcccttatgcctttacactctacgaacgatttccgaccgttctgagggaacctttgggcgcctccgttacattttaggaggcgaccgccccagtcaaactgcccacctaacaatgtcctgtcaccagtttcatggcatccagttagaacttcaatactatcagggtggtatcccaacaacgactccattaaggctgacgccctaatttcccagtctcccacctatcctgtacagacaataccgaaattcaatgctaagctacagtaaagctctacggggtctttccgtccaatcgcgggtagcgagcatcttcactcgcactacaacttcgccggattcacagttgagacagtgcacaagtcattacgccattcgtgcgggtcagaacttacctgacaaggaatttcgctaccttaggaccgttatagttacggccgccgtttactggggcttaagttcacaccttcgcttgcgctaagtgttccccttaaccttccagcaccgggcaggcgtcagcccctatacatcagcttacgctttagcagagacctgtgtttttgttaaacagttgcttgtgcctattctctgcggcctaccaaatggtaggcaccccttctcccgaagttacggggtcaatttgcctagttccttaactgtgattcttccgtcggccttaggattctctcctcatctacctgtgtcggtttgcggtacgggcactacttctctttctagatgcttttcttggaagcatgaaatcagatacttcggttccgtggaaccttccccatcacgccctaggattgttagaacggatttgcctgttctaactccctcaacgcttagaccagcatccaatagctggcacatcctatccttctccgtcacaccatcgataataacgattatagtggtattggaatatcaaccaattgtccatcgactacgcctctcggcctcgccttaggtcccgactaaccctaagaagacaaactttactcaggaaaccttagatattcggcctgtaggattctcacctacatctcgctactaatgccaacattctcactcgtaatcagtccaccgctccttacggtacgacttcagcccgattacgacgctcctctaccgctcatacaaagtatgaacccgtagcttcggtggtaagtttgagccccggacattttcggcgcaggatctcttgactagtgagctattacgcactcttttaatgagtggctgcttctaagccaacatcctagttgtcttagaaatcccacatccttttccacttaacttacactttgggaccttagctgacgatctgggctgtttcccttttgaccatggaacttatctttcatagtctgactgccgtgctgatagtatctggcattcggagtttgataaggttcggtaagcgctatgccccctagcctattcagtgctctacctccagtactcacatttcacgacgctagccctaaagctatttcgaggagaaccagctatatccgagttcgattggaatttctccgctatccacagctcatcccatgctttttcaacagcaacgtggttcggtcctccacgaggttttaccctcgcttcaacctggccatggataggtcacccggtttcgggtctacagcatgcaactagtcgccctattaagactcggtttcccttcggctccgtaccttaagtacttaacctcgctacataccgtaactcgttggctcgttctacaaaaagcacatcatcacacacataaggtgctttgatcggttgtaggcacatggtttcaggttctatttcactcccctcccggggttcttttcacctttccctcacggtactgcttcactatcggtcatcaggtagtatttagccttgggaggtggtcctccctgcttcccacaaggtttcacgtgtctcgtggtactctggtgcagaactgatcattatgacttttacttacaggactattacctcctacggtccaactttccagttgtgttcggttaatcataatttcacgttatgttctgtccgcaaccccagagataaatctctggtttgggctctttccttttcgctcgccgctactaagaaaatcgatttttctttctcttcctctaggtacttagatgtttcagttccctaggtgttccttcataaagctatgtattcactttacgatgcatgaggtttctcatgcgggtttccccattcggaaatctccggatctctggctatgtgcgcctacccgaagcttatcgcagcttatcacgtccttcatcggctcctgatgccaaggcattcaccatgcgccctttgtagcttgacctttttaagttttgatatacaaaactggttatattaatcattcacaaagaatatttattcttggctttgttgtattatatacattaatctatgtgcaattttcaaagaacattgaaagacttagtctttcaaaattgaacagaatcaatactcattaagtaacctttgagcaagttgtaatttttatagatgctttgcatctttgtactagtcaaacgccatgtttgctagatttctccatagaaaggaggtgatccagccgcaggttctcctacggctaccttgttacgacttcaccccaatcgctgaccctaccttaggtcgctgcctccttgcggttagctcacgaactttgggtattgccaactctcatggtgtgacgggcggtgtgtacaaggcccgggaacgtattcaccgcgacattctgattcgcgattactagcaactccagcttcatgtaggcgagtttcagcctacaatccgaactgagatcggttttatagttttgctcactctcgcgaggttgcatctcattgtaccgaccattgtagcacgtgtgtagccctagacataaggggcatgatgatttgacgtcatccccaccttcctcccggttaacccgggcagtctcgctagagtgctcaactaaatggtagcaactaacaataagggttgcgctcgttgcgggacttaacccaacatctcacgacacgagctgacgacaaccatgcaccacctgtcttcctgccaccgaagtggcttcctccattacagagtaattcaggagatgtcaagtctaggtaaggttcttcgcgttgcttcgaattaaaccacatgctccgctgcttgtgcgggcccccgtcaattcctttgagttttaatcttgcgaccgtactccccaggcggaatacttaatgcgttagcggcggcacagaggtcatgacaacccctacacctagtattcatcgtttacggcgtggactaccagggtatctaatcctgtttgctccccacgctttcgagcctcagtgtcagttacagtccagaaaggcgccttcgccactggtattcttcctaatctctacgcatttcaccgctacactaggaattctcctttcctctcctgcactctagatatccagtttggaatgcagcacccaggttaagcccgggtatttcacatcccacttaaatatccacctacgctccctttacgcccagtaaatccggacaacgcttgccacctacgtattaccgcggctgctggcacgtagttagccgtggcttcctccttaggtaccgtcattatcgtccctaaagacagagctttacaatccgaagaccgtcatcactcacgcggcgttgctgcatcagggtttcccccattgtgcaatattccccactgctgcctcccgtaggagtctgggccgtgtctcagtcccaatgtggccgatcaccctctcaggtcggctacgcatcgtcgccttggtgagccgttacctcaccaactagctaatgcgacgcgggtccatctcatagcggattactcctttaattgctgtaccatgcggtactacaatcttatgcggtattaatcttcctttcgaaaggctattcccctctatgaggcaggttacccacgtgttactcacccgtccgccgctaatccactcccgaagaagcttcatcgctcgacttgcatgtgttaagcacgccgccagcgttcgtcctgagccaggatcaaactctcaataaaaagtttaatcttagcttactcaaaataaagaattgctggtttacttaaatgtttatattatattctgttcaattttcaaagaccattttctttcacaactttacgttgttattttgtcacaaccaagcgactcacttagtatatcacttgatttgatttatgtcaacaacttttttcaaaacttttaattttttgttttaattaataattttgatcttatcttgttgtttcttgtcgctctctgcgacgtgttttatcttaacatataaaacaatacgaatatatttatatagttctatattttaaaaatattattatatttctctattatcctttatttttctttacttttcttataacgatacacgtggctcatattatatgcattttgtcctttattctatcatataataagctaattactatatttttatattttacttttaattattagcaataaaaaatggattaacaacataacattgctaatccatttttataattacaaaagctatatgaatattaaattattcttcgttatttgattcactactattctcttcaatagtttctggtgttgtattactttccaacttttcttcatcttcctctgaatcatcgctgctcaatatttttgctatggcaacaactttttcgtcttcagttgttctcattaatgttacacccattgcagatctattagtaactgaaatatctgcaacattaattcttatagcaacaccactagaatttatcaacataagttcgtcatccaccttacaaatagtggcacctgtaagttttccagtcttttcacttatcttatatgtgattaaacctactccccctctattttgaactttatattcagagacaggagttctcttaccgaatccattttcacttataaccaataattcttcgccatcaactgctatatccatacaaacagcaacatcatcatcctttagattaatagccttaacaccagatgcagttctacccattgctctaacgtttttctcattaaatcttacggcataaccattttgagttactatcataatgtttgcatcaccataagtgtttttaacctttaataactcatcattatcttttaaacttaaagcaattaatccattctttcttagattcttgaattcacttatgtgagttttcttaacaataccattcttagtggccatgaataagaatccttcttttttaccatcacttactgttagtacagtctgtatcttttcatctggctctattgctattaaattaattacatttgtaccctttgcctgtcttcctgcatcaggtatctcataagctcttaatttgtacactctacctctattagtaaagaataatacatcagaatgggtagatgtaatcataacatgttcaacaaaatcatcttcttttgttgtcatagcttgaataccctttccacctcttctttgagccgaataagtatctgctgaaattctctttatatacccagagttagttaacgttattacaacatcttcttcctggataaggtcctcaatatcaatttcattaacaaccttttctatttttgttcttctttcatccgaatacttggcttttatatctgataactcatctttaataactcctaaaagcttttcttcacttgctaatatagattttaagtattctatttgtttcattaattcagcatactcttcttctatcttttctctttctaatccagtaagccttctcaatctcatttctaagatagcagttgcttgtttatcagaaagagcaaatttttccatcaatgtattcttagcaatttcagcagtttttgaatgtcttataatactgattacttcatcaatattatcaagagctattcttaaaccttctaaaatatgcgctcttgcttccgctttatttaattcaaatacagttcttctagttattacttctttttgataatctatgtagttgcttaatatttctttaatatttaatactcttggctcattattaactaacgctaacatgattactccaaatgaatcctgtaatttagtatgcttatacaataaatttaaaactacatttggattagcatctctctttaattcaactacaattctcataccatctctatcagattcatctcttaaatctgatattccagtaatcttcttatctttaactaagtctgcaatattctctataagcttagctttatttacttgataaggaatttctgtaacaacaatcttatgtcttccattttcctcttcaatttctgcatcagctcttacaacaatcttacctcttccagtctcataagcagctcttataccagctttccccataatagttgcacctgttgggaaatctggtccttgaattttagtcataagatctaaaacagttaattcaggattatctataagcattatagtaccatctattatctcacctaaattatgtggtggaatattagtagccataccaacagctattcccgatgaaccattaactaaaagatttggaaatcttgatggtaatactaccggctcttgttcttcaccgtcaaagttaggcataaaatcaactgtattcttgttaatatctcttaacatttcaacagctatcttattcatttttgcttctgtatatctcattgcagctgcgctatctccatcaacagaaccaaagtttccgtgaccatcaacaagcatgtatctcatagagaaatcctgagccatacgtactaaagcatcataaacagagctatcaccatgtggatgatacttacctaaaacttctccaactattctggcgcattttctgtatcctttttctggagttaagcctaacccctgtagtgaataaagtattcttctatgaactggctttaaaccatctctaacatctggtaatgcacgaccaacaataacactcattgcatagtctatataacactttttcatttcatgattaatatctacaggtataacttttccctcattaaatatatccatgtacttcacctcatatcagtactaaatgtctaagttaacaacatttttagcattttgttgtataaattcttttcttggttcaaccttttctcccattaagattgtgaatatttcatctgcttgcatagcatcttcaacattaactcttaacaagattctttgttcaggatccattgtagtatcccataattgagacgcattcatttcaccaagacctttgtatctttgtatatcagtagaattgtcttttccaccaaaatcaattaatacctgctctaactctgcatcactataagcataatgttcttttttacccttgcttattttgtacaatggtggttgtgcaatatatacatgcccctcgtctattaacggtctcatatatctatagaagaatgttaataacagcgttctaatatgagcaccatcaacatcggcatcggtcatgattattattctatcatatcttatcttttcaatatcaaaatcatttccaataccagcaccaaaagcagtaaccattgatcttatagtatcagcatttaagattctatctaatctttgtttttcaacatttaatattttacctcttaatggtaaaattgcttggaactttctatttctgccttgtttagctgagccgccggcagaatctccttcgactatatagatttcacattccttaggatccttagatgaacaatcagctaatttcccaggcaatgttgatctttctaaaacagattttcttgttaattctcttgcttttcttgcagcatctctagctcttgctgccataagtgctttatcaactatcatttttcctactgatggattttcttctaagaaagtagatatgcattcacctacaatagaatcaactatacctctaacttcactatttcctaatttagtttttgtctgaccctcaaattgaggctcttcaattttaacagatactacagctgtaaggccctctctaatatcatcaccagtaaaattcttgtcattttctttaatatgaccaaattttttagcatagtcattaaacgctcttgttagtgcagttttgaatccaactaaatgagtaccaccttcaacagtatctatattattagcgaatgaaaaaatattttctgtatatccatcattgtattgaagagctacttcaacagatacattatctttaattccctcaatatatattggttcttcatgaagagctactttatttctatttaagtatgaaacaaaggattttataccaccttcataatggaaaacctcttctttttcattttcttctcttaagtctactaactttatgtatattcctttatttaaaaacgctagttctcttaatctttgtgctaatatctcaaaatcaaagattacttcatcaaatatttcagcatcaggcttaaagtaaacttgtgttccactttcactactttcacctattttttcaacatcagtaagaaccttacctttgctatattcttgctgccatatagcaccttctcttttaactgtaactctacattcttctgacagagcattaactacagatgcaccaacaccatgtaatcctccagaaaccttatatcctccgccaccgaacttacctccggcatgtagtatagtcattataacttcaacagtagatttacccattttaggatgtattccgacgggcatacctctaccatcatctgtaactgtaatagagttatccttatttatatttacctctatctttttacaataaccagctaatgcttcatcaatactgttatctactatttcataaactagatgatgtagacctcttgaacttgtacttccaatatacattccgggtctttttcttactgcctctaatccctcaagtacctgtatctgattttcatcatattttctattattttgttccaaatcagactcctcctaaacttataaaattaactgataaatcctttaaattaataattataatccatgtcagttctctttgttaatgtagttgatgatataggtgaaagatatattttactcatattatcaacttctgcaatgataaaagacttaggtctttcatctgtaattctctctacaaacccatcttcttctgctaatcttaagaactgtattgtatctgaactatacattgtattctgtatatcgaatattccaataatatccttgataggaaccacaacattttcacctaaatgtaaaaacacgaaatcttcctcctttaatttaaaattcttccacttgatacattaaatatttttgcattgtcgtctaaataatcgcttaaaacttcaataccagtacatgttattattgtttgtataccatggattgtacttaatatatatttttttctattaacatcaagttccgaaagaacatcatctaataataaaacaggatattctcctgtaatttctttaattatttttagcgatgaaaatttcattgttaaaatagctgttctctgctgaccttgagagccaaatgttttagcatctatatcatttagaaaaacattaaaatcatctctgtgaggacctactgatgtcaatcccttctctcgatcacgcttaatattatcttgtaatttttttaaataattatttttataattagttaaatcgacattacagctatacttaaatttaatctcttctttatcagctgttatttctctgtgtattttttctccataaaagtttattttatctatatattctaaccgttttgaaataatataatcagcatagtcaaccagctgaagatcatatacctctaaaacgtcctcattaaagttcctgcttttaagcaaaatattccgttcatttaaaattttattgtattgaaccaaattaaaataatactttttatttatttgtgataactccatatctaataattttcttcttagatttggtgcctctttaataacttttaaatcttctggtgaaaacattacaacattaaacgttccaaataactcacctattttagcaacttttatggaattaaccttaatagctttcttaccatctcttagaatatttatatctattcttttatcaagtctatcttttcctacaagtaaactgatatatgccttgtcatttttccaatttattaattctctatctttagatgttctatgagatttagcaaatgcacaatagtaaatagcctcaagtacattagtctttccttgagcattatcaccaatgaaaacattaacgtttttacttaattcaagtgataaagtctcatagtttctatagttagctaacattatatttttaatatacataaaaaatacacctataataattatatcataataataaaataagagtttattttaatttttagattgttaaatcatctaaccattattcctaagttctatgataacagaaaataacctttgaatacagttttataaatttaacaatctattcttaaaaaaaattcttatattatttcataatcaacaccatcaaaatttacaatatcaccagcttttaattttttaccacgctgagtgcaaatttcattgttgacctttaccatttcatcttgtatataaaattttgcttctgaaccagaacttgcaatagcagcccattttaaaaaagcatctaattttataatttcagtttcaatctttattttattcattttttctgcataaatattaattaaaatatttatcctccttatctcataagtctaactggaagtaccaaatacttcgcattttcattattattttcctctataacgcacggactaatacctgatgtcatttttaaaacaacttcatcctcttccatatttttcaatacatctaatagatatcttgaattaaatgcaatttgtatttcatcaccttgcaatttcatagatatttcttctcttacttttcccaattgagaattagatgagataatcaagttgtcttgttgtatgtcaagtttaattaaattcgtattcccatctttagccattaaagatgctctttctattgaattttgaagttcttgtctatttacatgaacagataatttatgttcttgaggtaacagagaattataatttataaacttaccttctaataatcttgatattattttagttttctctaaattaaataaaatatgattatttgtaaatgtaatatccacaatatcttcaacatcttcaagtattttagaaacttcattcaaagtttttcctggtattacaacttctatttctatatcactatctaaaaattcactttttatagctaatctatatccatctaatgcaactaaatttaaatttttgtttttaacttcaaataaaatcccctgaagtattggtctagtctcatcttgagctattgcaaaagatgtaccttttatcatattttttaatatattttgattaactgaaatctttaaatcttcatttatctcaggtagttctgggaattcattcgtattcatataaactacgtcaaatactgatttttcacaagtaattcttataacttgattttcaatagtttctatttttattgttgagtttggaagttttctaattatttcaccaaatattttagcatcaataactatacttcctggctctataatattggcatttacagtagtttgaatactaacatccatatctgatcctatcaatgttaatgatgaatctagttcattagtctttatgtatacaccttctaatataggcattgttgatttaccagtaatagctttttgaactattgagataccttctaatatttcttgtttttcacatgtaaaaatcatttaagttcctccttatttatacacaggtattttgcgtaagaatagagatagatatatataaatttatagtaataatagtagtaggtgctgttaattctgttgataaccatctcaacaatagatatatcaacaaaattgcatgggaaaagattgtggataagttggtgacaaatacacctagttatccacaaattccacagggctattgttgaaaaattattatccacaagttattagatagttattatatacaacttgtggattaattttgagttaattttttcgttatatcgttaactgtatgttgcagcgaatcatcagtttttagattctctgatattttttcatatgcatgtatgactgttgtatgatctcttccaccaaactcttcgcctattttaggaagggacatgtcagtaagctttctacttaaatacattgcaatttgtcttggatgagcaacatttctagttcttctttgagattttaaatcttctacacgcaagttaaagtagcttgataccacatcctgaataagatcaatggttatatgctttccttgctttttcgatataatatcttttaatgcttcagttgctaaatcaacagtaacatctctgttagttaatgaagaatatgcaattattctgattagagcaccttcgagttctcttatgtttgattttattttggtagctatgtatcccattacttcattcgccacatttaaattttcaacatcagcttttttcttaagaattgccattcttgtttcaaagtctggaacttgtatatcagctattagtccccattcaaatctagatcttaatctgtcttctaatgttggaatttcttttggcggtctatcagatgaaagtataatttgcttattagcatcatgaagagcattaaatgtatggaaaaattcttcctgagtacgttctttgcctgcaataaactgaatatcatctataagaagtacatcaacatttctatatttatttctgaaatcttcatttttatcatccttaatagcattaattaattcatttgtgaatttttctgatgacacatagactactttagcactaggattattatctaaaatataatgtcctatagcatgcattaaatgtgtttttccaagtccaactccaccatatataaataaaggattgtaggctttcgcaggggattctgctacagctaaggaagcagcatgagcaaatctattactattacctattacgaatgaattaaaagtgtactttggatttaatgttgatgacatttcatcatttactacgatggattttgatgctgaattagaagaagtctcttttaaatcttccttttcagaagcctcagatgctattacgaattcgattttatataattttgagcagactacttctattgaattagcaactaaatctttataccttttatctaatatatcttgagtaaaagaattaggaacgcttatcgttatagtgtcagaagatatagaaatcggctcacaacttttaatccatgtattaaagctaacctcgcttaattcactttttatagtttctaaagtttttgcccatatattttttagatccgcatccatgtatctgtattcctccatatatctaataaaaaatttttattaatattatgtacatcttatcaacaaatatatcaacagttttaaattataccctaatatgtatataaatatatcaacatgttaataattatgtgtatagagttatgttgaaaaaaattagtaacaacacgaaaaattaaattataaacagtgataaacccaggatttatcacattctagatataatttaattgaaaagaataaacaagttatacacaactttatccacaactgtggataaactatgttttaaataagttattcacaatatacacatatgatatcataagtaaatatggttattcaataagttatccacaaaaaaattacatgttgataattttatcaacaaataatggacactttacagaccttgacagaaatttatgttgtatatataatagaaaagtaaaatttaaaatcatgaagtatagtttttgctataaataatatatttaagggggtgcatgtgtaatgttcatgacatatcaacctaaaaaaagacaaagaaaaaaagaacatggcttcagaaaaagaatgagtactgcatcaggaagaaacattcttaagaacagaagacaaaaaggaagaaaaaaattaacagcataagggccgcatttagtggccttttttctgcaaatggcggaaaaaaggggttttaatatctatgatttatagattaaaaaaaaattttgaatttaaatttgtatatagaagaggcaaatcttttgccaatgaacttctagttatgtatatattaaaaaataaaaggaataaagataaagaaaataatctttataataaattaggtgtttctgtaagtaaaaaagttggaaacagtgttgttagaagtagatcaaagagattaataagcgaaagttttagattaaattgcaattatatattaaaaggatacgattttatttttatagctagaaatcctatcgtagacaaaaattattttgacgtagaaaaatctatgataaatttaattaaaaaggcaggcttatatattaatgaagaaactactaataagtctaattaatttttatagaaaatttatttcaccagggagaccttcgtgctgtaaatacaggcctacatgttctcaatatgctttagatgctataaataaatatggtgcatttagaggaagtattatggcagtttacagaattttaagatgtaatcccttttctaaaggtggatatgacccagtaaaataaatgaataggaggaatagttttttatgtttcaagcgatagttgattttatgcgaaacatatttgattactttcataacgtaatcgttggcatgggtgtaactgatctaggtctatcgtatgttttagcaatacttgcttttacagtagcagtaagactattaatattaccatttaatatcaaagctgcaaaatccactagaggaatgcagaaaattcaacctgaaattaagaaaattcaggataaatacaaaagtgatcctcaaaaaatgaatacagaggtaatgaaattatataaagataataatgtaagtatggtagggggatgccttccaacattattaccactaccaatattaatggctttatattgggtgtttatgggtattaatttaccagagggtcaagttgcatcattcttatggataaaagatgtatttgcaccagatccatactatatattagctatagtagcagctttatctacatatttaccttcttatttaatgacaaaggctacaccacagcagccaggtggaatgagtatgggaactatgaatttgatgatggctggtatgatgggattcatgtcattaaactttaaggcgatactagttttatattggattatgggtaacctaattcaagctgttcaaacttacttcttaaactatagaccagcggtaaaagataaaatcaaagaagaaacagcagtaaatagacaagaagaaaataagtttgctatggaagttgaagaacctaaaaatttagcaagtaagaaaaagaaaaaaaagaagaagtaatataaatttttatttttaaattttgcttttgaatttagaggtggtgagttaacacatgaaatcaatagaagtagaaggaagaactgttgaagaagcattggataaagctttaaatgaattatgtttaactaaagacaacgtaactgttgaagttttagaacatggctcaaagggattgttcaatgtcataggagttaaacgcgctaagattaaagttacaagtaaatatgactatattgaggaagctagaaaattcataagtactattcttaatagcatggaattaagtgctgaaataaatattgttgaagaaaatgatactttaaaaatcaatttaagcggtaagaatatggggcttataattggctatagaggagaaacattagattctatacaatatttagtttcattagtagttaataaaaattatgaacttcctcataaaaaagttatattagatactgaaaattatagaagcaaaagagaagaaactcttaagggtgttgcacttaaaagtgcatcaagagtaaaaaagagtggtaaagcatataagcttgagccaatgaacccttatgagagaagaattattcactctgctcttcaaaataactctgatgttaagacatacagtgaaggagaagagccatttagacgagtagttatagaattaaacagaaatatttaaagagaaagcctgaacgggctttctctttttataggcaattaaaaattgtactttaaattaatgcaatatatttttgactaattaaattttgttatgtaaaattgatattagttcaaactggatatactaataataaaagcttctttttaaggaggatactagatgagagaatttgatactatttgtgctatagcaactccaattggagaaggaggaattgctataataagaatttccggggaaaaagccctagaaattgctgacaagatttttgctccaaagagcaaaaaagatataaaagatatgaaaacatacactatgagatatggaacaatagtggatttagacactaaagatataattgatgatgttattctaagttatatgaaaggacctagaagttatacaggagaaaatgtaatagaagttaattgtcatggtggagttgttgctactaacagagttttaaatcagatagttaaagctggagcaaggatagctgaaccaggagagtttactaaaagagcatttttaaacggaagaatagatttaagtcaagcagaagcaacaatggatattataaaggccaaaactgaattatctatgaagtcagctatgatgcagagtaaaggtgcactttcaaaagaaattggagaattgagaaaatatcttttaaatgtattagcattaatcgaatatgctgtggactttacagaagatgatgaagatatagttgatgatgatttaattgctcagattaaagacagtataactaagactattacaagaattaattcattattaaaaaatgcagatgaaggaaaaataataagagatggtcttaatattgttattgtaggaaaacctaatgtaggtaaatcatctttacttaattcgctattaagagaaaagagagcaatagtaacagatatacctggaactacaagagatataattgaggaatatataaatttagatggaataccgataaagattacagatacagctggtattagagacacagaagatactgtagaaaaaattggtgttgaaagatcaaaggaaaagattgaagaagcagatttagttatattaatgctagatacatctagagctttagatgatgaagatagggttataatagatgcaattaatgataaaaagtatatagcgttgctaaataaagtagatttagaatgtaagttatcagaagaagttattacaagtttaaacagaacaatagagatatctgcaaaaacaggattcggaattgaaaacttaaaagaagaaataaagaatcttttctttaatggagaaattgattctgaaagcttaataatttcaaatacgagacataaacaggcgttatacagatccttagaagattgtaatttagcattagaaaagattaatttgaatgaatatctagatttaatatcaatctatataacatcagctatgagggctttaggtgaaataactggtgatgaattagaggaagatttattaaataaaattttcagtgaattttgttgtggaaagtaggtaaagaaaaaatggcagtaaattatgaagctggacaatttgatgtcattgtagttggagctgggcatgctggttgtgaagcagcactggcttctgctagaatggggttaaacacattagtttgtacaataaatttagattcaattgcattaatgccttgtaatcctaatataggtggtacagctaaaggacatttagttagagaaatagatgctttgggcggagaaatgggagttaatattgaccatacatttattcaatctagaatgcttaatacatctaaaggacctgcagtacattcattaagagctcaggcagataaaaaggattatcaatttagaatgaagaaggttctagaagaacaagataatttaaagataagacaaatagaagttacagaattaatagttgaagacggcaaagtgagcggtgtagtaactaaaaatggtgctgtatttaagtgtaaagcagtagttttagcaacaggtacatatttaaaaggaaaaataataattggagaagtatcatatagcggaggaccaaatggattattccctgctaatgatttatcacaatcattattagatttaggaatttcgttaagaagatttaagactggtacaccagcaagaataaatagtaaatcagtagatttttctaagatgatagaacaaaatggtgatgataaaatagttccattttcatttatgagtggaaaactacagaaggaacaggttgcatgttacttaacgtataccaatgaagaaactcacaatattataagagaaaatataaatagatctccgatttataatggaagcattaaaggggttggacctagatattgtccatctattgaagataaagtaatgagatttcctgataaaactcaacatcagatatttgttgagccagagggtatggatactttagaaatgtatgttggaggattctcttcatcacttcctgaagaagtacaaataaaaatgcttagaactcttccagggctagaaaatgttgaaatgatgagaactgcatatgcaatagaatatgattcaattgatcctactcaacttaaaccaacattagaatttaaaaatattgatggattatatggtgctggacaattaaacggaagttctggatacgaagaagcaggagctcaaggattagttgcgggtgttaatgcagcacttaaaataaaaaatcaagaacctttaattttaactcgttcagatgcttatataggagtacttatagatgatttagttactaaaggaactaatgagccatatagaatgatgacttcgagagcagagtatagattgctactaagacaagataatgctgatttaagattaactgaaatgggtcatagagttggattagttacagaagaaagatataatacatttttaactagaaagaaaaatatcgaagatgaattagaaagactaaagacattgaaagttacaaataagaaggaagtaaatgaatttttagtatcaataaattcaactcctttaagaaaagctattagtttttatgaattaatgcagagaccagaattagagtattttcagttagcacaattagatcctgaaagaccggatttatcagatgatattggtgaacaaatcaatgttcttactaagtatgaaggatatatacaaagtcaaatggaacaagttagtcaatttaaaaagtttgaaaaaaaattgttacctaaagacatagattataatgatgtaagtggattaagaactgaagcagtacaaaagttatctaatataaaaccaataagtatagggcaggcatcacgtatatctggtgtttcaccagctgatatatcagttttacttatatacttagaacatcaatatggaaagcaatcttaaggaccagtggaggttaatttatggaattttttaatttaatggctaaggcagcagaagatgttggattgcagctatcagaacaacaatatgagagatttatgaaatatatgagactgcttcaggaatggaatgaaaagattaatttaactgcaattactgaagatgaagaagttgtaaaaaaacattttatagattgtataaaggcatttaagagagatgagtttaaaaaagcagaaacattgatagatgttggaacaggggcaggatttcctggattaccaattgctattatgagagaagatttaaaagtaactttattggattcattaaataaaagaattaattttttaaatacagtagttcaagaattagggttgaaaaatgtaacaacaattcattctagggctgaagatggagccagaaacaaggatttaagggagcagtttgatatatcaacatctagagctgttgctaatatgagtgtattatcagagttttgtttaccttatgtaaagattggtggtaattttattgctttaaaaggaccttctgtagaacaagaaatacaagagagtagaaatgctatcggaactcttggtggccagcttgttgatatatgtgaggttaatatagaggaaacagaattaaaacataatcttgttgttgtaaaaaaaataaaaccatgtgaaaaaatttaccctagaaaagcaggtacaataacaaaaaaaccaataaaataacatataaaaaatgttattttagaaaatataaaaaggaaaattgtagctgtagtagaataaatatgttagtaaataattaatttttagtattttaatgagggatgggttagaacatgaataatgaaataatacagatagatatagataaagtgattcccaatatatatcaaccacgtaaatattttaatgaagagtctattgaagaattatccgagtcaattaaacaatatggaataattcagccacttacagtcagaaaaagaggggatgtttacgaattagttgcaggtgaaagaagacttagagcagctaaattggctaatttaaataaggttccttgtaatatagtagacataacagatgcagagtctgctgaaattgcactattagaaaatttacagagagaagatttaaattatattgaagaagcagaagcatattataatttaatacatgatcatagttttactcaggatgagttagcaaaaaggatgggaaaaaaacagtctacaattgctaataagttaagattattaaaattaagtactgaagttagaggaatatgcttaaataataaattaacagaaagacatgctcgatcactacttactcttccaaatgaagagttacaactaaaaataattaaaaaagtaataaatgacggattaaatgtaaaaaagacagaggaattaataaataaagaattacttaaaatttctagcgaagaattaaagaaaaagagaaaaaataccaaaaatgtacttccagcaaaattatatgttaacactataaagcaggtttttgaaaaattcgatataccagcagagtatggatataaagatgaagaggaatttttagagctaacaataaagattccaaaaccaaagaaatagatgattttatttttataaggcacagaattgtgccttaattttttctcataaaaatgaataatatttttattgtgaaatacaatatattttttaaccaatttaagactatttattcttttttataacataattcttttattatgggacaaatatatatataatattaatatatgggaaggggggaatgctctttttgggcttataattatgaagacgatatgtattttcaatcaaaaaggtggagttggaaaaactactactaatataaatttatgctcttatttagcaatggaaggtttcaaagttttaacaatagacatagatccacaagggaacacaacaagtggattaggtatagataagaacaacttagattgttctatatatgatgtattgatttctgatgtttctatgaaagaatcaatagtacaaagtgatttagttaataacttatttatatctccatcaacaatggaattagctggggcagaagttgaattaattaataaaagtgacagagaaaatattatgaaaaacaagctaaaggaaatagaagatgaatatgattatgtattcatagattgcccaccgtcattaggtgtattaactataaatgcgctgacttgtgctgattcagttttaattcctatgcaatgtgagttttacgcgctagaaggtgtaagccaattaatgaatactgtacaattagttaagaaatccttaaataagaagctcgaaattgagggggttcttatgactatgtttgattatagaactaaccttagtaatgaagttttaaaggaagttcagaaatattttaaggacaaagtgtataaaactacaatagcacgaaatataagattagcagaagcaccgagctttggattaccgatagttttgtatgataataagtgtaagggtgctgaagcatatactaacttaaccaaagaattcttaaaaagacagtaggtgaagtaaaaggatgggaaagaaatttgctttaggtaagggattaagtgcgcttattcctgaagatttagtagaatcagaacaacaggatgaaaaagggaagatgctaattcctttaaatgaaataagaaatgataataatcagcctagaaaagcatttgataatgataagatagctgaattaacagaatctataaaaactcatggaataattcaacctcttatccttaggaaatcagatgatggactttatgtaattgttgcaggagaaagacgttggagagcggctaagatggcagggttaaaagatgtaccagcaatagttatggagctcagcgaaaaggatgtattagaaatttctttaatagagaatatacaaagacaagatttaaatccaatagaagaagcgtcagcttacaaaaaattattgagtgattttaatttaactcaggaagatttaagtaagcgaataggtaaatcacgaacggctattactaatacaatgaggttaatgaatctagatataagagttcaacagtatataattgaaggaattattactgagggacacggaagagcacttctcggaataaaagataaagagattcaatatgaattatctcaaaaagttattgatgaaaatttatctgtaagagaattggaaagattggtaaaaagaatacttgaaggcaaaacttcagaagaaaaagaaacaaataatgaattaaatccttattataaggaaataaaaaatcaacttcaaagttattttggaacaaaagtaaatatatctaataaaaataataaaggtaaaatagaaattgaatattattcagaagatgatttgcaaagaatattagatattattgatatttaatgtttcacgtgaaacaattatgaaaggaatgacagtaaattggaagcattaattaattcgattaatgaatttatgccatatattataataggaatggcagtaataatagtattattatttataataattttatttttatttaaaactattggtaaagttgaagataagtatagaaggcttatgaaaggaactaatagtaagaatctagaagaaatgctgttagaaagaatagagagtgtagaagaagtaaaagaaatatctgaaaaagcaatcaaggaatgtgagagattagaagttaaaatggaagagtgcatacaaaaggttgctataatgagatataaagcttttgaagatgttggaagtgatttgagtttctcaattgcattattagatgacaaaaatgacggtgttatattaactggaatatatggaagacaagaaagtacaacttatgcaaaaccagttgataaaggaatttcaagatatgacctttcagaagaagaattatatgtattaaatgaagcttgtaataaatatgaagttaataaaaagaagaagtaagtatgaaaatatacttacttcttcttttttaataatattattagaagatattatttataatattgttagtttatacattacgattcaaatttatataagttctaattattttgtaatgaaaaaacataaatagtttacataactttatttaaattgtttcacgtgaaacaatttaaatatgaaaaatataaaatggttaatgtagagaaataatgttatcagaagttgtatctttattatcaagtgcaaaatggtaaatacctctagaaatagaatctgccagattcattactgtataaagtctagtattttgtaaaactaaaaattcaaaacttccagaaatattaacaattccagttatattcatctcaccaatagggggaagatccttgtttaaagctaatccagggtgtaaaggacctttttttataaatatttttccgatgttagttaatgatcccaaacaagaatcaattgcaataatataaggatttgaaaagtagcagcttattttttctagaatattagaaagattttttgcatggactgggttttctaaagtcccatagatataaatattatcaactgaaagatgttttaatttatatccaataataggacctaatgaatctccggtagatctatccgtaccgatgcacaaaattacaatggggcggttgttaactattgatttcaattcttttgttaagtattcttttatttttatataagcagttggtaaagatgaatcaacagaaaaattatcacacatataataaacctcctttattagatttatttccaataaaggaggttttattcaaataactatttatttagtgatattttatttaaagtttttagtgtaaagtcaatttcttcttttttattgaaatagctaacacttaatctcacggtaccacttggataacttccgatggttttatgagctaatggagcacaatgaagaccacatcgtgtttttataccactattttctagtaaataaccaagctcagaggaatccaaagatttcatatttattgaaatacaagtagttatgtttttaccagttgaatcaccgtaaattattatatcttttatattttgtagaccatctagtaaataatttataagataatgattatgttcatatattgtttttaatcctgtagaatttatgaattttataccttctgatagaccaacaatacctggcatattatgagttccgcattcaaatttatcaggaagaaaatcaggttgatctaaagaataggataagcttcctgttccgccatgtaatatacttttacaagagtcgtttaatttgtcatcaattatgaatcctccgattccttgaggcccaagaaggcttttatgtccggtaaaagcaatagcgttagcatttacagaatttatgttaagttctagaacaccagctccttgtgatgaatctacaataaaaaatacatttttttctttacagattttaccgacttcggctatattctgaattgatccagttacatttgaagcttgggtcaatactactaattttgtatcagatgttattttagatctaaaatctgaaacgttaataaatccaaattcatcagcatcaattatatcgagatttatatttaatagttctttacagtttataagaggacgtaaaacggaattgtgttccatagaagatgttagaacgtggtctccttgcttaattagtccttttattaacatatttaatgaagttgtaacgttgtttgtaaaaataacattactaggtgacgaaaaaccaaaaaagtcacttacaatttcacgtgcttcatataaaaatcgattactttgaagagtatttgtataattacctcttccggcattaccaccaacatttaacatgtagttatacataccatcaattacttgctttggttttggaaaggtggtagaagaattatctaaataaacgtccatatttgttcacctctaaagttaattatcaatatacaatcattatataaaaaagattattttataaatttaaatattcctaaaataatgaaagatattccgagaatcattaaaaaataatttaataattttgatgttgttttagtgtaatcagattttaattttcgaacacctttacttactaatatgttgagtaagcaaaaccaagttatacttccaatcatcattgaagataccgatgttaaaaaatatattcttccatgatatctccaaacactcaaaacagtagtacttagtgcaatccataaagaaggtgttgttggatttacaaaagtaattaaaaaaccagtcacaaatccatttgatgtatatttatttaatagatttttagagtcagttttctttttgctatctgtgaatgacagacgattaaatagaattagaatgactcctgatacaatccaaaatatactttgaaaattacgatgcttgctcaataatgtaaataaacctaaatttataataactatatataaaagatcagcagaaacagcacctaaagatactttgaacccttccctgaatcctttagacattgacctgttaacagattcaagaccagaaggacctaagggaattgaggctgtaaatcctgtaagaaatcctatgaatatagctttgcatatagtcaataatgaaaacatatcatactcctttattctctctatctatataattataagataaaggatagatattttcattaattaatagaaaatattttaattgtaataactttataaacttataaaaacatatataatataaattatagtgtgaaaggtggtggcagtatatgaattactatattgtggtttttaaaaatacacatgatgccatgtcagcagaaaaaaagttaaatgaattaaattacaaattcagaataatgccgactccaacgtcgataactatgagctgtggtatatgtgtaagaatggatgataaggaacatatcgattcaatattaaagaataatataatagagtataagaatatctattttaaggaagaaaacggatatattgttgttgagtagtaatattgagaggagagcagtaagtgcatggtataaattatctagtacatttgtcattagataagactgagcttgaaataggaaaagtaattataagtcttgaagattttgaggtagtgtttaataagggtataaaaattatctcaatagtaattattatgtatttatcaataaagataggaaaatacttaataaaaaaagcagtagataaacaagtgaagagtaatgccgcattatcattagatccacaaagagctaaaacccttggtggggttatgaaaagtatattaaagtattctgtatattttttaggaattacaagtattttgtcagtgctctttggtggaatatcctttacctttgcaagcataggtggagttgcattgggacttggatctcaaagtttgataaaggattttatcaatggattttttatattatttgaggaccaatttggtattggggattatgttacaataggaaatttcagtggaattgttcaaacaataggaataaggactactattataaaagattttacaggtgatattcattcaattcctaatggtatgatttcagaagtaactaatcattcaaggggtaatacacgatttatagttgatgttgatatagcttatgaagaagatatagataatgctataaatgctataaaagaatgctgcgataaatttcaaaaagaacatgaagattttattaatgaacctatagaagtatcaggggtatcagcattagctgcttctagtgttacaataagaacagttggaagaacgaaaccattaactcaatggaagatggaaaatgagcttaggaaagcaataaaaataacattagacgaaaatgggatagaaataccatatccaaaaactcaattaataaatattaattctgataagggggaattttaatggtagagaattttaatcttggagatatagtacaaatgaaaaagcaacatccatgtggtacttatgaatttgaaataatcagagttggcgctgatataaaaattaaatgtaccggatgtggaagaattgtaatgattcctagaagtaaatttgtaaaaggtgcaaaaaaaatagtagttgaagcagaaaaataaaataattacttgaaattttttgaattaaatgatataatcataaattgtaatccctgccgtgcaaagcatggccgttagtccgaggggaggaggtgaaattgatgagaaaatacgaaactatattcatattaaacccatcattcgatgaagaaactgttaaagctaacatcgaaaagtttaagggtgttatagaaaatggtggaggtacagtagaaaacgttgatttttggggtaagagaaagcttgcttacgaaatcgcaaaagtaaacgaaggttactatacattagttaactttactgctggtacagaattacctagagaattagatagaatattcagaatcactgatggtgttatcagacatatcatcgttaatgaacaagcgtaaggcggtgttgtaaatgaacaaagtagttttaatcggaagattaactaaagatccagaactaaggtttacgccaggaactggagctgcagtaacgactttaacattagcagttgataggtataacccaaagactggccagaatgaagctgattttattcctgtagtaatatggggtaaacaggctgaaagtactgcaaattacatgagtaagggtggccaagtggctatcagcggtagaattcaaaccagaagttatgatgctaaagacggaactaagagatatgttactgaagtagtagcagatcaatttggtggagttcaattccttggaagcaagggaagtaattcatcaaacaatagttttggcgcaagcaatgaatattcagcaccaacaaatgatatatttggtggtggaaactttgaagaggatataactcctgttgatgacggagatatgcctttctaagaaattttttaggtgaggagggaaagaaatgagcagagaagaaaacaacaatagaagaccaggcggtagaatgagaagatctagaaagaaagtttgtgctttctgtgtagataaagctgaattcatcgattacaaagatataaataagttaagaaagtatgttactgaaagaggtaagatacttccaagaagaatctctggaacatgtgctaagcaccaaagagaattaacaacttcaatcaagagagctagaaacatagcattattaccatttacaactgagtaatagtaataatttgagaagctgtcgcactaatagtcataagctattagtgcgacagttttatttatatgtaaaaatataatataatgagttttagactaaactcaaaattattgatgaaaaaataaattattgatataatagtttatttttattataaaaaataagtattatacttacaaaatgtggtaaaatatagaaggaaattataaattcttgcaataaggatgaaaaaaaattacaataagaatacgagggttaagagggagaggggatatgtctatgaaaaaggataattttaatataatgaaaaacattaaaattatagaagacttgaaggcacaacttctttgtataataggagagtttttcagattacttactaagggtaataatgtagctaaagatgctatattggagtgtgtttcaggtgctataataattttatatgtattaggtgaaaaacttggatatccatttgaagacatagataaaactatgaaaacaaagttagacttaggaatcagagcagaggatcaagttgaaaaggaaggtaagagtttaagtagactaaaacgttatattagtggtaatagaacagactagggatgtcttaggaggcttttatggataaagtaactatgcttaaacgtttgcttaagcctggattattaattataacttcaataatattaatttcatttaatcatatattagctggaataattttattaatttttcattgtattgataacttttatacattgaattcattttggactaaagaagatgatataaattatttttcaaaaactcttgataaggggattgaggataatgttcttcaatttatatatcctttatcattaattagagaagatggagaaataatttggtgcaataaattatttaatactttgcagcctaatgaaaatgctttaggaaataatattttaagtatagcaagaggattaaatttagaaggaacattaaccaatgaatataatcatcaaagattaaatattaataataaattatatgatgtatatgcaactgtaattgaaaaagaagaaaatgaatatgtatatttattatcatttaatgatataacaaagcttatagattatgaaaagactcaagagggtattatgctaatagaagttgataatctttcagaagtattaggaaagactgatgaaagtaataaacctcttttagttgcagaaatcgagagaacaataaagtattatgcaaataatttaaaagcaatgatagaaaaatatgatacaaataaatacgtcttatcagtacaagataaatatattgaagatgaaattaataaacaatttaaaataatagatgaaatttcaaaaattgattttggaaattcaatagaagttacattaagtattggaataggatgtggaggtatatctccacaggaaaattataatagtgctaaatttgctaaggaattagctcttggtagaggtggcgaccaggtagtagttaaaaatgggaatgatataaaattctttggtggtaatactaaggaaatagaaaaaaggactaaagttaaagcaagagttatagcaagagctttaagcgaacttatttgtgaaagcagtaatgtttatattttaggacataaaaatccagatatggactgcttaggtgcagcaatgggattatcaagtgtggtaaagcaattaggtaagacctgtaatattgtattaaataaagacactaatgcaatagattattatttagaaaaacttaaagataattctaaatataatgatttatttacaagtgtagaatacgctatggaaaatataaataaaaaaacattagtcattattgttgatgttcacaataaaggttatatatgtgaccttccattagtatataaagcggagcgtaaagtaattatagatcaccatagaagaagtccagacatgattgaaaatgatattttgaattatatagaagtatatgcttcttctacttctgaaatggttactgagataattcagtatatggtagacagaccaaatctcactaggattgaagctgaaggacttttagcgggtatctttatggacacaaaaggtttttcttttaaaactggtgtaagaacttttgaagcagcatcatttctaaaatcattgggtgctgatactatagaagttaaaaagatgtttactgatgatttaaatagttatttacaaattgcagatactataaagtcagcagaagtaactaataaagttgctattgcaattactccagaaaacatagatactgtaattgtggctaaagctgctgatgaattactgaatatatcaggtatttccgcaagctttgttttgggaaagatagaaaatgatatatatattagtggaaggtctcttggcgatataaatattcaaattgttttagaatccttaggtggaggcggacatatgaatattgctggggctaaagtatcaaattcaacaatagatgaagttgttactaaattaaaagaattaatagaaaaatacttaaggataggtgaataattatgaaggttattttattacaagacgttaaaaaaattggtaagaagggtgaagttatagaagcttcagatggatatgcaagaaactttttatttccaaggaaattagctgaagaggcaacagcttcaaacttacacattttaaataataaaaaagaaaatgaaagaaaacaaaaattagctgaattagaagcagctcaaaaattagcaggtgaattaaaaggtaaagaaataaagattactgctaagactggtgaaaatggaaagttatttggagcaataacaagtaaagatattgcaggattaataaaggaacaatataaagtagaagtagataaaaagaaaatagttatggatacaataaaagtagctggtggatatgaaattgatgttaagttatatcctgaagtaagcacaaagatgaaggtaattattgtgccacaagcataaggaggattaaatttgaattcatatgaaaactctaatatattagaagaggttatttcaagtaatttatctcttgagtcaaaaatagatgcattgtatggaataacaaaaaatgttcttgataaaggggcatttagagcaagaactataagatttaaattagataagtatatacagtcatcaaacccttgtgacagaatttttgcattaaatacaatactttcagaaggtaagggattaaaagttgtacctaaagaagatgatttagaaaaatgtgttgaagaaacaataggtcttatttctgatgagttggcaaagaaatatgttcagaataaaattgaagctcaagttgagcagtccataatggaaaagcaggaaaagtatatagatgaagtaagactttctgttattaacaagcaaaagggtgttgaaaacaaaaaaactcttggaaaattaaataatttaattgagttagatagcaaagttacaagtaaaaatataatgagctttttaagacctcaggagtttagtcaggtaataggtcaggatagagcgataaaatctttgatatcaaagctttcttcgccatatcctcaacatataattctttatggacctccaggagttggaaagactacagctgcaagacttgctcttgataaggttaaggaaattccgtttactccatttgatgacaaatcaaaatttgttgaagttgatggaacaacactgagatgggatccaagagaaataacaaatccattacttggttcagttcatgatccaatatatcaaggaagtaaaagagatttagctgaaataggtataccagagcctaagccaggactagttactgaggctcatggaggagtgttatttatagatgaaattggagaactagattcaatgcttcaaaacaaattattaaaagttttagaagataagagagttgaattctcgtcatcttattatgatccagatgatgaaatgataccgaaatatataaagtatttatttgataatggagctccagcagattttgtattaataggagctacaactagaagccctagtgaaataaatccagcattaagatcaagatgtacagaagtttattttgaaccactttcatcaaaggatatatcagctataatttatgatgcagctaaaaaattgaatgttaaattagaagatggagttgctgaaaaaataagtagctatacatttgaaggaagaaaggctattaatatgcttacggatgcatatggatatgcattacattcatgcgagaattcagaaaaagatttagaaataaaattatctcatttagatgaaatcatatcaattggaagatatactccttttgaaagattaaaagatatgagtaaaagagaaataggtcatgtttatgggcttggtgtaagtggattcttaggatctacaattgaaatagaagcagctgtttttccagcaaagaaaaagggtgcaggagtagttagatttaatgatacagcaggttctatggcaaaggattctgtatttaatgcagcatcagtaataagaagcttaacagataaagatatcaaagattacgatattcatgttaatgttattggtggaggaaaaattgatggtccttcagctggtgcagctattacaacatgtataataagtgcattattaaagaaacctttaaggcaggacatagcaattactggagaaatatctcttcaaggtaaaattagacctgttggaggtatttttgaaaagatatatggtgcaaagagaatgggaataaatcttgttttaattccaaaagaaaatgaacatgaaattccattaaacaatacagatatccaagtaaaaacagtagaaacaatagaagaacttatggatattgcatttaattagataggaaatgcacaacctgcaatttactaatgtttattggttggtgtgcatttttctttttgttttcaaataacagattttataatataatttttagtattgataataattaagaatgggaggaggaaaaattttggatgcaccagttatgagaagtctgcctcaaagtatagaagcagaacagtcagtaataggttccatgataatcgataaaaatgctattgcaaaggttctggaaagcctaaatgaagaagatttttatagagatggacataaagtcatatataaagcaatattagaaatgtttagaaatgatatggctgtagacttggtcactcttttagaatatttaaaaagtacagaaatgctcgaaagagcaggtggtgtaacatacataacagaggtaagttcatctgtaccatctactgctaatttaagttcatatataaaaattgtttcagataaatcaacattaagaaaacttattaaagcatctactacaatcatagaagagagttataacaatcaaagtaatgtagaaaatgtggtagatgtagctgaaaagaaaatatttaacatagctgaaaatagaacttcgaaggactttgaatctttaggtgatgtacttgaaagaggtttcatgcagatagagaaactttttaataataaaggtgaagttacaggagttccgtcagggtttactgatttagatgctaaaacatcaggatttcagagcggtgacatggtgcttatagcggcaagaccatctatgggaaaaactacatttgctttaaatatagctgaacatgtagcacttagagaacataagagtgtagtaatattttcactggaaatgtctaaggagcagttagcttataagcttctttgttctgaagctaatgttgatatgttaaagcttagaacaggagctttagatgatcaggattgggaaaacatagctatggcaagtggtcctctttcgaaagctaagatttacatagatgatactgctggtgttactgttatggagatgagatcaaaatgcagaagattaaaaatggagtacggaattgatcttattgttatagactacttgcagcttatgtctggaggagcaaattcagatggtaacagacaacaagaagtatcagaaatttctagatctattaaggctttagcaaaggaaatggagtgtcctgtaatagcattatcacagctatcccgtgcacctgaacagagagctgaccatagaccaatgttatcagaccttagagaatctggatcaatagagcaggatgctgatattgttatgttcttgtatagagatgaatattataataaagaaacagaagataagaatattggtgaatgtattatggctaagcagagaaatggtccagttggtactgttaaattagcatggcttggacaattcagtaaatttggtaatttagatgttgttcacaatgaataaaaaattattgtttatagatataagaaatatttaaataaatatttcttatatctaaatttatttataaactataaatggtgcaaccttttagagttttaaaagctattataattaaaaaatcatttaaaaattattaaaatagattttaggaatttttagtgataaactatcattatagtaaacatgtgaaatcttgtttatatttacattaggtaaataaaataattttgtagctaaggtttttactgaagaatctctatgtttgatttgtaatattaaaaagctgtttttgtaatacacttcaaatatattatatttttgataaaatggatctattgttattacataatgatcagaaaattcctttatatcagaaataggaattctttcggattttatatcattacataaaatgttagttatgaaagtatcaagatctgaaattttgttattgtatactatagaagtacaggtcatataaattcctcccttcaactacttatagtttgtgaagttataatccaagctatcctatgattgtagtggtggaaattaaaaatatttatagaaaaacataaaaaatgaattaataacaaaaaatttttaaattgggggctaaagcatgattaaaaaagtaggatttataggatgtggaaatatgggaagttctatggtaggaggattaatcaaatcaggtttcttgaaatctgaagaaataattgtttctacgaaaacagaggcttcttcaaagaaattacgtgatgaatttaaagtggcaacaactttagatagtaaaacagttgcaaaagaaagtgagactataattttagctgttaagccaaatatgtataagtctgtagttgaagaaataaagtctgaattaactgaagataagttaataataacaattgctgcaggtataagtattgaaaatatggaagagtggcttggtgatgatttaaagattataagaacaatgccaaatactccagcacttgtaggtcaggcgatgtcagctgtatgtcctaacaaaaatgtaagtgaggaagaattaaaatattgtataaatatatttgaaagctttggcgaatgtgaagttttagaagaaaaatattttgatggatttatagctgtggctggttcatcacctgcatatgtatttatgtttatagaagcaatggcagatggtgcagttaagcttggaataccaagagcaaaagcgtataaaatggcagctcaaagtgttttaggttcagcaaaaatggtattagaaacaggaaagcatccgggtgaattaaaggatatggtttgttcaccagcaggaactacaattgatgcagtagttgaacttgaaaagcttggatttagaaatagtgtgattcaggctatggataagtgtgcagaaaaatctaagaatatgtagtttgtgaattggtaaaaagtaaggattaaatgaaatacttacaaacatatttttaaagttaaatttataatttactaaataaaaattatttcataatttttatttagttgtggataattaaattgggagcagaaaattaaaatttttctgctccctctatttttatgtggaaaatttgaactttattatattgtggaaaacttaataaaaaaatattgtggataaaattatttttttagaatgtggataagtttttaaatttaaactgtgtataactttagtgaaaaattattgttaataattttaattaatatttatcaactacagttccgatcatagcatgtttaattattttattattttcaagaatttttagttcatttggatgccctacaactacaacaccattaatttttatattgtctgcattgaaatcattatctactactccatattccccatttgctcttaaatattgtaaactatctttaaatttatttaatctatcatttacgtcattgatagtgttaccgttgtagttaatagattttatgcctatagcagaagtatcattttcataagttttgttttgaatttcgtaagttctattttcctcattagatatatctacccagtagaaagttattaagctactatcaattaaagtatttacttgatcataactatatccatcgtcaaatgataatgccatttctaatgttttagaattatctatttcatttaataatttaaaatcatttatagtattttcatagttgacatatggatacaagaagtttaaatgtcttaaaccatatgagctagaaggtctgttgtttatatcattatccaatgatgggaacggtttagaaatcaagtaactgtcatgaatgaagctatttttatttaatccgccaagagtatttgttatattagcgagaagaagtctacttcctattgtttttgaaatatcatacgtactttgaaacttaaaatatcctgtttcaagatagttttgatgtgtaatgtattcatttgggtatttaatttgatattccatggttttaatatttaaatctttataaaattgtgattttatatatttatcacttaaaaatgttaatcctaaattacctaaaaagataatgagtagagtagaaataaaggttataagaataatttttaaatttaatttttttctgcttttttttactgttctttttaatgtatcttcaaattcatttgaaaacacatcatcaatttcattactcatatttttcacactcccagatttttttaaatttgtttctagcacgataacataatgtttttgcagaagtttcatttatatttagtaatttgctgatattaaaataagacaatccaaggttgtattttaatatcagtaggtttttttcactttcattcatttttgatagtatatggttgatatctaaagacatatcaatattagatatttgaaaatccgttttcaaatttgaacatagttcatcagttagagaaatacttgtcttactttttttatataatgtatagaatttattaagtgaaactttaaacatccatgcttttaaattgccatctattaaaacatctatattctcatatgtcttaacaaaggtttcttgtattatatcttcagcatcttcttttgaagctcctattgaaattaaatatttaaaaattaaggacataaatccctttattaataagagtgtttcgctattaatatgctttgccccccttcttaagcatatgtgctagtggtaccacgtatatataacaattaactatgtaaaaaggtaaacaaaaaattattatttttttgtatagagtgatattttattaaaaataaaacatcgcacttatgaatagataagcacgatgttttatattattactatgaatttttatagctacattatatttgagctacaccacttttaatagcagcttcttttacagcttctgcaactaatttttgaacttttaaatcaaatgcttttggaattatattttcagcagttaattcactttcagcaatagcatttgaaattgcataagcagcagcaactttcatttcttcatttatttctgatgctctaacatctaatgcacctctgaatactccaggaaatgcaagtacattgttgatttgatttggataatctgaacgtccagtacccataacagcaattcctgcttcttttgcatcttcagggaagatttcaggagttggatttgccatagcgaatattattccatctttattcattgtttttaccatatcttttgaaactatgtttggagcggaaacccctataaatacatcagcgccaaccatagcgtctttaagcattccagtaacattgtgtggattagttatctccgctaattcagccatatatttattatcgctaaaatctttgtctctgcttattacgccatttatatcacacattactatattttttacgccagaagaaagtaataatttacagattgcagtaccagctgaacctgcaccatttataactacattaatattatctaattttttattaactacctttaatgcatttattaatccagataaaacaacaatagcagttccgtgttgatcatcatggaaaactggtatatttaatctttcttttaatttttgttcaacttcaaagcatcttggagctgaaatatcttctagatttattcctccaagagttggagcaatattagcaactgtttcaacaatttgatcaacatttttagtatcaagaactatagggaatgcatctacattaccaaattccttaaatagaacgcttttaccttccattacaggtaaagcagccataggtccgatatctccaagcccaagtactgcagttccatctgaaattacagcaacagtattccatttacgtgtgtatgtataaacctttgatgaatccttgtgtatttcacggcatggttcagcaacaccaggtgtgtaagctaaacttaaatctttagcgttttttacttcgcatgttggtttgatttcgtatttacctctcttttcctcatggaatttcaaagcttcttcataaatattcatagaaaacactccttaatagtttaaatgtatattaatttgaaaataattagcataatatatactcatatacaataattatacgaattatttcataaaaatgcaaaaaaatattcgatatatagttgaccgttgacatggactttgctaatatttaaagggagatataaaaataatttatagataacttaaatataattttatttaattcataataaaatttctaaaatgtttgtcgttaagtagacattttaaattacttatctatgaataactccacaagatacaagattattaaagaaataaagagtatttattttaagggaggcaaaatagatgtcagcatttattgttttaggagctcaatggggcgatgaaggaaaaggtaagatgacagattacttagcagaagaggctaatgttgttgttagattccaagggggaaacaatgctggtcacactgtagtagttggtgacaaagaatataaattgcacttaataccatcagggattttatatgaagataaattaaatgtaataggaaatggagtcgttgttgatccaaaggctttatttgaagaaatagattatttagaaggtgttggagttaaggtaacaccagaaaaattaataataagtgatagagcacaacttataatgccttatcataaagttttagataagcttaaagaacaagcaagagggaaaaatgatataggtactactggtaaaggtataggaccttgttatacagataaatttgaaagatgtggaataagagtatgtgatttaatgcatgaagatgtattcacagaaaaacttaaagaaaacatcgaaatgaaaaatgcttatataactaaagttttaggtggagaacctgtaagttttgatgaaatattaaaagaatacttagagtttgctaagaagttaagaccatttgttcaagatacttcagttagagtttacaatgatattaaggctgataaaacagttttatttgaaggtgctcaaggtatgttattagatatagattacggaacttatccatatgtaacttcatctaatacaactgcaggaggagtagctaatggtgttggtataggaccaaacatgattactaatgcagtaggtattacaaaagcatatactacaagagttggtaaaggaccattcccaacagaattacttgatgaaactggtgactggataagagaaaaaggtcatgaatatggtgtaacaactggaagatcaagaagatgtggttggttagatttagttatagttaaaactgcatgtagagttagtggattaacttcattagctgttactaagatagataccttagctggtttagataagttaagagtttgtgttggatataaatttaatggagaagttattgattacttcccagcaagtttagaagatttagctaagtgcgaacctatatatgaagaatttgaaggctggggagaagaagtagcaaatgcaagaagctacgatgaattaccagaaaatgcaaagaaatacttaaagagaatagaagaatttacagatactaagatatcaatagtttcagtaggacctaagagagatcaaactatgagagtaaaatctctatagtctagtaaagtggtcgggtattgacttttactgtgtcataaaatataattttttgtatacaatattattatgttatgtgcagaagaaggtgaagtacaatgataactaaggatatgacaatcggtgaagtagttcatgcagatgcatctaaagcagaagttttaatgggctttggtatgggatgtgttggatgtccatcagcacaagctgaaacaatagcagaagctgcagcagttcacggaattaatttagacgatttattagaagcattaaataaataatataaaagtaggattttcaaaattgaaaatcctacttttattttttaaaattaaaaatacatgttatttataagattttaaatttgtaatttagatatgtttaaaaatataagattcaatagtgtatcgaattaaaatgctaaaatgtaataatttaattcaaaattatgatttaatatcaattaaatagctgttttattgacgaattgttattggtgtgttattattgataatatattaataataaatcctgagaaaagaaaaagtaggtattattatgttcttaagaaagttagtggttgatgaaaactaatgtacatattttactgaaaatcatcttggaggagtgaagcagaaataaagtaagcttcaacggtatttcaccgttaaaagaaacacatatgtttagtatgtgatacgagagctattaaattatatttttatgctttaaatatgattttatagaagtagggtggtatcgcggatttacttcgtcccttgtttggggggaggtatttttttatgcaaaaaagcatcattgttttaagctgtaaattaaataagatgatgttttaaaataaattcatattagatttagggggctattatattatgaatgcattaaaaaaaataagtaaattattatctaaaaacacatcggtgtttgttattgcagtagcaatagtaactttttttattccagaattatttacatgggttagaggcaccaatcaaacaataatacttggaataataatgtttggaatgggattaacacttactactcaggacttcaaaatattagcacaaagacctttagatatatttataggtgctttagctcaatatacagttatgccactgttggcatatacagttggcactttgctaggattgccaaatgaaattaagattggattagttttggtaggatgttgtccaggtggagtttcatcaaatattatgtcatttttatgtaagggtgatgtccctttttctgttggcatgacaacggcctcaacacttttatcaccaatattaacaccagttttagtattatttttagcaggtgcacaaattgaagttaatgctattggaatgtttaaatcaataattcaatcagtaataattccaatcgtaataggatttactttaaattatttctttggagaaaagagagaatttaaagatatccaagaggttatgccaggggtttctgttacagggcttgcgtttatagttggaggagttatttctttgcaaggtcaaaatttctttaaatcaggagtattgatattcatagcagtattattacacaatggattaggatatttgttaggatatggagttggagttcttacaaaaatgtctacagctaagaaacgtacaatatctattgaagtaggaatgcaaaatgcaggacttgctactaatttagcaacagctcactttgcagctacaccacaagcagcagttgcatgtgcagtatcatgtgtatggcattcaatttcgggaacaatacttgcaggattatatgctaaatttgatgaaaagaaagataagaatcaaatatcagatatagaagccattagtgaataatttttcatattagtatttatattgttgaggattactatttttatagtagtcctttgttttttatggttaatgttgattatttttataagaaattttggagagtaaaataatatattgtaaaaacatttaaactaatggttatatttaacttaagatatatgataatatataatataaggtataaattaacagacagaagggaggagaattgcaaagtttatataaataaagaaatagcttttgcaaaagtatatgactaaagaattcactaaaaattatgagatacattattatgaggtagattcaagactgagatgtaaattatcatcaattattgattttatatgtgatgtgggaactcaacaatcagaatcagttggcggaggaatgaaatattgtacagaaaataattgtgcatgggttttttacaaatacgatataaaaatgagcaaatatcctatgtttggagagactataagtataactacaaagccagtaggtttcaaaaagttttatgggttaagaaaatatattattaaagacagtgaagaaaatataataggtgaagctttagcattattttttcttataaatattgaaaaaagaaggcctacaagaattcagaaggaacaatatgatttttatggagtagatggtgatattgattatgatgtaagtatggagaaattagaaagagttgattatgaagattactcagtagacttccatataagatatagcgatatagactctaataatcatgtcaataatgtaaaatatattgaatgggcaattgaagcagttccaattgaagttgttaaggattatagaataaagagaattaaggttacgtttgaaaaagaaagtagatatggtgagactatatcttcatctgtagcctttaaagaagttaatgaaaatacaataaattcttatcatacaattagaaaagatgatggtactgaattaactttgttagaagctgaatgggaaaaagatactagtttataatgtttaattgtattaaaaacctctatagttgaattttactatagaggttttattaatatatattgaactatttgttttctgaagctgatttaccagcgagatatccagaactccatgcccattgaaggttaaatcccccacagtcaccatgaacatcaagtatttctccgcagaaatatagattattaactagatttgattctaaagtcaaattgttgatttcttttgtattaattccaccaacagtcacttgagcatttccaaacccatttgtatcaatacagttgaaatcccaagttttaaattttgaaataagtttatttatatacttccattcaacattactgcaaggaaggtggatatcttttattcctgaatcctttaataatgtaggaattaactttttatgtatagttcctactaaagcagaagaaatttctctatagctgaacattgaaaaatgacttgaaaaaaagttttctacatcttctttagtttcgcttggaaacatatctattcttattgtaacttttgatttattatttaaagccttggaagcataataagaaagttgtaagattggtggtcctgatatcccataatcagtaaacaagacttctccggtttcagttcggactacttcaccatctattaatatagaaacatttccatcgaattttactccagatattgattttaaataaggataatctaattttaattgaactatacctggaaccatatctgtagtgctgtgtcctaaggattttgctaatttatatccagtaccatcagagccagtcttaacagcagactttccaccacagcttaaaattaattttttacatgaaaaaccatcatattcatcattatttgtagaaagattaaagttttttttcttgcttatagaattaattttacaatttgtatacaaaggaatttgtttatcttcaagtgtcattctaaatatatctactacagatgaggcttgaagtgattttgggtacatttttccattatctaattctgttaaaggcaatcctaatgataaaaataaattttttgtatcttcaactgtaaggttgtttaaagcttctacgaagaaatctttattttcactatgataagtattatatggataagaaattcggttatttgatatattgcatcgtccattaccagttgtaagaatttttttacctattctatctgtgccttcaacaatggctacatctattccaaaatctttagctataatagcagcagttaggccagaagcaccaccgccaacaactattaaatcgtgataaatcattttattgatcactccctattttatttgagtaaaaaaatataaattattttatctccatgaattatttagtaaaagaaaagtttgacttactaatttataaagaaagtattatcttaaaatcattataataatcatctttttatccaataagaaatagaaatatattttttcgttaaataaattttatcatagtaatattaaggttaaaagaaaggaatactaaaatacagaggtgagttaaagtgcaaataaaaattattaatgaaaaatcagaggatttgggaagaacatttaaagttagaaggatgaattataatgaaataatagttaattatccatcaggcaatggattaaaatatttttcatttaaagatgttgaatgtataagagaaaatgatatagatgattttttgataaataatagagactttttaaaaataaaattaaaaaggggaatttcaatagttctttataatgctatttatgattcaatcaaagatgagattgaagaagaaattgaatctttgaatgttttgagagacaaatacaaaataaacaaaagaggaatatgggataaagaaattctagtaaatgtaaacaataggtttcccttggaaatacaggcatcaggacaaaactttaaaagagatggatataatataattatcaataaagtagaaaaagatatttttttggaaatatgcagaactgagatagaaaatttagagaaggaaatagacatgaaaaacaaggttattactagctttagagatgctattactgatgttaaaaacttatatgaagattagttaaaaaagcacttgaaaataagaaaaataagatgaaattaaaaaaaataaaaaaaaattaaaaaatgtgttgacacataaacagaaattctgtattatagtctatgtggtcagcgcgacacagtgcaaaacgcaagagtgtaaagcgaagacaatatagcatggctccttggtcaagcggttaagacaccaccctttcacggtggtaacaggggttcgattcccctaggagtcaccatttaaatttaatatttaaaattatgagaaatcatagaccaaactatcttatgggcgcatagctcagctgggagagcacctgccttacaagcagggggtcacaggttcgagccctgttgtgcccaccatgagatggctcagtagctcagttggttagagtgccggcctgtcacgccggaggtcgagggttcgagccccttctgagtcgccatttaaaatgctggcatggctcaacggtagagcagctgacttgtaatcagcaggttgtaggttcgattcctattgccagctccattttaaatgaagcaacataatattatggctccttggtcaagcggttaagacaccaccctttcacggtggtaacaggggttcgattcccctaggagtcaccatttaaatttaatatttaaaattatgagaaatcatagaccaaactatcttatgggcgcatagctcagctgggagagcacctgccttacaagcagggggtcacaggttcgagccctgttgtgcccaccatgagatggctcagtagctcagttggttagagtgccggcctgtcacgccggaggtcgagggttcgagccccttctgagtcgccatttaaaatgctggcatggctcaacggtagagcagctgacttgtaatcagcaggttgtaggttcgattcctattgccagctccattttaaatgaagcaacataacattatggctccttggtcaagcggttaagacaccaccctttcacggtggtaacaggggttcgattcccctaggagtcaccatttaatttaatatttaagttatgagtaatcatgacttatatttctatcttatgggcgcatagctcagctgggagagcacctgccttacaagcagggggtcacaggttcgagccctgttgtgcccaccataagatggctcagtagctcagttggttagagtgccggcctgtcacgccggaggtcgagggttcgagccccttctgagtcgccaaatagtgcaaacaagctttagttttctgaagcttgttttattttatatacaattataggtcatgatgaatttatattagttattataattagaacaataataactaatataaatttgtaattaaaaaatagatgagtagttcattgtgctactcatctattcttttctaaattctttttgattcttatatcttcagaataaaatttaaataatttaaaatcaccaattaatcgtgaagatattctttcgctatatcgcttcactatatcaggtaaagttaaattagttgatattatcattttctttttatttaatatttttctgttaagtatattaaataattctgcaatggaaaattcattaagatgctctgcacctaaatcatcgattataagtaaatcacagtcaaatagaagtgattcaagattagtattgttgttaaatcgtatatcacgaagattttgtattaattcatctgaagttttataaactacaagatatccatcgtctaatatgttttttgatatacaataggataaatatgttttgccgctacctggattgccataaaacaataagttagtatgtaatgaagcaaaatttggaatataatcattttgaatatactctaaaatattttccatgttttttcttgaagaatatttttcatctcctattctatgcactggatataaacttaaatcaaaattactaaaattatttgttttaataacctgctcaagttcagaatccttgtagtaaaggcgtattaatttttctttgtagcatttacattttatatttcctataaagccagtatcttggcatttagtacaatgataatgcatattgagatattcaggagaatatcctctttctacaagcatttcacatttcttcattcttaaatcggttatattttctttaaagtcatttaaggtttttccttcatcattagctttaataacagataaagccatttttaaggaaagtttttgtatttgattatcaagttccataatttcaggatatttatcagcaatttcagcttttctgttctttagtgcttttgattctttatctctaatattatcgtatatttttaaaatttcactttgatatcctttaatcatcattatcccatcctaataatttcttttctaaagagtcataatcatattgtcttggttcaaagttattaaacttatgaggaacctttgagttttgtgtgttattattgtatgaattctttttaaaagatgaattttgagttgttttattatcttttaatgctatatcatcaagagttcttatgttatttttgttccagtttgaaagaattccatcgatatatttaaaatcagctctatttaatctttcaaagcatacatcacatgctttaaaaataatttcatttggaaatttaaaagttaatatccatttttcaatcatatcctgttgtggcttcattatatctgtattagtgataccaagataagatagaatttttcttatgttaatccatttatcctcagttttcttaataagattttgagcctgttcaacagttgatattttttgatcatgccaagctaaagcaactttttcaatatatctgtgatcactttttccttttgaaacacagtactctattaagattaatattaattcagatgaaaaaccaaattcgtgttgccagtttaaataaagtgacatttcgtttggagagagaggtcttcctaggagaacttctatatctttaagcatatcttttgtattattgctatccaatgcctctaataaatcgatttgcttcgctggagatttaacttcatcggctaactctaaaaattcaatattaaagtttcccattttatctatacatgttaatttaataacacctaaatcattccaataatgtaatgcattcattatatcagattcaagtaaatttagagaggaggctaatattgatgagcttacgcctaattcaccagaaacattatatttcaacatcaataagtaaatttttataaattcgcctctagcttgagtcatatatttttcaataaaaatattgcttacaggagtaaatcctacagatttactttttaacatgaatgtactcattttatttgctacctacctttcaattttatcgtatatgttaagtcaattataggtgacagaaatttaaagccttaatctatgagtactataattatagcataataaataattaactcctaaattaaaaaaagtatacagaatctttttaatcaaaaaatgactctgtatataagaagtgcacatataaaagaaaattaggttataagttttttaaaattaataacaccatcaccttgaatatatttagggatatcatcaatggaattacaagcaacttgtaaaagtgaatgcatatctttaaacatgatgttaggatttttttcgcagattaatgcacatattccagaaacataagctgttgctaatgaagagcctgtaaatgtcttatatgatacatcaagttgctttggataaagtttgattccattcttttcagaaatataatttttatcacaatttagagatacgatatttacgcatgaggcacataaatctggtttgtcatatttagataatgggccacatgcagaataaggataaggtttaataattgattttgtagtatccagaccgcctacagtaatgcagttttgcaatgtagcaattcccataactgaatatttactattaagactgcttcccgcagaaactataggaatcataccattttctatagcgcgatcaaataatttttcaaatgcatttgttataaagacattatgacttaaaagctcaaaaggaagacacaatatctttatgttatgttcttcagatagatttagattaataagactttcaattgcgaaaagtacatcagaagcaaatcccttaccgagtttgtcaaaggctttataacaataaagcttactttttgggcaaatgcctttgtacatattattagaagaaaatccgctactacacaaaattccacttacagaagtaccatgtccgttatcatcatatggatattgtatatcgtttattaaatcttcaaaaagtgaaattttatttgttggggaagttaaatctttatgaggatatacaccgctatctacaactccaataccaattcctgagccagataaattagttttttcaatataagtagatttattggcagaagctacactcataccacataaaaataagtattcatcaagaaatatttcttctatttcaggatattcaattattctctcaatgcttcgtccattaagctgagcgcttataatattagaagattctattatatgatatacatttcccttgtaggaattgatttttttcgcaattgaagattgaaagtctttatatttaatgagtactcgataagatttataaatatttttggacatgtagtactttaaattgtaatctaatttgtttttatttgaaaacatactcattctccgataatttttgctttaatatatattatacggagaagagtaatattgttaatgagaataaatagattttaaaaactaaaagtttctccaacatcaagaagctttattgaattatcatttaagtttaataatatttcttctgtttcgttgaagttctctaaagatattctgaatgttttatagtgaataggaatcataataggagagttcatcattttaaacatttcgtaactctgttctggagtacaatgcatatatgaaaatctatcaggtttatagcagccaacaggcattaaagcaatatcgcattgaatacctttaaaattttcagttaatgcggtatctccagcaaaaaaaacagatttatcttctctttcaataagataagatatgctttcatcatctataccaaaataaaaacgtcttccatcatgattggcttcaaatgcagttatttttataaagctgtcttcatacacatcacctggatgcagtataacaacatttttaaaaccaataagttttaagagttttttatatcctttaggtgctataacaattgcacttttattaagcttcataagagaaggaaagtgaagatgatccatgtggccatgagataaaagtatgtaatctacatttaaatcctttatatatgaaggtttttctacaactcttttaaaataaccgagtaagttgcataatactgggtcagttataattaccttattatataaattaattatagttgtagcatgaccaaaccaattaacagagtttgttattaattcatcagattttatagaagaactctttttaaaatattcttttatattattgacagttaaattgtataaaaaaatggcattagaaaatatattcaaaattatacatcctttctcaatgtttccatttaaatattacaataccaataatcataatagcaatacctatgaagttatttaatgaaaacttaatcttttcgtttccaaataaccccaaggcatcaatcaaagcagctgcaagtaactgagcaactagaattattcctattccaagagtcggtcccatacttccaacgctttttattacggtaaaagttattataacacctagcactccccctagaagatagagtttattagccgtctttaaattactgtagcttccatcaccataaaaaaatgatattattagagaacatattaaagcgattgcttgaactaggactgtagtttcccataaacctattttttctcctaaacgagtattgaacacaccttgtatgctcattgctattccagaaattattgcacatattatgcctaacatattatcacctcaaagatattattccccgaagttataaattattattaataatacaggttacataattaaaaataaataaaaaagagctatgcttttatgtaagaatttttttattcaaacaaagataactcttataagtatatttatgtaattatactgagattaaatctaaatctttttcaaactgacctgagatttcatcttcagaaaaacctaatgttaatcctagacttaataaatcttcaaataaagtttgataatgatccatagatggtgaagcaattaaatcattaatatctatatataaattcaaaaattgatcacttaagcaataatcgtttggaatcatatctatagagtttattttatcatatctataatcaattcctaatgttaaaacttgagaaatacagactataaatttattgaaaatcttatttaaatctatggtttttggtgttttcaataaaaagttaaagcaaattgtttcgttagctaactcaccaagagtaatttggaatagtaaattttttcgagcccttaatttgtaagaatccaattctgtattgatacttagagtattattaaaccttttttgtatttcaaacattggttgaacattcattgcacatcctcctacaattttaacaattaatactattttacaaaatctttaaaataaatgaaagtgcagtaaacgaatacaaataaattttttaaaaatatttaatttttaaaaaatttcaaaaattaaaataaggattactacattattaaaaacatttagatttaataatgtagtaatccttaacaattaagttataaatagttgtcaaattgttaattaaaaactttttaaaggatatgattgaacaggtgtgttctttttcaccgttggaagtttccatatttcaatactttttattctaagttttacgatattactgtcacaataaatatcagggaaatttaatttaacatcttgctttttgtaatctttaggtatgtaacctaaatttgcaagagatataaagttttcacctaaagtcttaatgttaaagccgtgtaaagataatgtatcgcaaatagagcgagaaagtcttgttatataacctttattatctaactttaaattaacagtttttgttggttcagataaataaactaagtcattagcatcaattctgaaactcttataaggtgaaattattttatttaatataggatttaatttatctaaatttggattatcaataatagctagtggtatgtatggagcaggagaattcctatttgctctaaacttttttgacatatttcgttgaattggcgcaattatttgataagtatcttcgtcaaataatgcaactacataatacttcatgatacccctcacaatctttaattagtattaatcgaagtttaataaattataacatattagagaaaataaaagaatataggaataattaaattttgaatgcaaataataaaaatgtaaaataatataatatttaacaaaaaataaggatgttttttctaaaaataacatgtaaataaaataagaatattgtaatgtatatgtaaattcgtagaaatctcataaatgcttaaaaaagtagtgcttgactgaaaaaatgtgtttaaataaatttagtttatgatataataattaaggtagattttaataatagcaaatttttaacgtttaattaaatatttgttttaaaataaatataaataatatgtatattttatatatagacgtaaatgggattttatatacaataaaagatattagttttaatagattagtttagataaataaattttagataggatatattttatagatagggtgaattcaatggaaagattagttataaacggaggatacttgctcaaaggatctgttgatataaatggtgctaaaaatgcagcagtagcaattttaccagcagcaataatggcaagtaagggcaaatgcataattgataacataccagatattgaagatgtacactgcttagaaagaatactcagaagcttaggttgtaatattaacaaaatagataataacactttagaaatagacagcgcaaatgtagacaatttcgatgcatgtacagaagatgtaagaagaatgagagcttcatactacttcataggtgcgttattatcaagatttaaaagagcaagagtagttcttccaggtggatgttcaataggtgtgagaccaatagaccaacatataaaagggtttgaagctctaggagcagacgtaacaatagaacatggtgcagttaatgttaaagcggatagacttattggtgcaaatatattttttgatgtagtttctgtaggtgccacaatcaatgtaatgattgcagcaacacttgcagaaggaattaccacacttgaaaatgttgcaaaagagccacacgttgttgatgtagctaatttcctaaattcaatgggtgctgatattagaggcgcaggaactgatgtaattagaattaaaggtgttgaatcgcttcagggatgtgcttatagtgtaatacctgatcaaattgaagcaggaacatttatgattgcagcagccgctacaggtggagatgtttatataagaaacgttataccaaaacatttagaatcgatttcggctaaattaatagaaatgggcgtaacagtagaagaaaatgatgattctataagagtcactgtagataagccactaaaaggtgttaacataaaaacaacaccatatccaggtttccctacagatattcaacagccaatgtctactttattaagtattgttccaggcagaagcttgattacagaatcgatatgggaaaatagacataaacatattgatgaattaaagaagatgggtgcaaatatcaaagttgaaggcagagtagctataattgatggtgtaaacagattaacaggtgctatagttaaagcgactgatttaagagcaggagctgctatggttatagccggattagttgctgaaggagaaactgagataacaagtatagagcatatagacagaggataccctcatatagaagataagtttagagctctaggtgctaatataagaagaattgaagtagaagaatagagaaaatgtaagggggaagggaactgatggtattttgttccttatacagtggtagtagtggaaacagtatgtttattacctcagatagagctaagatattaatcgatgcaggactccctggtaaaaaaatcgatgaggcgctaaaggcgattgatgaagaaacaaagaatattgatggaatctttataactcatgagcatagtgatcatattaaaggtgtaggagtaatatcacgaaaatacgatatacctatatatgcaaatggagatacttggagtgccatggaaggctcacttggaaaaattaaagaacataatattaaagtaatcgataaaagatctgttacagaaatcggtgatttaaatattaaagcttttaatattcctcatgatgcagcaggccctatgggatatactgttagtgatggaaagaaaaatataagtgttgctacagattttggtacattcacaagagagatatatgataatgtaaaagactctgaagttattcttttggaaagtaatcatgatgtaaatatgctgaaatttggcccttatccttatcagcttaaacgtagaatattaagtgaaattggccatttatctaatgatgactgcggtaatgctattgtagaacttgttaaatgtggaaataataaaaagattattttagggcatttgagtaatactaataatcaaccagatttagcatatgcaacagtattagatgtcttaaatgataatggaattaagaacaatgaagacataatattaactatggcaaataggcataatcctagtagctacataaaaatttagtttagagtataatttaaaatactattataaatatgaaatttaagggaggactttataatgagtttatatacacaatggactgacatggttgttgactatgtgaaaactaagggagaaaatgctttctgggcagaatacagcaaattagagaagtctatatacaaggatttattagcaaatcataagactgttaaaacaacgactataaatgatttagcaaaagaatacgattcaacaatagaatttatcatgggattcattgatggaatcaatgacagcttaaagaaccaatacgatttagaaactcttgaagctgattcaaagttagaattagatattaatttagaaactttatactacaacatgttagatgctaaagcagaatatttatatacattaccacaatgggatggaatattctctgaagaaaagagagaagaaatccaaaagcaatacaaagaatctaagatagttagaaacttagataaagttggtagaaacgacgtatgcccatgtggaagcggtaaaaaatataagaaatgttgcggacaaggaaagtaatatttctgatacataagaaagtcctacttttaaggtagggcttttttgtgcatctcaaataattgtaaagtcctcttgatattaatataaagtataagaataaatttccagggaaatggaacttgggaatagtatttatagactaaggaaagatagtattaataaattaaacttataaacgaaaaggcaaggagaatgtgtttaaatatgaacataacgattatttcagtaggaaaacttaaagaaaaatatttgaaactagcaatagatgagtattcaaaaagattatcacgttactgtaaactaaatataatagaattgtccgatgagcagacacctgataatgcatcagaaaaggatgagttaataataaaggataaagaaggacaaaagattttaaattcaataaaggatactatgtttgttattactctagatcttaaaggcaagatgttgtcatcagaagagctatctaagtttgtagataactgtggagtaagaggagatagtaatttatgttttgttataggaggaagccttggattaagcgatgctgtattaaagagagctaattatagtctttgctttagtaagatgacttttccacatcagttgtttagagtaatgcttttagaacagatttatagagcttttagaataagtaatggggaaccgtatcataagtaaagctctaaatctatgatttagttagctgaacttactcagcgaccgtagggagtcgagtttcctttataaaatgagttttttagccttaagcattgatataaattgcttaagactatttttattgttgaaaacaccgtatcataagtattaataatttatatattagtgtaggtataaataacaaagagttaagataaaaatagtaaaataaatggtattatatatataattaaaaaatgagaaagcctattttaatatagttctccactaaatctcccgcctgttaaaaggtttaagtatattgttttatatttaaagaaatagtttgttataggttggaacacctgtataggactgtttatttatgatataagcaaaaaagcaagaaatgaatatctttatttagtgatatagtatatattttagaacgtattacatgtttaggcgttatagagtttagttgataatatggaaacatgattattaaaatactattaatgtaaatttagaaggagtgaagagttattttgaattttttgtgtaataaaaaatcattatggattaaaaaaggtgtagagtttgtcggatatgtctgcatttttctttttttgaatataaacctatactttattatgaagcattttagatatgacgagtattttatgtggattccattaatattatgttttattgttccaaagttaggttcagttttaaagtacaatttctctgttaatatgagtttagtggtatcattaactacgttaattattatttacatatcaaagacgaattcaaatataagagctttttatactaaaaatgataaactaattttgacattattagttataacttttttaattagcaaaattatatctgataactacaaaatagagaataatgataatgaagaaaatgaaaaaaaatcagagttgtttaacttattatatgttaatacatcaaaagtacatgaaatagcaatgttgattgataataaagtaatgaaaacagtagaaaaagaacaaatatctgaagaactattaaaatcatcatattcatatggtttaaaatcaaatgtaggcacatcggatgcttctattcaaaaagaagaaaactctaaaaaacgagtatatgaaaactttgatgtaaaaaccacgaaatctataatgcttagaaagatatatgatgaaataaaacaaggtaataataaacaagatgaaaatcttaaaattggacaactagttatgtttaatgaagttgccttggagagaagaaatgttgatgatacagttatgatattaaatgttattcaagacagtaaaattaagaatcaagttgatcaagacatagagataaatatgaataaaatgatggaaaaaatgttagatgattttacaatagattatgtgtttgaacaaagtaggaaagatagtatgccaaattctaagtatatatttcaattaccatataaatctaatgaaaattttgaaaatggctatcaacataatgatttacaacttggtactcttagtttaattggaatttatagaggagaaattgatttttcgaagagagaaagtgtatcgtctaaatttcttgaaatgatgtctgattcatataataatcctacaaatagacaaagtgatgaggtaatgaaaactagtattgtacaagcggatcagcagttgttaccatttaaatttaaacacaagaagttaaatgataaatatcacttgattgatataatagcaattattcaagagttaaatatagagaggtcctaatagaatgaaaaaaaaattatatgtttatagtaatgaaaaagtagaagacttaaaaaaagatttcaataatagtaattttattagtataggttttattttgaatagaattcaaagtatagatgccattgataatgaagaatttgataattttataattgatattacaacattagcatttgataatggatactataaactatttatggaacaatatttatataaacttacagataaatttagaaatgcaattttcatagtaaattatttacatagagatgcctttcttaataaatttccatacgtatttgattatatagatgatatatatgtaaaaaagttagataatagttcaaatataaatcaagatataatccctatagataatagatatattgaacctataccattattgatgtatagcaaatcgatgttagataattatttaggaaaatataaaattatctctattgggagcctttttaatggaagtgataacttaagttatagttttaatatagaaagtataaaatcttttttttattctaatgaaatacagtatattgatattactcaattaattgattcatttatattaagaaaagatttgatattgacttttgaaattttgattagacaaatttttatttgtaagaaagatatcaaatttttgatttgtgatgaaaagtcagacgatataaagaagtatttaccatttacatttaaaataaataatgattttttttataaggaagaagtttcagctgcatctgaaaaggctattatcaataaacatgacattaatgaaatatttgatataattaatgataaattaaaaggtcatgatgattttaaaagagattttaaatttaatttacaaaaatatatgttcctaaataaattaggagagcgtaaaatattttctgttttcttaactggagagtctggaataggtaaaacggaattcgctaaaatgctttcagaagcaatgtatccatcagaaagtttaataaaaattaattttggaaattattctaatgaaggggtattaaatagtttaattggttcacctctcggttatgttggtagtgaagaagggggagagcttattaataaaatgaaaatttcaaattctaaaataatccttatcgatgaatttgaaaaagcaactccaagtgtatttcatttcttttatgagcttttagaagatgggaaatttactgaccgacatggtacagcacacagtatggatggatatattattatatttacttccaatatgacacgaaaaagatatattgataatgttccagatcctttaaaatcaagatttgacatggtttattgttttgttgatttgcctacagaagaaaagaaaaagtttgctatggaagtggcagaaaaactaataaaaaaaatctatgaaaatacaaatataaatatagagcttacttatataaaaaatgaattagataaactaattacacataataatttacgtagtataaaaagaaaagttgaggatttagtgataacagagtattataaatccatatagaaaatttaacattgatttaagtaaaaggcgtattttatatgttattaccataatttaattttaaattagttaaatttatgtattattttaaaataagtttacaaaaaatataaatagattagttaaagttataaatattgataataattatggaattcaattggaaagaattaaataaacctcacttagaggtgttacggtgaaccgtatcataaataagtgagaataggtgaatatatacaatgctagttgtttaggcaactagtatcactagattttttctataagtaacaacaacaaattaaagcaatttgaaaggagtatccatatgtatacagcagattattttgtgaaaaacttaaatatgatagcacatccagaaggtggattttataaagaaatttattcatcagaagagaatataacatcaaaagatttaaaagttaactttgaggggtcaagaatactttggactagtatatatttcttgcttagagatggtgaggtttctaattttcataggttaaaatctgatgaaatgtggtattatcattcaggatcaccattaactatttatatgattagccctgaaggcgaatttataacagaacagcttggtcttaatattgaaaatggtgaaaaacctcaagtattagttccaaaagattatatatttggttctgctatgaataatgaaggttatgcattagttggctgtatggtctcaccaggatttgaatttagagactttgaattatttaaaagaagcttcttattagaaaaatatcctcaatatgaagaaataattcttaaattaactcataatgaatgattgatataataaggtaatagacaataagttttgtttttaatgaaaatattataattagaatagtacttaaaaattagtggttttccaatttaaattggaaaactatttttttgctttttctgagagatatgtctcaaaatatagtaatttaaaagttaaaaaatcaaattttatcctttttaagttgaactttttatcaaatggagtaagtaaattttccattttttatatataaaagaggtaaatgatattgccatttcattacagttattattaaatctatgttaaatttataatcttttgttaaaaatagtttaaaaaatattaacaaaagtaatataattatttggggaataatatctaatattttttagaatagtataggagatgaattaatgtttaataataggaaagaagataagtttttcaacatgttattaaaatcagctgaaattgttaatgaagcagctgtagaattaaaaaatgatttgaaatgtctagacgttacagaggaatggatgaaaaagatcgcagagttagaaaatatgggcgatgacttagttcgtactttaattaaagaactagacgatgcatttataacacctatagacagagaagatgtatatgaaattgtaaaagaaatggataatattttagatttaataaattcccttgttcacagatttataatgtttgatataagagaaagcacagatgaattagaatgtgtatgtgatatcttagtacaagttacacaagagcttatgtcattaatgaatgaattaaaaatacatgggtgtagatcaaaaaatataaatgaaaaaataattagcataagtaaaatggaaagtaaagctgatgaaatatttagaaagactgttcaaaaattatttaagtgcgaagaaaatcctatagaaatcatgaagtggaaggaaatatatcagatattagaaaatgtagtagataaatgtgaacaggtagcaaatatagtagaaagagttgtaattaaaaatgcatagttcattaataataacaatattaatagtatttcttgcattagcatttgattttataaatggatttcatgatacagctacagctgttgctacatcaataacaacaaaggcattaactcctaaacaagctataataatatgctgtatatgtaattttattggtgctttcatgggaacagcagttgctaaaactgtaggggacaatatagttagtcatacatcaataccacaatgggtaattatgtgtgtattaatttcatctataatttggaacctattaacatggtattttggaataccaagtagttcatctcatgcgttaataggagcgcttattggaggtggaatagcatatactatgacttttgatgttgttaattggtacaatctttttcatagtgtaattttgtggttaattctctctccactaataggatttatagttggatatatattaatgttaatactaaattgtattttaaaatcacataagagatcggttgtgaacaagctgtttttgaagttacaggtattagctggtgcatttatggcgcttaatcatggaggaaatgatgctcaaaagtctatgggaataataacgatggcactattgagtggtggattaataagtagctttgaagtacctgtatgggtaattttcctttgtgctttatccatggctcttggaacttctataggtggtaaaaaaataattaaaactatgggtagtggaatggcaaaattgactcctgttaatggttttgcagcccagactggagcagcatttgtaatattgtgtgcaacattatttcatgcaccagtaagtacaactcatataataacaacaagcataatgggtgttggtgcatctaaaagaattaagaatgtaaaatggggagtagcaaaacaaatagtttgggcttgggttttaacaattccaataacagctgtattctcaggggtaattattttaatagtcaaattgtttatataatcataaacacaaaagatacatataataaataaaaagtgctgatttttcagcactttttatttattagcatatttatttgaaatataagtatttcgggtttgttaagagacttttattcatgatatttgttaatattttatgattatgatactatatagtgtacagaatatataatgtaaaacttatagatataaacgaatggaggaaatgaaattatggataaattaccaagttgcccaaaatgtaattcagaatatacttatgaagatggaagttttttagtttgcccagaatgtgctcatgaatgggctccaggaagtgaaaatgaaaatagtgatgaattaattgtaaaagattcaaatggaaatgttttaaaagatggagactctgtaacaataataaaagatcttaaagttaaaggtgcttcttctgcattaaaaaagggtacaaaagttaaaaatatacgtttagtagatggcgatcataatattgattgtaagattgatggatttggagcaatgagcttaaaatctgaatttgttaaaaaaatataatattacataaatcaaggctggataacttccagctttttatatataaattataattaaagggaggaactataatgttatctaatatatttgaagagtatattaaagtaaataaacaatatgtagattttgttaatgaacttgtaaataaggattttactaattttaaagaagatgaaattgtaaataaacttgtagagggaaaaacaaaatttgaaaaacttatgaatgacactgatatttgtgaaaaggaagaagaagaaggattatttttaaaggacgttaaatactctatagtagacggtttatttttatctatagatttacttaatttttataattcaaaagaattagaaagatttaaaatgagagcggttaattatattagaaaaggaagagttacaagctttttttaaataacacatatactgctacatatcatgaagaagaatcatctagaaggttaaaaataagtgatggttcttttgcatttataaataacacatattgagaaaatgataacaattatatggaaaaatatagattattgttgaaatttataatttaaagtgcaataatataatagtttggaaatattatttaatgcagtaataataactgtattaaatttagaaaagaaaaggaggtatatagttaccaagtgtaactatagttattggggatgagtgaattagaaaaattattaagtcagataacagatataatagatacgggtctgactaaagatggtgtatcatcaatattaaatttattagagatttcatttcctgttaaattattagatgaaatgaagctttatggagattatcttcctaaaaacaatgaaataggagtatctgatgaaaaaagatacctacattttttatgggatgtattagataagtctccaatgtgtttagttgctaatttttcaattttatatagaagaattttagcaaaaaaactatttaaatcatgtggtgaaaattttattgcagaagaaaatgtaagatttaatgttccagataatattgaagttggagataacgtattcttaaatagagatgtgtacatagattcaaaaggtggagttaaattaggtgattctgtagcattaacagaaggagtaatgatatttactcattctcattcagaggataatcatgaagaaagaacatatagtccagttataatagaagattatgcaaagatatgctgtagagcaacgattcttccaggtgtaaaaatagaaaagcaagctatagtggctgctggagcaataatagataaaaatgtagaagtaaattcattagttgctggaatcccaggtaaatttgttagagaaagaaataatttaaattgtgctggtgatgaattaaatcatatatggcttcataatggaatatttcaatagtctataaaagaactattagacttatatttttaagtaaaatttataagtacatattatcttcatttaaaatataatcaaatattagagaaacaacataataataaatacatatataggcttatagtaagaaatagaatgtattaactgtttgtaaatatgtgatataatatattggaatttaagatttagtaaatggaggagatatatatgtttactaaggaagaacttttagtaatagaagatgcattgaaaattgcagattcagaatatataagaataatggatgaaagcaaatctaataagaataaattagttgcatacaatagaaagcaaaaaaagctttggttagttcaaaataaattaaaaaagattattgaagaaaataaataactttttctatactccttttatatcagattatattgtctcatataaaaggagtataattttttactcgaagtaattaaagtaagtattgtttaaataattttgattatagatagtgagtgaatattaactgagtaaaaaaattaagttttggtataataggattaatataagtaaaaaagaggtatgaagtttgaataatggtgacgttaaagaagaaaaagaatttggaaaatacttttacataataaattataatagggagtttgaagaggagttgtgcatgatggagatggattcgtttttcaatatgaaaccatttaaaaaacaattctttgcaaataaatatattaatccttccaggagtccttttataaaggaagttataaaaataaaatatgaggaaaattcaatagaagaaatattattgaatattaaatctgataatcttgcttatgagaatttcaaagtatgttttatgaaaagcgaagataatacggttggttataaagagagaataaatagcataaaagaaataggatatataataaaaggtgaggcagatatccataatccagaaatcatttttgggttaagtaaggttggcgataaatggatatttggagaatattatagaaatgattttaagtggcatatacatgataaaaaaccttattcatattctaattctctaagcttaagagtagctagagctttagttaacatatcagtaggaaataatataaatcaaaaatttatagatccatgttgtgggataggaactgttataatagaggctttgtctatgggaattaatgcttgtggatgggaaatcaacgataatatagctgaaaatgcacaaaaaaaccttgagttttttggatatgataatgtaattataaatggcgatatgacaactataaaggacaaatttgatgttgctataatagatatgccatacggtctttttacaccaattactaaagaagagcaagttgctataataaattcagcacgtagaataacaaatagattaataatagtaacatttgaagacatgagtgaagtaataaagaaatctggttttaacatcattgatactggacacgtagcaaaaggtaagtttaaaagatatataagtgtttgtatataggcatacccatgttataattttcaaaattataacatgggtattattttttatatttatatatttggaagagaatatcttttaaacttgatagacactaggattagataaataaatcaacaaaacgaataaaaaaatatagaaaaagttataagaaaacatttacaaagaggaaatattggtatataataaattcataccaacgaattagaattattaaatatgaaatatagaaaatatgaaaaggggaagaaacatgcaagaattagaaatggcgataatgaatattataattaatgctggggattgtaaaaatcatgcatatgcagctttaaatcatgtaaatgacggaaattatgaagaagctgataaagaaatgcagttagcagaagatgcaatggcaaaagcacatgatggacagactactttccttcaaaaagaagcagctggtgagagtgtagatttttcagtactatttgtacacgctcaagaccatttaatgacagcaattactgaaaagaatttaattacacaaattatagacttaagaaaaattgtaaatacattaattaataaataatacgtaaatttataaagataaagtaaacgataacaaaaatataagagtatttaggaggaatttattatggtaactattagattattttgtgcagcagggatgtcaacaagcttattagtaaataaaatgaaagaaagtgcaacaaagagaggaatagaagcagatattgcagcgtttccagaaggacaaatggataaacatttagatggtgtaaatgttgcattacttggaccacaagtaggatacagattagctaacgcaaaagaagtgtgtggagcaaaaggggttccagttgatgttataccaatggttgactatggaatgatgaatggagaaaaagttttagattttgctttgaatttagcaaaatagttaatagtatatttcaagaaaacgtttaataaagattccatgcaattacattatgaatttgctttgaaaattgcatggaatttttcagtaataataatctcgtaaattattattacctatattatatcaaatctttcaacaaaagttaacttatattatagggggaattattatgtcaatcggcaatacattaagtcaaaagcttataccgcaagtaatgaaatttgtaaacttaaaaccagttattgcattaaaagatgggattctatttattttaccattaacactaattggttcagtgtttttattactagctcaaataccatatcaaccattcaatgattggatggctagtacattaggagcgaattggacagagccattaatgcaagcatatggcgcatcgtttaagataattgctttagtagcggcaataggtattgcatatacatatgctaaaaatgaagggtatgaacctttatcagcaggaattatatcacttgtaatatttcttttaacaactaattcttatgtaacacttgaatcaggtgaaatagcagataatgttattccaaaggcttggactggtggagaaggaatggttactgctattattataggtttattagtaggggcaatatattcttggtttatgaagaaagatataagaataaagatgccagctggagttccacaaggagttgctaactctttctcagctttaattccaggggcagtaatgattgttggtgctacagtagtgtacactatatttaaatatggaatgaatacaacatttatcgaatggatatataaagttatacaaacacctcttcaagggttatctgattcattaggtggagttattgtaatgtgtttcttaattcctttcttatggtggtttggagttcatggttctactataataggtggagtaatggatggtatcttaatttcaaatgcaacagcaaaccaaaacatcttagattcaggaatggctttaacaatagaaaatggtggacgtatagtaactcaacaatttaaagattgtgtagttaatctttcaggttcaggtgcaactattggtcttgttatatgtatgttattcttagctaaatcagctcaatctaagcaattaggaaaattagctgtagttccagcatgctttaatattaatgaaccagtcatctttggtactccaatagtaatgaatccatttatggctataccatttatattaactccagtaacaattggtgtacttcaatattttgcaatagcaacaggattgattccattatatacaggggttgtagtaccttggactacaccaccaataataagtggattcttaacaggtggatggagaactgctttattccaagtagttgtaatagcaatatcaactgcaatatacttcccattctttaagaaagttgatagtatgaactataagaatgaacaagcagctcaaaatcaatagaatttaataagttaaaataaggctacttcgtacaaaaagatgattttagtaagaagtggccttattaaatataaaaatatagaattaattgggtatatttaatacaataaatattgtattaaataaataatgtattaaaatataattattattgattaaaagaataggaggggtaaagtgacaactaaatacgaaatagttattaacaaattaatgaataatataaaagatggagtatacgataaagataaaaaactccctacggaagatgaacttatgaatatattcagtgttagtagaaacacaataagaaaggctattgaaattttggttaatcatggatatgtatatcaagttcaaggtagtggaatatttttaagggattcgcaaaaggggaagtgtgtttctcttcaagaaatgaatggacttacaaaagagtttgatgataagcgcatagaaagcaagattattgaattttcaattatcgatgcagatgaaaaattagcagaaaaatttaaatgtgctctaaatacaaaaatttatcatattaagagagtaagatatgtaaatggagaacctattgaggtagaggaatctttttataacaaagaaataattccatatctaaatgaagaaatttgccgttcttctatatttaattatattacaaatgatctgaaattaaatataggttttgcagataagattataagttgtgatgtattaactgatgaggagtgcgaacttttagaagttgaaaaaggagaaccaacattacagcttgagaatactgtatttttaagtacaggagttatttttgacgtatcaatagaaagatataattatagaaagataaagctccttagtccaactgttttacaaagtataatttaaaatttaagaaaacatttacaacatggatttattagtatatactatattcataccaataaatttaaaagaaataaatctatgtttagatgtagatattaaacattcaaaagaaaaggtaagggggattacatatgaaatttgcaaacgatttcctctttggagcagcatctgcagcgtatcaagtagaaggtgcatgggataaagacggaaaggggattagcaactgggatgtattttcaaaaataccaggcaagacatttgaaggaacaaatggagatgtagcggttgatcattacaaccgatataaagaagatattaagttaatggctgaaatgggattagaatcatatagattttcagtatcatggcctaggataataccagatggagatggagagataaataaaaagggacttgagttttataacaacttaattaatgaatgtttaaaatatggcatagtaccttttgtaacattatatcattgggacatgccacaagtgttagaagaacaaggtggttggactaataaaaggactatcaatggatttgttaaatatgcagaagcatgttttaaggcttttggtgatagagttaagcattggataacattcaatgaagcgatagtgttttgtaaatcgggatatattactggagcacatccacctggtttggtaaatgatcaaaagaagtattttcaagctacccacaatgtatttgtagcacatgcaaaatgtgtagagatatataagaatctaaaacagtatggagaaattggaataacacatgtttttaatccggcatatagctttgataataaagaagaaaatattgcagcaactgaacatgcaaattattatgatacatattggtattatgatcctatattaaagggtgaatatccagaatatgtagtagaattattaaaagaaaagaacttagtgcctgattggactaatgaagaattagaattattgaagaatactgctgataaaaatgattttataggtttgaattactatcagcctcaaagaataatgaaaaatacagatggtcagcaattagttgcttctagagaaaattctactggagcaccagggaatccttcttttgatggtttttataagactgttatgatggaagataaggtttatacaaaatggggttgggaaatctctccacaaggatttttagatgggttgagaatgcttaaagctagatacggtgatgtaaagttatatattactgaaaatggattaggagatgaagatcctataatagaggatgaaattgtagatattcctagaattaagtttatagaggaacatttaaaagtagtgaaagcagctataagtgaaggaataaatttaaagggatattatgcttggtcagttatagatttattaagctggttaaatggatataagaagcaatatgggtttatatatgtagatcataaaaataattatgatagaaagaaaaaactatctttccactggtataaaaaagttattgaaacaagaggggaaaatttatagtcgataataatatattttattaggtagaatatatgcaaatagaacaataaaacggttcatgcttaatgtgggccgttttattatttttatttaaattaaagtgcaacttttaaaaatatcaattcaatcattggagctcgtaagatttaattagataatggatattgtatgtatatacttcaattgtatggatacatttgaaatgtatggatatatatattaatatatttgtattaaaacaaaagggggctatattaatggaaagagaattagtaaataaaaatcttgctcaaatgttaaagggcggggtaataatggatgtaacaaataaggaagaggcaataattgcagaaagagctggggcttgtgcagttatggctcttgaaagagttccttctgatattagaaaagaaggcggagttgcaagaatgtcagatcctaaaatgataaaagaaattcaagatgcagtatcaatacctgttatggctaaggtaagaatagggcattttgttgaagctcaaatattagaagctttaaatattgattttattgatgaaagtgaagttcttacaccagcagatgataagtatcatatagataaggagagttttaaagtgccatttgtatgtggtgccacaaatattggagaagctttaagaagaattggtgaaggtgcatcaatgattagaactaaaggagaagctggtactggagatgttgttaatgcggttactcatatgagaacaatgacagaacagattaaggatattcaaaaggcgtcaaaggaagagcttatgacaatggctaaaaatcatggagcaccatatgatttagttaaatatgtgtgggaaaatggaaaacttcctgtggttaattttgcagcaggtggaatagcaacgccagcagatgcagctttaatgatgcaacttggatgtgatggagtttttgttggatcgggtatatttaaatctgataatccagaaaaaagagcaagggctattgttttagcaacaacttattataatgatcctaaaaaacttgcagaggtgtcagaagatttaggtggggctatgagtggtataaatgctaaagaagttttaacaaggtatgcagaaagaggatggtaaaatgaaaattggtgttttatcattacaaggtgggtttatagagcatattaatcaaattaaacttttaggatatgaaccaatagaagttaaaaaggaaagtgatttagaagttatagatggaataatacttccaggtggtgagagtaccactatgggaaaattactaaatgttacaggattaatgaagccattaaaaaataaaatattagaaggattacctgtgtgggggacttgtgcagggatgatacttcttgcaaaggatatagaaaatgactgtagaagacatttagggataatggatataaaaattagaagaaatgcttttggaactcaaatagatagttttagaacaaaaaaggttatagaagaagtaagtgatgctgaaatagaacttgtatttatcagagcaccattggtagttgaagtgaaagataatgtagaaataatatgtagagttaataataatatagttgctgtaaaacaaaaaaacatgttagcaacatcatttcatccagaattaacagaggatttaagatttttaaagtactttatagagaagatagttaaagctagtaatagtagaggtaatttagtggctctataataaatgaataaatataaaataaatttccgcaataaattaagcaagtgtggaaatttattttgttttgcgtatatatactatgcgcaaattgatttgtgttacataatcagattaagttaattaatatgttaaatagtgtgatgtttattcaaaagtatactagttatatgaatatccataatgaaatgtatcattaataaatgtatatatattagaaaaaagtatataactaatcctggcgtatccatatgagaatattagagaaaattagagtaaaatgtagaaatttaattatatattatatattctgcaaaatatatattgatatatatgaatattaaatgataagataaaacacgtcgctgagagcggcaaacaacaaaattaaaacttgataaaagctgaaattaatgaagcaaaataagttttaaaaaagttgttgacacatgtcaaaccaagtgatatactaagtaagtcgcttgagggtgacaacataataacaacgtaaagttgtgaaagaaaatggtctttgaaaattgaacagaatataatataaacatttaagtaaaccagcaattctttattttgagtaagctaagattaaactttttattgagagtttgatcctggctcaggacgaacgctggcggcgtgcttaacacatgcaagtcgagcgatgaagctccttcgggagtggattagcggcggacgggtgagtaacacgtgggtaacctgcctcatagaggggaatagcctttcgaaaggaagattaataccgcataagattgtagtaccgcatggtacagcaattaaaggagtaatccgctatgagatggacccgcgtcgcattagctagttggtgaggtaacggctcaccaaggcgacgatgcgtagccgacctgagagggtgatcggccacattgggactgagacacggcccagactcctacgggaggcagcagtggggaatattgcacaatgggggaaaccctgatgcagcaacgccgcgtgagtgatgacggtcttcggattgtaaagctctgtctttagggacgataatgacggtacctaaggaggaagccacggctaactacgtgccagcagccgcggtaatacgtaggtggcaagcgttgtccggatttactgggcgtaaagggagcgtaggtggatatttaagtgggatgtgaaatacccgggcttaacctgggtgctgcattccaaactggatatctagagtgcaggagaggaaaggagaattcctagtgtagcggtgaaatgcgtagagattaggaagaataccagtggcgaaggcgcctttctggactgtaactgacactgaggctcgaaagcgtggggagcaaacaggattagataccctggtagtccacgccgtaaacgatgaatactaggtgtaggggttgtcatgacctctgtgccgccgctaacgcattaagtattccgcctggggagtacggtcgcaagattaaaactcaaaggaattgacgggggcccgcacaagcagcggagcatgtggtttaattcgaagcaacgcgaagaaccttacctagacttgacatctcctgaattactctgtaatggaggaagccacttcggtggcaggaagacaggtggtgcatggttgtcgtcagctcgtgtcgtgagatgttgggttaagtcccgcaacgagcgcaacccttattgttagttgctaccatttagttgagcactctagcgagactgcccgggttaaccgggaggaaggtggggatgacgtcaaatcatcatgccccttatgtctagggctacacacgtgctacaatggtcggtacaatgagatgcaacctcgcgagagtgagcaaaactataaaaccgatctcagttcggattgtaggctgaaactcgcctacatgaagctggagttgctagtaatcgcgaatcagaatgtcgcggtgaatacgttcccgggccttgtacacaccgcccgtcacaccatgagagttggcaatacccaaagttcgtgagctaacgcgtaagcgaggcagcgacctaaggtagggtcagcgattggggtgaagtcgtaacaaggtagccgtaggagaacctgcggctggatcacctcctttctatggagaaatctagcaaacatgacgtttgactagtacaaagatgcaaagcatctataaaaattataacttgctcaaaggttacttaatgagtattgattctgttcaattttgaaagactaggtctttcaagaaatatgggggtatagctcagttgggagagcacctgccttgcacgcagggggtcaagagttcgaatctctttatctccaccattaagatttaagttaaattaaatctttaaatgttctttgaaaattgcacatagattaatgtatataatacaacaaagccaagaataatattctttgtgaatgattaatataaccagttttgtatatcaaaacttaaaaaggtcaagctacaaagggcgcatggtgaatgccttggcatcaggagccgatgaaggacgtgataagctgcgataagcttcgggtaggcgcacatagccagagatccggagatttccgaatggggaaacccgcatgagaaacctcatgcatcgtaaagtgaatacatagctttatgaaggaacacctagggaactgaaacatctaagtacctagaggaagagaaagaaaaatcgattttcttagtagcggcgagcgaaaaggaaagagcccaaaccagagatttatctctggggttgcggacagaacataacgtgaaattatgattaaccgaacacaactggaaagttggaccgtaggaggtaatagtcctgtaagtaaaagtcataataatcagttctgcaccagagtaccacgagacacgtgaaaccttgtgggaagcagggaggaccacctcccaaggctaaatactacctgatgaccgatagtgaagcagtaccgtgagggaaaggtgaaaagaaccccgggaggggagtgaaatagaacctgaaaccatgtgcctacaaccgatcaaagcaccttatgtgtgtgatgatgtgctttttgtagaacgagccaacgagttacggtatgtagcgaggttaagtacttaaggtacggagccgaagggaaaccgagtcttaatagggcgactagttgcatgctgtagacccgaaaccgggtgacctatccatggccaggttgaagcgagggtaaaacctcgtggaggaccgaaccacgttgctgttgaaaaagcatgggatgagctgtggatagcggagaaattccaatcgaactcggatatagctggttctcctcgaaatagctttagggctagcgtcgtgaaatgtgagtactggaggtagagcactgaataggctagggggcatagcgcttaccgaaccttatcaaactccgaatgccagatactatcagcacggcagtcagactatgaaagataagttccatggtcaaaagggaaacagcccagatcgtcagctaaggtcccaaagtgtaagttaagtggaaaaggatgtgggatttctaagacaactaggatgttggcttagaagcagccactcattaaaagagtgcgtaatagctcactagtcaagagatcctgcgccgaaaatgtccggggctcaaacttaccaccgaagctacgggttcatactttgtatgagcggtagaggagcgtcgtaatcgggctgaagtcgtaccgtaaggagcggtggactgattacgagtgagaatgttggcattagtagcgagatgtaggtgagaatcctacaggccgaatatctaaggtttcctgagtaaagtttgtcttctcagggttagtcgggacctaaggcgaggccgagaggcgtagtcgatggacaattggttgatattccaataccactataatcgttattatcgatggtgtgacggagaaggataggatgtgccagctattggatgctggtctaagcgttgagggagttagaacaggtaaatccgttctaacaattctagggcgtgatggggaaggttccacggaaccgaagtatctgatttcatgcttccaagaaaagcatctagaaagagaagtagtgcccgtaccgcaaaccgacacaggtagatgaggagagaatcctaaggccgacggaagaatcacagttaaggaactaggcaaattgaccccgtaacttcgggagaaggggtgcctaccatttggtaggccgcagagaataggcacaagcaactgtttaacaaaaacacaggtctctgctaaagcgtaagctgatgtataggggctgacgcctgcccggtgctggaaggttaaggggaacacttagcgcaagcgaaggtgtgaacttaagccccagtaaacggcggccgtaactataacggtcctaaggtagcgaaattccttgtcaggtaagttctgacccgcacgaatggcgtaatgacttgtgcactgtctcaactgtgaatccggcgaagttgtagtgcgagtgaagatgctcgctacccgcgattggacggaaagaccccgtagagctttactgtagcttagcattgaatttcggtattgtctgtacaggataggtgggagactgggaaattagggcgtcagccttaatggagtcgttgttgggataccaccctgatagtattgaagttctaactggatgccatgaaactggtgacaggacattgttaggtgggcagtttgactggggcggtcgcctcctaaaatgtaacggaggcgcccaaaggttccctcagaacggtcggaaatcgttcgtagagtgtaaaggcataagggagcctgactgcgagacctacaagtcgagcagggacgaaagtcgggcttagtgatccggtggtacctcgtgggagggccatcgctcaacggataaaagctacctcggggataacaggctgatctcccccaagagttcacatcgacggggaggtttggcacctcgatgtcggctcgtcgcatcctggggctgaagtaggtcccaagggttgggctgttcgcccattaaagcggcacgcgagctgggttcagaacgtcgtgagacagttcggtccctatccgtcgcgggcgtaggaaatttgagaggagctgtccttagtacgagaggaccgggatggactgacctatggtgtaccagttgtttcgccagaagcatagctgggtagctaagtcgggaagggataaacgctgaaagcatctaagtgtgaagcccacctcaagatgagatttcccatagcataagctagtaagaccccttgaagactacaaggttgataggtcagaggtgtaagtgcggtaacgtatttagctgactgatactaataggtcgagggcttgaccaatataatcgagttgtaaatacattaaaaactatgtgcaattttgaaagaacaaaagttttttcaaaaagttaataaggaaactcgctcagacgagctgaggagtacagttcttttagctaaatcatagatttagaaagaactagcatctggtggtgatggcatagaggtaacactccttcccattccgaacaggacagttaaggtctatagcgccgatggtactgcatgggagactgtgtggaagagtaggacgccgccaggtaagagtaaggatagttagaaataactatcctttttagcgtataaaaatataattaattacagatttattttcctatataaaatgaagaattaaatttgaataattagatacaatttaaatgtttttaaatgaaatttatcatttaacatattaattatttattaccgaatcgagcgatagctcttttcaaggtacgattgtataagaatttagaataaatatttacttaatggataaatttctagaaaaaaataaatttatatggttcaacttatacacaatttgtttttgttatagctaaaaacatgttgatcatgtgaataattaaataaaatttttataatatttatacggagaagaaacttttataaggtgattaatataaaattatataaaaatgctaattatttagaattacaaaaatcgaacaataaatataaaaagaactataatatatggtatataggttattgagtggataaatatgtaattatgaatggtatatcgaaccaggcgtatcaatcgaaagattatagagataaatggagaaaaataaagaaatataggaataaattaattaaatgacttataatgtgctgatatagaatcagatgtatgatactataaaacacgtcgctgagagcggcaaacaacaaattaaaacttgataaaagctgaaattaataaagcaaaataagttttaaaaaaagttgttgacacatgtcaaaccaagtgatatactaagtaagtcgcttgagggtgacaacataataacaacgtaaagttgtgaaagaaaatggtctttgaaaattgaacagaatataatataaacatttaagtaaaccagcaattctttattttgagtaagctaagattaaactttttattgagagtttgatcctggctcaggacgaacgctggcggcgtgcttaacacatgcaagtcgagcgatgaagctccttcgggagtggattagcggcggacgggtgagtaacacgtgggtaacctgcctcatagaggggaatagcctttcgaaaggaagattaataccgcataagattgtagtaccgcatggtacagcaattaaaggagtaatccgctatgagatggacccgcgtcgcattagctagttggtgaggtaacggctcaccaaggcgacgatgcgtagccgacctgagagggtgatcggccacattgggactgagacacggcccagactcctacgggaggcagcagtggggaatattgcacaatgggggaaaccctgatgcagcaacgccgcgtgagtgatgacggtcttcggattgtaaagctctgtctttagggacgataatgacggtacctaaggaggaagccacggctaactacgtgccagcagccgcggtaatacgtaggtggcaagcgttgtccggatttactgggcgtaaagggagcgtaggtggatatttaagtgggatgtgaaatactcgggcttaacctgggtgctgcattccaaactggatatctagagtgcaggagaggaaaggagaattcctagtgtagcggtgaaatgcgtagagattaggaagaataccagtggcgaaggcgcctttctggactgtaactgacactgaggctcgaaagcgtggggagcaaacaggattagataccctggtagtccacgccgtaaacgatgaatactaggtgtaggggttgtcatgacctctgtgccgccgctaacgcattaagtattccgcctggggagtacggtcgcaagattaaaactcaaaggaattgacgggggcccgcacaagcagcggagcatgtggtttaattcgaagcaacgcgaagaaccttacctagacttgacatctcctgaattactctgtaatggaggaagccacttcggtggcaggaagacaggtggtgcatggttgtcgtcagctcgtgtcgtgagatgttgggttaagtcccgcaacgagcgcaacccttattgttagttgctaccatttagttgagcactctagcgagactgcccgggttaaccgggaggaaggtggggatgacgtcaaatcatcatgccccttatgtctagggctacacacgtgctacaatggtcggtacaatgagatgcaacctcgcgagagtgagcaaaactataaaaccgatctcagttcggattgtaggctgaaactcgcctacatgaagctggagttgctagtaatcgcgaatcagaatgtcgcggtgaatacgttcccgggccttgtacacaccgcccgtcacaccatgagagttggcaatacccaaagttcgtgagctaaccgcaaggaggcagcgacctaaggtagggtcagcgattggggtgaagtcgtaacaaggtagccgtaggagaacctgcggctggatcacctcctttctatggagaaatctagcaaacatggcgtttgactagtacaaagatgcaaagcatctataaaaattacaacttgctcaaaggttacttaatgactattgattctgttcaattttgaaagactaagtctttcaatgttctttgaaaattgcacatagattaatgtatataatacaacaaagccaagaataatattctttgtgaatgattaatataaccagttttgtatatcaaaacttaaaaaggtcaagctacaaagggcgcatggtgaatgccttggcatcaggagccgatgaaggacgtgataagctgcgataagcttcgggtaggcgcacatagccagagatccggagatttccgaatggggaaacccgcatgagaaacctcatgcatcgtaaagtgaatacatagctttatgaaggaacacctagggaactgaaacatctaagtacctagaggaagagaaagaaaaatcgattttcttagtagcggcgagcgaaaaggaaagagcccaaaccagagatttatctctggggttgcggacagaacataacgtgaaattatgattaaccgaacacaactggaaagttggaccgtaggaggtaatagtcctgtaagtaaaagtcataatgatcagttctgcaccagagtaccacgagacacgtgaaaccttgtgggaagcagggaggaccacctcccaaggctaaatactacctgatgaccgatagtgaagcagtaccgtgagggaaaggtgaaaagaaccccgggaggggagtgaaatagaacctgaaaccatgtgcctacaaccgatcaaagcaccttatgtgtgtgatgatgtgctttttgtagaacgagccaacgagttacggtatgtagcgaggttaagtacttaaggtacggagccgaagggaaaccgagtcttaatagggcgactagttgcatgctgtagacccgaaaccgggtgacctatccatggccaggttgaagcgagggtaaaacctcgtggaggaccgaaccacgttgctgttgaaaaagcatgggatgagctgtggatagcggagaaattccaatcgaactcggatatagctggttctcctcgaaatagctttagggctagcgtcgtgaaatgtgagtactggaggtagagcactgaataggctagggggcatagcgcttaccgaaccttatcaaactccgaatgccagatactatcagcacggcagtcagactatgaaagataagttccatggtcaaaagggaaacagcccagatcgtcagctaaggtcccaaagtgtaagttaagtggaaaaggatgtgggatttctaagacaactaggatgttggcttagaagcagccactcattaaaagagtgcgtaatagctcactagtcaagagatcctgcgccgaaaatgtccggggctcaaacttaccaccgaagctacgggttcatactttgtatgagcggtagaggagcgtcgtaatcgggctgaagtcgtaccgtaaggagcggtggactgattacgagtgagaatgttggcattagtagcgagatgtaggtgagaatcctacaggccgaatatctaaggtttcctgagtaaagtttgtcttctcagggttagtcgggacctaaggcgaggccgagaggcgtagtcgatggacaattggttgatattccaataccactataatcgttattatcgatggtgtgacggagaaggataggatgtgccagctattggatgctggtctaagcgttgagggagttagaacaggcaaatccgttctaacaattctagggcgtgatggggaaggttctacggaaccgaagtatctgatttcatgcttccaagaaaagcatctagaaagagaagtagtgcccgtaccgcaaaccgacacaggtagatgaggagagaatcctaaggccgacggaagaatcacagttaaggaactaggcaaattgaccccgtaacttcgggagaaggggtgcctaccatctggtaggccgcagagaataggcacaagcaactgtttaacaaaaacacaggtctctgctaaagcgtaagctgatgtataggggctgacgcctgcccggtgctggaaggttaaggggaacacttagcgcaagcgaaggtgtgaacttaagccccagtaaacggcggccgtaactataacggtcctaaggtagcgaaattccttgtcaggtaagttctgacccgcacgaatggcgtaatgacttgtgcactgtctcaactgtgaatccggcgaagttgtagtgcgagtgaagatgctcgctacccgcgattggacggaaagaccccgtagagctttactgtagcttagcattgaatttcggtattgtctgtacaggataggtgggagactgggaaattagggcgtcagccttaatggagtcgttgttgggataccaccctgatagtattgaagttctaactggatgccatgaaactggtgacaggacattgttaggtgggcagtttgactggggcggtcgcctcctaaaatgtaacggaggcgcccaaaggttccctcagaacggtcggaaatcgttcgtagagtgtaaaggcataagggagcctgactgcgagacctacaagtcgagcagggacgaaagtcgggcttagtgatccggtggtacctcgtgggagggccatcgctcaacggataaaagctacctcggggataacaggctgatctcccccaagagttcacatcgacggggaggtttggcacctcgatgtcggctcgtcgcatcctggggctgaagtaggtcccaagggttgggctgttcgcccattaaagcggcacgcgagctgggttcagaacgtcgtgagacagttcggtccctatccgtcgcgggcgtaggaaatttgagaggagctgtccttagtacgagaggaccgggatggactgacctatggtgtaccagttgtttcgccagaagcatagctgggtagctaagtcgggaagggataaacgctgaaagcatctaagtgtgaagcccacctcaagatgagatttcccatagcataagctagtaagaccccttgaagactacaaggttgataggtcagaggtgtaagtgcggtaacgtatttagctgactgatactaataggtcgagggcttgaccaatataatcgagttgtaaatacattaaaaactatgtgcaattttgaaagaacaaaagttttttcaaaaagttaataaggaaactcgctcagacgagctgaggagtacagttcttttagctaaatcatagatttagaaaggactaggatctggtggtgatggcatagaggtaacactccttcccattccgaacaggacagttaaggtctatagcgccgatggtactgcatgggagactgtgtggaagagtaggacgtcgccaggtaagagtaaggatagttagaaataactatcctttttagcgtataaaaatataattaattacagatttattttcctatataaaatgaataattaaatttgaataattagatacaatttaaatgtttttaaatgaaatttatcatttaacatattaattatttattaccgaatcgagcgatagctcttttcaaggtacgattgtataagaatttagaataaatatttacttaatggataaatttctagaaaaaaataaatttatatggttcaacttatacacaatttgtttttgttatagctaaaaacatgttgatcatgtgaataattaaataaaatttttataatatttatacggagaagaaacttttataaggtgattaatataaaattatataaaaatgctaattatttagaattacaaaaatcgaacaataaatataaaaaggactataatatatggtatataggttattgagtggataaatatgtaattatgaatggtatatcgaaccaggcgtatcaatcgaaatattatagagataaatggagaaaaataaagaaatataggaataaattaattaaatgacttataatgtgctgatatagaatcagatgtatgatactataaaacacgtcgctgagagcggcaaacaacaaattaaaacttgataaaagctgaaattaataaagcaaaataagttttaaaaaaagttgttgacacatgtcaaaccaagtgatatactaagtaagttgcttgagggtgacaacataataacaacgtaaagttgtgaaagaaaatggtctttgaaaattgaacagaatataatataaacatttaagtaaaccagcaattctttattttgagtaagctaagattaaactttttattgagagtttgatcctggctcaggacgaacgctggcggcgtgcttaacacatgcaagtcgagcgatgaagctccttcgggagtggattagcggcggacgggtgagtaacacgtgggtaacctgcctcatagaggggaatagcctttcgaaaggaagattaataccgcataagattgtagtaccgcatggtacagcaattaaaggagtaatccgctatgagatggacccgcgtcgcattagctagttggtgaggtaacggctcaccaaggcgacgatgcgtagccgacctgagagggtgatcggccacattgggactgagacacggcccagactcctacgggaggcagcagtggggaatattgcacaatgggggaaaccctgatgcagcaacgccgcgtgagtgatgacggtcttcggattgtaaagctctgtctttagggacgataatgacggtacctaaggaggaagccacggctaactacgtgccagcagccgcggtaatacgtaggtggcaagcgttgtccggatttactgggcgtaaagggagcgtaggtggatatttaagtgggatgtgaaatactcgggcttaacctgggtgctgcattccaaactggatatctagagtgcaggagaggaaaggagaattcctagtgtagcggtgaaatgcgtagagattaggaagaataccagtggcgaaggcgcctttctggactgtaactgacactgaggctcgaaagcgtggggagcaaacaggattagataccctggtagtccacgccgtaaacgatgaatactaggtgtaggggttgtcatgacctctgtgccgccgctaacgcattaagtattccgcctggggagtacggtcgcaagattaaaactcaaaggaattgacgggggcccgcacaagcagcggagcatgtggtttaattcgaagcaacgcgaagaaccttacctagacttgacatctcctgaattactctgtaatagaggaagccacttcggtggcaggaagacaggtggtgcatggttgtcgtcagctcgtgtcgtgagatgttgggttaagtcccgcaacgagcgcaacccttattgttagttgctaccatttagttgagcactctagcgagactgcccgggttaaccgggaggaaggtggggatgacgtcaaatcatcatgccccttatgtctagggctacacacgtgctacaatggtcggtacaatgagatgcaacctcgcgagagtgagcaaaactataaaaccgatctcagttcggattgtaggctgaaactcgcctacatgaagctggagttgctagtaatcgcgaatcagaatgtcgcggtgaatacgttcccgggccttgtacacaccgcccgtcacaccatgagagttggcaatacccaaagttcgtgagctaaccgcaaggaggcagcgacctaaggtagggtcagcgattggggtgaagtcgtaacaaggtagccgtaggagaacctgcggctggatcacctcctttctatggagaaatctagcaaacatgacgtttgactagtataaagatgcaaagcatctataaaattacaacttgctcaaaggttacttaatgactattgattctgttcaattttgaaagactaggtctttcaatgttctttgaaaattgcacatagattaatgtatataatacaacaaagccaagaataatattctttgtgaatgattaatataaccagttttgtatatcaaaacttaaaaaggtcaagctacaaagggcgcatggtgaatgccttggcatcaggagccgatgaaggacgtgataagctgcgataagcttcgggtaggcgcacatagccagagatccggagatttccgaatggggaaacccgcatgagaaacctcatgcatcgtaaagtgaatacatagctttatgaaggaacacctagggaactgaaacatctaagtacctagaggaagagaaagaaaaatcgattttcttagtagcggcgagcgaaaaggaaagagcccaaaccagagatttatctctggggttgcggacagaacataacgtgaaattatgattaaccgaacacaactggaaagttggaccgtaggaggtaatagtcctgtaagtaaaagtcataatgatcagttctgcaccagagtaccacgagacacgtgaaaccttgtgggaagcagggaggaccacctcccaaggctaaatactacctgatgaccgatagtgaagcagtaccgtgagggaaaggtgaaaagaaccccgggaggggagtgaaatagaacctgaaaccatgtgcctacaaccgatcaaagcaccttatgtgtgtgatgatgtgctttttgtagaacgagccaacgagttacggtatgtagcgaggttaagtacttaaggtacggagccgaagggaaaccgagtcttaatagggcgactagttgcatgctgtagacccgaaaccgggtgacctatccatggccaggttgaagcgagggtaaaacctcgtggaggaccgaaccacgttgctgttgaaaaagcatgggatgagctgtggatagcggagaaattccaatcgaactcggatatagctggttctcctcgaaatagctttagggctagcgtcgtgaaatgtgagtactggaggtagagcactgaataggctagggggcatagcgcttaccgaaccttatcaaactccgaatgccagatactatcagcacggcagtcagactatgaaagataagttccatggtcaaaagggaaacagcccagatcgtcagctaaggtcccaaagtgtaagttaagtggaaaaggatgtgggatttctaagacaactaggatgttggcttagaagcagccactcattaaaagagtgcgtaatagctcactagtcaagagatcctgcgccgaaaatgtccggggctcaaacttaccaccgaagctacgggttcatactttgtatgagcggtagaggagcgtcgtaatcgggctgaagtcgtaccgtaaggagcggtggactgattacgagtgagaatgttggcattagtagcgagatgtaggtgagaatcctacaggccgaatatctaaggtttcctgagtaaagtttgtcttctcagggttagtcgggacctaaggcgaggccgagaggcgtagtcgatggacaattggttgatattccaataccactataatcgttattatcgatggtgtgacggagaaggataggatgtgccagctattggatgctggtctaagcgttgagggagttagaacaggcaaatccattctaacaatcctagggcgtgatggggaaggttccacggaaccgaagtatctgatttcatgcttccaagaaaagcatctagaaagagaagtagtgcccgtaccgcaaaccgacacaggtagatgaggagagaatcctaaggccgacggaagaatcacagttaaggaactaggcaaattgaccccgtaacttcgggagaaggggtgcctaccatctggtaggccgcagagaataggcacaagcaactgtttaacaaaaacacaggtctctgctaaagcgtaagctgatgtataggggctgacgcctgcccggtgctggaaggttaaggggaacacttagcgcaagcgaaggtgtgaacttaagccccagtaaacggcggccgtaactataacggtcctaaggtagcgaaattccttgtcaggtaagttctgacccgcacgaatggcgtaatgacttgtgcactgtctcaactgtgaatccggcgaagttgtagtgcgagtgaagatgctcgctacccgcgattggacggaaagaccccgtagagctttactgtagcttagcattgaatttcggtattgtctgtacaggataggtgggagactgggaaattagggcgtcagccttaatggagtcgttgttgggataccaccctgatagtattgaagttctaactggatgccatgaaactggtgacaggacattgttaggtgggcagtttgactggggcggtcgcctcctaaaatgtaacggaggcgcccaaaggttccctcagaacggtcggaaatcgttcgtagagtgtaaaggcataagggagcctgactgcgagacctacaagtcgagcagggacgaaagtcgggcttagtgatccggtggtacctcgtgggagggccatcgctcaacggataaaagctacctcggggataacaggctgatctcccccaagagttcacatcgacggggaggtttggcacctcgatgtcggctcgtcgcatcctggggctgaagtaggtcccaagggttgggctgttcgcccattaaagcggcacgcgagctgggttcagaacgtcgtgagacagttcggtccctatccgtcgcgggcgtaggaaatttgagaggagctgtccttagtacgagaggaccgggatggactgacctatggtgtaccagttgtttcgccagaagcatagctgggtagctaagtcgggaagggataaacgctgaaagcatctaagtgtgaagcccacctcaagatgagatttcccatagcataagctagtaagaccccttgaagactacaaggttgataggtcagaggtgtaagtgcggtaacgtatttagctgactgatactaataggtcgagggcttgaccaatataatcgagttgtaaatacattaaaaactatgtgcaattttgaaagaacaaaagttttttcaaaaagttaataaggaaactcgctcagacgagctgaggagtacagttcttttagctaaatcatagatttagaaaggactaggatctggtggtgatggcatagaggtaacactccttcccattccgaacaggacagttaaggtctatagcgccgatggtactgcatgggagactgtgtggaagagtaggacgtcgccaggtaagagtaaggatagttagaaataactatcctttttagcgtataaaaatataattaattacagatttattttcctatataaaatgaataattaaatttgaataattagatacaatttaaatgtttttaaatgaaatttatcatttaacatattaattatttattaccgaatcgagcgatagctcttttcaaggtacgattgtataagaatttagaataaatatttacttaatggataaatttctagaaaaaaataaatttatatggttcaacttatacacaatttgtttttgttatagctaaaaacatgttgatcatgtgaataattaaataaaatttttataatatttatacggagaagaaacttttataaggtgattaatataaaattatataaaaatgctaattatttagaattacaaaaatcgaacaataaatataaaaaggactataatatatggtatataggttattgagtggataaatatgtaattatgaatggtatatcgaaccaggcgtatcaatcgaaatattatagagataaatggagaaaaataaagaaatataggaataaattaattaaatgacttataatgtgctgatatagaatcagatgtatgatactataaaacacgtcgctgagagcggcaaacaacaaattaaaacttgataaaagctgaaattaataaagcaaaataagttttaaaaaaagttgttgacacatgtcaaaccaagtgatatactaagtaagttgcttgagggtgacaacataataacaacgtaaagttgtgaaagaaaatggtctttgaaaattgaacagaatataatataaacatttaagtaaaccagcaattctttattttgagtaagctaagattaaactttttattgagagtttgatcctggctcaggacgaacgctggcggcgtgcttaacacatgcaagtcgagcgatgaagctccttcgggagtggattagcggcggacgggtgagtaacacgtgggtaacctgcctcatagaggggaatagcctttcgaaaggaagattaataccgcataagattgtagtaccgcatggtacagcaattaaaggagtaatccgctatgagatggacccgcgtcgcattagctagttggtgaggtaacggctcaccaaggcgacgatgcgtagccgacctgagagggtgatcggccacattgggactgagacacggcccagactcctacgggaggcagcagtggggaatattgcacaatgggggaaaccctgatgcagcaacgccgcgtgagtgatgacggtcttcggattgtaaagctctgtctttagggacgataatgacggtacctaaggaggaagccacggctaactacgtgccagcagccgcggtaatacgtaggtggcaagcgttgtccggatttactgggcgtaaagggagcgtaggtggatatttaagtgggatgtgaaatacccgggcttaacctgggtgctgcattccaaactggatatctagagtgcaggagaggaaaggagaattcctagtgtagcggtgaaatgcgtagagattaggaagaataccagtggcgaaggcgcctttctggactgtaactgacactgaggctcgaaagcgtggggagcaaacaggattagataccctggtagtccacgccgtaaacgatgaatactaggtgtaggggttgtcatgacctctgtgccgccgctaacgcattaagtattccgcctggggagtacggtcgcaagattaaaactcaaaggaattgacgggggcccgcacaagcagcggagcatgtggtttaattcgaagcaacgcgaagaaccttacctagacttgacatctcctgaattactctgtaatggaggaagccacttcggtggcaggaagacaggtggtgcatggttgtcgtcagctcgtgtcgtgagatgttgggttaagtcccgcaacgagcgcaacccttattgttagttgctaccatttagttgagcactctagcgagactgcccgggttaaccgggaggaaggtggggatgacgtcaaatcatcatgccccttatgtctagggctacacacgtgctacaatggtcggtacaatgagatgcaacctcgcgagagtgagcaaaactataaaaccgatctcagttcggattgtaggctgaaactcgcctacatgaagctggagttgctagtaatcgcgaatcagaatgtcgcggtgaatacgttcccgggccttgtacacaccgcccgtcacaccatgagagttggcaatacccaaagttcgtgagctaaccgcaaggaggcagcgacctaaggtagggtcagcgattggggtgaagtcgtaacaaggtagccgtaggagaacctgcggctggatcacctcctttctatggagaaatctagcaaacatgacgtttgactagtataaagatgcaaagcatctataaaattacaacttgctcaaaggttacttaatgactattgattctgttcaattttgaaagactaggtctttcaatgttctttgaaaattgcacatagattaatgtatataatacaacaaagccaagaataatattctttgtgaatgattaatataaccagttttgtatatcaaaacttaaaaaggtcaagctacaaagggcgcatggtgaatgccttggcatcaggagccgatgaaggacgtgataagctgcgataagcttcgggtaggcgcacatagccagagatccggagatttccgaatggggaaacccgcatgagaaacctcatgcatcgtaaagtgaatacatagctttatgaaggaacacctagggaactgaaacatctaagtacctagaggaagagaaagaaaaatcgattttcttagtagcggcgagcgaaaaggaaagagcccaaaccagagatttatctctggggttgcggacagaacataacgtgaaattatgattaaccgaacacaactggaaagttggaccgtaggaggtaatagtcctgtaagtaaaagtcataatgatcagttctgcaccagagtaccacgagacacgtgaaaccttgtgggaagcagggaggaccacctcccaaggctaaatactacctgatgaccgatagtgaagcagtaccgtgagggaaaggtgaaaagaaccccgggaggggagtgaaatagaacctgaaaccatgtgcctacaaccgatcaaagcaccttatgtgtgtgatgatgtgctttttgtagaacgagccaacgagttacggtatgtagcgaggttaagtacttaaggtacggagccgaagggaaaccgagtcttaatagggcgactagttgcatgctgtagacccgaaaccgggtgacctatccatggccaggttgaagcgagggtaaaacctcgtggaggaccgaaccacgttgctgttgaaaaagcatgggatgagctgtggatagcggagaaattccaatcgaactcggatatagctggttctcctcgaaatagctttagggctagcgtcgtgaaatgtgagtactggaggtagagcactgaataggctagggggcatagcgcttaccgaaccttatcaaactccgaatgccagatactatcagcacggcagtcagactatgaaagataagttccatggtcaaaagggaaacagcccagatcgtcagctaaggtcccaaagtgtaagttaagtggaaaaggatgtgggatttctaagacaactaggatgttggcttagaagcagccactcattaaaagagtgcgtaatagctcactagtcaagagatcctgcgccgaaaatgtccggggctcaaacttaccaccgaagctacgggttcatactttgtatgagcggtagaggagcgtcgtaatcgggctgaagtcgtaccgtaaggagcggtggactgattacgagtgagaatgttggcattagtagcgagatgtaggtgagaatcctacaggccgaatatctaaggtttcctgagtaaagtttgtcttctcagggttagtcgggacctaaggcgaggccgagaggcgtagtcgatggacaattggttgatattccaataccactataatcgttattatcgatggtgtgacggagaaggataggatgtgccagctattggatgctggtctaagcgttgagggagttagaacaggcaaatccattctaacaatcctagggcgtgatggggaaggttccacggaaccgaagtatctgatttcatgcttccaagaaaagcatctagaaagagaagtagtgcccgtaccgcaaaccgacacaggtagatgaggagagaatcctaaggccgacggaagaatcacagttaaggaactaggcaaattgaccccgtaacttcgggagaaggggtgcctaccatctggtaggccgcagagaataggcacaagcaactgtttaacaaaaacacaggtctctgctaaagcgtaagctgatgtataggggctgacgcctgcccggtgctggaaggttaaggggaacacttagcgcaagcgaaggtgtgaacttaagccccagtaaacggcggccgtaactataacggtcctaaggtagcgaaattccttgtcaggtaagttctgacccgcacgaatggcgtaatgacttgtgcactgtctcaactgtgaatccggcgaagttgtagtgcgagtgaagatgctcgctacccgcgattggacggaaagaccccgtagagctttactgtagcttagcattgaatttcggtattgtctgtacaggataggtgggagactgggaaattagggcgtcagccttaatggagtcgttgttgggataccaccctgatagtattgaagttctaactggatgccatgaaactggtgacaggacattgttaggtgggcagtttgactggggcggtcgcctcctaaaatgtaacggaggcgcccaaaggttccctcagaacggtcggaaatcgttcgtagagtgtaaaggcataagggagcctgactgcgagacctacaagtcgagcagggacgaaagtcgggcttagtgatccggtggtacctcgtgggagggccatcgctcaacggataaaagctacctcggggataacaggctgatctcccccaagagttcacatcgacggggaggtttggcacctcgatgtcggctcgtcgcatcctggggctgaagtaggtcccaagggttgggctgttcgcccattaaagcggcacgcgagctgggttcagaacgtcgtgagacagttcggtccctatccgtcgcgggcgtaggaaatttgagaggagctgtccttagtacgagaggaccgggatggactgacctatggtgtaccagttgtttcgccagaagcatagctgggtagctaagtcgggaagggataaacgctgaaagcatctaagtgtgaagcccacctcaagatgagatttcccatagcataagctagtaagaccccttgaagactacaaggttgataggtcagaggtgtaagtgcggtaacgtatttagctgactgatactaataggtcgagggcttgaccaatataatcgagttgtaaatacattaattaagaggaaactcgactcacttagttcgctgagtaagttcgattaaccaaatgtaaaatttggattctcacttatgtgcaattttgaaagaacaaaagttttttcaaaaagttaataaggaaactcgctcagacgagctgaggagtacagttcttttagctaaatcatagatttagaaaggactaggatctggtggtgatggcatagaggtaacactccttcccattccgaacaggacagttaaggtctatagcgccgatggtactgcatgggagactgtgtggaagagtaggacgtcgccaggtaagagtaaggatagttagaaataactatcctttttagcgtataaaaatataattaattacagatttattttcctatataaaatgaataattaaatttgaataattagatacaatttaaatgtttttaaatcaaattatttattatgtactattaaaatagtgatagatttttcaaagaatagattgaaacttatctaaaattgacattttataatattacatataaaatagacacattgaaaaaacaaggaggggcttatgtattcatatcaattaatgttggcaattatttgcccactagtcttttgtgctggatttgtagacgctgttgcagggggaggcggtttaatatcattaccagcatatatttttgcaggagtacctatacatgtagcatatggcactaataagtttgctaattgtacaggcacttttgtagcttgcatgaaatttcttaaaagtggaaatataaaaattaaatctggtttattatctgctttaggagcacttattggttcttggtttggaacgcaattagttttaatacttgatgaaaaatatttaaaatattgtttaatgataatacttcccattgtagcagtatttttattattcaatagaaattttggatccaacaataaaagtaaggatatatcagataagaaagcaaatttattatcctttattataggattagttataggggcttatgacggattttttggaccaggtacaggaacgtttttagtattagcttttacttcattactaggctttaatttaataactgcttctggcaatgcaaaaatagtaaatttagcatcaaattttgcagctctaattgcatatataattaatggaaaagtatggcttagtataggaataccagctgctatttgtgcagtattaggtaattatattggtgctcacatggcaataaaaaatggagctagagtgattaagcccattattttattagttgttttcatgttattgggaaaagttatatacagttttatttaaacaattaaagatatatcgattgattaaagggaagaatttaaattttctattaaaatataattctaaaaaatattttacaaaaatttatattagtggtataataaacttaatttaatacggaaacctatggtagaggtgctgtgtataaagagtaactataaggagctggcaagctttgatagatagtgaaaggtatagcagccgaagagataaattaggcatatattatttctgggcatgtataaaatatatacatgactgtcacgttagtggagagctacaaggattaacaggattgatttaaatagtaaatgttttatatttattattatgttttaactatatatactatatgtaattttattataatagtattcaattttgttctaactttaagtgattaactctacccgttggttttacccaacgggttttcttatttaataaattaaatttcaaggagtgaatttattaatgaatctacaaggagttatggtaccattagtaacaccattcaaaaatggaaaagtcgattatgagtcatatagaaatataattgatcattgtattgaagaaggtgtcagtggaataatacctcttgcaactacaggtgaatcacctacaatttctgaatatgaatacgaggaaatattatcgaaaacaatagaatatacaaaaaagaaagtctctatttatactgggcttggtggaaataatacaatagaagttgcaaataaattaaagaaattagaaaagtatgatattgatggaatattatctgttgcaccatattattcaagacctaatcaaaagggattgtacgagcattttagatgtatatcagaatcaacagatatgaatattattatatataacattccatatagaacagggacaaatattcaaaatgaaacactattagaattatcacaaataaataatatagttggagtaaaagattgttctggagatatgaaacagactactgatttattaatcaacagacctgaaaatttttcaatattaacaggtgaagatgcatatttttatacaactcttgctttaggaggagatggaggaatactagcttctgcaagtgttaaaacaaaggaatttgtagaaatttataatttaataaaaaataataaaaataaagatgcatttgagaaatggaaggatctttacaatatgataccactattatttgcagagcctaatcctacaccagtaaaatattgtttaaagaaattaggattaatagaatctgatgaagtaagacttccattagtaaatataagtaaagaattagaggaaaaacttgatactttttttaattaaaagcaaggtatttattaagaactagaaaacaatatttctagtataattaattatataataaactaaaggtttatttcgatttggggcattggaatagcgactttagcaataaataataagtaaattatattgaataataatgtaatattatttttattatcatacgaaataattaatctagattacattatatttaaatttaagtaattaagaagaagcaaaataagcttcttcttttttattttaaaaaagaatattaaagaatttaataaaaaatattaaaaaaacgttttctttgaacaaatttagaaaaaaaccaataaatgtgactgaatatggaaaaaattactttgactaggataatatttaagagtaatataaaaactgataaaaactaaataaggagtggataataatgatgcccaagttcttttctatgattaagaacaaggaaattactaaacaacagatggtgaaagatataatagcagggattattgttgctgttatagcattaccattatctatagcccttgcaatatcttcaggagtttctccagaaaaggggcttataacggcaatatttgcaggatttgtaatatctcttttagggggtagcaaagttcagattggggggccaacagctgcatttgtaactataatttattctataatacaggaacatggtctagatggattaataacagcagttataatggctggggttatgcttgttataatgggattattgaagtttggaacactaataaaatatatacctaaaactataactgtaggttttacagcaggtatagcactaacattagtttctacacagcttaaagattttttggggcttaaaattgaggatgttccatcagaatttattccaaaatgggaaagctatttctcaaatatgaatacaatagatatgtggtcaatggcaataggattattatgtattgctattatagtgttatggccaaaaataaataagactataccgggttcaatgattgctctaatagttgcaacccttatggtaaagttcatgaatatacctatagatactattggaagtaggtttacagaaatttcttcagctattcctgtaccggtattaccttcatttagtataggaactataaataaattatttgttccagctgttacaattgctatacttggagcattagaatcactattgtcagcagttgtagcggatgaaatgataggagatactcatgattctaatatggagcttgtagcacaaggattagctaatattacatcaggactatttggaggaataccagcaactggagctatagcaagaacagcttcaaatgttaaatctggaggaagaagtccaatttcaggtatggtacatgcaataacacttcttataactatgcttttattaatgccattagcaaaaatgattccaatgactgcattatcagcaatattaattgttgtagcatataatatgagtgaatggagaacatttaaagcgttattaaaggcaccaaagagcgacattgcagttttattaataacttttagctgtactgtaatctttgatttagttgttgctataggttttgggatgataataactatggctctgtttatgaagagagtaagtgatacaactgaaataagggatcttgtagatgaagaggtatttgatgatgaaatcactaaagtcttagaaaaagcagatggaaaaataaatgtttatcaagttaatggaccaatgtttttcggagtagttcaagaatttataagcaaaatgaaggaattagagtcgactacagaggtagtaatacttgatatgagacatactcatgctgttgatgcttcagctattgatgccatgacaaagcttcttaagcaatgtgaaaagttaggcataaaattatatttaactcatgttcaagagcagcctagaaaggtcctagacaatatgggatttgcaataaaagttggacacaagaatatatatgatactaaaacagaagcaattgaagatgcttatgattatgtgaagaatttagcatagacaatatataaaaatcatacatcaagtataagtaaatacataaatagctacttagaatataaatatttaataataaatatttaatagtaggatttgtttgtaaaaagtataatttttttatttattaagactggtttagggcttatagcattaaatcggtcttaatttttatataaattaagttaaaaatataaaagagtttatgttaagatatatagtaatgtaatattgtagaattaaagatacaaatatatagggggataatttgtggaaaaaaattgggaaagaacgttaccttttctttatgtagatagggaaactataaataaactttttaaaggaattataaaaaaagatgagataattagtgttaaaccagttgatgagggctgtagaactagtaactacattatatattcaatggacaataagaaatatttattaaaaatatttttttcagatgatcagcaatatagaaaagaatgtgaaattttaagtatactaaaagataaaatatgtgttcaagaaatttgtaaatttgataaatctaatttgattaatgataaatattatgtaatatacaaatatatagaaggtgtgacactatcaaaatcattaaataatggagatatgactaatgaatatattattcgtgatgcagctaatattttagctaatattcataagaaaagattcagtagtgttggatttttaaatgatgaattagaagtttatcataagttacctccattaaacaaatggtatgatcagtttattacagataaagttgaaaaaagattaggaaaagatattattcaaaagataagaaaagtaattaacgaaaatatagaggatttattaagtttagataatgaccctagactcgttcatggagactttcaaggaactaatatattagtagatcataacaaaattactggtattatagattgggaattcgcaatggctgggcatccacttgctgatataggtcaactatttagatatgaggaatattttaataaacaattaatttcaatatttgaagatgaatatagaaaaaaatcagattatatattacctgataattggtataaacttagcaagataagggatttagcaaatttaattcaattattggactttgaagaggatatgcccaataagtatatggagataaaaactttgataaaaaaatttcaaaatgatgttgacattggtaaaatttaataatatactagtctacaagaacaatggagttcaataaaggtaccaacaggttggtaaatttattgagctccatttcgttttgtaatgaatttttcttagtactatgaaaaaagtaaaaaataatattaattttaatataataaaaaataaaattttttattattaatattaagggggattatatatggaaataaatttagcagatagtgcatttgttatgatttgctctgcaatggtattttttatgacacctggacttgcttttttctatgctgggatggttagaagaaagaatgtattaaatacacttatggcttcgtttttttgttgcggtttagcatcattattgtgggtaattataggttattctttgtcatttggtaatgactttcatggaattgttggtggatttaatcatttattcttaaatggagttggtgcagatattaattctgcatattcaaatagtatacctgaattattatttgctttgtttcaaatgatgtttgcaataattacaccagcacttataactggttctttaacaggaagaatgaaattttcagcattattcgtttttatagccgtatggtcaatattagtgtactatccaatggcgcatatggtttggggtgatggtggattgataaaagaacttggagcagttgattttgctggaggaaatgtagttcatataagctcgggagtgtcaggtttagtagcgtgtataatgcttggaaaaagaagaggttatggaatgatatcttataaaccacacaacattccatttgtagtacttggagctgggctactatggtttggatggtttgggtttaatgcaggaagtgcacttggagcagaaccacttgcagtacaagcatttatgactactaacacatcagcagcaacagcaatgctttcttggatgcttatagaaaaaattgcacatggaaaaccaacaatgcttggagctgcaactggggctgttgtagggttagttgcaattactcctggagcaggatttgtttcaatatgggcatctataatcattggagcattagtatctccaatatgttatttttgcatgggacatcttaagaataaatttggatatgatgattcattagatgcctttggatgtcacggagtcggtggaatatggggaggcattgccacaggattatttactcagacttcaattaattcgggagcaaaatggaatggtttatttttcggagactttaagcttttaggagcacagattttaagtatagttattacagcagcatttgcaggaattatgacgtttgttataattaaggtaataagtttatttatggatataagagtagaagcatcagaagaagctgatggtcttgatattgtagaacatggagaatctgcttaccctgcatttacaggtttagattaattaaaatattaaagtgaaaggtgatagataattatgaagagaatagaagctatcataaggccttcaaaacttgaagaaataaaagaagcattaaagaataataatattaatggagttactataagccaagtaatgggatgtggtaaacaattaggatggaaagaatatcatagaggaactgaacttattactaatgtattaccgaaaattgaagtaaaaatggtaatagaggatagtaaagttgaagaagtaatagaaataatttcttcaatagctaagactggtgaagttggagatggtaagatattcgttatagatatatgtgattgtgtaagaataagaactggagaaagaggaaatgaggcactataagttaaaaaaatattgtttaagagacaataaacttaattaaattaattaaactgtatataattattgaaataattagtttttgagatttaaatagttaagattatcgaaaatatagtaaaatatgatacattaatttgaataaatacaaaaaaatactataaaaatgcaatttataatattataaattgcattttttattttgtaatttattatttgaattaaaaacaatacagtgtatttgaatgaatattagagaatattatagataaattaaaaaaataaggtaaaaaataagatttaaattacataaaatccccagtggattacaagaatatgaatgaaaatttttcaaaattgcaaaaaatataaaatacatttaaaattgtatttagtttacaaaatacttaaacatttatttaatatttaaggattaatattaaataaatgtttaaactttagaagtatatttttatataaatatcaaaggaggaagaaaaatgagtaattttgcagggaatgtggaatggttaagtaattttttatacacatatatacttgtggctatgcttatagtgttgggtatattctttacatgtaaaacaaaatttgttcaatttagatacattaaagagatgttcagattattaggtgatggggcaactagtaataaagaagatggacacgtatcatcatttcaggctttttgtataagtacagcttcaagagtaggtactggaaatttagcaggtatagcaatagctatttcaataggaggaccaggtgcaatattctggatgtggcttatagcattaattggtgcaggatcaagctttgtagaatcaacattagcacagatatataaagaaaaggatagcaaatgtgcatttagaggtggaccagcatattacatagaaaaaggtcttaacaagaaatggatggggattttattctcaatacttataactgttagttttggtttgatttttaattcagttcaatctaatacaatttcaattgccatgaatgaggcttttggatttgatagattaactgttggaattgtattaacaattttaacaatagtaataataatcgggggcgttcaaagagttgctaaggtttcaagtattattgttcctgttatggcagtgctatatatattagttgcattatttgtaatatttaagaatattggagaggttccaagaatattactattaatttttgaaaatgcatttggtgtagagcaagctgttggtggaagtttaggaggagtaattcttatagggattaagagagggttattctcaaacgaagctggaatggggagtgcaccaaatgcagcagctacagcaaatgtttcacatcctgttaagcaagggttaattcaaacattagcggtattcaatgatactataataatatgtagttgtactgctttcattattttattatctgatgttgatctaagtggtgggttaacaggaattcagcttactcaaaatgctttaagttctcagattggaagtataggaagtacatttattgctatatgtatatttttgtttgcctttagttctattgtaggaaattactactatggggagtcaaacattgaatttttaactaataagagagtatacataggtatttatagagcagcagttgcctcaatggttctttttggagcaatagcaagcttagatattgtttggaacctagcagacgtatttatggctggaatggctatattaaatcttattgcaataacagcattaggaaagtatgcatataaagcattagatgattaccgtaagcagaaaaagaatggaataaaggaacctgtatttaaggcttcatctattgaaggtttaaaaaatactacagagtggcaatagattaatatataaattagtatttcaagatgttatctgattataatttttaatatttgatataatagatatatgtattaatttaattattactatataaacttaataataatatttctttggggtaaggttaaatattattatattaagataatttaggtagattaattaatataaaaactaagattgatttacattataattttattgttattataagttgctaaatttagtgtttattataggagaatattatgaaagacaaagattatgagatttttttagaaatagaaaatcatttgttaaatgatgataaaccatcactttttttgaaaaagctagcagatgaaaaattactcaataattatccattttcaatgattggagatctacaagatgttgagcaaaatcctaaatatcatccagaaggaaatgtttttatacataccatgatggttattgatgaaggtgctataaatagagaaaaaagtaatgataaaagagcatttatgtggtcattattattacatgatgttggaaaaaaaccaactacaaaaatgagaagaggaagacttacatcttatgatcatgatagggttggaagggatatggcggaaaaatttttagagtatttcaatcaagataagaattttgttgataaagttattggtcttgtaagatggcatatgcagagtttgtttgtaataaaagattcaaggtttcagaatatcgatgagatgctaaaagatgttgatgtgaatgagattgttttagtagctcttgcagatagacttggaagaggtaatttagataattttgcaagagaagaaacaattaatgaaattaattgttttgaagaaaagcttataaagtataaaaaataatataaaatttactatttataactttaataaatataataattatagtattaattatagaaaaaagaggagataagaattacatatatttgtaattcttatcttctctttttatgtttgtatatagataataaaacgctataagttgatgtgttttaccagtaaaaaagttaatgaaaaactctaataataatatcgattaaagtataatgagtatattgataagatgaggctattagcgggaatgctaagaaatctaagtataaatttttacttaaaaaaaaacacaaaaattgtagtttaaaaataaaataattagttaaataatgttgattattatggtattataaatttgtataataaaaacatatttaataaaaaattaacaaaattggaggaaaaaatggatatatttttagttataggactaattggaggtagtgcggttgttctttcgggattattaatgaaaggcgctagtccaagcatattgtttagtggtgaagcaataatggtaattattgttggtagtataattggtattttaaattcttttccaaagaacgaagttactaaaattcctaaaattcttggagttttgtttagtaataaagggcgtcaagatcctgttgaaatcattgagcagcttatagaaatgtctcaaagaacaagaagagatggattattatcactcgaaggtactatacaagggcttgataataggtttatgaaaaaaggattagaaatggtagttgacggtatggaatccgatataataaaagaagtacttgaaattgaaattgaaagtatggaagaaagacatcgtctaggagctactgttttttcaacagcaggtggtacagcaccaacacttggtgttttaggagctgttattggattaattggtgcacttggaaatcttaatgatattgataaacttggagagagtatatcttcagcattcgttgcgactgtttatggtattttttgtgggtatttaatattccatccattttcaaatagattaaaaagaaaatccctagaagaaataaaaaatatgaatattatacttgaaggggttttagctattcaagctggaaataatcctaaaagtatcgaaagaaaattagttggaatgttggaacctaaggatagaattaaacttgaaaagaatagcaataattaattcaaaaggagaaagctgatgagtagaaaaaaacaacatcatgaagagcatgttgatgaagcttggcttcttccatattcagatatgttaactttgttattagcattatttattgtaatgtttgcaatgggacaaacagataaggcaaaatttcaggctatgagcaaatcttttaatcaaatattttctggtggaacatctatgatgcaaagtgatggaaactcgattattcctatggatacaatatctgatgggactggcaaaagtgatgcagaacttgaacaagataagatggttgcaatcaaagcagttatggaagaagaaattacaagtgaaggatatagtgatgccattaacgttgacattaacgaagaaggattatatattacagtacaggatgttgcactttttgattctggtaaagccgatatacatcaaaatgtaattccgttattatcgaaggtttctgctatgttgaatggattagaaaatgaaataaaaattgttggacatactgataatgttcctattgataattcagaatttcattcaaatatggatttaagtgcagaacgtgctataaatgtaagaagcttattggttaagtcggaaaatgggcttgatccagaaaaaacatcaatagaagcttggggagaacttaagcctaaagcatctaatgatactgaacaaggaagagctcaaaatagaagagtagagattgttgttagtagagagtataaggaagctgatacagcatcaaaataatacataaaaatacttaataacttcctattttaatataatttaaatacttttaatttttagactacaattcacacaaacttgaaaaataaagctgccattttaggtggctttatttttttacaaaggtcttatatttggttcaatacatctaatataagtattccctttactttctttggcgtatagaactataattgtataattttttatactgtattaacattttaattcacatttaaatagtatatataataaaggttataaggaggatactatgtttggaatgtttccttttggaatgggtaatatgatttcatttactagttttacgagtttcacaagtacaaaggatggtattaatggctttaatgtaactaatgggtatagtggtttctttgatcctaatcaagcaaataactttaatcaaaatatgaataatatgaatggaatgaacttactagatcatatacaaagtgcagtaacatctgtattaaataatgttgatatagaaaagcttgcagaggaatattatacagctatatcagatactataaaagaaaattcaatagaagatgactgtgattttattgattttgaacgaaatgatgatatgtatatactgagaatcgatttaaatggtatagatttaagggaattaagtataagatatgatccgggaattttagatataaaccttaaaagatctgagtatgacaataattcatataggggatacactaataatattgtaaagaagaaatataatactagttttgacaatattgaagaaatagatacagatagagtattaaagtcaattgacaatggcatatttacaatgaggatgccaaaaaaatatgctttggatagtgcatctaaaattatagaagtggaaaactatactgtggataatgaaaatgataaagttatcaagaaaatgtagataaatataaaaaatctgtggattatttttttcgaatgtggatatctttttattttaaaaaagttatcacaattccccctggggttatataagcacggattgaatttgttccctagggtacatagatagtatataattgagaaatgatagttaaaggtaaaataaaaaggagttgttacatctaatactatagctattgtatataatatacacaggatagcttaggctttatgccacaactccaaagttaatttaattatttcttacgtctattagcaacttctacattaacttttttcttgttgatttttccacctggacatttatctaatatttttttagatacagtttcatcaacacttacaaatgagaagttttccataaggtctatttgacctattgttgaagcattaactctagttctatctttaatataattaattaaaactttaggagttaatccatctcttttaccgacagagaagaataaacgaatatcttcttttttaggtgcttctaatttatctgaactataatcaaatacgctttcattatcatatttaattttcattaatgcagcaactactgataatggatcattgttttctactaattcaattgcattaggcatgaacttagtaagatctccagaagttatagtttcagtaacttcttttattatatcattgaattttttattcttaatttcttcagcagttggaactggcttttgagttatagcactcttagtaactttttggatttgcttaagcattgagaaatccttaggtgttactaatgaataagcagtaccttctctattagctctacctgttctacctattctatgaacatatgattcaacatcttgtggtaaatcatagttaaatacgtgagtaacgccatcaacgtcgatacctcttgcagcaacatcagtagctattaataaatttaaagtaccttctttaaatttacttaaagtagttaatctgtgagcttgtgtcatgtcaccatgcattccttcaaccatgtagccttttgattgtaattcttgaactaattcatcaacgcctctcttagttctacagaatattatagctgaacttggattatctaagtctagtagtctacaaagcgcttctaatctgtgcttattgtttatcatgaagtagctttgttctattttagatactgttaaagaacttttcttaacactaacaagtttagcatcaggcttcatgtatcttttagcaagttttgctattggatcaggcatagtagctgagaataataaagtttgtctttcttctggtgtatgacttaagattgattctatatcgtcaatgaatcccatattaagcatttcatcagcttcatctaaaactaaaaattcaacgctatctaaatgaaggcattttcttttaattaaatcaagcattcttccaggagtaccaacaactacgtctacaccttttcttaatgctcttatttgtctgtctattgagtcaccaccgtaaacagctaaaatttctgctttttcgtacttagacaatctgttcatttcatctttaacttgaacagcaagttctcttgttggagctaaaataagggctttaattcctttattagtgctcattttagttagtataggtaagctatacgcagcagtttttcctgtacctgtttgtgcctgcccaataaggtcagcgccacttaatgttacaggaatactttgttcttgaatttgagatggttttgtaaaacctaggtctgatattgcacgtacaatactctctttaagacctaaagttgcaaattgattatcactcattaaatatcctcgtttctttatttttaaaattgaaaatttttttatttaaataataattattaaaatcttaattaatatttttcatataagcaaataaaattattataacagaaatcaacaaacattgtaaagatattttttaactttacaatttgtgtaaaatcatatcttattatatatgaaataattaaaatagtaattaggcgattaaatccatatttatagagtaattctaaaataactaaaaaataaattaattttatataaaacatgtgctttaattaaagattgatattatctattttatgtagtgttaaattgagcaagtaatattaaatgggaaaccccctataatattttttagttatatagaaaaatatttataataatataaaaaataatcctaattaaaagaaaacttaaaattaagattatttttttattatatagttgtacaatccttgcttataatagaacgcacagtattgtgaagattctcagattcctctttagacaaagaagtaacatcaattggtgggtgtatgataagtcttacattatcggcctttatccaattcttattagcttctagaagtttatatgttccatctatagtaactggaactataggacactttgattttgtagcaagcttaaagcttccagccttaaagtcttcaactggaccgcctttacttcttgtgccttcaggaaatataaccattgagtatccattctttaatagtttagcaccttcaacaattgcttcagctgattttctaaggttgcttctatccatgaatatacaattgatatatttcatccacgtacttatcataggccatttttccagttcctttttagcaataaatcctttaggtacatcgattgaactcattattaaaggaatatcaaagttactttgatggtttgcaataaataatacagtctggtctttaggaatgttctcttctccaataacggtaattttagcaccagataatttcattacaaattttgcccattgtgtagtgactttgtgaatgtaagcttctcttttctttgagtcgccttttttcgttaaaatatttattttaattctatatagattggtaattatcaaagcaagaataatacctgggtaaaaaataaaacttctcattacaatgttacacatccttatattttatattatcactattattcagtatattataaaagattagtttttaaaagtatttatattctcaatgtaatggattaattgaattttaacaagaataattaagtatatatttttctactaatttccatattaaataaaaaatactttacggaatttacaattaaattatagtcaataaaacatttatataatttatgaaattaaaggagaattctttatataaatttaaggaattatataggtaattaataagattgatattataatatatttatcaagtgattgttaaatatgcataaataaaggaatataagtaaaaataagatttgacttatatggataataataattttgctaaaatgttatgaaaatatttatctattattgaaatattttgtatgtattttaatgttgctattaataaaaaatatagataggtgagatagttataatggagtttaagaatttagtatgtaatggagaggctgaacatatgaaaagtaaggatattaaaaataagatagtatctgataagaagataaatgaatcagatgaagaaaagaagcttactggattaaatgatgaacaagttaatataagaataaaagaaggaaaagtcaactatgtaccaaaagctccagcaagaacatttggacagatacttagggcaaatctttttacaagttttaatgctattaatgttgttcttgcagttattataatattagccggatcacctaaaaatgctatatttgtaggagttatattggtaaatacattaattggagtagctcaagaactgagagcgaaagatatacttgaaaagctatctgtaataagtatggctcaagctaaagttctaagaaatggtgagattaatgaaatacctatagataatattgttcttgatgatgttttatatcttgaaacaggaatgcaggtattagctgatgctgaagttattgaaaataacggacttgaagttgatgagtcaatgcttacaggtgaatctgatgctataggcaaaagagaaggagatgcacttctttcaggtagctttatagttgcaggagaatgttatgctagagttaataaggttggtaaagaaacttattcatcaagtcttgcagaagaagcaaaacagtttaaaattactaattctgaattacaatcagcaataaataagatattcaaagtattattatggattattattcctcttacaatacttcttacagtaacacagttaagggttcctgatgcaacatggcagagtgcagcaattggaactgtttcaggaataattggaatgatacctgaaggattagtcttattaacaagtgcaacatttattgtttctataataaaattatcaaagtttgatacactcgtacaagagctttgtgcaacagaggttttagctagagtagatgtattgtgccttgataaaacaggaacacttacacaaggagatcttaaattatcagaaatcaaagtaataggcgatactgataaattagaggtagacagggcattagcggcattagttcataatttacctagtaaaaatccaacacagaaagctattttagataaatataaagagtatgatcaaaatttgaaatgtatagacaagattccattttcgtcaaaaagaaagtggggaggattaacttttgaaggtgatcttggttcatggattttaggagcaccagaggttatattaggtaaggaatatgtttttattaagaacatggtagaagaagaagctaaaaagggtaagagagtattactgttagctaagtttcatggagaagaattaagcgacagccttttaggaaagatagaaagtatagctttacttttaatagaggacataataagagaagcagctccagatgtacttgattatttcaataaacagggagttgaagtgaaaattatttctggtgatagccctgtaactgtatctgaagttgcaagaagggcaggagtacagtcatggaacaaatatgttgatgctcgtgaacttcctgaagacgataatgaatttaaaaatttagtaaaagatacaactgtttttggaagagttactccacatcaaaagaaaaaaattgttacagcccttcaagaaatggatcatactgttgcaatgactggtgatggtgttaatgatgtattagcattaaaagcatcagattgtggtatagctatggcaaatgggtcagatgctacaaaagcagtagcacagcttgtattgatgaagtcagatttctcagcacttccaaaggtattagaagaaggaagaaagcagattaataatcttgagagagtttctgaattatttttatcaaagacaatatactcaatattattggcatttgtttgttcggtaatgtttttaccatatcctatattaccaatacagttatcattagttggtagttgtgctataggaattccagcatttttcttagcgatgcttcctagtacaggtggggtaaaaaaaggatttttaacaagagtaataacagtaagtataccaaatggaataattcttgctggattcacagtaggtacttttttaatatctttggctttaggtgttggaatgcaacaaagtaggactttagcattgttaatgtttgctggaattagtatggtgatattatttagagttgcaaaaccattaactaatttcaaagcagtattatgcttaagtatgtttggtataatgattcttgcgtttattactcctataggacgatatatatttagtttaacaacaattaaattaagatattgggcaatatctttagcggttatagtattatcaggtcctcttataactagatttgttgacttctttagaataagagttaataaaaaatataaagttagaacaatttagaaaaataaaaaaaatgtacaatcaacagatagatttatgtagttaagtttaataagaataagctatatatttatctgttgattttctgtggggataattataatttgtttaagcaaaatatataaatattactaaaccaatataaatcatactttttattacatataaagaaaaataaggtataatattacaagaaggaagaggtgacaattaaatgataaagaaaagaaaatttattgcttttacagtagcttgtgcgatgcttttctctcaaagtatatatgctaaagcagcagaagtagataataataatcaaaccaataaaactgtaaataatgatgtaagagagcaggatgatttctatgatgctgttaataaggattggttaaatactgctaaaattgcggatggaaaaacatctaattctgcatttgattcagtaaataattcattaacagaacaaaagaagaatcttatgagtgaacttatagcaaataaaaagatgtatggtgaaaatagtgatgagaaaaaaatcataaatttatatgaaaattatttaaataaagatgaaagaaataaacaaggtatagagccagcacgagaaattcttgaaagaataaaaaatataaaaagtcttgatgaacttaatgatttaaataaatatgatataagtaatcctttaatcggatttgcaattagtgtagatttaaaggatgcaactaaatatgctctttatgtggaacaaacagggctttcattgggagattctgatgaatatacaaaacctacagaaagtacagcacatacaaaggaacttataacaaattattatataaagcttttaacattaactggttatacagcagatgaagcaaaacaaaaagttgaaaatatgtttaaacttgaatacatgattgctccatcgataattggaaaagaagagagcactaaaaatgagaacgcaattgatgaatcatataatgtagtaagtattgatcaacttgataatttagctcctaatttaaatataaaaaaatatatggaaaatttaaaggttgatactgcaaataagataatattaggcgaagaaaaatggataaaagctttaaatgacatatataaagaagagaatcttcagctatttaaagattatatagaaattaataatatagctggaatgggagcgtttttaagtgaagattttacaaaggcgagtacagaatttgccaatgaatatatgggttcaaagggagatattcctgatgatgaaaaagcaatatcttttgtaaattctttcttatcagaacctttcggtagattatatattaatagatattttaatcctcagataaaaacaaatgttgaaaatatgacaagtaagattatagaaacttataaaaaaagaatagaaaaattagattggatgagcgataagacaaaagctaatgcaatagaaaaattaaataatttaaatgtgaatataggatatcctgaaaaatgggaagattattcatcagtagaaattaagtcatatgatgaaggtggatcacttttacaaaatgcacttaacatgagtaagtttttatatgaaaaacagttaaaaaaattgaatagtactgtagatagaaatgaatttgcatgtcctccacaaatggtaaatgctttttataatccaacatctaacggtataacagttccagcaggaatacttcaagatgaattttatgatataaatgcatcggaagaaagaaattatggagcaattggagctgtaataggtcatgaaataagtcatgcttttgataatactggtgctaagtttgatagtaatggtaatttaaactgttggtggacagatgaagatctaagtaaattccaagaaaagactcaaaaagtaagagattattataataaagtaaaaactgataatgggaaaaatgttaatggtgatgctactgtaggcgaaaacatagctgatattggtggtattgcatgtgtcttagatatcttaaaagaaaaagaaaatcctaattataaagatttctttgaaagtaatgcaaggatatggcgtgagatagctacacctgagtatgaagatatggctttaaaatttgatgtacattcaccaaataagataagagttaatgttgtgttaccacaatttgatcaattttatacaacttatggagtaactgaaaaagataagatgtatataaaaccagaagacagattacaaatttggtaaaataaaaaagctaagtgtgtatgttatagtaagcttagataatatataaaagttgcaattaaataaaaattatgttaatatataagagtagcaaaaatgctaacaaaaaaagtttcatttaggtaaatagtttctcgggaattagagattattatatcaatttagaatctttaattttaggaggaataattatgacagataagacaatagtatgcagagattgcgggaatgaattcatatttacagtaggagaacaagaattctacaaagaaaaaggatttgaaaatgaacctgtaagatgtgcagattgtagaagagctaaaaaagaacaaaatagaagataattttagattgttgaaggttgtaatgtatattacaacctttttattctttttgaaaattatatttatgaagagtttgtgtaaatatatattcttaaaaagagatttcataaataataaaattttttattaaaatttgacaattggggttaattataatagaatttaatagacatttaaagtaaatttaatatgcttccatagtttaatggatagaacaatcccctcctaagggatagatgtgggttcgattcccgctgggagtaccaacttaataacaaaaggcttaactgtaaaggttaagccttttgttatgtgtgcagttaagaaagccagtctttaaagcctttttttaattcgtattttaatattaaaatcatatctattttatccatagaaatttataaaaaatattttttttatttattgactacgatttcataaagtagtaatattatattaacatcttaacatgttaagtggttaaccttataaatggagaggaggaggagaaatggaaattagatatgcacatagtcctaaagatatagagcattattcaactaaagaattatgcaatgaatttttacaaaaaagaatattttcacctggtgagatttgtttgacgtatttgcattatgatcgtcagatcttcggaggagtgacacctaaagacaagcctttagaaataattttttcgaaagaacttggagtagattatttcttagagcgtagagagcttggaattattaatataggtggaccgggaacaataattattgatggtaaagaagaagaaatgaaaaaacaagacggatattacatcggaaaagaaacaaagcaagtgatatttaaatctaaggatttaaataatctagcaaaattctatgttgtttcaacacctgcacattataaatatccaaatgttaaaataagcatagataatataacaccaaggattgttggtgaaggaaaaacgttaaataagagaagaatattccaatatattcatcccaatgtatgtgaaagttgtcaattgcaaatgggatatacaattcttgaagaaggcagtgcttggaatacaatgccgtgtcatactcatgaaagacgtatggaaacatatctgtattttgatatgaatgaagaaacgaaggtttttcatatgatgggtaaaccggatgagactaaacatattatagtaggaaatgaagaagctgttatatctccaagttggtcaatacattcaggagtagggacaagtaattatacattcatatgggcaatgtgtggagaaaatatcacatatgatgatatggatatggtttctatgaatgaattaagataagtgttataagtttcattacacttgaaagccataatgatataacatataattataataatatacttaatacattaacgtgttatatgattagggagagatagagatgcttgcaaaatatgaaattataaaacaagacattattcagatgattgaagaaaaaaagtttaagcctggagataaaatttattctgagggagagttaaaaaaaatttacaatgttagtagtacaactgttgttagagctcttcaagatttagttttaagtggctaccttattagaaaacaaggagaaggaacttatgtaaggaaatcatttaagcatagacgtgctttctttgatgagggaagtccaataattgaagaatttaagaatgagtataatgagaaaaagataatagaaagtaaaaaaatattaattgtaaaagaaatagaagatgcggagattgctgaaaaattaaaagttagagctaatgagactttagttaaattttgtagagtgagttatgttaatgatacaccatggcaagttcaaaatagctatattccaaagaagtatttaaagaaatttgattataataatttaaatgaaaatgatagagtttctgatgaaataaaaaaagctttggatataaatttaatgactttacctatgaaacaaaaaatacaagtagagtttccaatttcgttaaaaagtttatgtgatgtattaaaagttgatgaaaatacaccattatataaattagaaagaattacttattatcctgctcaaataccatttgaatttataagaagctatatacattataaattttactctatagaaattcaaactgaagataatgtttaattaaaaattaacattaaggagttttggaaaatatgcgcaatattataaaagaaccgttgattcgtagtgaacgttattttaatcgtggtttcttaactaaagaaacaattgaagtagcattagataaatgtataagaaaaatagatagaaatatagaaatatttggagagaattttccaacaccagcaactaaagataacacttatggtgtcatggataatactgaatggaccaatggattttggacaggaattttatggttggcatatgaatatacaaaagacaataaatataaggaattggcagagaaaaatgttgagtcattttataatagaattgtaaataatattgaagttagtcaccatgatttaggatttctttatataccatcatgcgttagtgcttataaattaacaggaaataagatggcgtatgatgcagcaattatggctgcagatgcacttattaaacgttatcaagaaaagggtgaattcatacaagcatggggtgaactaggtgttgctgacaattatagattaattgtagattgccttttaaatattcctttattatattgggcaacagaagtaacagaagaagaaaaatataaagaaattgctgaaaaacactttaaaacaacgattgcaaatgcggttagagataatgcttctgcatatcacacattctattttgatccttcaactggaaatcctgttggtggtaagactagacaaggatattcagatgattctagctgggcaagaggtcaagcttggttaatttacggaatagcattaaatcattttcacaatataaatgaagagaatataaatacttttgaagcagtagcaaattattttataaatagattaccagaagattttatatgttattgggatttaatttttaatgatggttctggacaatcaagagattcatcttcagcagcaatagcagtttgtggttttaatttaatggacaagttcctattagaaactgatgaaatgaagagtgtttatagatatgtacagcactcaatgttagctagtttaataaataattatactgatgatttgactgatggagctacagcacttataaatcatggagtatattcttggcattcaggtaaaggtgtagatgaaggtaatatttggggagattatttctatatggaatctttaattagattttataaaagttgggaaatgtattggtaaaaaataattaattattttataaatggaggaattaactatggaaaataaaccaaatataaaaatggtgcgtgttgatgaaagattgatacatggacaaggacaattgtggattaaaagtttaggtgctaacttagtaatagttgcaaatgataaggtgtcaacagataatattcaacaaaccttaatgaaatcgattgtatctaaagatattggagtacgtttttggactattgatagaacgaatgaagtaatttggaaagcagctccacatcaaactattttcacagttgttaaatcttgtgaagatgctcttagattagtagagggtggattccctatagaagagttaaacataggtaatgttcatgcagcagaaggcaaagaaaaaatttctcaatttatttatttaggagaaaatgataaagaagcattgcgtatattaagagataaatataatgtgaagtttaatacgaagacatcacctgtatcagatgatggagttaagtccatagaagctttaaataatgctctatagtaggaggaagaaaagatggaaatatcattaactcaggcaattttaataggattaattactgcattttgttatgcaggacaattacttggtatatatacaaatcgttcaattattatggcatttttcgtaggacttgttttaggggatattcctacagcactaacttttggagctttagctgaattagcattcatgggatttggtgtaggtgcaggtggaacagttcctccaaatcaattagggcctggtatagtagggacaattatggcaattacattaaagaatcaaggagttactcctgaatcagcgttatctctatcattcccatttgcagtattattccaattagttactacagctatatatactgcattatcaggtacaacagataatgctaaaaaattattaaaacaaggaaagtatggtaaatttaatttacttgcaaatagtacagtaattgcatttttagtagttggatttattataggaattatttcagcagtaagtttacctgcattacaatcgtttgtaaatgttttacctcaatggttgataaaaggattatcaatagctggaggacttatacctgcaatcggatttgcaatgataatgtcagttatgcttaagaaggaatttataccatatgttctattaggttatatatgcgtatcatatttacaattaccaactatggctattgcgttagctggtacagtatttgctttaattgtttataatttaaactctagtaatgctcagaaggtagtagctgagagctatgttaatgtttctgatgaggaggatttttcaaatggaatctagaaaacctgtattaaaacaaagagattatttaaatacaacccttagaagttattttttacaaaatggatttaactataattcatatcaaggaacaggatatttatttgtaatcctaccagtattgaaaaagatatataaggatgatccagaaaaattaaaagaagttgcaatttcaaatatagaattttacaatataaatcctcatacattaccatttgaaactagtatgcatatggcaatgtatgatcatggcgaagatattgaaaattcacgtagtataaagatggcattaatgggaccattggcaggaataggtgattcgattgcacaatttggtttagcaccattattttcaactatatttgctggattagctatgaacggattaacttttgctcctatggctttctggataactatgataatttctatgttaactattaagttattaatgggatatttaggctataaattaggtacaagtgtaatcgatacattgagtgagaaaataggtcaagtttctcatgctgctggtatagtaggtgttacagttatatctgcattatcagttagttttgtaaaagcaaaaataggtattcaatatgctactactcttgcatcaggtgaagagcaagttgtttctattcaaacaattttagataaaatacttccaaacatgttacctgctgttattactataatagtattcatattagtaaagaaatacaaatggtcaacatataagttattagctttactatttgtattaggtattggactttcgtattttggtattttagtttaggaggaatttaaatgtgtaaattagtaattgtagggcatggtaattttccaagtggagttttatcagcagtatctttattagtaggaaataatgaaaatatatgtgcttttgatttagataagaacgaaacacatgaaggattcgaacaaaaaataaaagaattattagataataatgataaggttatagttgttgctgatttaactggtggagcaccacatcaaatagctgctcgattaatattagaatcaggcaaaatgaatcaatatattatttcaggaattaatcttgctttagttgtagacttagcaatgaaatgttgctttagtgaggttgaggaagaagagcttgaaacaatgttattagattctgttaatgatagcaaagaaacaatgactttattatctaataggatgtaatgaagatggatgctaaaaatatactttttatatccttaatagtagtagtatttatttgttacattgttatctctactattattaggtataagggaattaaggaaaataatgagaagcatttaaagtttcttaatgaacttaatattggtgataaagtattattaaactctgggatttttggaactttaaaagataaaaataaagatagttattctgttgagataagcaaaagtactgtaataaaggttttgtcatctagtattataggaagaggttgagtgtaaattatgataacttttgatctaattaataaatatagcaatgaatttttatcaaatgattggaaaagctttgttaaagagaattgcaaaaaagaaataaaaagagcaaaatttcaaggtgatttactttgtaacaacataataatttataacgatcctatggatatggaagcgacttctattccttataaattcgatggcgtagaatggaatagaagcgctaattcagatccggaatggatatatatgttaaaccgtaatggatttatggttgacttagcaattgcttatagggttactgaaaataaaaaatatatagaaaaatggaaggagtatctttttaaatttattaaatataatggaactccttctgaatataataaagattcgtggcgtagtcttgacactggtataagattatctaattggatgagaagtcttatatatttaggaagtgatttaaatttaactgaacaagaaatagagatgttagaagaatcactgaagatacatgtagaatttttatataaagcgtacacaccaaagcaattactaagtaactggggagttttacttatcacaggtgtactttcagcatctattttgttccctgaattagtagatgaagagcataaaaaatggtcatggagcttattggaagatcaacttgacatccaattttatcaagatggaatacaatgggaacagagtcctatgtatcatcatgaagttgtattaagcagtgcatatgttatgatgcatgctgaatacacaaatcatcatgttccaattaatattagagaaaagttaaaacctttagtggaagcatcacaattttacaaaaatcataatgaagatcttctttctttacatgatagtgataatgttgacttttcatatgtatatagcatatatagatgtttgggcttagcaaatgaagttaattctgaaaatgaaaaaggaatattatttgttggaagtatgtataaggacaagtatataagttatgaaaatagttcgattaatggatgctttaaacaaatagatagtggatttctagcatataaagatgataaccatttaataacattatttaatggaagacatggaagtgctcatggacatgctactgttggaagtgtgactattaatttaaataaacatgatattataggagatccagggagatttacttacctatataattctccattaagaacaggtttaaagaaacaatggatgcataacactgtagatgttgataatagagaagattttaaaattagtggagattcttcatatgcagaagtacaagatccaataggtaattcttataatcaaaaaggcaattatatagcgttggaaggagtatggtctggaagggctaatgtcaaagaggaccatgatgttttagaaaagaatctatatacaatcagaagaacttcttttatagaaaacaaaatgaatattgtaattgtgtttacagcaattgattatcctggtgagcataaatggcgttcaatatacaatattcacccaacagcaagatgtattaaaacaggtgacaaagcagttattgaatcagaaaacatgaattttgtagtcgattcattagatggagatccttttgttaaattaacgagtgttttctcaactaaatataaccaattgtgtaataatgataagttagtatctaattcttcttttatagacagaggaattaagatagaagctttttatgagaaggatactgttaagattaaacctttatatgttcatcaaaatggtaaatctgaacaagctgagaaggataagatgattggctttgaagtgaaaagtttaaatagtgatgaagaattttcaatattctactgtgcttttgatacctttaaaggtgataagatttactatagcgaaaaaggacaaggcatttttggaaaattaactgtttttaataaagataataagagaattaagcttttataaaataactttaattattattaaaaaggagtctagtaaaatgttaaagattcaattaatttctggaagtggagatataattaaagaatcattcggtgaggaacgagtatatttaggatataagggagctctaggtgatggagcatcggtaaaaattataacttataatcctggagaatatttatggattaagataaataagtgtattgataaatcgttagtttattttaaagatactgaaatgaattatgagttcccttttactgaagaagctaaattggcttatccagatggagcgtttgaaggagatagacattatttttcagtagaaaaacctagtaaggaagaattaatgcaatatagaaatgtggcgttaaatcctactgatcataaaaatgcaattggtatttatccgcatgttatagcaaatgttgaaactagaaatgaatcagcattttatgctaacaatgtaatagatggtgtttgtgtaacagatggacatggaagatggccatatgaatcatgggggataaataaaaaagagaatgcagaaataaccgttgaatttggaagagaggttttaataaataaaattggtttatttttaagagctgattatccacacgatagttattggacaagtgttaaactatcattgtcaaatggagaagaaatgatattaaaaacaactaatagtccagattgtcaatgctttgatatcccaaaatgtaaagtggagtggataaaattatcaaatctaataaaaaataaagatgattcagaattcccagctttaaaacaaattgaagtatggggatggattgcttctctttaaataatattaaatgaatgagttaactgatagagttggctcattttttgcgttttaagtcaggtagattttatttgttgaaagtatgtgagttttaagtataaaccaatattatatatttgtatctaatgataagctataataagacttaaagtatataattgtattgagtataaagagtaaattcaatacaaatagttttataacagggggagaacaatgaagcttaaagaggctataaaagaaataaataacttggatgaaaggtctatagatgaagctattagaagatgggacagtattgcaaaaccattaaaaagtcttggattgcttgaagaagctgtgattaagattgctggaataacaaaatgtagtagagttagcttgaataaaaaagctttaattataatgtgtgcagataatggtgtagttgaagagggagttactcaaacaggtcaagaaattactgcaaatgtaacagaaaattttacaaatgaaaaggcaaccgtaagtataatggctaaatcaataggaattgatgtttttccagttgatattggaatttatagagatatggatagaactttaaataagaatgaagagatgattccatttaatattttaaacagaaaaatagcatatggtacagataacatattaaagggacctgcaatgagcagggaaaatgcgataaaggctattgaaacaggaataaacctagttggaaatatgaaggaatgtggatacaatattatagcaactggtgaaatgggcattggaaatacaactacaagcagtgcaatagcatcagtattattaaatgcacctgtagaagaagtaacaggaaaaggagcgggattaacatcgaaaggtcttgaaagaaaaattcaagttataaaagaatctataagattaaatgatcctgatttaaatgatcctatagatgttttatctaaagttggaggatacgatattgcaggactcgcaggagtgtttattggcggagcagtatataatattccaatagtaatcgatggatttatatcagcagttgcagctcttgttgcatctaaaattgaacataaaacaattgagtatatgcttccttcacatgtatcaaaagagccagctggaaagatgcttcttgaagctcttgatttaaaaccatttattacatgtgaaatgtgtcttggagaaggcagtggtgcagtagccttacttccaattttagatatggcttgcactgtatataataaaatgagcagctttaatgatattggaatagaacaatataaacctttatagagtttgggggaatttaatgttaacattaataactggaggaagtggaagtggtaagtcagagtttgctgaagacttatcagtatcttataaatcaaataatttaatttatattgccactatgtttctctatgataatgagtctttaaaaaaagttgaaagacataaaagaatgagagaccataaaaattttaagaccatagaatgttttaaaaatttaaagtcattatttatatcaaataattcaacagttcttattgattgtatgtcaaatctagtagcaaatgagatgtatcttgaaggtggagcaaaagataagacagtacaagaagtaataagaggtatagaatcaataaataatcaagcagaaaatttagtaatagtgacgaatgaagtattctcagatggtattgtttatgatgatgacacaatgagatatataagaaatctaggtgaaataaataaagaaattggaaagaaagctgacaatgtagttgaagttgtttattctattccaatttttcataaaggaggtatttaaaagtgtggggttcttttaaaatagcattttcaatgtattcaaaaatacctatgcctgaaactgattggaataaggataatatgaaatatgctatgtgctttttcccaatggttggagcagctataggattattagttgttactgtatacctgatttgtaatacactacagatgggtaatcttttaaaagcatctatacttacagttttgccagttcttataactggtggaatacaccttgatggatttgttgatactatggatgcgataaattcctatcaaagtgtagaaagaaaattagagatattaaaagattctcatataggagcatttgctttaataagttgtgttgtatactttatagttgattttggcttatggagtgaaattggtttaaggtcaatacttatattgtgtgttggatttatgttgtcacgagccttaagcgctctttcaatagtaacattcccatgtgcaaagactaatggacttgcagccagcttttcagatgcagcacaaaaaaatactgtaaaaataactatgtatatttatattgctttttgtattggcattatgttgtttattaattctattttgggaagcatatgtattattagtgcatttctaatgtttatttattataaacatatgtctataaaaaaattctctggaattacaggtgacttagcaggatattttcttcaaatgtgtgaattacttatgcttgcaagtgttattttaggagaaaagcttattatacttttataaaatgattgtattcaaatatgaatatatattaattcacaattaataatatacgagtagatgaaattcattacaggatttattgaacttaggatgtagaatattagatatacaaaaaagaataatagattttaagtattcttgaataatcataagtaaagtgaatattttatggaaaggagatggaataagtgatttttataattggaggagaaaatcaaggaaagcttgaatatttgtttaatataagtagattcaaaaaagaagatgtggtagattgcttgaatgttgatgggttaaaagcagaagaaattttaatgagtaataagcctgttatatataattttaataatcttataaaagagcttctagtagtgtatgatgatgaagagaaggttaaagaaaagataaaaaaaatgataaaagaaaatagaaaagccgttattatatctaatgaaataggctatggtatagttccaatagataaatttgaaagaagatatcgtgaattgacagggagaatatgctgtgaaatagcaaaagaatctaaagaggtgcatagggtaatatgcggtataggaactataattaaaggtgaagaaaatgattaaaatagctttaataagacattctaaaactgaagggaatcttcatggaagatatataggaaagacagatgaaaatctttgtaatgagggaattatcattgctaaaaataaagaatttccaaaggctgaacaggtttattctagtcctttaaagaggtgtgttgaaacttcaaagataatatacaattattgtgaaccattaatatttgatgatttaagagaatgtgattttggtgattttgaaaataaaaattacaaagacctagatggaaatgaggattatcaaaaatggattgatagcaatgggtcaatgccttttccaaatggagaaaatactgaagcttttaaaaggcgtagtataagaggctttgataaggtaataaagaatattatagataataaaattaataatgcagcaataattgtccatggtggaacaataatgtccatattagataagtattcgcatcctaataaagaattttattgttggcaagtggataattgctgtggatatttaatagaaatagataaggctttgtggataaaaaataataaaagagttaatgttttagaatctatataagaacatattaaaatagaattatttattaatcttttagataatggaggaaagattgtggcaaagacaataatgatacagggaactgcttcaaatgccggcaaaagtcttattgttgcaggattgtgtaggatttttaagcaggatgggtacaaggtagcaccgtttaaatcgcagaatatggcattaaattcgtttataactaaagatggatttgaaatggggagagcgcaggtgatgcaggctgaagcagctggaatagaacctgatgtacgtatgaatccaatattgttaaagcctacaagcgatactggatctcaggttatagtaaatggtgaagttgtaggagatatgagtgcaaaggactattttgcacaaaagaaaaaacttatccccgatataatgaaggcttttaatgaattggcagaggaaaatgacattatcgtaattgaaggagcgggaagtcctgctgaaataaatcttaatgatgatgatattgtaaatatggggatggcaaagttagcacaagcgccagtatttattgttggagatatagatagaggtggtgtttttgcttcccttgcaggaactatgctatttttaaaagaagatgagaagaacatggttaagggtactattattaataaatttagaggggataaatctatacttgagcctggtttgaagatgcttgaagatgcaataaacgtaccagttacaggtgttgttccatatttgaatattgatgtagatgatgaagatagcttaactgaaagatttaatgtaagagaagagattgccctagtagatattgcagtaataagactccctagaatatctaatttcactgattttaatgctttagaatatattgatggagtttctgtaagatatgttggttcggtaaaagaattaaaaaatccagatttaataatacttccaggtactaaaaatacaatatcagatttaatttggcttagagaatgtggattagaagcgtctataatgaagcatgtatctaagaataagccactctttggaatatgtggaggatatcagatgcttggacttacattaaaagatccccacaatgtagagtatggtggagaaatatctggtcttggattactttcgtgtgaaactatattcgaaaaagaaaagacacgagttcgagttgaaggaaaacttgaaaaagtaagtggagtattcagtagcctttcggatgtagtatttgaaggatatgaaatacatatgggtgatacaactaataataagaatattgttaacgagggtaatgtttatggaacatatattcatggaatttttgataaagagacagtatctaaagaaattatagaaacacttctggaattaaagggattaagttcggaaaatataaagactttcaatatgaaagaatataaggaaagccaatatgatatattagcaaattcacttagagaatcacttgacttagaatatatatataaagttattggtgaaaaagaaaattaagaatttgaattataaaaaagcatctatgtttaaattaatttctaaatttaaacatagatgcttttttgttttgagctcataaatagtttgcctttcactttgatttatattttgaactaaattatgatattaagaagatttatttgaaataagctcatttacttcaaatttaacaaaacgcaatattttatctgtaaactccataaattcttcattagttaaatcgagatctccatatccattacttatatatgttagaggaattgtattattttctattgcaagttttaatgaagactgtaactctgcatcatcaattggaagcttgttgaagtttattgtgaattcacagagttttattaagttttcaattacgttaatcgtagtgctgtcatctgataaatatttttctcccacattgttattagaagattgcacattcaataagtcgtgaacgtctacagacagtacatcagctattttttttagagttaatgcatttggttctctattattattttcataattggaataagtggaagaaggcatatttaatttttttgccatatctttttgagatatattcttctccttacgaattttttttatattattacccacttttattatctcattaattcccattcgaatttaaccctcctataataattaccaatatatgtatattatatcacagatattatataattattaaaattttattcgaataaggatagttaatcttcatataaaattactagaagatttgtaagtatatataaatattatgttaacaaagtaataagtatatgaaagatagctaaatataaggtataatgaaatcgtataaataaaaaataaagtttaattatagtaaattttatacttaaaggggatgttagcgttatggaggtatttttagaacaatttatagcatgtgataagagtaggaacacattaaaaaatattaagactgctgttatagcagtactcgtatttggagtattaatgttttttttaatctcaccactaatagcactgctgatgcaaatagctgcagttatattttttttagttacatatttttcattcatagactatgagtatgaattattcaatggaaatatagatgtaagtaaaatatatgctggaagtagaagaaaagttgttaagaagataaattctgaggatgttgaatttgtatatgaatcttcaaataatgcaattagtaaagatgctcttttcaataaaaatataaagggattaaaaatatatacctttgaatttaaagataggaaaaaagtccagcttgcattaaatgaagagcttgagaagatagtgaaaattgtatatagaggaaaaatgcaaataagataaaaaaatagttttttgatttattaatcaaaaaactatttttttttagagaatacataaatattaattttttgataataactaaatgagaaaggaatatgtacaaaaaacacttttttgtggaactgatatcacattttgattatgtaattgatatcaaaaaataatatttttttaattaaatttattaaaaataattataaaatttatctttattagaaaaaataatgggtattaaatattaaatattagaaaataatgaaaaaacattaaaataaaagctaaatatgttaaaaaactaacaaaaatttttttttgaaaaccattgacattgcatatatggaattggtatcatatactcatgaaaacgatttttgaaaaatgtgggaggatatatgtatgaaagaacaagtagtagcaaaacagattttagaacatattggtgggaaagaaaacatcaaatcaattgaacactgtgcgactagattaagaattatcgtaaatgataaagacagaatagatgaaaaagcaatagaaaatattgacggagtaaagggacagttctttgcggcagctcaatatcaaattattttagggacaggatttgttaataaagtatatgcagaaatagttggtggatcagaagatttagcaaatagtagtaccaaggaagatgcatatgcaaatatgtcattattacaaaagatttcaagaacttttggagatgtattcgttcctataatacctgtattggtagcaacaggattatttatgggattaagaggcttgttaacaaacctaggattgttacaaacaggaactaatttttacttattcactgaagtgttaacagatacagcctttgcatttttaccagcattagttgcatggtcaacaatgaagaagtttggtggaacaccagttataggtatcgtaataggattaatgcttgtatcacctagtcttccaaatgcttatgcagttgctggtggaacagcagagcctatatatctttcattacttggattaacaattcctgttgtaggatatcaaggttcagtattaccagcattagtacttggaatacttgcagctaagatacaaaaggctcttaaaaaagtaataccagatgtattagatttaattgtaacaccatttataacattattaatttctatgatattaggattattaattgttggaccaataatgcatagtgcagaacaaatagtttttggtgctatcagatcatttatgttacttccatttggaataggtggagcaatcgttggtggtttacatcaagttatagttgttactggtgttcaccatgctttaagtgctttagaagttgaacttatatcaactacaggattaaatccttttaatgcaatgataacttgtggaatagttgctcaaggtgcagctgcagttgcagtagcattaaaaacaaaagacaaaaagaaacgttctttatatatttcatcagcagttccagcgtttttaggaattactgaaccagcaatattcggtattaacttaagatttataaaaccattcgtatatggatgtataggtggagcagtaggtggtatgcttgcaggtatgcttcatatggcaggtacaggaatgggaataacagctataccaggtatattactatatatgaataatataggtggatatcttttaataaatggagtagctatggctgtggcattctgtttaacttatttcttctttaaaactgaagaataaaagataatttaatataaaagcaataatagatttagtagaaatagatatatttctactaaatctatcgtgttatagaaaagaataatgatcttttaagattattattacaaagtatattgataagattatttatatcagtatattttgtaataataccaaattattcagacaatatattatctaaatttatagcaatgcagataatatgtttgatatttctaataaattttaattagagctgaaggtattataattatcagatttcaactaatgggtaggtcttgaatttatatggattttaaacagtagaattttattaggaattttgaattgtgcattgtttattgttttaataagactatataattatagtgagtaagtcttatatggaggttaaaatgaagcagaaagttacaattcaagacattgctaatatggttaatgtatctaaaagcagtgtatctagatatttaaataatggttatgtaagtgaagaaaatgcaaaaaaaataaaagaagctatcgaaaaaactggttttgaaacaaatttttttgctaaaaggttaaagacaaagagaagtaaattaattggaattgttattccaagaattaattctgttactgtaggtgaattgcttactggaattaatagaagattagaagaaaacaattatcagggaattattttaataagtgatttaagtattgaaaaagagttatctaatattaagagcttagcgcaacaaggagttgatggaataatagttaactcaatatcaattacaaaagagcatattaaattagtaagtaaagtatcagttcctatcatatttactgggcaaaagagtgaatatgtggattcaattaagattaatgattatgaagcaggaactgtactaggaaaatatttcaaagaaaaaggtcataaaagtgttgtgtttgctggagttacagaaagtgatgaggctgttggtattgaacgtaaacaaggatttatagatgcttttacagatgaaaatgaaaatagtagtgtaaattttgttgaaactggatttgcttttaaaaaatcttatgaaatgacacctgaaattttaaagtatagtcctacagcaatagcttgcgcaacagataatatatgtcttgggatacttagatacttacatgaaaacaatataaaggtgccagaagaagtttcagtagcaggatttggaggatatgaaataagtagtgttgcatatccagcactaacaacagtagcttttaattatgagcttactggagaaaaaactgctcaaggaattttagatttgattgaaggtaaagagctagatgaaaaaaatgatataccattaaaactaattgaaagagaaagtgttgaagatttaattataaagacttaaagttttaagaaaagaggtagttatgacgaatatatatgaaaaagtaaaacaagatttaaataatttttatagcaataatgacaataatatatggagaaataaaaatcatatagaaatgccgtttggcttagttaatgatcctaatggattaagttattttaatggaaagtaccatattttctatcaatggaatccatttggatgtgaacacaaaactaagcattgggcattagttaaaactactgattttgtgaattttactaaacctgaaataattttaaagcctgaagactggtttgataaaaatggatgctattcaggtggtgcatatgtaaaggatgatatattaaaattattctatacagggaatgttaaaaatgaaaaagatgaaagagaatcttatcaatgtatagttgattataataaagatggatcatttgaaaaaagaggacctataatacctaagcaacctgatggatatacagcacattttagagatccaatgatatttgtaaatgaaggtatatattatatggttcttggagtacaaagagaaaacttaactggagctgctttaatatacaaatctgatgatattgaaaaatgggaacttgttggtgaattagaaactgacatgaaagaattcggatatatgtgggaatgtcctaatattataaaggttaatgatgataaatatgcatttttattttcaccacaagggttagaagcagaagaatttaaaaatcaaaatatatatcaatcaggatatgttataggaaatttagattttaaggtaccacaattaaaaaatcattcggaatttaaagaaatagatatgggatttgatttttatgcacctcaggtgtttactcataacgataagaatataatgattggctgggttggaatgccagataaagatagtgaatatcctagtggagaaaatggaggatggatgttcccattaacgttacctagagttcttgaatacaaagataatgttttatatcaaaagccacttaaagaagttgaaaatttaagagaaaagcagattgtatcagttaaggatttaaatataaatgaatattcactagatttagattctagaaatatagaaatagatttagagttgttattagaagaatgtacttttatagattttaaatttatattcagagatgaatatataaacttaacttataataaagaaaatggagtttgtattattgatagaaataatatgaaacttggtggaaaaggaataaggaaatttaagctgaatgttgataaaacattaaaattacatatgtttattgacaattctgttatggaaatatattatcaagagggattagagacaactacattaatgtatttccctaagtttgatgattttaaaatagagataaaaagtgataataaagttaaaatgagtgaattaaatatttggaatctaagggggattaaatatgaataaaaatgtattttgtattggtgaactattaatcgacatggtatgtgttgataataaaggtttaaaggatggagaaaaatttgaaaaaaaagcaggaggagctcctgcaaatgttgctgcagccataactaaattagaaggtaatgctgcgtttttaggtcaagttggagatgatttttttggtaaatttttagttcaaatcttaaaggatttaaacataaatactgaaatgacagtagaaaaaggaagcactacaatggcattggtaggaattgatgctgatggagaacgtaactttgatttcttaagaggaagcgatggagaatattcttttgataatgttgatacatcaaaaataacttcaacagatataattcactttggatcggctacaggattcttagaaggtgaattaaagaagacttattttaagttattggattatgcaaaacaaagtaatttatatgtatcttttgatcctaactacagagatgcattaataaaacctgatatgctaccacaatttgttgaagacagtaaagcgtttttaaaacatagtgattttactaaactaagtgatgaagaattaacattaattactggtgaaaaagatttagaagcaggtgttaaggctttacatgacttaggggttaaagttgtaactataactttaggatctaagggaacttacctaagtgttgatggtgaaaatgtaataataccttcaataaagataaaccaagttgattcaactggagcaggagattcatttgttggtgctgtattaaagcaagtatctgatattgaggataaaaagaacatcagcatggataaatggaaagaaataatagcttttgctaataaagtaggggcaataacttgcactaattatggtgctatagcttcaatgccaactttagctgaagttaacgcaatttaatataaatataatagtaatagaatctacctataagaaatattaaataggtagattctatttttttatggtattttagatgctgcaatagtgtaatttcaaatttaaaatcatagcatttacacttatataagtgttcaatatgatataataattatagttattttgtaaaataatacagagtactaaatatattctataaatgaaacttaagataaaaggtggaatattaaaatggaaaatatgcaaatattaatccaaaactcacatgaaagaagcagagtatatggtgttgaaaagaaatctaaatgttcacgaaaaatattatatggtgaagaattagaaagaatccttgctagaaataaggaattaatagaaatatcaagaatatatattgatatggttttttctgctgttgaagatgaagagtttattatagtactaactgataatgaaggttgcattctttatattagaggagctgaaaaaataactaaatccctaaattgtatggatttaaaagtaggagcttacatggatgagcggagtattggtacaaatgcaatgggaactgcaattaaagaaaatagatgtgtacagataactgctcaggagcattatatagaaggtcttcatagtttaacatgttcagcagctccaattcacaatgagaatggagatattataggaactttaaacttaacaggaaaaagtagcatgaaacatccacatacattaggtttagtagtttttggtgtgaaagcaattgaaaatgagattgataaaaataaaattaatgatatcttaaatcaaacatataattatatggaaagtataatagacaatgttgaaaaagggataatgattgtagacaagcaagggaaaataactaacataaataagtttggcgtggatatattccagaaagaaaaggaatttttaataaaagaagatatatatcatattgttcctaatctaggaaatattttagatgaattaaataatgataatagtacaatcattaaagaggtaaagattagtcattcaagtaactataagacagaacttgtatttaagggtataacacataaagatcaggtaataggtatggtaattactatgagtaatatgaaagaaaattatgatattaaatctgctacaggtgcatttttaacctttaacgatattataggggaaagtgctgcaataaaaaatgttgttactaatagtaaaataatagctaatagtccttcaactgtacttatacaaggagaaagtggtacggggaaagaggttctagcgcaagcaatgcataattatagtttaagaagaaataaaaaatttgtagctataaattgtggagccatacctaataacataatagaaagtgaactttttggctatgaagatgggacatttactggagcaaaaaaaggtggaaagccagggaagtttgaagttgctaatggtggaactatatttcttgatgaaataggagaaatgccactagatatgcaggttaatcttttaagagttcttcaggaatcaagagtaacaagacttggtggaagtacggaaattccgatagatgttagagttattgcagcaacaaataaaaatttaaaagaagaagtaaacaaaggaaattttagagaagatttatattatagattatgtgtaattccaataacactacctcctctaagagagagaaaagatgatgtacaaaaattaatggaatattttttgacaataaaatcatttaaattaaataagccaatacctaaaataaatgatgaactatattctaatttattatcatatagctggcctggtaacataaggcagttagagaattatattgagaatattgttaatttagaagggaatatttcttttgatctgtgggatgaagaacataaaaaagattttaacaatgagaatatatataaattcaatgcaaatgagaataataatcaactttgtgaaaatgaaaacaataatttgaatttaaatttccttgaaaggaaaactattgaaaaagcaatattaaaatttggaaataatatgactaaaactgcaaaagcattaggtattagtaggaacacattatatctaaaaataaagaaatatggaataaaaacgtcctaaaatagtacgctgtcctaaaataagacataaaaataagaaaaaatgtcttgatttaggacagttttttgtttattatagaaacttgaaatcacaaacccttaaaaacacttgcttgataaaaaaataacaagttggcacggattttgctatatatattctgtgaaaagaaaaataaaaccacagatatatttaggaggacaatttatggcacgttttactttaccaagagacttatatcatggagaaggtgcattagaagcacttaagactttaaaaggaaagaaagctttcgttgtagttggtggaggatcaatgaaaagatttggttttcttcaaaaagttgaagattacttaaaagaagctggaatggaagttgaattatttgaaggggtagaaccagatccatcagttgaaacagttatgaagggtgcagaagctatgagaaactttgaacctgactggatagtagctatgggtggaggatcaccaatagatgctgcaaaggctatgtggatattctatgaatacccagattttacttttgaacaagctgttgttcctttcggattaccagaccttagacaaaaggctaaatttgtagctattccatctacaagtggtactgctacagaagttacagcattctcagtaattacaaattatacagaaaagattaagtatcctttagctgatttcaacttaactccagatgttgctatagtagatccagctttagctcaaacgatgcctgctaaattagtagctcacactggaatggatgcattaactcatgcaattgaagcatatacagcatcattaagatcaaactttagtgatccattagcaataaaagctatagaaatggtgaatgaaaacttagtaaaatcatttgaaggagataaggttgctagagatttaatgcatgaagctcaatgtttagctggaatgtcattctcaaatgcattacttggaatagttcactctatggcacataaagtaggagctgtattccatattcctcatggatgtgctaatgcaatcttcttaccatatgtaatacaatataatagaaaatcttgtgaagatagatatgctgatattgcaagagcattaaaattagaaggaaacacagatgctgaattaacagattcattaattaaattaatcaatgaattcaatgataaattaagcatacctcattcaatgaaagaatatggagttgaagaggctgaattcaaagctaatcttgaatttatatctcataatgcagtagtagatgcatgtacaggatctaacccaagagaaatagatgatgctacaatggctaagttatttgaatgcacatactatggaactgaagtgaatctttaatatataatttcaaaatatattagtaaagcaaatgctctctgtctaagggagcttttgtcaatgtaaacaatatatacaataaaaagaaaaagtactatattatggtgctgaggtggggcgtatgtcatataaaattttcggaaagaaaaaacttatggatgaagtatatttaattgatatagaagcaccggatattgttaaaactgcaaagatagggctgtttattattgtgaaaaataataatgaagataatgatatttccttggaaataatagattacaataaggaaaggaaaattataactgtagttttgcaaagaataaaagataatataaaaaaattagaattattaaaagaaagagacttcatttttgatattatgggaccttttagagtaccttatgtgaagtattaaagtcggtaaaacaaagtaattacgtgttagtatatataaataggaggaaatacgagtgtttaaaatagttagtaaaagagaacttacaaataacatatatttaatggatatagaagcacctagagttgcaaaatcagcaaaaccaggtcaatttataataataaaaaatgatgaaaaaggtgaaagaatccctttaacaatagctgattatgacaaggaaaaaggaactgtaacaatagttttccaaactgttggtgcaggtactaaacaattagcagaatttaaagaaggcgaattcgtagctgattttgttggaccattaggtgttccaagtgaatttgtaaatgaagatattgaagaattaaagaaacaaaatataatatttgttgctggtggagttggtgcagcaccagtataccctcaagtaaaatggatgcatgaacatggaatagcatgtgatgttatagttggaagtagaaataaagaattattaatattagaagaagaaatgaaaaaagtagcaggaaacctttatattgctacagatgatggttcatatgggttcaatggaagagttacagattgtcttcaaaaattagttgatgatggtaataaatatgatcatgcagttgtaattggaccaatgataatgatgaaatttatggctatgcttacaaaagaattaggaataaaaacaactgttagtttaaatcctataatggttgatggtacaggtatgtgtggtgcatgtagagttactgtaggaaatgaaattaaatttgcatgtgtagatggtccagaatttgatggtcatttaattgattttgatgaatctatgagaagacaagcaatgtataaatcagaagaaggcagagctactttaaaattagaagaagggaacactcatagccatggtggttgtggatgcagaggtgataaataatgaatatgcaagatagaatgaaaagaacacctgtaacagaacaggctccagaagttagagctaagaactttgaagaagtatgcttaggatatacagaagaacaagcaataaaagaagctaatagatgtttaggatgtaaaaaccctaaatgtgtagaaggttgtcctgtgtcggttaatataccaggatttatagcaaaagctaaagaaggagattttgaagctgctgctaaggaaattgctaaatatagtgcattaccagctgtatgtggaagagtttgtcctcaagaaagtcaatgtgaaggtaaatgtgtacttggaattaaaggtgaagcagtagcaattggaaaattagaaaaatttactgctgactggtcaagaaaaaataagatagacttatcagatgttgaagctccaaatggtaagagagttgcagttataggtagtggacctgctggattaacttgtgctggagatttagctaaaaaaggatatgatgtaacaatatttgaagctttacatgaagctggcggagttttagtttatggtattcctgaatttagattaccaaaagaagatgtagttaaagctgaaattgaaaatattaaaaagcttggagttaagattgaaacaaatgtagttatcggaagaacaataactattgatgaattgatgaaagaggaaaagtttgatgctgtatttataggatcaggtgcaggacttcctaaattcatgggaatcaatggagaaaatgcaaatggtgtattctctgcaaatgaattcttaacaagagtaaacttaatgaaagctttcaaggaagaatatgaaactccagtaagagctggaagaaaagttgcagtagtcggaggcggtaatgttgctatggatgctgcaagaactgctttaagactaggtgcagaaactcacattgtttatagaagaagtgatgcagaacttcctgcaagagctgaagaaatacatcatgctaaagaagaaggaataatttttgatgtattaactaatccaacagaaatcttaacagatgaaaatggatgggttaaaggtatgaagtgtgttaagatggaacttggtgaaccagatgcttcaggaagaagaagacctgttgttaaagaaaattctgaatttgtaatggatgttgatacagtaattatgtctcttggaacttcaccaaatccattaatatcttcaactacagaaggtttagatattaacaaatggaaatgcctagttgcagacgaaaatggattaactacaaaagaaggcgtttatgctggtggtgatgcagttactggtgcagcaacagttattttagcaatgggagctggtaaaaaagcagcagctgctattgatgaatatcttaaataataaaattttaaataatgctcataattaatttatcataaaataaaacatacacaaactatttgatataaatatatatttatattcaataaaaaagagaattcaatcatggattctcttttttgttgattaaatgataaaaatattacaaaccatcaattacatattatttctaaaaatggatttaattttaaaaatatatgatataattatattgtctattttatatataaataaaaattaggaggacaatttatggcacgttttactttaccaagagatatttatcatggagaaggttcattagaagtacttaagactttaaaaggaaagaaagcttttgttgtagttggtggaggatcaatgaaaagatttggttttcttcaaaaagttgaaaattacttaaaagaagctggaatggaagttgaattatttgaaggtgtagaaccagatccatcagttgaaactgttatgaagggtgcagaagctatgagaaaattccagcctgactggatagtagctatgggtggaggatcaccaatagatgctgcaaaggctatgtggatattctatgaatacccagattttacttttgaacaagcagttgttccttttggtttaccagaacttagacaaaaggctaaatttgtagctattccatctacaagtggtactgctacagaagttacagcattttcagtaattacaaattacacagaaaaaattaagtatcctttagcggactttaatataacaccagatatagctatagtagatccagaattagctcaaacaatgcctgctaaattagtggctcatacaggaatggatgcattaactcatgcaattgaagcatatacagcatcattaagatcaaactttagtgatccattagcaataaaagctatagaaatggtaaatgaaaatttagtaaaatcatttgaaggagataaaactgctagaaatttaatgcatgaagctcagtgcttagctggaatggccttttcaaatgcattacttggaatagttcactctatggcacataaagtaggagctgtattccatattcctcatggatgtgctaatgcaattttcttaccatatgtaataaaatataacagaaaagtatgtgaagatagatatgctgatattgcaagagcattaaaattagaaggaaacacagatgctgaattaacagattcgttaattaaattaatcaatgaattcaatgatgatttaagtattcctcattcaatgaaagaatatggagttgaagaggctgattttaaatctaatgttaagtttatagcacataatgcaattctagatgcatgtacaggatcaagtccaagagagatagatgaagaaacaatggaaaaattatttgaatgcacatactatggaactgatgttaacttttaaagtttaagtagtattcaaaagagcatttaaattatatatttataacaagctattattaagaataaaataatagcttgctttttaatattatcaaactatgaagaataaaaggaaatatattaaggaaggtaatagtagtgaatataaagaaaagatttatagctatactaatgtgtttgataacagttattttatttattcagcctaagaaagtacaggcagagacaataaaagattataatatactatcggattgtgcagttactgtaaaacaagcaaaagaatgggcaaaagaaagaaatgcaactgaaacatttattgatttagcagatttgtattggaaatatgcagaagaatgtggaggagtaaatcctgcaatagcatatgctcaggcagccaaagaaactggatatggaaattttggtggtgttttagatgaaagttattgcaatccatgtgggctcaaaatagaaaagggtggagacgataatgatccagatgctcatcaaaaatttaattcatggaaagaaggagtacaagctcatttggatcatttagcattatatgctggtgcagagggatatccaaagagtgatacttatgatccaaggcattttaaaactataatgggaagatgtaaaaccataaatgaacttggaggatcaggaaaatgggcaccaagtgcaacttatggagaagaagtaaataagttatataaaagtttactagtttttgctggtattgaaaaagaagaagttgtgagtttacaatctgaaatattatctataaatacaaatgttaataattcaataaatgtaacatcgaatataggatggaaaaaagaaaataattcttggagttattataaagatgataatacaaaagtctttggatggattaatcctgatggaaactggtattatctaaacagtgatggaaatatggtaactggatggcttaaagatagtgagacttggtattatatgaatgaatcaggaactatggcaagaggatggaagcttgcaaataattcttggtattaccttcaaggtgatggaagtatggttactggattaagaagtatagaaggaaaaaattattatttaagtgaaaatggaagtatggctacaggatgggtaaatataaataattatagatacttttttgataatgatggctgtatgaaaactggttggttcagtgatgacaatggtatatcatattattacttagataaatcaagtggaaaaatgattataaatgatactgtagatggatatgagattggttctgatggaaagagaaaagcagtattaggttctacggatgataatacaaaaacagaaggtaaagttatagttgtagacccgggacatgcttacggaaaagatgaaggggttaaaacaacaataaatgacataaattatattgaaactgatttaaacatgcaggttgctaaaaagttaaaggtagaacttgaaaaaagaggctttactgtaattttgactagaactgaaaatcagaaatttacagatcttaatgacagtttatctcatagagtagatgtggctaacgaagctgatgcagaattttttataagtattcatcataatgcagtagatggaattccagaagcaaatggaatagaatcatactacagtgttgcagctaaagatgataactatggaagtggagtagatgctgaaagagtggcaaaatctaaaaagcttgcaaaattaatcaatgataatatagttaacaagttaaatgcagcagatagaggtgtgaaatctgatgaacaatcagcatcgggaagtttatttgttttaagaaatacaaatatgcctgcggtattagttgaaacaggattcttaagtaatgagaaagaagctgagagatgtgctgattcaaacagtcaacaacttgtagcagaagcaattgctgaagttattgcagagaatttttaataagaattaattataaaaaattaatacataaaaagtagtttaatgtaattgaactgctttttatttttctgtataagactaaatatagaaaggaatttgagcgtataggaaacttttaaactatatgaattgtaaattatttgattgaaatcgtaatctaagtaataaataaaatttatttgaataaattgataaaaaaataacaattataattaaaaatacataaaagtaaaaatgtggatgaataaaaaataacaaagttgaacaaaatatttaattttcagaaaatattttaaatttagaaatagagtgataaaggctgaggttaacaggttttttgtaaaaataaatatggagaataattcaatttaactaaaaaatcattaaaaaaagtttgacaaaaaataaacaatacactaaaataagcttgtaagatgtgttaaaaaaataacaagcatttaacataattttatgggaataataaaataggtaattgaaatcaacaaaatttaagataaattgatttggaggaacaggaatgaaagttacaaacgctcaagaattaacacaaagaatcactgaactaagaagagctcaaaaagaatttgcaacattcactcaagaacaagtagataaaatctttagagcagcagctatcgcagctaataatgaaagaataagattagctaaaatggcagtagaagaaactggtatgggtatcgttgaagataaggttgttaaaaaccacttcgcagcagaatacatatacaatcaatacaaggatatgaaaacttgtggtgttttagaagaagatcatacttatggagttactaaagttgcagaaccaataggagttattgctgctatcgttccaacaactaacccaacttcaactgcaatattcaagactttaatagcattaaagactagaaatgcaataatcatctctccacatccaagagctaagaacgctacaatcgaagcagcaagagttgttttagatgcagcagttaaagcaggagctccagaaggaataatcggatggatagatcaaccatcagttgaattatcacaaaatgttatggctgaatcagacataatattagcaacaggtggtccagcaatggttaaagctgcttactcatcaggaagaccagctttaggagttggagcaggaaatactccagcaataatcgatgaaacagctcatataaaaatggctgtaaactcagtattattatctaaaacatttgataatggtgtaatctgtgcatcagaacaatcattagttgttttagaacaagtttacgatgaagttaaaaaagaattagctgcaagaggagcttatatccttaaaggcgaagaaatagataaagtaagaaagataatcttaaacgaaaaaggcggattaaatgctgacatggttggtcaatctgcttataagatagctaaaatggcaggagttacagttccagaaactgctaaggttttagttggagaagttacttcagtagaattagaagaaccattctcacacgaaaaattatctccagtattagctctttataaagttaagaatttcgaagaagctttagaaaaagctgatagattaatagtattaggtggtatgggtcatacttcaatactttacactgacgaaataaaatctaaagacagaatagctgcattcggtgaaaaaatgaaaacagctagaacattaataaacatgccagcatctcaaggagctatcggtgacttatttaactttaagttagcaccatctttaactcttggatgtggatcatggggtggaaactcagtttcagaaaacgttggtccaaaacatttaattaatgttaaaactgtagctagaaggagagaaaacatgctttggtttagagttccagaaaagacttacttcaaatacggttgtttaccaatcgctcttgatgaattaaaagatatgggcaaaaagaaagcatttatcgtaacagataaggtattatttgacttaggatacactaacaaggttacagaagtattagaaagaaacggaatccaatttaaagtattctgtgatgttgaaccagacccaactttaagatgtgctagagctggagcagaagaaatgttaagcttcaacccagatgttgtaatctcacttggtggtggatcagctatggatgctgctaagattatgtgggttatgtacgaacatccagaagttgaattcgaagatttagcaatgacattcatggatatcagaaagagaatctacaaattcccaacaatgggtcaaaaagctatgatggttgctatagctacatcagctggtactggatcagaagtaacaccattcgcagttataactgacgaacaaacaggagtaaaatatccattagctgattacgaattaactccagatatggctatcgttgatgctgaattaatgatgacttctcctaagggattaacagcttgtgctggtgttgacgtattagttcacgcattagaagcttatgtttcaataatggcatctgaatacactaatggattagctttagaagcaatcagattagtattcaaatacttaccagatgcatatagtgaaggaacaactaacgttaaagctagagaaaaaatggctcatgcatcatgtatggctggtatggcattctctaatgcattcttaggaatttgtcactcaatggctcataaattaggtgcattccatcacttaccacatggtatggctaactcattattaatcaatgaagttattaagttcaactcatgtgatgctccaactaagcaagcagcatttgctcaatacaaatatccaaatgcagcatgtagatatgctaaggttgcagattacttaggattaggtggaaacactgatgctgaaaaggttgaattattagttaaagcaatcgaagaattacaaagaaaattaaatatgccaatgactattaaagaagctggtgttgaagaagataaattcagagcagacttagattcaatggttgagcaagcatttgatgatcaatgtacaggtgctaacccaagatacccattaatgagcgaattaaaagaaatgtacttaaacgcttatgatgttaaggctgtagctgacaacaaatcaaaaaaagataacaaaaagaaataaaaaagttattacctattattaatatataaattagacattcagaaaagctctcatagattattctatgggagctttttttaatatcaaatatttattcgattaaatcaaaaaatatgaattttaaaatagagtttagagcatcataaaatgaaagggtttatattacttttaatcataatatggtataatttaaagtaatattaaattaaattatttaggagagtgattgtatttggaccctagttatacgtggcagataatcatactaattatactaatagcattatctagctttttttcaatgtcagaaacagcattgatgtcattaagcaaaattagattgagacatatggttgaagaaggagtgcctggagcaaaaagagttgaaaaacttactgaggaccctaataaacttttaggtgctatattaataggaaataatattgttaatataggagcgtcatctcttgctacaattttagctacaaatatttttggaagtagcggagttggaatagcaactggtgtaatgacaattttagtacttatctttggtgaggttacacctaaatcaattgcaaagcaaaaagctgaagcagttgcactaaaggttgcaaggtttatcgagtttgcagtagttatatttaaaccatttatatatatttttacagcaatatcttctctttttatacgccttgttggatgtgatcctaatgaggctgaatcatttataacagaagaagaactaaagactatggttggtgtaagtgaagaagaaggagttttagaaaacgttgaaaaggaaatgatattcaatgtttttgactttgctgaccagcaggtaaaggacgttatggttcaaagagttgatattatttcaattgatgaagaagcaacttatgatgaagtcatgagtgttattaaaagtgagcagttttcaagaataccggtatataatcaaactattgacaatattattggatttttaaatgttaaagatttagctatggttgaaaatccacgtgaggattttaatgttaagaaatatataagagaaccattttatacatttgaatttaaaaaaatagtagaactatttaaagaaatgaagaaaagcagaaatcatattgctgtagttttagatgaatatggtggtactgttggaataataacaatagaggatttaatagaagaaatagttggtgatattgaagatgaatatgatgactatgataaatcagttgaagttataaaagaaaatgaatatgtctttgatggaagtgtaaggcttcatgatataagtgaattaattggagtagatgtagattcagaagagtttgattcaatcggaggtttaatgattggagagctaggaagaatgcctgaagaaaatgaagaagttttaattcacaatctaaagcttgttgctgaagaaatagagaaaaatagagttaagaaagtaagaatgtttatttatgaagtagatgattctgaaaacaatgaattagaagactaatttaaaaaactgctgaattatttcagcagtttttttaacagaaataacattaatatctgcctagaaaggatgtgaaattataaatgaattttatagatgaagcaaaaggagaagcaattaaagcctatgataaaggagaaattccagtaggagctgtaatagtaaaagatggggtaataataggtcggggacataatttgaaagaaactttgaatgatgtaacagcacatgcagaaattttagcaataaaggaggcttcaaataagattggagactggagacttgatggagcagaaatgtatgtaactttagaaccatgtcctatgtgtgcaagtgctatagttcaaagtagaatttcaaaagtttatataggaacttttaataaagatatgggagcatgtggatctgttataagtttattagatagtagaagattaaattcttttgtagatgttaaatggctgtatgataaagagtgctctgaacttcttgttaaattttttgaagagaataggagtaatagatataaataaatttttagaagaaagatattctgtcttatggtgttagatactataattattgtgattaataggtatttatgataaaataatttggtataaacatttaatggagagatgtccgagtggtcgaaggagcacgcctggaaagcgtgtatagaggcaactttatcaggggttcaaatccccttctctccgccaattatagaaggcccctatacatatgttatgtgtataggggcttaatagatttatataatatttttgcattattattaataagtagctatgtggtttataaatatttacaagtatggatatatgatataattattctataaagtaatttatagaaatgagggagaaatgtgagagtaatagctgtggaagatctccatataaagtctgttgaatagttgatgatgctttatatggagaaaaattattatcatcaattttattcagtaagtaagcaggctttagatccttaatattaattgaggaatggggttttattatgaaatatgtaaatgctatggaaatacttcctaaagagcttatttctgaaatacaaaaatatgtagaaggtaatataatatatattcccaataaatcgggaaaacgcactagatggggagaaaagactggtgctaaaattaaatgcagacagagaaataatgaaattagaaatttatacagaaatggatattcattagatgaactttcaaaaaaatattacctttctgttgaaactataaagaaaattatatattcaaattagacaatgccatctgtaatagtttcattacagatggcattgtaattttttattataaaaatttatggcatataatttcaaatgttttagccttagaatatttatataagatatatgcttgtagtaaaaatagcatttatcttattaatacacaataaatggggagataaaaacatgaattataaagttatagatatggggaagtattatagaaaaggagtatttaatcatttttcacaggactgtaaatgttcagtatcaattactaataaaattgatgttacaagacttgttgaagtttctaaaaaatcaggaacaaagttctatataaattttctatatatactttcaaaagtattaaattcaagagaagattatagaatgtcttatttatacaataccaatgaacttatagtatataataaaattaatccaacacagtatgtttttcatgaagatacagaaacatgtataccagtttacacagaatattttagtgattataaagttttttataagacttgtgaagatgatataaagagaggaaaggaaacaagagaatatgttattgattcagaaaagtatcccaattggtttgatgcatcatatatttcatggctttcctatgattctttaaatattgagcttccagatggatatctctactttatgccaataataaattggggaaggttcaagaatgaaaatggaagattgataatgcctgttagtgcaagaatgaatcatgcagcagctgatggatatcttgtttcaaaggtattcttgatgcttcaagatgaaatagactatttcaatttttgtaatgaggtttaatttaaaaaataagttgaaatacattttaaagcattatatgatgaattcaggcatcgatgtactctataaaaaagaaggaaatctatgaatattaaaactgaaatgataccagaatataaaattgcttatatacgaaaaatagggtcttacggttcagaaaatgtaaaagtaatggaacaattaaaaagttgggctatagaagaagagttatttaatgaaagttcaataatattaggaatagcccaagataatcctcaatttacagagcctaaagattgtcgttatgatacatgtttagttgtttcagataaatttaaggttgataataagaatatcaatttaggaaaaactattggtggaagatattgtgtatttataataagtcatactgttgatgctgtgcaaaatgcatggatggagatattttctgagttatcaaaaagaaaatatgaatttgatgatagaagacctattgttgagcgctatgcaatgcaaatgataaataagcatcagtgcgaaatttgtgtaccaatattataaaagaaattgcaagttgtagagaagtaataaaaattaataatttttagaataggttatagataatattaataatgagagaagtgcagcgtattagaaaaaatgctgcacttttttagtgtgaaaatatttaaattatatcttataattaagaatttaaatttgataaactaaattttatgcttacagatgtttgtggagtataaggatatggttatattgaaataattatgtagttttgatagatatggcaaaccatattacgaaatattaagtgtaagggatagttaactatgaaggattgctagaaagaggggtaaaaatgaaaattaatgaagaaaattttctcgatcaattaaaaaagaaaaacgaaaaagcattagattatgttatagatacctatggatggattattaaatctgttataaaaaaacatttgtacaatttacagagtgttcaagatgaatgcataaatgatgtattgttaggactttggaataatattgataaatttgatgaaaacaaaagtgaatttaagaactggatagctggaatagctaaatttaaagcaatagattataaaagaaaatatctgagagagttagataatgagaatgtagatgatttaaacataacagtagatgattctattcatgaacttttaaaaaatgaattgagcttagaaatgcaggaaatgatgaattcattaaaggaaaaagatagagaattattttataaattgtatgtggaagagattgaagtggataaagtcagtcaggaaacgggtattaaaagagatgtgatttataacagagtttcaagggccaaaaagaagctaagggatatttttaaattaaaagaaagcgagaggtgttagccgtatggacaagaatatatatgaaatgttaaatgatatgaatatagatatagacaactataaaaaagaagagttcaatgatttcgaaaagaaaaagttaaaaagcaaatttagaaaatctataaagccacagagaaaaaatagaaaaggtatagctgtggcagcagctgtagtaattgtagttggaagtataggattgtttggaactgatgcaggagctgaaataatggcaaagatgagtgaaagtatttcagaatcaattggaattcacaaagatttagaaagttataatacagttatgaataaaagtattactgataatggtataactattcagcttaatgagatcatattagatcagtctcaaaatcagcttgtaatttcagaaacgataagttctcaaaatatgctaaaagaaaatgatttgtataatacaaataaaacaatttacatcaataataaaagagtaaaatttatttctgagagtggtagaagtaagagaatagatgattattcagaacagtcagtatatgaatataatttaagttcattaaaagatatggatttaagtggagacttaaatataaaaattgaatattcaaaggttatggttaatcataaaaatcctaaaaaagggaaatgggtatttcaatttaaaacaaatggtgatgcgttaaaaatagacactaaggagataactctaaataattcatttgttcttgaaaatggagagaaggtaatattagaaaagtatacatcaaatgctttaggacaaaacgttatctgtagtattgaaaattataataaaaatgaacattatgatgtaatgctgaaaggtacagatgatttgggcaataaagtagaattttatttaaagagaggatcaaaggagtctatggtacttagatatgataatttagatagaaatttagatgaaaatgcaaaagaacttacattaacaccatattcagttaaatttccagagcagagtggaaagatgagtaatgactttaaacaagcaggagaagaatttaaaatatcattaaagtagtgaaagattattttaatatataaataatagcattaaaactagaatgtacagagatataactgtctgtatattctagttttttttattaccaagaaaataataatttagaacaatttcatttttatttaagaataaaagtgactaaaaaaacaaactgatagatatatatataattgatagatttaatatggtaattttaaggaggaattttatatgaattttagagaaaaatatggtcagtggggaattgttttaggggcaacagatggaattggtaaagctagtgcttatgaattagctaatagaggtatggatgtaattttagtgggaagaagaaaggatgcattagaggcgttagcaaaagatatacatgataaacatggaattgaagtaagggtattacctcaagatttatctgaatatgatgcagctgaaaaaataatagaatcaatcaaagatttagatatgggattaatagaatatgttgcatgtctccatgcaatgggccagtataacaatgttaattattctaaatatgagcagatgtacagaattaatataagaaccttctcaaaattattgcatcattatataggtgaatttaaaaatagaaatagaggtgcatttgtaacaattggttctttatctgggtggacttcattgccattttgtgcagagtatgccgcacataaagcttatatgatgacgctaacagaaggggttgcatatgaatgcaaggacactaacgtagatgtactgttattatctgctggatcaacaattacaccaacatggttaaaaaataaaccatcagatcctaaggtagttgaagctgctatgtatccaaaagatgttgtaaaagatggatttgagcaattaggaaagaaattcacatatttagcaggtgaattaaatagagaaaaaatgaaaaaaaataatgaaatggatagaaatgatttgattgcaaaattaggtaagatgtttgatcacatggcataaaatttgatatgcatataaggaggaacttagaatgaaaaaattagaaggaaaagttgcaatagtaactgcatcaactaaaggaataggattagcatcagcacaggcactagcaagagagggtgctacagtttatttagcagcccgttcaaaagaacttgctaatgaagttatatctgaaatgaaaaagaaaggtgaaatagctaagtttgtttattttaatgcttcagaagtagaaacttataccacaatggtaaaatatgctgctgaagctgaaggaagattagatatattagtcaataactatggtaaaactaacgttgatttggataaaaatttgacagatggagacactgatgaattttttagaatattaaaagataatgttgaaagtgtatatttaccatgtaaagctgcaataccttatatggagaaatgcgggggaggaagcataataaatatatcaacaataggttcggttgttcccgatttatcaagaatgtcatattgtgtttcaaaagcagcaattaattctttaactcaaaatatagcaatacaatatgctggaaaaaatataagatgtaatgcagtattaccaggtttgatagcaacaaaggctgcactagaaaacatgtctaatgaatttagaacatcatttttaagacatgtaccattaaatagagtcggaaaacctgaagatatagctaatgcagttttatattatgcatgtgatgattcatcttttgtaacaggaatgattcatgaagttgcaggtgggtatgcactaggaacccctcaatatgcagagtatagccaaagataaatttttattttaaaatagtattatatataatttctaaataatattgaagagctaaaataaattagatctcttcaatattaattacttatttaaaaattgattatgctattcaccaagaacttctttaatagattctaagcatgtcttaactgcaaactgcatttcatcaggttctatagtaagaggaggattaaaatatagtatatttcctataggtcttaaaagaagccctttttctaaagcttttttataaacttgatagcctattctttttttagaatcaaaaggttttttagtatttttatcttcaactaattcaattgcatttataaggccttgacttcttatgtcacctgcatatttataatccttgaatgtgttatatactaaatctttgaaatattgtctcttatcttgagagttttctatgattttttcttctttaagaatttttaaaatttctacagctacagaacatgcaagagcattcccgctatatgtatgactgtgcataaatgcttttcccttattataatcatcataaaatgcattataaatttcatcagtacttatacataaagccattggaagatatcctcctgttaagccttttgatacacacattatgtctggtgatatatctgcatggtcacatccaaacatttttccagtccttccatatcccatagctatttcatcatcaataagatgaacattatatttgtcgcatatttttcttaatttttttaaatatataggtgagtacattctcattccagcagcaccttgaacaataggttcaattatgaatccagatgttacattaccatattgttcaaaagctttttctgcattttcaaaacactcagcattacagctttctctacattttccgtatttacatctatagcagtctggagcatctactcttactatatcaaaaagtagtggcttaaatatttcagcatataagtccataccacttacagataaagcaccaactgtttcgccatggtaggcatcagatagtgacataaaggtttttctgtgtacctcacctacttgatagtgatattgaaaacttaactttattgcagcctcaatggcagatgaaccgttatcggtaaataaaaatttattcaatccttttggaaggacttcacataataattcacataattcaattccgggcttgtgagaaaaatttgcaaatataacatgttctaaattatctacttgattttttaatgcagtatttatcctttcgttacaatgtccaaataaattacaccaccatgaacttatgatatccatatatttttttccgtggatatcatataagtacatgccttttgcatgatctataactattggtggaagtttttcgtagtctttcatctgtgaacaaggatgccatatatgtttcaaatctttttcttctaagctaatacttataactatatctcctggtataaatttaataatttatttatatcgatatctaaatttttatcatttgttttcactgtagctattactggaattcctgtcaaacgctctactgattttttattatctctatggagaaaattattttcatcataattattcataattattcctctaacattgatattattcgattttgcataatcaacagttaagacaacattgttaatagtaccaagttccgatgatgcaataatgaatatatcaagattaagttcttttataacgtctttaagcattataagctggttgtccattcttagcggacaaattattccaccacttccctctacagttatatagtcacaattagattttgcttttaaaaaatctgattttattttattcatttcaattggattaccttcaatttctgatgctaaatgtggtgatactgctgttttataaatataagaaacaagatttgttgggtcttcttttaaattactaatatcagcaacatatttagcatctccaggaataagtttatcatttactaaatctgctccacttaatgcagctttataataagaagcatttatattgttttctcttaataattttaatattaatcctgtgacataggtttttcctatatctgttccagttgctgtaataaaaattcctttactcattttttcacctcataatttaaatattctttgatatgaattttgaatgttcttctgtggattgtattgagttatttataacaggaattactttttttgctacacatgtagatataagacatagtagtatatctccaggtactgcaagaataaagcagtatagtattaatggatataatcctattggagaatttataaaatagttacctatagcatagtaataaatcattccaaacacataaactatagctagattacaaaagctggcatataatatattttttaatgaaaaattattatttttatgaacaatatgtccagcagcataagttcctgcataaaatcccagtatatatccaaatgtgggatgaataaaatatccgattcctcctccttctgaaaaaatcggaagtcctataagacctaaaattatatagataccaactgctcgacttcctacttttttaccaagcaacaatccagcaaggttggtaaatagaaattgtaatgtgaatgggcatataggaataggtatttttataaatgcacctactgctataagagcagcaaaaattccacagagtatattattttttacattattattcataagatccctcctattgtaatatgttaaatccttacaaggagattgtcaactttaaaaaaaaataagttgacaatattctgtaatacataagattttatatataaatatcatctgtttaaaaaatttgatataatagtaggtaggaaaatagtatttaaatatacataggataaatttaaaattgatagaggtgacaaatatgacatattattgtccacaatgtggtaatgttgtagaatgtataaaaggatgtggatctacaggatatttttgtaatacatgcaagaaactaatatcaagtaaagctgtattgacagaaaaaccactagaattgaaaaaagaagataaataggattaatttgataggctgaaaagtctatctttttttatgagaaaaaatttaaagtataaaaaggtcaaatataaagactataatttttaattactattttaatatatatgtgctagaacacatgtaaagttatgctagaattcattgaatttatgtattattaaagataaaatatagactaaaagaaaattataggcaacgatgtcagatttaaagtttaaaattaattctggcatttttttgtcttttaatagtgaaattataatgaaattacatgggggctaaaaatgttatcagaaatattatttttaattgttttattcttttcaaatgtagtacaagggattactggatttgcaggaacggttttggcaatgccaccatcagcatgtttgattggattggataatgctaaggttatactaaatgtaatggcattgatatcaggattattaatagctattatgaactataaaaatataagatggaaagaattaataaaaataatcatatttatgattattggaatggtagttggaattaaaatttgtgaacttgttaattctgataatgctcttcttaccatatatggaatagttatatttataattgcattgaaaaatttgattttgaaaaaggaggtaacagtccctccatcaatattactaattgtattattactttcaggtataatacatggaatgtttgtgtcgggaggagcacttcttgttgtctatgcagtgcaggtttttaaagataaggatgaatttagagcaacaattgcaccagtatgggtttttcttaacacatatatggcgttttcacaatataaatctggtctatttacaagtagtaatataaatttaatattactaagcatcatacctttatttatagcaacatgggttggtggaaaattagctgaaaaattagataaaaatatatttttgaatttaacatatatcttattaattctttcagggatgtcattaatattataaacttagaaatttaggggattatataggtctgttttattaaaaggtttaattgaacaggttaatagattgctactaaaattgatttatctcgtttagaaaacagattaagattaaaaatagttttatgatatagtctgttgtgttgcagcacaaataaaattaggctttgttacattgtaaagataaggataaaaagataaacttaatgacatagaagacaagggcgtctattacataaaagtaatatgtgtcctttttattttagggtaattataatttttgaaaatattattttattttaggaggaaaagaaaatgagtttaaatggaaaagaaatagcagaaatgcatcaaaaatatgtaatgcagtcatgggcaaaatcaggagcggatacattaccaatagagagagcagaaggaatttatttttatgattatgatggaaaaaaatatgcggatatgtcatctttgttagtatgctcaaatttaggacatcagcttccagaaattgttgaagcaataaaagaacaagctgataaaatgtgttttatggcacctgcatatgcatcagaaccaaagagtaagttagcaaaattattagtagaagctgcaggggaagatacttacggaagagtattttttacaaacggtggagcagaatcaaacgaaaatgctttcaaaatggcacgtatggttacgggaagaactaaaatattctcatgctatagaagttatcatggagcaactcttggagcttcaaatgcatcaggtgactggagaagatatgctgctgaagttggtggtgcaaatggatttattcactttatgaatccacaaatgtatagagatggatatacaaaaggtgtagatgatgctgaagctacaaagagatatttagaagcacttgatttacaattacgttatgaaggaacacaaaatgtagctgcaatagttatggaatcaatagttggagctaatggtgtaattcttccaccagatggatatatggaaggtgttagagcactttgtgataaatatggaatattattaatttgtgatgaagttatggctggtttctatcgtactggtaaaatgtttggatatatgaactttaatattaagccagatattattacgtttgcaaagggtgtaacttgtggctatgttcaattaggcggatgtattgtaactaaagaaattgctgagtattttgaagaaaatgttttacaatgtggtttaacatatagtggacatactttagcctgtgcagctggtgttgcatcagtaacttattacagagaacatggaattgaagaacatgtagcagaaatgcatgacattttatcagcatttatggataacatggttgaaaaacataaatgtattggtgaatctagatgtatcgggttatttggtgctttagaagttgttaaaaataaagaaacaagagaaccaatgcaggaatatggagtaccaggaccagttatgccatggatttttgcagaactaaagaaacgtggatttgcaacatttggtcgtgaaaactttattgaaatatgcccaccattaataattactaaagaagaattagaagaatatctaccaattttagatgaagtattaacaattgtagatgaaaaatactgtaattaatttatagagaaggtgaaagtatgaattgggattatttacaacctgtaaagattcactttggaaaaggaagaatttcagaggtaaaagatattgcaagagctattggatgtaacaatggattattagttgcagatccatttttcttcacaaatggattagctgaaaaaataataaatgaaagtgaaggaactattatagcatcatttggtgaaatttcaccaaatccagatgttactgaagtagatgaatgtgcaaacattatacgtgaaaagaatattggatttgttgtagcacttggaggcggaagttcaatggattgtgctaaggcagcagcaagtgtagctttaacacaagattcaattagaaaatatcatggaacaggaatatctcttccaattaatcatctgccattaattgcagttccaacaacatcaggaactggaagtgaggtaacttgtgtttcagtacttactgatcatgaaaatggaaaaaaatctcctatagtttcagatggattcttcccaagtgtagctataattgatccagaattaacatatactatgcctcctaaagtaacagcaggaacaggtattgacgtattatctcatgcacttgaaggttactggagtaagggacatcagccaatatgtgatgcctgcgcaattcatgcagcagatcttgtatttaaatatttgtacaaggcttatgaaaatcctaaaaatgaagaagcaagagaaaaaatgtgtgaagcatcattaatagctggcttggcatttacattaccaaagacaacatcatcacatgcatgttcatttccacttaccaatattcatcatataccacatggagaagcgtgtggattaacattagattattttgttagaattaatgctaatggttatgaaggtgaaagaatagacaaattagctaagactcttggattcgaaaattctgatagtatggcggatgcgatttatgagctaaagaataaaatgggattgagaaatgatttaaaagacttaaaccttaatgaagatcaaattaatgatttagtaagaataagtcgtcacccaaatctttataataatcctgttgaaataacagatgaaatgttatcagaaatgtaccataaattagcttaaacaagttgattttatgttaagtgtactgcagcataaaaagtattgtgctgcagtttcttgagtacaattatcgattttagtagaaaaattaaaactgaaaaaacttgacatgcaggattttattttgtataattcattttaataaaggcaacggagcatttatttttataataggattccgttgtctttttttattttaattgatatatcagtgggatttcagtggaaaggtgtaatgatattgaaaggatttgaaggggcatattcaaaagaaatctataaaaaattaaaacatgatattttaagttctcaaattaaagatggagattttcttacattatcagaattagcagaaaagtataatgtaagcaaaactccggtaagggatgcccttggtgcattagaaatagagggatatcttaaatctttaccgagaaaaggatatttagtgaaacctgttactaatagaagtataagagaatcttttcaaatgagattaattgttgaaatagcagcagctaaaatagcaattaaaacagcagatgattctgaacttatgagtatattagaacttgcatcaaagtttccagaaacaacagcgaaagataatttcttttcgtttaataaattaaatgatacattccatatggcaattataaaagcaactcacaattcattatttgttgagattggattaggcataatggagaatttatcgagaatacttatggcagatagtcatgagctagaatttattaatgaaaaacatgagcatataaagatagcagaatccttagcaaaaagagattttgaaagtacagaaaaattaatttcacagcatattttccatttacaagaaagagtttgtagtaggcagagagaggtatagaaaagttttatgaagaacatacttttattaacaactgggggcactattgcatgtgttgaaacaaaagatggacttgttcctggattaacaggtgagtggcttatagagaagataccacaaattaagactcaatgcacaattacaataaaaccaattttaaatattgatagttctaatatgtactctgaagactgggtaattattgcaaatgccatatatgagggattaaaaaaatttgatggaattgtagttactcatggtacagatactatggcatatacaacatctattatttcttatatgttaaaaaatgttgataaaccagttgtttttacgggatctcaagttccaatcgataaggaaggcagtgatggaataactaatttattgcaagggtttcaagttgcactttcagaattaaataaaatttgtctcgtatttaatggcaaaataatgcttgggacaagagcctttaaaattcattctttagatgaagatgcttttgtaagctgcaatgattcttatttaggaagaataaaaaatggaaaagtaattttagaagaatcttatgatccagtaaaagaaactactaagatttattcaaagatctgcgataaagtttttttattaaaattaatacctggaataagaccagagattattgattttattgtaaatcagggatataagggtgttgttgttgaagcatttggcttgggtggaataccttctgaatatacaaatttgcttgcaaagtttaaagaaataacaagtaagtatagaattcctgttattgtagtaagtcaatgtgtttatgatggagcaaacttaaatgtttatcaggttggagttgaagcagaaaaatgtgggctgatttcaggtagagatatgagtactgaagcagcagtgacaaaattaatgtgggctttaggacaaactgaaaaatatgaagatatagaaaaaattatgaatacaaatttatgtggagaaataagcaaaagcaattaaaaagtttatataaaataattttaatataaaaacgagtagtaattaaatagtattactcatatttgaaaggggttaattaaaatgaaaaaaagcaaaatattatctgccgtaatggcatcagtattatcagtagcattacttacagggtgtggatcagcaaatgcaggcggaagcaaggaatcatcaacaggggaagctaaagaaggtaaatacataatagcatgtgatgctaaatatgcaccattttcatttgaagaaaatggatcttataaagggattgacgtagaattattagatgctatagcaaaagaagaaggttttgaatatgaattgaaaccaatggatttccaagctgtaattccagggcttacaagtggacaattagatggagcaattgcaggtataagtattacagatgaaagaaaacaagctttagatttttcggatggttattttgaatcaggattatcattagttgttaatgctaataacactgatataaatggagtagatgatttacaaggaaaaagtgcagcagttaaaaaagggacagcaggatctcaatttgctgaagaaaatgcagataaatatggtttaaaattaaattatcttgaagattctccaacaatgttcttagaagttgaaaatggaaattctgatttcttattagaagattatccagtaatagcgtataagattaaagttgatggtggatctaagttaagaatagctggtgacaaattaacaaaagttgattatggttttgcagtaagtaaaggaaaaaacaaagaattattacaaaaatttaatgatggtcttaagaaagtaaaagaaaacggagaatacgataagatcgttggacaatatataggaaaataattaaaaaagtagtaatgagggctttaagccttcattactgttgtgataattagttaggagagaagtttatgcagtttttagaattattaaaagattctttacctagtttaactagtggactattggttactataaaaatttcaataatttcaattataatagctgttatattaggaattgtttttgggatatttagtataagtaaaaataaaatattaaaaacactatacattatatatttatatataatcagaggcacacctttaatggttcaagcattaattatttattttggtattgcaccattaattgtagaaagatctaatccaatgtattgtgccataattgctcttgctttaaatgcaggtgcatacatgtctgaaatatttagagctggtattcaggctgtagatgttgggcaaatggaagcatcaagaagcttaggccttggatatttaaaaacaatgcaaaaggtaatattaccacaagcaataaaggtaatgataccatcaataattaatcaatttatagttacaataaaggatacatcaatattaacagtaataactataagagaattaacagcaagtggacagattatagtagctagaaactttaaaccactagagacatatgcaatagttggtataatgtattttattttgataactacattaagtatattatcaaaatacatagaaaggagcttacatcatggtcataaaagcaaatagtgtaaagaagagctatggaaagttagaagtacttaaagatatatctttagatgtgaaagaaggagaagttgtttgtataataggaccttctggatcaggaaaaagtacttttttaagatgcttaaacagacttgaagaaattcaagggggaagcattaaaattttaggcgaagaattagtaaataacaagaatatagataaattaagacagaacataggaatggtatttcagcatttcaatttattcccccatcaaagtgtacttaaaaacatgatgcttgcacctgttgaattaaaaagattaactaaggaagaagctgaaaaaaaggcacttgaattattggataaagtaggattgaaggataaaaaagatgtttatccagatacattatcaggtggtcagaagcaaagggtagctattgctagagcactggaaatgaaccctaagataatgttatttgatgaacctacatcagctcttgaccctgaaatggttggagaggtattaaaggttatgaaagatttagcaagtgaaggaatgacaatggtaattgttactcatgaaatgaactttgcaaaagaagtagctgacagggttatatttatggataaaggatatattttagaagaaggatcaccagaagagatatttactaatccgaaaagtgaaagatgtagagaatttttagataaagtaattaataatggttgatttgagaagtgaatagtaaactcatttatagtcattacataaatatacttagacaggttagtatattaaaaaaggttatcttctatgcaattttgatgaacaaacaaaaaagctaatgaaacaagctttattatagctggtttcattagcttttgtttattgtgtcatatttaagttgaataataaaatttttctttatattttgtgtacaaaaattagtataagcaatggataaattacagaaaataattttataaaaaaatatttttgttgaaaggggtaattacaaatgaaaaaaggaaggttattactagctataatgtcattaatgttgctaacagtactattcacagcctgtggaaaaaatacaaaagacattaatgaaaatacaacatctaatgatgagacaaagcctaaatatgtaattgcatgtgattcgaattttccaccattctcatttgaggaaaatggtacttatacaggtattgatgtagaattattagaagctatatctaaaaaagaggattttgattatgaattaaaaccaatggattttggatcaataatttctggtctttcagatggcactattgatggtgctatgggagcaataagtattacagatgaaagaaaagaaattttagatttttcagaagaatattttgaatctggattatccatgggaataaaacatgatgacacttcaattagtaaatttgaagatctacaagggaaaaatgtagcggttaaaaaaggaacagcaggcagtgagtttgcagaagataataaagaaaagtatagcttgaatttaaaatattttgataactcacaaagtatgtttttagatgttgaagaaggaagttcggatgctgtaattgaagaccatcctataatagcatatgaagtaaaaaaagctacaccagctaatttgaaaatagcaggagataaattaaaaacttttaattatgggtttgcagtaaataagggcaaaaatcaagaattattagataagtttaataaaggtcttaataaagttagagcagatgcagaatatgaaaagattgtaagccaatatatagtaagataatttttataaactcgttaagattaagtagcttttaatgtagaatatacaataaattttaataacctatttaagaaagtataattacgtgaatataaaatttggagtttaatttaatatatgaaaaacaaagcatttttttataaaaaaatttaaatattatagccttgaatttaggtattttatatgttatcattaacaagtattaaaacagtgtaattattttattacattaataaatactatgtgatttgcataaagtatataagaataatttattgtacttaagcatgttgcaatgaataacatggtctgatgtccactggggacgagactttttcttaaaggattaagaaaagtttggaggttcaatccctcttcattccaccattgccacgctagatggggagttagcggtgccctgtaacctgcaatccgctatagcagggttgaattccttgattaggtatcagtaatttatagtctgacttttgtaagtggtgttgatgactgggtcccacgcaatggaagcccatgaacctcgtcaggtctggaaggaagcagcgataagtggtcactttcgtgtgccgtggatcaatctggtctgagctaactgcagaagtaacgtatagagagctgataacaactcaaggtgcgtggtttatttatatggattcttcatagtcgtatgaagaagttttaaagaattaaataggttattcttcaataggattaacaatataggacacaatcaataggataagaaaatgaggggatttcatttatatgaaataccctcattttctttttacaaaaagcgacaggtgacagtcaccttaccgtatttttgatacaacctatgccttcaatttcacactcaacaatatcacctgattttaagaattttggaggttgaaatcccattcctacaccagcaggagtacccatagcaattatagtaccagcttttaaggtcattccttgagataattcagatattgcatctgatatagttgtaatcattaaatctgttacactattttgtcttaattctccattaactcttgagcatatttttaaaacaggaggttcattaaattcatcttttgtaacaatccatggccccataggcgtaaatccatcaagactttttccaaaataccattgtttatgccttgtctgtaagtttcttgcgctcacatcattcattattgtatacccaaatacatagtcataagcattatcagaagatacgttctttgcatctttaccaatgataacagctagttcacattcataatcaaggctgtccactaatccatcatataatggaataatatcaccatcagtcgttgcattgttaacacgttttgaaaaataaacaggatattttctatctttttcaaaagcttcttttttatatcgtgctgattcttctgcatgagctgaataattaattccaagacatattatatcttgtgcaggaattggaataggagcagatttttttacttcttcaacagatataagatcattatcgcaaaagccctcaaaaattttattatttaataatttaatttcttcatcacttatattacatattaattcattcatagattcatagttaataccaatcttttttataggatatattttattgttatttactaaaatacctaaactttctttgttatcgtattcaaaagttaatagtttcatttttatctccccaatttctaattttatgttgtagttaaattactattgcagtgtattttataaattcatatctgaatataacaatactcagatatgaataattttattattttcttactaaattaataaaagaatatgtaagcccatttttttcatcaatcattttatctgatgaatattcaatgtcatacttagaaaaatctatttcaggaaagtgtgtatcaccttcaaaagattcatggactttagttaaatataattttttgcagtgaggtagaagttgtttgtaaatttctgcaccaccaataacaaaaatctcttcttcagagttttcatgattttttataaatgaatccaaatcagaaattatatcaacttgatcagaatcaacagcatatttatcatcacgtgttataatcacatgctttctattaggaagtattccaggaagtgattcaaaggtttttcttcccataagcattgtattgccagaagttatagatttaaatctctttaagtcttctgaaatatgccagattagtttgttatcttttccgataacattattttgtgcaatagctactattaatgatagcatatatagccctccttatatgatttttaaattatcttattatactacaaatcataaatatataatttaaaaaatatagtatggtaaaagattattaactgctaactgtaaactaaacggatacaggcatttttattgtttcgtgatgtttataatcaataagttttatatcatctggtgtgaaatcatagaaatttttgatttcagggttaatccaaagttttggagcatcataagcatcatcttttcttgttaattgagttttcataccttcaatttgattttcataaatatgtgcattgtttattacatgagtaaataatcctggcttaagtccagtaacttgagctaataaatggactaatacagcatattggcttgtgttgaatggaactccaagtggtaaatctcctgatctttggataagcatacagttaagtctgccatcagtaacatcccacattgttgcccaacagcaagggtataaagcaccaccatctaagtgctcccattgccataagttaagcatcattcttctatcttgaggattgttttttaaagcatcaattagtttgtcgatttgattgaatttttttacaacccatccgtaagaagttccgatagtaccatcttccatttcccattcatcccagatacgtacgttctgagcttgaagatctttaacattatttgattgatctttaaatatccataaaagttctttaacagcagttttaaaagcaacaaactttgttgttaaaatcggaaattctttttctaaattaaattgcattatttgatgtggtaatttgtatgtaggcattcctgttctattgttatcatagtacccattttctagtatatctttagcaattgataaatatttatcatcatatgtactcataaaattaaaatcctcccgttacctattaattgtagtatatttattttatcattgttagatgaattatgaaaactaatattgtcttcatttaattattataaatagtttggtttatatttgactatctctaaattcaatttcagtaccttcaggtgctataactttaaataaaaatccattttcaactttatatatttctttgtcattttttaatttgaactttgtatatccacatgactttattttttcatattctgagtgtatattatctacaaagaagcacatatgaacaattccttcatttaaagtactatagttatttagtggaatattatttttaggtgtttgtaactcaatcatgaaatctccacatttcagccatgtgttatagtctcgattatgaaaatttttagtttcctgaactatttcaaaatggagtatttggttataaaaatctaatgaatttttataatcattagtttgaatgcaaacatggtgaataattttttttgacatattgaatatttctcctttatatgtttaatattacttttataaggtattttaaattagtataaactaaaacactaagatttaatatacttcaattgccatgtgataattatcagtccatgttaaaatcctatgtgatttaaatattaattgtaaagtttatagtttaatatatattttttacttaaaataacatgatgataggttgaattaagagatattttgaattgaagtggcattagtgtataataagggtatatttaagataaatagcgaggtgagaggcctttgggttatacagcattatatagagaatggagaccaaagacttttgatgatgtagttggtcaggaacatattactaccacattaaaaaatgaaattataaatgatagaatagcacatgcttatcttttctgtggaacaagaggtacaggaaagacatctactgcaaaagttatggcaaaggctttaaactgtcttaatttacaagatggagagccatgtaatgaatgtgagatgtgtaaaaaaattaatgaaggattggctatagatgttactgagttggatgcagcatcgaataatggtattgataaaataagggatattattgatgatacaaaatatccgccacaggaagcaaaatataaagtatacataatggatgaggttcatatgctatcagttggagctgttaacgcatttttaaagaccttagaagaaccacctaagaatgtaatattcatattggctacaacagatccacaaaagcttccaataacaatattatcaagatgtcagagatttgattttaagaggattaatcataaagaagtatcagcaaggctgagaagaataacagaagctcaaaacatagattgtgaagataaaagtttagatcttattgcaagagtttgtgatggagcaatgagagatgctctaagtatattagatcaggcaattgcaatgggagaaaatgaaatagactataatgatttggtaagtatccttggtttagtaactaatgaatatttatttgatataactaattctataatagaaagaaatattgaaaaatcgatgattattgttgataagcttgtatattcaggtaaggatatgcagctattcataaaagatcttatagctcactttagaaatcttcttatgattaaggtaactactaatccagaagaagtattagatatgtctcttgaaaatattacattagtaagagaacaggggcgtaaaataagagtagaagaaataatgagggatataagaattcttcaagaagcagaagctaattctaagatgagtaagcaaagcagactatatcttgaattatcaataataaaaatgtgtaagatagagtatgatacttctaatgaagttattttatcaagaatgaacagactagaggaagatttgaaaaacggaaaagttcaaatagtgagtaattcatcagtggatgaatctgaaaattatagtaataatactgggactatacgtaatgattcaaatcaaaaaagagaagctactagttctaaaaaaattgagaataaaatatcaggcaatggtgaagctgttaatgaaggtttcaatactgaatccaaactaacaattgatgatgttgcaagagcgtgggctgaaatattagaaatgtttaaagccatgagagcgagaataattcatgcatccttaataacaggaaaaccatatagttttaaaaatggagtactaactataggatttaatgaactatactcacaaagcaagccaaggttagaaaaccaacagtatagagaaactgtaaatgaaatattctctaaagtacttcgtgaaaaagttatagttaattatacaattataaaagaaaaagaagatcttgttgataaagagcaaatgcttaaagataaaatagaaggcataccttttgaagtatatgatgaataatataatagttaaaatataaatttagaagatagtaattttagagtataatagtgaaacttgtttattatttgaagatgttttataattaaaaaatgatatttaagaataagaggaggatttttttatggcaagaggaggattcccaggaggcttcggcggcggaaacatgaacaatcttatgaagcaggctcaaaagcttcaaaagcaaatggaagatatgcaaaaagaaattgaaactaaggaatttgaagcatcagtaggtggcggagctgtagttgttaaagtaaatggtaaaaaagaagtttctgctataaacataaaaccagaagttgtagatccagatgatgttgaaatgcttgaggatttagtattaactgctgttaatgaagcaatgaaaaaagctgatgaagaaacttcaagtaaaatgggtaaattaactggtggaatgggtggattattctagcaggttataattattaaaatatagcatacaggaagttggattatccatcaccttgtatgcttttttcaataaataaaaatgacaatcaataattacattaaagtacggtataataaataagtaaacaattgattaaaataatatatataagaactctaagaagaaaaggagaaattaatatggaattttatccagtagccatagaaaaattaatagaagaatttgcaaagttgccaagcataggaaaaaagacagcgcagagattaactttacatgtgcttaatcttccagaagatgaagtgagagaatttgctaatgctttagttaaggctagaggaacaataaagtactgttcaatatgtggaaattttactgattcagatccctgttctctatgttcgaatcccaatagagataagggaatgatatgtgttgttgagcaaccaaaagatattatgactatggaaaaagtaaaagaatacaatggagtttatcatgtattacatggaaatatatctccaatgcaaggcagaggcccacaggatattagaataagagaacttgttgcaagaatgagtgcagatgtaaaagaagtaatcttagctacaaatcctaatattgaaggagaagcgacagctatgtatatttcaaaagtattgaagccattagatgtaaaagttactagaattgcagcgggaatacctgttggaggagatcttgaatatgctgatgaagttacgttatcaaaagctcttgaaggaagaaaagaaatataataaaggaacccaagtgggttttgggttcctagaaaaaggtgttacatagatgggagttagaagtttttgtttgacatgagtgaaaagcttcttatatcatatagtatatggactataggttaaattgttacaaatgatgaatataaaaataaaaaaataaatgaagcataatatttccaaaaagtggatagtaatataataagaacttttttggagggatttatgtgaacagaaaaaagattctgggatacttgtataatagtacaaattcatatgaactttatgaaaagctattagatgagatggaagaagcaaaaaaagaaataagtgcagcacgaagtatgtttgacaatgttagtgatgctacacttatagaagtagctatttactcagagaatgtagcaagaaaaagatatgattatttattatcaatagcaaggtctatagatcttcaagtaggatatgactatatatacgaaaaaaatcttaaagtcatggagtagcatttagggaagaggcgttaattatgaatgaacaatatttattatatggcttggtaggaatagtagcattatttttatgtataaaattacttaagtggccaataaaaatactgataaatggaataataggagttgttttattatatgtagttaatattataactgctaatttaggagttattggaatacacactaattttgtgttaccaattaatcctattactgcattaatagctggatttttaggaattccaggagttgtggttattgctttaattgtgttatttttataaagttatatgacatatagaatattattaaaagtacttgtttaataaacaatatttattttgagatgatttatgattaattttaatacataaacgttactcaaaaatttataaatgttgttttaaagggacaagtgctttttttattatgtatatttttattaaatttttaattttatatattttagtttgttatattaaacaatataatataatatgtaaagtatggaattaaaatatgtaaataagcaatattttactgatggtttataaaaattagaataaaaaaggggaaaagttagtgagaagagcatatgttaaaaaagtgattttaatgacattaatgagtctgacagtttctatgcctgtctatgctgaatggaataaggaaagtgataagtggatttggacggaaaatcaagaaaaatctataggatggaaagaaattcaaaataagtggtatcattttgatgaaaaagggcatatgaatacggggtggattcaggataatgacaaatggtatatgttaaatgatgatgggactatggttaatgactggaaacaaataaatggtaaatggtattattttaatgattctggtatcatgcagtctggatgggtaaaagacaatgaaaaatggtacaagtttgatgatcatggtgtaatggtaactggatggtttgaagaaaatgaaaaatggtatcatatgtcccctagtggaattatggataagggatggaaggaaattgatgatgaatggtacatgtttgatgaccatggaataatgcttaccggatggattcaggataatgatacgtggtattatgctgattcaaatggaagacttgaaaaaggtagtataagtatagatggaaaaagttatacttttgcagagaatggtgctatgttaagtggggcaaatgatcaaactacagcatcatctcaagaagattacaataaaaaagcatatgtaaatacaaatagcgattttcttaatgttcgctcagaagcatctactgaatcttctgtagtagataaattagctagaggaactgaagttaatattgtaggaaatatacaaaatggtttttatcctatagtgcttaatgaaaaaaatgcatgggtaagttctgattggattagctttgaaaaaccaacagatatacaatcaaatactgataaagacaagaagcctgttgaagatcataaagaaaataatggcacagtaactttaggtggaataaggactacatctccaaatttgaatgatgttcattactattcagatgcgaatatattttataaagtaagattatcaccaccattttttaatagttcaggagagcaaataagaggaaactgtacatggtatgcatggggacgtgcatgggaattgactggaaaaccaccaatagaagcaaattttataggaaatgcttatgaatggtgggaatcaaataaaagaacaggtaaatataagtatggtacagagcctaaagtaggagctattgctgtatggaattcaagtttaccaggatcaggcggatgtggacatgttgctgtagtagaaaaaatagataataacaagacatatatatctgaatctatgtggcatggggattgttttaaatatcaagagatctactcaacacaatatttatatggttatatttatttagatgaacctaactattaaaatattgctttgacaatcgagaactttgcgttaatatgtaatgtagcaatatatttaaaggagtagtgataagtatggcagcaggaaatggagtaaactgtagtgactgtacagaaataaaaaaaggaaaatgtgatggaaaagatttaacatgcttatgttataagtgtccaagaaagctggctcagtgcatgtgtgttaagtattgcagagaaacagaatcagtactatattttgatgatgaatatgataattatgactaatcattagcactagaagatttctagtgcttttttattcttgttttacatattttcaaaagtaaagatgattagcaagtaaattaattgagtatatattacataattaacatatcaataaaatttgataaaatttttattgatatgttattcctaaaaatataaaatatgctataatagttataaaatataaaaattggggggcaattttcatgtcaagagtttataattttgcagcaggaccagctgtattaccagaagaggttctaaaagaagccgcagaagaaatgttagattataaggggactggaatgtcagtaatggaaatgagtcatcgttctaaggcatttgaaggaataatccaagatgctgagaaggatttaagagatttaatgaatattccagacaattacaaagtattatttcttcaaggtgggggttcaacacaatttgcaatggtaccaatgaatttaatgaagaataaagttgcagattacattattacagggcaatgggcaaaaaaagcagcagcagaagctgaaaagtttggtaaagtaaatagaatcgcttcttcagcggataaaacatttacttatattccagatttaaaaaatatagaaattagtgatgatgcagattatgtatacatctgccacaataatacaatctatggaactacataccatgatcttcctgacactaaaggtaaaattttagttgcagatatgtcatcagatatattatcagaaccaatagatgtaactaagtatggattgatttttgctggagttcaaaagaatattggaccagctggtactgtagttgtaataattcgagaagatttaattacagaagatgtacttgaaggtacaccaacaatgcttcaatataaaatacatgcagacaataaatctttatataatacaccaccagcttatggaatatatatttgtggtaaagtatttaaacaccttaaaaaacttggtggtttagaagctatgaagaagagaaatgaagaaaaagctaaaattctttatgattatcttgattcgagcgaattatttagcggtacagttgtaaaggaagatcgttctctaatgaatgtaccttttgtaactggtaatgaagaattagatgctaaatttgtaaaagaagctaaggcagcaggaatcgaaaatattaaaggacacagaactgttggtggtatgagagcaagtatatataatgctatgccaatagaaggtgttaagtatttagttgaatttatgaaaaaattcgaagcagaaaataaataataagttttagaataaataaaaaatcccacagtagattttagtgtgggattttttttgtattttacattaaatgtaaaatataatatatatatactttttagatattaaataatcattataaaagctatatattaaacaaattatcttataaaataacaaaaaaatattcaattaataatttaaattactaattgaagcaataaagtattgaactggaagaaaataagtagtaaaatataacaaatgttataagtgtataaatttaattactcagaaaaatgaggttatttttttataattataattcagacaacttttgttggatataaaatattagttacgatggcgtagaaaattaaactctgctagtttgtacactaatagggttctttctttgtttggggaaatttattgaaagaaactaaaaaaatattacatattatttatgatatatatggtaataagcataacaatatttaagggggatttaaaaaaatggttagagtattaacaaacgatggtttgcaagcagcatcaattgaagctttaaaggctttaggggtagaggttgtaaacgaacatattgaaaaagaggaattaggagaaaaattaaaggaatttgatgctatcgttataagatcagcaacaaaacttactgcagatatttttgaagcagaaaaaggtggaaatttaaaattagctataagagcaggtgttggaattgataacattgatattccagcaggaaatgaagcaggagttactgttaagaatactccagcagcaagttcggattcagtagcagagttagctttagctcacatgtttgcccttgcaagatttgttggtatagcaaatgtcacaatgagaaatggtgaatggaataaaaagaaataccaaggaactgaaattggaggaaagactctagggatagttggtatgggaagaattggacaatctttagctagaaaagcagaagcattaggaatgaaagttgtttatactgatttatttggtaaaaatgattcattagcatatgactttttatctttagaagaagtgttaaaagtttctgatttcatttcgcttcatgttccatatgataaaaatgcaggatcattaattggcaagaaggaactagcattaatgaaaaatacagctttcttaatagactgtgcaagaggtaaagttgttgaagaatctgcattacttgaagctcttgataatgaagtaatagcaggagcaggacttgatgtttttgaagaagagccaacaaagaacactacattagttaatcatccaaaggttagtgtaactcctcatattggagctgctactaatgaagcacaaacaagaattggtgaagaagtagtatcaacaataaaagaattctttaacttataatttaagtaagtatttcaggctcagagagtttgcttacaataaaagtctgctctactgagccttagtaagtttaaagatatgaaagctaagaagtatattgtagtgatgtatcatttagtttttatattgaatatatatatggtgatgaaaacaagtcgctttttaatgataaaaatagaacaatattatgtatgatttatataatatatttttatatagggggaatttcgatggcaacaattagaccatttaagggtataagacctgttacagatttagcttcaaaaattgcagcattaccttatgatgttatgaatagtgaagaagcaagagaaatggtaattggaaatccacactcatttcttcatgttgatagagctgaaatagatttagatccttcaattgatgtacatgatcaaaaagtttatgaaaaggctaaagaaaatttagataaaatgatttcaggtggtgaatacactcaggatgagcaaccatgtttatatatttatagacaagtaatgaatggaagatctcagacaggtatagtgttttgtgcatcaatagatgattatatgaataatattataaaaaaacatgaatttacaagagctgataaggaacaagacagaataaatcatgttgactattgtgatgcaaatacagggccaatatttttaacttataaagaagaacagatagcttcagagattatagaagcatggattgaaaatgaaagtaaaagaaagccaatatataattttgtagctgaagatggaattcagcatatagtatgggtaattgataatgatataatcattaatgaattaactgatttatttaaagaagtagattatttatatatagcagatgggcatcatagatcagcatcagcagtaaaagttggtctaaagaggagagcagaaaatccagattatacaggagaagaagaatttaattatttcttagctgttgcatttccagataacgatttaatggtaatggattataacagagttgttaaagatttaaatggaatgacaaaagaagaattcttgaataaattagatgaaaaatttattgtaactaagtctgagaataatgctccggtaaaaccatctaaaaaacatacttttggaatggatattgaaaatgagtggtatatacttgaggctaaatcaggaacatttgatgaaaatgatccaatagagcagcttgatgttgcaattcttcaaaataatgtactaactcctattttagggattgaggacgtaagaacatcagatagaatcgattttataggtggaatcagaggaattaaagaacttgaaaagagagtaaattcagatatgaaaattgctttttcaatgtatccaacagaagttcatgatattatggatgttgctgatattggagaagtaatgccaccaaaatcaacatggtttgaacctaagcttagaagtggattatttattcataaattgagttaaatctttctcataaaaaagattattaacaaataaaaaattaacgagaaaataaacgaaggaataaggtataacgcttaaaataaatgcttgagagagtattttgaattaatgcgaaatgctttattcctttttttatacaaaatctgtctgaagattgattgtaaatttaataacaaaaacatgattaaattatattaaaaacaatgataatgataaaataattacataaaagtaataaaaatataaaaaaactattaaaatacaatattgacataaatagagaaaaagtataaacttatttaatgatagttgggaatttaatattattttataatattaaattttcggtaagtagcaaaggggctattaaacgagaattttgtttaatagctttttttattaaagttcgagtcatgcatatgatacatatagcaagattagatatatggataaaaataataaagagggggtttttaaaatgaaatttaaaaaaataatagcagccatgtcattagtattatcaatatcaatgttagttggatgtggacaaggggcgtctcaagagacatcagctgatgttgataatggagcacaaagttcatcagtggaaaataaaaaatatgaggcagaagatatgagtaaactgccacaagtagctaaagatagaaaggatactttaataataggaacagagtctccaaagggtgtatttaatccactttttgcaaattcagtatacgatactaatattgctcgtacaatgtatgaaagacttttagaatgtgatgagcatggtgaaccaacacctagattggctgaaagttatagtgtatctgatgatgggttatctgtaacttataaaataagaaaagatgccaactggtcagacggaacaccaataacaagtaaagatgttgaaatgacttggaaaattatggcggataaatcatatgatggacaacaagatgttattaatggtacgtatacaattcaaggaataaaggactatcatgatggaaaaactgaatcaatttcaggaatcgaacttgtggatgataagactgtaacattccatcttactaattattatccttttgcagcacaagatattgcatcatatgaaataataccatcatcttggtatggaacattatataaacatggtgattgtagtggcttaaaatcaacttatacagaaccaggtcctgtttcaggagcatataagcttacaagctatgaacaaggacaagaagtaaaaatggaggcaaatgataaattttatcttggtactccaaatattaagaatataatctggaaagttgatacacaagataatgttttgcaattcttaaaatctggtgaaatagatatggattgggtagttgctaataatgataatattgatgatgtagaatcagcaggatttttaggttatcaaaactatttagataatggatatagctatatatcgttaaatcaaacactaccacaatttcaagatccagcagtaaggaaggctcttactattggtcttaatagaaagaagatagttgatacaacttcggataaatatggtaaagtgataaatattccagagagttcaacagcgtggacatataaagaaccaaaggaaacttatgattatgatgtggaaaaagctaagaaaatgctagatgatgcaggatggaaagttggatcagatggaataagagaaaaagacggtgttaaattatcatgtcatttcttatgtccaactggaaatgaattttactcaacacttttatctgttttagatcatgattggaaagaacttggtgttgattatactggtgaacagatagactttaatgcactatgcacaaaaacagataataaagattttgaagcatattgtatggcttggtcattaaatccaattccaagtggagagacaacatttgcaagctatggttcacaaaactataacacttacaaagatgataaagttgatgatttactaaaacaaattgcagctgaacatgataaagataagataaaagaattatatggtgaatattatgatgaattaaatgaaagtttaccatatatctgtttacaacaaaaaattagaaattattcaattagtggaagagtaaaaggtatagaaatttcatcatatgtaccattttatttgagtttatataaagcaacaattgagggatagaaataagcaattaaagtgaagggtttaaaggcatctgatttaagatgcctttaattagattttttaggaggttaaattatgttaaagttcattactaagagattactaaaagcaatacctcaattgattgttatatcaatgattatatttggaataattgcaatggttccgggagattttgttagtgcacaatccaatccaaacatgagacctgaacagattgcaagacttagagaaatttatgatttagataaacctctacatataagatatgtaaaatgggcgggcagtgctataaagggtgactttggtgactctctatcatttaatcagccagtttcatctgtaataggggggtatatttggaattcattttatttatcattcacatcattaattattacattattaataggagtaccgcttgggataatatgtgcagttaaacagtattcgatttttgataagatatccacggtgtttgtatttatttcgttgtcaattccatcatttttcttggcattggttttggttaaagtttttgcattagatttaaaaatatgtcctttagcaggaatgactacaactggtggcaatttaacaggtatggcttattttatagatgtagctaaacatatgatacttccagtaataacactttcgttattaagtgttggtgcatggatgaaatatgttagaaattgtatgcttgaagtaataaatcaggattatatacgtacagcaagagcaaaaggattaaaagaaaaggtagttatttataagcatgcattaagaaatgcagcagttccaatggttacatatcttggactttgcataccaggtctttttgcaggagcaataattacagaaacagtatttgcttggccaggtgtaggaagacttgcttatgaagcaattggaaatagagattatacattacttatgggattcaacatgctttcagcagtattattaattctaggcaacttattagcagatgttctttattctgttgttgatccaagagttaaattaaagtagggggatgtaagctatggaaaatgtaaataaaaataaggaaatagttatgtcacccagcaaaatggcatttcaaaaattacttaaaaatagaatggcaatgttaggattggcagctgttgttatagtaatattatttagttttattggacctttatttatgaagtttgatatgaatactcagacagattgtatccaacaaggaccaatgatacaaggacacgttttagggactgataaattaggtagagatattatgactagacttatgtatggaggaagaatttctatattggttggattagttgcagtagcaatagaattatgtataggaacatttgtaggagctatatcaggatattatggtggaaaagttgatgcaatattaatgactctcactgaaatatggatgacaatcccttttttgccagtaataataataatgggaactatactctcttcactaaaggtggaccctaatgttagagtattatttttgattttatcaatggggattctttcgtggggaggtattgctagaattgtaagaggtgaaattttaactttaagggaacaggagtttattcaagcaacagaagcactaggacttagagatagtagaaagataatgaaacatcttattcctaatattatccctatattaatagtaaatgcaacattagatgttggggcttttattgcttttgaagctgcattaagttatcttggcgttggaatttcagaaccaatagcatcgtggggaaatatgcttcaagcagcaaataatcaagcaaatctacagaagagagcatggctttggttaccaccaggtatatgtgtattgataatttcactaggaattaatttattaggtgatggacttagagatgcacttgatcctaaaaagagataggagtagacagtatgagtgaaaagttattacaagtaaaaaatttaaagacatttttcaaagttgaagctggaactgtaaaagctgtcaacgatgtttcttttggtgtaggtgaaggagaaacggtttgtattgtaggagagtctggatgtggtaaatcaataacttcaatgagcattatgggattaatttcaggcaatggaagaattgaaaatggagagataatatataacggacaggatttattaaaattctcaaataatgaaatgtgtaaaataagaggaaaggaaattgctatgatattccaagaacctatgagttcattaaatccagtttttaaaataggatttcagataatggaaccattattaattcatgaaggaattggtaagaaggaagccaaagccaaagcagtaagcttacttaaagaagttggtattccaagagcagatgaaattgctgaatgttatccccatgaattatcaggtggtatgagacaaagagtaatgattgctatggctttagcatgcaatcctaaggttttaattgcagatgaaccaacaacagctttggatgttacaattcaggcacagattcttgagcttatgagaaatctttcgaaaaagcataatacagcaatactcctaattactcatgatttaggagtagtagctgaaatggcagattatgtagttgtaatgtatgcaggaaaagttattgaagaaggaccagttttagaaatatttaaaaatactttgcatgaatatacaattggattattaaaatctaaaccgtcaatagaagaagagaaagatgaattgtatgcaattccgggacaagttccaaatccaataggaattaaagattcttgttattttagtgatagatgtacaaaatgtatggatatatgtagaaaaaaaattccgccattaaggaaaatgggaaataatcataaagttgcatgctggctatttgaaaatgatgaagcagataaggaggaaagtaaataatgagtgatgaagcaataataaaagttgaaaatttaaaacaatactttcctattaagggtggattctttggacaaactactggaaatgtaaaagcagttgataatatttcatttgagataaaaaaaggtgaaacattaggtattgttggagaatcaggatgtggtaaatcaactactggaagaactatattacagcttttaaaaccaacaagcggtaaggtttattttaaaggagaagacattactaatattagtagaaaggaattgagggaacttagaacgaaaatgcagcttatatttcaagatccgtattcatctttaaatgcaagaatgacagttggaagtataataggagaagcacttgttgatcataatttagtttctaaggatgaattaagagaaagagtacttgaagtaatgaatatgtgtggtcttcctgattattatatagacagatttccaaatgagttttctggaggtcagagacaaagaataggtattgcaagagcattagcactgaatccagaatttattgttgcagatgaacccgtatctgcacttgatgtgtctatacaagctcagatcataaatttacttgttaagctcaagaaagaaaagggatttacatatatgtttatttctcatgatctttctgtagtaaagcatatttgtgataaagttggagttatgtatcttggaaatatgatggaacttgctgataagaaagaattatatgaaaaccctatgcatccatatactgaagctttactatcagctataccaattccagatcctacagtaaaaaagaaaaggataatattaaatggagatattccatcaccagctaatcctccagtagggtgtaagtttaatacacgatgtccgtatgctgacgataagtgtagcaaagaggctcctgaatataatgaagtaaaacctaatcattttgtagcatgtcataaagcgggaatagttaggacgtagaaaatttactacataataaatcctgcataagagcaaatttgaatattgagtttaaaaagagttacttatttgtggtttcttttgaactttataattatttaactggaggaattaattatatggaaccatttgggaatatatttaaaaagagatatgaaaatatatcggagatgagtaatgaagaagaaaaagcaaagctcgcaaaattaagaaaagaaaaaataggaataggtgatatattagcattgataattgcaatgtttcaggtattacttccatttttattatttatagtattaggatattttattattataaaatttttgactgttttttggattaaataagatggaataaaagtttaaagtattagtatcttataaaaaaactatacatcatagtcgagaaatcaattttgatgtatagttttttattgttaaattaaagatatatttccataatacttaaaaattctatatttacatcatttcaagcattctttttaaaatcttagttgaattttgaacagcaattggaacgaatttttcataatccatgtgagctccattgtttgcattatcagaaattgatcttataactacaaatggaacagaatttaagtagcaaacttgagctatgcttgcaccttccatttcacatgatatagctccaaattcttgatcaagccattggattttttcaatattagcgacaaattgatcaccagaagcaattcttccagtaaagctattcaaatctgaaagttcttcacaggatttttttgctaaagatattaattcagaatcacatttaaaatcaaatgtatcaagtctaggtatttgtccgattttatctccaaaaacactagtatccatatcatgttgaactaaattttcagcaacaactatatcaccaggatagatatctttcccaattcctcctgcaacaccaacatttattactttatttacgctatattcagaaattaatatttgagtacatacagcagaattaactttaccaattccacaaacaacagctacaacatcttggccgtaaagcttccctttatgaaaagtcatattagctttttcttttttttgttctaatgataaatcttttaataagatttctaattcttctgccatagcagcaataattcctattgtcattgttattcctccgatatttacaaataattttatctttattaaaactaattatgtagtatatattagctgaacaagataataatttagataataggtaaattagactaaaaataaagttaagtatactgtataattagaaaaactattctaaaatcctaattattattataaacattataattagaatttaatagtaaactttttacaaatttttcgaaaatattttaatatagtaaaccgatagattttatatgttaaattgatgtataattatttagaaataaaaattaaatttaaatatggtataattacagaacgattttaatgtctagaaacaagtttataaaattagtaaagtattagactgaattaaaataaatcttaagggttagaagatatttatattaggtagaataaaattaaattgattaaaattaaggagcggatagacaatggcggaacattctttaacaagaacagaactattaataggaaatgatggacttaacaagttaagaaaaagcaaagtaattgtatttggagtaggtggagtaggtggatttgcggtagaagcattagcaagagctggtgttggagaaataactgttgttgataatgatactataagtttaacaaatcttaacaggcagattattgctacatatgatactatagataaagcaaaggttgaagttattaaggaaagaatacaatctataaataaagattgtagagttataactcgtcaagtttttgtatcaaatgataatattgaagaaattgtaccaaaagacattgattatgttgtagatgcaattgatactgtatctgctaaacttgggttggcagaatattgttataaaaacaatataaatataatgagttcaatgggaactggaaataaactagatcctactcaatttaaagtgtcagatgtttttaaaactcaagtatgtccacttgcaaaagttatgagatgtgaacttcgtaaaagaggtgtagaaaaattaaaggttgtatattcggaagaaatgcctttaaagcctaaatctgaatattcctcagaagttaaaggaactgctaaaaggcctgttcctggaagtatgtcatttgtaccgccagtagcaggaatgataattgcaggtgaagttataaaggatattttaggaataaataataaaaagtaagaaagttaataataatccacaatatattgaaaagacttaataagttatccacaacatattgtggattttgtgtataatttaatagtgaagcaagataattgctacaagttatcaaatatgtatttaataataaacttttattatagtataataatacttgaataatagcgatatataggaataaatgatgtagttaattattgtgtaacttggagagaatgatatgaagcctaatttaaaagtaaaaatacaagcggataaatcttgtgaagaagaatatataattaaagataataatgacataatagtaggaagatttaatataactgaacttagcgtttcaaataaacgatgtgatgttaaaatgaatttttatagagaaaataattatgaattactttgtgatacattaagtttagtattaagtgcaatatttaaaaatagtaaggtatttaaagtaaatatacgatcagtagaaaatataaatataaatgcatttcttaatttaggatttactttagagggaatattaagccaaaatgaatattgcaaaggtgaatatttagatgaattattttttggaataacgagaatagaatattcaaaacagaaaaattatcccatgatagaattagaaggaaagaatataattttaagaaatttaaatccaggtgatgcacaggagttagttgaatactataataaaaataagaattatcttgctccatttgaaccaacacgagattcagggttttatacattggaaaatcaaagaagtttattaattgagagttacagacaaatgttaaatggaacaaatgtggacttggggatttttaaagaaaataaatttatagggaaaataaaaatatctaatattgtatgtggatctttaaaaagcggagtattaggatattcaatagatgaagatgaacaaggtaatggatatatgaaagaaagtgttaaattaattttaaattatgcatttttagattgtgatcttcatagagttgaagcatccgcattagtagataatattaaatcgagaaaagttttagaatcaattggatttaaattagtaggcatcaatgaaaaatatcttttagtaaatggtaagtggagagatcacgccacgtattatattattaaggaagatttttataaaggagactaacgtttattaataaagcttatttataaggagtgaaatgatgagcacaatacttagtagagatgagattgtagtaaaggtatttaataataacattgttttagttaattcagaagatatagaaaagattctttttgcagtaggtatcggtttcggaaaaaaaccaggaagcgtaatacctaagggaacttccattaataaagtatttataattgaagagaaagaaaatataaataatttaaaagaacttgtaaaggtaattgattccgagttttttgctgcttgtgaagaggctatttatgaagtttctaatatggttgatgaagaattaaacgagcgtattcatattagtcttatagaccacttgttttttgctataaaaagattaaaaaataatgagaaaattgaaaacccatttttaatagaaacacagacactatattctaaggaatacaatcttgcaaagctagttgcaaagatgattgaaaatcactcaaatgtagaaataccagatggagagattgcattcatagctctacatattcattcagctttaaatgatggaaaaatatcaaatactattaaaaatacaaatttaattagtgaaattgttgaatatgtagaggggaaattagattgcaaaatatataaagattctttagattatgctcgtttctgcactcatgtaaaatttgcaattcaaagaataatgagtaataatacaatagataatgatttaacaaaaattataaaagaaacgtataaagagtcatatataatatctgaaggtataggacgtataattgaaagaaatataggtatttctgttacagatgatgaaatttcatgtttaacgattcatgttgaaagatttaggatgaatcaaaaaaaataaatgtcaaaacatttacattcatgaagaaatgtgttaatatattaacataatgtaattaaaatttaaggtgtaactggtaatgcaggcaagacttattatacaaacaaatactttgtttaaatattctcgtttaaagagaatatttttatgaagttttggaatgttattaatgagtcttttttttgttgtttaaaatttgagttggccaactctatattaataaattaaatcttaaaactcaaattgaggaggaattattatgcttcaatatttacaaagaataggtaaagctattatgttaccaatagcagcattacctatagcgggtatattactaggcgttggtggagcactattaggtatttcaggtttagataacccaccaggaatttatcagccacttattgcttttgttaacattccatttgttacagcaatcttaacagtaatgaaaaatataggtgatattgtatttggaaatttaccgattttatttgcagttggtgttgcagttggattagctaaaaaagataagggtacagcagcgttagcatcagtttttggattcatagtaatgaatcaggttatttctacattactttctttaggagttactcaattaggagttcttacaccagataatgttggtgaatatggaacttatgttacaactaacttaggaatctttacattaaatatgtcagtattcggtggtataataacaggtatcataacagctatattacatgatagattccatgaaattcaattaccacaggtaataggatttttctcaggatcaagatttgttccaatagttacagctataactatggcatttgtaggtgcaatattagcatacttatggccagtagttcaaaatggaattggaatgattgctaacttagttagagacgcaggatttatagggactttcttctatggtttaattgaaagagctttaataccatttggattacatcatgtattctatactccattctggtttggctcatttgttgatggtcaaattttagttaacggggcttggcaatcggttgcaggagcaaatacagcatattttgctcaattatctagtatgactgatttagttggagcttcatcagacacaatggctacagttgtttcaggtactacaagatttatggcaggtaaattcccattcatgatgtttggattaccagctgcagcatttgctatgtatagatgtgcagctccaagtaagagaaaagctgtagggtcattattattagcagcaggtataacttcattattaacaggtataactgaaccattagaatttacatttatattcgttgctccagttttatatggagtacactgtgtattagcaggtatatcattcatgttaatggatatatttaatgtatttataggtatgacattctcaggtggattaattgacttcagcttatttggattacttccagctggagcaggtgtgcctactaagtggtttatggttcttttagttggtgcagtttatgcagtagtttactacttcttattctcatttataataagaaaatttaacttaaaaactccaggtagagatgaaaatgaagaagaaactaagttatatagtaaagcagactatcaaggaagaaatggtcaatcaaatacagatactaaagcatcagcaggtggagctaagggtgaaattgcagaaaaggctccagcagtattagaagctttaggtggaccagaaaatatagtaagcgttgatgcttgtataacaagactaagagtagaagttaaagatagatctaaagtagataaagatagattaaaatcattaggcgcagcaggtgttatggaagttggtaagggtattcaagctatatttggtgccaaggctgatggatataagaatgctattaatgatatattaggaaacaactaatattaaaaaatatgttagtgtatagagtttaaaccgaactgtttttataatatcatatttgaaaaaaacatcttcaatgttgaatcgttgaagatgtttttttgtattaaaaactaaaaaaagatgcctaaatggcatcttttttactataataatgaatttcttatagtgaattgttacatagtatattctaatattgtagtttcaccagcaacagtttctatgttttcaattggtgaaattgattttaagatatctgggtttgttattaatacaggagttattaatggaagtccttttgattttatgaactctctgtcaattttgattattggatcaccagctttaactttagttccttgttctgctaattgttcaaatccttcaccgtttaaagaaacagtttcgatacctatatgaactaataattcaacaccgttatctaaagttattgcaaaagcatgttttgtattaaacactaaagttaattctccatcagcaggagctacgatagtatcagatgcaggatccatagctaatccatcaccagccattttttgagcgaaaacagggtctggagtttctgataaaggtattgatttaccagacataggagcaactaatttaaatgttttagcgctttcttcagcaacaggagctgtttttgctactggagcttcctcaacttttgttgtgttttctgtgttgtttttgaaaaggttctttaaaaatccaaacataatttatatcctgataatcaggataattcacatcctttcattgtttaatttattattattttatatctatatttttggttagtttttataaaatataacacttacctaaaataaataaaaaaagacataagcttccctaagtgttttagaaaacttatgcctgatttaacagtaacacgtctcaactgatttttattatatatttaatgtaaatgactgtcaatagttaagttgtgagtacttgagtactatgtatatacattatatattaactatatttagagattttgagttaagtatatttaaataataaaaattaattatatattacttatagttattaattgattattaactacaataatcaattaataatattgtatagatttagataaaaaatgtatatgtaaaaattaatacaataatttttgaaaattaattagggtttatattataaaattatattgtttgattttaaattagtaatatatatagtagtacttgaatttttaataatataacataataagcttcatctaaagagttatatttgatattgaaactgtattaaataatgctacttaactaatatataatatttataatatagaatattattatgttaattggtgaaaactagaactaatgttaaacaatataggcataaaccataccaagggtgtctatactaggattaatgaggaaattgctagaataatgtagaaaaatattgataaactgaaaaataagtagtaatattacatgcgatgaaaatgcttatggtgttatgatagaacacgtcgctgagagcggcaaacaacaaacttaaaacttgataaaagctgaatttaatgaagcaaaataagttttaaaaaaagttgttgacacaagtcaaaccaagtgatatactaagcaagtcgcttgagggtgacaacataataacaacgtaaagttgtgaaagaaaatggtctttgaaaattgaacagaatataatataaacatttaagtaaaccagcaattctttattttgagtaagctaagattaaactttttattgagagtttgatcctggctcaggacgaacgctggcggcgtgcttaacacatgcaagtcgagcgatgaagctccttcgggagtggattagcggcggacgggtgagtaacacgtgggtaacctgcctcatagaggggaatagcctttcgaaaggaagattaataccgcataagattgtagtaccgcatggtatagcaattaaaggagtaatccgctatgagatggacccgcgtcgcattagctagttggtgaggtaacggctcaccaaggcgacgatgcgtagccgacctgagagggtgatcggccacattgggactgagacacggcccagactcctacgggaggcagcagtggggaatattgcacaatgggggaaaccctgatgcagcaacgccgcgtgagtgatgacggtcttcggattgtaaagctctgtctttagggacgataatgacggtacctaaggaggaagccacggctaactacgtgccagcagccgcggtaatacgtaggtggcaagcgttgtccggatttactgggcgtaaagggagcgtaggtggatatttaagtgggatgtgaaatacccgggcttaacctgggtgctgcattccaaactggatatctagagtgcaggagaggaaaggagaattcctagtgtagcggtgaaatgcgtagagattaggaagaataccagtggcgaaggcgcctttctggactgtaactgacactgaggctcgaaagcgtggggagcaaacaggattagataccctggtagtccacgccgtaaacgatgaatactaggtgtaggggttgtcatgacctctgtgccgccgctaacgcattaagtattccgcctggggagtacggtcgcaagattaaaactcaaaggaattgacgggggcccgcacaagcagcggagcatgtggtttaattcgaagcaacgcgaagaaccttacctagacttgacatctcctgaattactctgtaatggaggaagccacttcggtggcaggaagacaggtggtgcatggttgtcgtcagctcgtgtcgtgagatgttgggttaagtcccgcaacgagcgcaacccttattgttagttgctaccatttagttgagcactctagcgagactgcccgggttaaccgggaggaaggtggggatgacgtcaaatcatcatgccccttatgtctagggctacacacgtgctacaatggtcggtacaatgagatgcaacctcgcgagagtgagcaaaactataaaaccgatctcagttcggattgtaggctgaaactcgcctacatgaagctggagttgctagtaatcgcgaatcagaatgtcgcggtgaatacgttcccgggccttgtacacaccgcccgtcacaccatgagagttggcaatacccaaagttcgtgagctaaccgcaaggaggcagcgacctaaggtagggtcagcgattggggtgaagtcgtaacaaggtagccgtaggagaacctgcggctggatcacctcctttctatggagaaatctagcaaacatggcgtttgactagtacaaagatgcaaagcatctatgaaaattacaacttgctcaaaggttacttaatgagtattgattctgttcaattttgaaagactaggtctttcaatgttctttgaaaattgcacatagattaatgtatataatacaacaaagccaagaataatattctttgtgaatgattaatataaccagttttgtatatcaaaacttaaaaaggtcaagctacaaagggcgcatggtgaatgccttggcatcaggagccgatgaaggacgtgataagctgcgataagcttcgggtaggcgcacatagccagagatccggagatttccgaatggggaaacccgcatgagaaacctcatgcatcgtaaagtgaatacatagctttatgaaggaacacctagggaactgaaacatctaagtacctagaggaagagaaagaaaaatcgattttcttagtagcggcgagcgaaaaggaaagagcccaaaccagagatttatctctggggttgcggacagaacataacgtgaaattatgattaaccgaacacaactggaaagttggaccataggaggtaatagtcctgtaagtaaaagtcataatgatcagttctgcaccagagtaccacgagacacgtgaaaccttgtgggaagcagggaggaccacctcccaaggctaaatactacctgatgaccgatagtgaagcagtaccgtgagggaaaggtgaaaagaaccccgggaggggagtgaaatagaacctgaaaccatgtgcctacaaccgatcaaagcaccttatgtgtgtgatgatgtgctttttgtagaacgagccaacgagttacggtatgtagcgaggttaagtacttaaggtacggagccgaagggaaaccgagtcttaatagggcgactagttgcatgctgtagacccgaaaccgggtgacctatccatggccaggttgaagcgagggtaaaacctcgtggaggaccgaaccacgttgctgttgaaaaagcatgggatgagctgtggatagcggagaaattccaatcgaactcggatatagctggttctcctcgaaatagctttagggctagcgtcgtgaaatgtgagtactggaggtagagcactgaataggctagggggcatagcgcttaccgaaccttatcaaactccgaatgccagatactatcagcacggcagtcagactatgaaagataagttccatggtcaaaagggaaacagcccagatcgtcagctaaggtcccaaagtgtaagttaagtggaaaaggatgtgggatttctaagacaactaggatgttggcttagaagcagccactcattaaaagagtgcgtaatagctcactagtcaagagatcctgcgccgaaaatgtccggggctcaaacttaccaccgaagctacgggttcatactttgtatgagcggtagaggagcgtcgtaatcgggctgaagtcgtaccgtaaggagcggtggactgattacgagtgagaatgttggcattagtagcgagatgtaggtgagaatcctacaggccgaatatctaaggtttcctgagtaaagtttgtcttctcagggttagtcgggacctaaggcgaggccgagaggcgtagtcgatggacaattggttgatattccaataccactataatcgttattatcgatggtgtgacggagaaggataggatgtgccagctattggatgctggtctaagcgttgagggagttagaacaggcaaatccgttctaacaatcctagggcgtgattgggaaggttccacggaaccgaagtatctgatttcatgcttccaagaaaagcatctagaaagagaagtagtgcccgtaccgcaaaccgacacaggtagatgaggagagaatcctaaggccgacggaagaatcacagttaaggaactaggcaaattgaccccgtaacttcgggagaaggggtgcctaccatttggtaggccgcagagaataggcacaagcaactgtttaacaaaaacacaggtctctgctaaagcgtaagctgatgtataggggctgacgcctgcccggtgctggaaggttaaggggaacacttagcgcaagcgaaggtgtgaacttaagccccagtaaacggcggccgtaactataacggtcctaaggtagcgaaattccttgtcaggtaagttctgacccgcacgaatggcgtaatgacttgtgcactgtctcaactgtgaatccggcgaagttgtagtgcgagtgaagatgctcgctacccgcgattggacggaaagaccccgtagagctttactgtagcttagcattgaatttcggtattgtctgtacaggataggtgggagactgggaaattagggcgtcagccttaatggagtcgttgttgggataccaccctgatagtattgaagttctaactggatgccatgaaactggtgacaggacattgttaggtgggcagtttgactggggcggtcgcctcctaaaatgtaacggaggcgcccaaaggttccctcagaacggtcggaaatcgttcgtagagtgtaaaggcataagggagcctgactgcgagacctacaagtcgagcagggacgaaagtcgggcttagtgatccggtggtacctcgtgggagggccatcgctcaacggataaaagctacctcggggataacaggctgatctcccccaagagttcacatcgacggggaggtttggcacctcgatgtcggctcgtcgcatcctggggctgaagtaggtcccaagggttgggctgttcgcccattaaagcggcacgcgagctgggttcagaacgtcgtgagacagttcggtccctatccgtcgcgggcgtaggaaatttgagaggagctgtccttagtacgagaggaccgggatggactgacctatggtgtaccagttgtttcgccagaagcatagctgggtagctaagtcgggaagggataaacgctgaaagcatctaagtgtgaagcccacctcaagatgagatttcccatagcataagctagtaagaccccttgaagactacaaggttgataggtcagaggtgtaagtgcggtaacgtatttagctgactgatactaataggtcgatggcttgaccaatataatcaagttgtaaatacattaattaagaggaaactcgactcacttagttcgctgagtaagttcgattaaccaaatgtaaaatttggattctcacttatgtgcaattttgaaagaacaaaagttttttcaaacaagttaataaggaaactcactcagacgagctgaggagtacagttcttttagctaaatcatagatttagaaagaactagcatctggtggtgatggcatagaggtaacactccttcccattccgaacaggacagttaaggtctatagcgccgatggtactgcatgggagactgtgtggaagagtaggacgtcgccaggtaagaataaggatagttagaaataactatcctttttagcgtttagaaataatatttttaaaaaagaatttgatattatgaagatagtttaattaattattatgaattgaattatcctcataatatctttatatatgttatgataattaattaaaaatgatataagttataaataaacaaatttgttattttaagtagaatttttttgaaaattaaaaatattttaaatttaaaaaaatgttaacgttattaatacatatataatattgaataatttgcaaattagttttaagatataaagagatataatactaaaaaagtaaaaaaaatattttaatgggtaaaattacaaaaataattaatagaaaattataaaaacaagtgaaaaatctcacaaattttggtaaaatatatttataggcaataataagttaaaaataaaataaggaaatgcagaggaaaggttaacgactatgagagggatactaatatggatgggggtaagagttaatgtcagataaacctaatggaagcagtaaaataattgcagaaactacagttgaaacaacagcaaaagtagattcttcagcatcttctactaaggaaaaggcaaaaacaacaactagaaaaaggactactagagctaaatctaaaacagaaaataatgtatctaaaggggatatatcaactgagttaaagactgatgcgaaatctttaagcagaaaagatatcgataatgaaaataaagaaatagatatagatactaaaaaaatagttgaagttgaagaaaaagtaagtgataaacctttagaaaatgaaaaagttgagaaaaagacaagagcaactaaaaaaacaacaacagctaagaaaacaacaacaaaaactagaactactagaaagactactaaagcttcaaaaacatctagttcaacaaaggctgatacggataaagcggaaaataaagaagtaaaagcagctagtactaaaaagacagaagatgttaaaggaagtgttcaagtagatattgaagagacaaaaatagtagaaagtaaaaatgataaattaacagccatgagtaaagaaaatttacctagtgcaaaagaaataattacagaaaaagataaagaaaatattgatgatactgaaataacaagctttaatgagtatttgttccatcagggaaagaattatagtgcatataatattttgggttctcatgttgtaattagaaataatgtaaaaggagttcagtttgctacatgggcaccaagagcaagtgaggtttatgttgttggtgattttaatgactttaatgttaatgatgcttataaacttgaaaaaattagtgagaacggaatatggtctggattcttcactcaacctaaggaaggagacaagtataaatattgtgtagttgattccaagggaaatagtggagaatataaatctgatccatatgctatttttagtgaattaagaccaaataatgcatctataatatatgcacctaaagattttacttggaatgataaaaagtggatagaaaatagaaataaaataaatgtattagagcagccattaaatatttatgaaattcatttgggttcatggagaaggaatcaagatggtgattttttatcttatgaagaaataagtgaaattttacctgcgtatttaaaggatatgggatattcacatgttgaaataatgcctcttgttgaacatcctttagatgcatcatggggatatcaaggaacaggatactattctccaacaagtagatatggaaatccagaaggacttaaattattaatcaataagttacatgaacaaaatataggagttattatggattgggttccaggtcatttctgtaaagatgcacatggattatataaatttgatggtacagctacttatgaatatcaagaagaatggagagctgaaaataaaggatggggaacatgtaactttgatttaggaagagcagaagtacaaagttacttaatatcaaatgctttatattggtttagggaattccatgttgatgggttaagagtggatgcggtatcaagcattttatacttagattatagtagagagccaggagagtggaaacctaataaatatggtggaaatggaaatttagaagctatagactttttgaaacaattgaatcaagcagtttttgcagagtatccaactgcattaatgatagcagaagaatcaacagcgtggccgaatataacaaaaccaccaatggaagatggattaggatttaatctaaagtggaatatgggatggatgaacgacacattagaatatgtaaaaatagatccttcgtatagaaagaataatcatagaaacatcacttttgcaatgatgtataattatgcggaaaattatgtattaccattatctcatgatgaagtagttcatggtaagaaatctttaattgaaaagatgtggggcgatgaatggaataaatttgcaggattaagagcctttatgggatatatgatgggacatcctggaaagaaacttacatttatgggatgtgaatttgctcagggtatagaatggagagaatacgaacaacttgaatggaatctaatagaagctttagagataaatgaaaaaactcagttattttttaaagatttaaataagttatatcttgataataaagcattttgggaattggaccatgatcatcgaggatttaattggatagaagctgataatagtgaccaaagcatacttgtatttacaaggagaagtagaaaagatgatgaaacattaatctttatagtaaactttacttcaattgtttattatgattatcaaattggagtaccatttttaggtgaatacgaggaattatttaatacagatgattctaaatatggtggttcaggacaaattatggacacaccattatttgctgaaagggctcctttccaaaatcaaccatattctgtaaagattaaagtaccaccaatggcaactttagtgttaaaagttaaagatatatttaaaaatgaagaaaataatgaaacagaaaaagatgaaaaagaaattaattaaaataaaagacatgtaaggttatggattattgatgataatttattgtcaccaataatctgtaattattaatgtatattaggctagggggataagaaatgagagttttatttgtagcatctgaggcaagtccttttattaaaagcggtggtcttggagatgttgcaggggcattacctaaagcacttgctcaaaaaaatgtagatgttagagttgttatacctaaatataaagaattaaattgggaagtaaaagataaactaagatttgtaaaatggtttaatgttcgtgttggatggagagatgaattctgcggagtatgggaatgtttctataatggtgttacctattatgttcttgataatgaaagatattttaatcgtgatgggttatatggattttacgatgatgcagaaagatttgctttttttgacagagcagttttagatatgttaaggcaagtagattggcaacctgatttaattcattgtaatgattggcagacaggtatgcttccagtattattaaagtttcaatataaaaaatatgataatttttactggaatatgaaatgtgtatattcaattcacaacatagcattccaaggagtgttcgatcctaatatactaccagaattatttggatttgatcttgaattatatgataatacatgtttgaaatttgatgagggtgtcagctttatgaagggcggactctattactctgatattattacaactgtaagtaatagttatgcaggtgaaattcaaactccagaatatggacatagattagatggagtattaagggatagatcatatgttctaagaggtattgtaaatggtatagattatgatgaatttaatcctaagactgataggagaataattaggaattatgatgtgaatacatttacaagtaaagctataaataaaattgcgcttcaaaaagaactaggattaaaggtagatgagagtattccaatgatagcaatggtaacaagactaacaagtcaaaagggaattgatttattagttaatatttcagacaaattgcttcaagagaatgttcagcttgtaattttaggtactggagacaaacattatgaagatcattttaaatggttagattatgcttatggagataaggtatctgcaaatattaggtttgataatactttagctaataagatatatgcttcaagtgatatgttcttaatgccatcggcatttgaaccatgtggattagggcaattgatagcattaaggtatggatcaattcctatagtaagagaaacaggaggactaaaagatacagtaaacccatataatgaatatattggttcaggaaatggatttggatttaaaaactataattcagaagaattgttaaatataattaaatatgccttatggatatataaggacaaaaagaaatggaataaccttgttataaatgcaatgaattctgataatagttggggaagatcagcacagatatatcttgatatgtacagagaattaacaggacaatattagtaaatacttgatatataagatgtaattagtattttaataaaaaaatgaattaacaaatgataatatagtcatattcgcattaactgcagatgaaagaattaactactataaaaatttttgatatatttcatagatgtttataatagttatacaaagataagaagagtaatggacgatttaataaatggtaaatatcataattatagaaataaatttagaaacatttatgaaaatctactaacttataatgatgagtttttttattgaataattttaattcatatttaaaagctcaaaataagattgatactctttatagaaagactgataaatggtagaaaatgtgttagataaatattgcacattcaaaaatgttctcatctgacagaataactgaacaatatgcagcagggacttggagatcagaagtaatttataagaatctataggaggtaaatcaatggacaggataaaggtaatgcatgactcgcaaagcatagtatatagaagaccttttggtgctgtagaggaaggacagaaggttaagttatcaattgatatagagaaagagatagtagtagctattgaactattacaatttgatggtacaaaagtaaatatgggaatggaaaaggaataccttaatagtggaaattatcgatattctatagagattgatacagaagatgctttgggagtcttggggtattattttattttaatagatgggtatgacagagtatactacggaaataatgatgaacatctaggtggtattggtcagatatatacctataatcctgtaccatatcaaataactatatataagaaatctaatttaccagaatggtataaagagggaattatatatcaaatatttgtagatagattctgtaatggaaatgatgatggtagtataaataatcccaaaaaaaattcttttatatatggaagatgggatgatactccagtatatataaaagattatcaaggaaggactataagatgggacttctatggaggcaatattagagggataataaaaaaattagattatataaagtctttgggcgtaaatataattaatttaagtccaatatttaaatcttcaagctgtcataaatatgatgcaggagattatgacataattgatgagatgtttggtacagaggaagattttaaagaattatgtgaaaaagctaaaagtaaagatattaaaataattttagatggagtatttagttatacaagttcagatagcagatatttcaataaagccggaaactatgatgaaataggagcatatcaatctccaaattcaaaatatcataattggtataaatttaatagatatccatatggatatgaatgttggtgggggattgaaggaaggcctaatattaatgtaatgcataatagttatattgactttttagtaaatagggatgattcaataataaaaaaatggattgatcttggagcaagtggatggcgtttgaatgttacagatgagcttccagatgaatttatagaaataataagagataggctagataccttggataaggaaactgttttaataggggatgtatgggatgatgcatctaataagataagttattctaaaaaaagaagatatctatatggcaaagagatacaatctgtaactaattatccattaagggagagtttaattaactttactagaggatatataaaatcagataagttaaaaaagaaagtaatgtctttatatgaaaattatcctagagaagtatttttaggaaatattaatcttattggaacatccgatacagaaagaatacttactgtattagatggaaatatacgatgcttaaaaataatagtagcattacaatttactattcctggggtacctttgatatattatggtgatgaaacaggggttacaggaggaaaagatccagataacagaaagagttatccttgggaaaatgaagatgttgatttaattgggttttataaaaggatagcacaaattagaaatggtcaagatgctttgaaaaaaggggattttaatattttcgatacagaagaggatatttttgcatttgaaagagtatatgaaaatgaaagaattgtagttgttgttaatgtttcaaatgcacaaaaagtagtaaggggtattactttagaaggaacttatttagatttatttaatgaaggtgaaaaatataaatttgttggatatgaaagtgttttaataatgtatccatgtagctttaaaatattaagaaaaataaataagtagtaaatttaataattaatatatagcaaaaattgatatgcttaacaaatagcaaattaacataaaaacattatgttaagcatattatttaaataaatgtgtaaagcacaaaaatccattttatgagaataaaacgtatgagaggagaaaaaattatgggtaaaaatgaaattgtagcaatgatattagctggtggacaagggtctagattaggggtgttaactaaaaagttagcaaaaccagcagtaccatttggaggaaaatatagaataatagattttccattaagtaactgtgctaattctggaatatatacggtaggggtattaacacagtataaaccacttgaattaaatgcacacattggtataggtgaagcatgggatttagatagaacacaaggaggcgtaagtattttacctccatatcaagaagaaaagggtggagaatggtataagggaactgccaatgcaatatatcagaatatagaatttgtggaccgatatgatccagaatatatattggtattatccggagatcacatatataagatggattatacaaaaatgcttgattttcataaagaaaagggggcagatgcaactattgcagtaatagaggttcctatggaagaagcatcacgttttggaattatgaatactagagatgatttatcagtatatgaatttgaagaaaagccaaaagcaccaaaaaataacttagcatcaatgggaatatatatatttaattggaagacattaaagaaatatttaagagaagatgaagcagataaaacatcaaaaaatgattttggaatgaatataattcctaagatgcttaatgacggaaataaattggtagcttatccatttaagggatactggaaagatgttgggactatagatagtctttgggaagcaaatatggatttaataagagaagataatgaattagatttgcatgatgaagattggaagatttattcagtaaatcctgtaagaccagcacaatatattggtgaaaatgctaaagttaataattcgcttgtagttgagggatgtgttgttaatgggcaaattgaaaactcaatattattccaaggtgtgcatataggtaaaaatacagttataagggattctataattatgactgatgcaaaaataggtgataatgttgttattgaaaaagcaatagtaggtagtggagcagttgtaagaaaagactgtaagatttctttaggcgaagaaatagcgataatagcagctaaagaagaagtaaaaatgggtacagttatagaagaaagcaataaagcagtttaatggtatgctaagggggagaaagaaatgaaaaattgtattggtataattaacttagatgaaaatgaaaatagaatgggtgaactagttgtaaatagatctcttgcttcagtacctatagcagcaagatatagagtaattgatttcgtattatctaatatgacaaactcaggaataaattgtatcggaatattcacaaagaataaatcaagatcgttaattgatcatattactaatggacgaccatgggatttaaatagaaaaacagatggattaagagtatttaattttggaaatgatgatcctgtatatgatgatgttcataattttgcagataatattcaatttttaaatagaagcagaaaagaatatgtattattagctccaagttatatgatatgcaatatagattataaagaagtgttagaatatcataaaagtactggaaaagatataacaattgtgtataagaaagttaataacgcagacgaatcttttggtgactgcggtgttttaaatattgatgattcaggaagtgttattagtgtaggagagaatattggaaagaatcctaaggctaatatcaatatggaaatgtatgtattaaaaagagaattgttcttaaatatagtaaatgaatgtataagcagcggtatgtatagaaaggttaaagaatatattcataataatttaaataatctttcagctggtgcatatgaatttaaaggacatttagactgtataaattcaataaaagctttatatgatagtaatgtagctcttttaaataaaaaagttaataaggaaatatttaatgaagagagaccaatttatacaaagactaaagatgaaggcccaacattctattcggacaatagtaatgttgtaaattctattattgctaatggatgtaggatagaaggtacagttgaaaattgtgttattggaagaagagtttatgttggaaaaaatgcaaaaataaaggattgcataataatgcaaaatagcagaatcgaagatgaggtagttttagataatgttatagcagataagggtagtgaaataagaaaaggtgagactcttataggatctactatgtatcctttagttattaaaaagaagaattggttatagaattcatgaaattagagcattaatatagtatatatgtgaagaattttaaagttatatagaatatgtagttaatataaagtgtgtccagaatttattctggcacactcttttaatttataggaaattataatgataatatgattatttaatatagtgaattcaacagacttagagaatttatagttaagtatgaaatttataaagtagatttctaaaaataaaaaaatcaataaaaattgagccttttcactgaaactgtcaactttacactatcaattatcaaatgaaagagtgggatagctacttttgtgaaacataaaaaattagagctaaacagataaatataaatttgggtttatagattaaaatagaggttttaaatactaatataaataagaggattatggtataaaatatgattggtaagcatttaagttatctaatactaaataatattttttataactataaaaaagtgttgacagtatatttataaagtgatagtataaatgatgtcgtcaggacatgaaacaacaaaacaaaacaatgttttgaaaaagttgttgacatgaaatgcttcgagtgatatactaagtaagtcgcttgagggtgacaacataataacaacgtaaagttgtgaaagaaaatggtctttgaaaattgaacagaatataatataaacatttaagtaaaccagcaattctttattttgagtaagctaagattaaactttttattgagagtttgatcctggctcaggacgaacgctggcggcgtgcttaacacatgcaagtcgagcgatgaagctccttcgggagtggattagcggcggacgggtgagtaacacgtgggtaacctgcctcatagaggggaatagcctttcgaaaggaagattaataccgcataagattgtagtaccgcatggtacagcaattaaaggagtaatccgctatgagatggacccgcgtcgcattagctagttggtgaggtaacggctcaccaaggcgacgatgcgtagccgacctgagagggtgatcggccacattgggactgagacacggcccagactcctacgggaggcagcagtggggaatattgcacaatgggggaaaccctgatgcagcaacgccgcgtgagtgatgacggtcttcggattgtaaagctctgtctttagggacgataatgacggtacctaaggaggaagccacggctaactacgtgccagcagccgcggtaatacgtaggtggcaagcgttgtccggatttactgggcgtaaagggagcgtaggtggatatttaagtgggatgtgaaatacccgggcttaacctgggtgctgcattccaaactggatatctagagtgcaggagaggaaaggagaattcctagtgtagcggtgaaatgcgtagagattaggaagaataccagtggcgaaggcgcctttctggactgtaactgacactgaggctcgaaagcgtggggagcaaacaggattagataccctggtagtccacgccgtaaacgatgaatactaggtgtaggggttgtcatgacctctgtgccgccgctaacgcattaagtattccgcctggggagtacggtcgcaagattaaaactcaaaggaattgacgggggcccgcacaagcagcggagcatgtggtttaattcgaagcaacgcgaagaaccttacctagacttgacatctcctgaattactctgtaatggaggaagccacttcggtggcaggaagacaggtggtgcatggttgtcgtcagctcgtgtcgtgagatgttgggttaagtcccgcaacgagcgcaacccttattgttagttgctaccatttagttgagcactctagcgagactgcccgggttaaccgggaggaaggtggggatgacgtcaaatcatcatgccccttatgtctagggctacacacgtgctacaatggtcggtacaatgagatgcaacctcgcgagagtgagcaaaactataaaaccgatctcagttcggattgtaggctgaaactcgcctacatgaagctggagttgctagtaatcgcgaatcagaatgtcgcggtgaatacgttcccgggccttgtacacaccgcccgtcacaccatgagagttggaaatacccaaagttcgtgagctaaccgcaaggaggcagcgacctaaggtagggtcagcgattggggtgaagtcgtaacaaggtagccgtaggagaacctgcggctggatcacctcctttctatggagaaatctagcaaacatggcgtttgactagtacaaagatgcaaagcatctataaaaattacaacttgctcaaaggttacttaatgagtattgattctgttcaattttgaaagactaggtctttcaatgttctttgaaaattgcacatagattaatgtatataatacaacaaagccaagaataaatattctttgtgaatgattaatataaccagttttgtatatcaaaacttaaaaaggtcaagctacaaagggcgcatggtgaatgccttggcatcaggagccgatgaaggacgtgataagctgcgataagcttcgggtaggcgcacatagccagagatccggagatttccgaatggggaaacccgcatgagaaacctcatgcatcgtaaagtgaatacatagctttatgaaggaacacctagggaactgaaacatctaagtacctagaggaagagaaagaaaaatcgattttcttagtagcggcgagcgaaaaggaaagagcccaaaccagagatttatctctggggttgcggacagaacataacgtgaaattatgattaaccgaacacaactggaaagttggaccgtaggaggtaatagtcctgtaagtaaaagtcataatgatcagttctgcaccagagtaccacgagacacgtgaaaccttgtgggaagcagggaggaccacctcccaaggctaaatactacctgatgaccgatagtgaagcagtaccgtgagggaaaggtgaaaagaaccccgggaggggagtgaaatagaacctgaaaccatgtgcctacaaccgatcaaagcaccttatgtgtgtgatgatgtgctttttgtagaacgagccaacgagttacggtatgtagcgaggttaagtacttaaggtacggagccgaagggaaaccgagtcttaatagggcgactagttgcatgctgtagacccgaaaccgggtgacctatccatggccaggttgaagcgagggtaaaacctcgtggaggaccgaaccacgttgctgttgaaaaagcatgggatgagctgtggatagcggagaaattccaatcgaactcggatatagctggttctcctcgaaatagctttagggctagcgtcgtgaaatgtgagtactggaggtagagcactgaataggctagggggcatagcgcttaccgaaccttatcaaactccgaatgccagatactatcagcacggcagtcagactatgaaagataagttccatggtcaaaagggaaacagcccagatcgtcagctaaggtcccaaagtgtaagttaagtggaaaaggatgtgggatttctaagacaactaggatgttggcttagaagcagccactcattaaaagagtgcgtaatagctcactagtcaagagatcctgcgccgaaaatgtccggggctcaaacttaccaccgaagctacgggttcatactttgtatgagcggtagaggagcgtcgtaatcgggctgaagtcgtaccgtaaggagcggtggactgattacgagtgagaatgttggcattagtagcgagatgtaggtgagaatcctacaggccgaatatctaaggtttcctgagtaaagtttgtcttctcagggttagtcgggacctaaggcgaggccgagaggcgtagtcgatggacaattggttgatattccaataccactataatcgttattatcgatggtgtgacggagaaggataggatgtgccagctattggatgctggtctaagcgttgagggagttagaacaggcaaatccgttctaacaatcctagggcgtgatggggaaggttctacggaaccgaagtatctgatttcatgcttccaagaaaagcatctagaaagagaagtagtgcccgtaccgcaaaccgacacaggtagatgaggagagaatcctaaggccgacggaagaatcacagttaaggaactaggcaaattgaccccgtaacttcgggagaaggggtgcctaccatttggtaggccgcagagaataggcacaagcaactgtttaacaaaaacacaggtctctgctaaagcgtaagctgatgtataggggctgacgcctgcccggtgctggaaggttaaggggaacacttagcgcaagcgaaggtgtgaacttaagccccagtaaacggcggccgtaactataacggtcctaaggtagcgaaattccttgtcaggtaagttctgacccgcacgaatggcgtaatgacttgtgcactgtctcaactgtgaatccggcgaagttgtagtgcgagtgaagatgctcgctacccgcgattggacggaaagaccccgtagagctttactgtagcttagcattgaatttcggtattgtctgtacaggataggtgggagactgggaaattagggcgtcagccttaatggagtcgttgttgggataccaccctgatagtattgaagttctaactggatgccatgaaactggtgacaggacattgttaggtgggcagtttgactggggcggtcgcctcctaaaatgtaacggaggcgcccaaaggttccctcagaacggtcggaaatcgttcgtagagtgtaaaggcataagggagcctgactgcgagacctacaagtcgagcagggacgaaagtcgggcttagtgatccggtggtacctcgtgggagggccatcgctcaacggataaaagctacctcggggataacaggctgatctcccccaagagttcacatcgacggggaggtttggcacctcgatgtcggctcgtcgcatcctggggctgaagtaggtcccaagggttgggctgttcgcccattaaagcggcacgcgagctgggttcagaacgtcgtgagacagttcggtccctatccgtcgcgggcgtaggaaatttgagaggagctgtccttagtacgagaggaccgggatggactgacctatggtgtaccagttgtttcgccagaagcatagctgggtagctaagtcgggaagggataaacgctgaaagcatctaagtgtgaagcccacctcaagatgagatttcccatagcataagctagtaagaccccttgaagactacaaggttgataggtcagaggtgtaagtgcggtaacgtatttagctgactgatactaataggtcgagggcttgaccaatataatcaagttgtaaatacattaaaaactatgtgcaattttgaaagaacaaaaaagttttttcaaaaagttaataatgaatacaaatcgctaaaacgatttgcataagttcgctaaccaaatataagatttggaagctcacttaatctggtgatgatggcatagaggtaacactcctttccattccgaacaggacagttaaggtctatagcgccgatggtactgcatgggagactgtgtggaagagtaggacgtcgccaggtgaaatatgcgggattagctcagttggtagagcacctgactcttaatcagggtgtccagggttcgaacccctgatctcgcaccaaaaactgttgtaaatattcaacagtttttttgttgtctaattttatatgaatttaaaaagaaagacttataatgtgaaaattattattcagtataaatatatagtattaaattggacaagataataaagagtgaaaaacagaatttaaagattttttctaaagttatctacagttgaaagataaatatccacagaaatgaatgaataattcataaaaagtgtggattattttatttttttgtgtataaagtcaatatatgagtaaggtaattctataaaataaaataatttaaaatatttattaaaaaaatatgaaaaatgtgttgacagtatacataatagtctgtataataatatcttgttgaggcaattgttcgacaaaagatttagaacaatatgtatcatattgtggttcactagctcagtcggtagagcacatgacttttaatcatggtgtcccgggttcgattcccgggtgagccaccaaattaaattgtagtgaaaacttgcttagtatttatatataagagtattttactttattgtaaaagctctttttttgtttatcataaaataaaaagttagagttgatattaaatcatgctctaactttattttaattaagtttatatgagaaaatggttttgtcgtcaattaagatttagaatttaaaagaaaattacatgatctatctagaattccgttcaattctgctaatgctactccaaagttagttataggtatattttgttcttttacatgctctaatcgcgaaagaagctgtcttcttgtaaacatacatgcaccacaatgaattattaatttatattctgatagattatcaggaaaatcaactccagtaatattaactatattcaattttccaccaacttttttttctaataatagaggaagtttttcgcgtgcaatgtcacctttaagagcatgatgtgtacatgattcagcgattaaaattttatcattaggtttcaatgaatttataactttagcaccgtttataaacagatctaaatcacctttgtatcttgccattaatattgagaatgaagtaagctttaaatgttcaggaattaattcatttacttttctaaacatttgagaatctgttattataagagatggttcatcttttaatgagtcaagaatatctaaaagctcagtatcttttactgttagagctagtgcatcattgtccagtatatctcttattatttgaacttgaggaagtattaatcttccttttggagcttgaatatcttgaggtgctactagtactactttgtctttagggtttactatatcacctaaaattgtaggcatctcaaaatcaattggtgcattatcaataagtaatttttttaaacctgaaatattaatcttttctttagcacttatttctacaaatggaatattgaaattagattttattaatttacagttatcattacataaatctattttatttataacacctatcgtaggtattttctttttttctaaatctgcataccaagttaattcattttttaaatcgttactgcatgcatcaaagacaagtacgcctaaatcagttttttcaataacttttagagttttttcaattcttagttctccaagaagtccattatcatcaagtccagcagtatctattagtacaataggacctaatggaagaagttccattgatttagaaacagggtcggttgtagtgccagggatttctgaaacaacagaaagtgattgatttgttaaggcatttatcaaacttgattttccagcatttctttttccgaaaattgaaatatgaagtctatttgattttggtgtattatacatattaattctccttatttagtatttaagtagatatgcaattaggtatatgatagtttatttgtgataatataattaaaacaaaggaatatttcttagagaaataaataaagaccttctgtgcaggacagaagatctttattatcatgaaaaatacttttactaaagcactttttttagatttaattatatcctctttttgcttagaaattaatctttacaatcagattttaatgttttaatttataatactgatacaataagtaatcatatagtataattgcaatttatatacattattataaattttaacatattatataagcttaaatctatatatatagtaaaataagtagttgatatataaatacttttaagatttaaaagtatttactatatcattcttaataaaaataagaaatttctttatattattaatatcatcttttaatgaggtgtcttcttcagaagaaagataaccattattaaaaagagtaagtataaaaaatagtataccaagatttatatatatatcttttatatctgctatgaataaattgcttattcctataaagtctaaacttccaccatagaaaactttatctattaatgagcataaggctccacataaaacaaaaataaaacacatatctgaccaaaaatctttattacccttaaagtgatagtatctatatacctctataaataaaattaatgctaatacattaactattattaataaaggaaaacttactgatgtgccaaaacgtgcatttaaccaagaaccatctgtgtttattataggactgaaataaagaacaccaggaattagcgtttttcgaacattaaaataaaagaactttatgactattttaaatccttgatcaataaaaagaaaacttaaaaataatattagcaaattattaaaatcaaatccattattatgtttcaagcttatactgtatataatgtatcctactagggcaaaaagaagtataagaaagatattaaaaataatagtttttaaatcggtgattcttcctgtgagtaattcaaatattatatagattaaccacattgcaggaagaacacttattgttaatgcttttttagtattcatagttcacctccaaataattcatactaccttaaagtgtaacatatggtaaataaaaattcactactattaaaactataaaaaaaagagtaatataaaaatataattaaatatgtaaaatggttactaaaagggaataaataaaaatatttagctagaatattttagaaagagggtatggttttatgttaacgtttttagccgtttctgattctataggtgaaacagcaaatcaagttgcaatagcagcatcaagtcagtttaatgaaaaagttgaagtgaaaagaattccgtatattaagtctttagaagatgtggaagatgttatgaaatgtgcagaacaatgtgataatgttattataatatctacaataataacagttaatgtgcgtgaatacttaacacaaaaagctatggagagaaatatctctgttatgaatgttctaggtccaataataaatgttgcagcaaatatgttaaatatgcagccaacatataatcctggagcaatgagaaaaacagatgaagaatattttaagagaatagaagctatggaatttgccatgcaatatgatgatagtaaagattatagaggattaaaaaatgcagatgttgtattaattggtttatctagaacatctaaaactcctttatgtatgtatcttgctaataagggagtaagagcaataaatttgcctctaatgcctgaagttggagttccagatgaactatacgaagttgatagaaaaaaagtatttgggttaacaataaacccacttagattaatagaaataagaaaaagaagattagataagttccatagaataacttctgatattgagtatgcaggtgatgcaagagtattagaagaacttgagtatgctgataaaataatgagaaaagtaggatgtaaaattattgatgtgacagaaagggctattgaagatacagcactgattatacttgaaaagataggatataataaaaaataaaatactaaagtcgcattggcaaattctaacaattatattagaactgataattcaatgcgatttttttatgacttatattataattgtgtaggtaaataaaagaaaaagtataataaaaaacaacttcatttttagttataagcattatttaaacatatgtctatagagttataggagaattagaacaataactatacctagcgtatcaatagtagaaaaaatgagtattttgcattaatattgattattttgaatataatttaaatatatagaataattttgtaaaaatgattacttaattcaatgttaagataaaacacgtcgctgaggtgacaaacaactggaattaaagatgattaaatactttaaagaaaagatttgaaagttttgaaaaaagttgttgacaaaaatcaaattcaagtgatatactaagtaagtcgcttgagggtgacaacataataacaacgtaaagttgtgaaagaaaatggtctttgaaaattgaacagaatataatataaacatttaagtaaaccagcaattctttattttgagtaagctaagattaaactttttattgagagtttgatcctggctcaggacgaacgctggcggcgtgcttaacacatgcaagtcgagcgatgaagctccttcgggagtggattagcggcggacgggtgagtaacacgtgggtaacctgcctcatagaggggaatagcctttcgaaaggaagattaataccgcataagattgtagtaccgcatggtacagcaattaaaggagtaatccgctatgagatggacccgcgtcgcattagctagttggtgaggtaacggctcaccaaggcgacgatgcgtagccgacctgagagggtgatcggccacattgggactgagacacggcccagactcctacgggaggcagcagtggggaatattgcacaatgggggaaaccctgatgcagcaacgccgcgtgagtgatgacggtcttcggattgtaaagctctgtctttagggacgataatgacggtacctaaggaggaagccacggctaactacgtgccagcagccgcggtaatacgtaggtggcaagcgttgtccggatttactgggcgtaaagggagcgtaggtggatatttaagtgggatgtgaaatacccgggcttaacctgggtgctgcattccaaactggatatctagagtgcaggagaggaaaggagaattcctagtgtagcggtgaaatgcgtagagattaggaagaataccagtggcgaaggcgcctttctggactgtaactgacactgaggctcgaaagcgtggggagcaaacaggattagataccctggtagtccacgccgtaaacgatgaatactaggtgtaggggttgtcatgacctctgtgccgccgctaacgcattaagtattccgcctggggagtacggtcgcaagattaaaactcaaaggaattgacgggggcccgcacaagcagcggagcatgtggtttaattcgaagcaacgcgaagaaccttacctagacttgacatctcctgaattactctgtaatggaggaagccacttcggtggcaggaagacaggtggtgcatggttgtcgtcagctcgtgtcgtgagatgttgggttaagtcccgcaacgagcgcaacccttattgttagttgctaccatttagttgagcactctagcgagactgcccgggttaaccgggaggaaggtggggatgacgtcaaatcatcatgccccttatgtctagggctacacacgtgctacaatggtcggtacaatgagatgcaacctcgcgagagtgagcaaaactataaaaccgatctcagttcggattgtaggctgaaactcgcctacatgaagctggagttgctagtaatcgcgaatcagaatgtcgcggtgaatacgttcccgggccttgtacacaccgcccgtcacaccatgagagttggcaatacccaaagttcgtgagctaaccgcaaggaggcagcgacctaaggtagggtcagcgattggggtgaagtcgtaacaaggtagccgtaggagaacctgcggctggatcacctcctttctatggagaaatctagcaaacatggcgtttgactagtacaaagatgcaaagcatctataaaaattacaacttgctcaaaggttacttaatgagtattgattctgttcaattttgaaagactaagtctttcaatgttctttgaaaattgcacatagattaatgtatataatacaacaaagccaagaataaatattctttgtgaatgattaatataaccagttttgtatatcaaaacttaaaaaggtcaagctacaaagggcgcatggtgaatgccttggcatcaggagccgatgaaggacgtgataagctgcgataagcttcgggtaggcgcacatagccagagatccggagatttccgaatggggaaacccgcatgagaaacctcatgcatcgtaaagtgaatacatagctttatgaaggaacacctagggaactgaaacatctaagtacctagaggaagagaaagaaaaatcgattttcttagtagcggcgagcgaaaaggaaagagcccaaaccagagatttatctctggggttgcggacagaacataacgtgaaattatgattaaccgaacacaactggaaagttggaccgtaggaggtaatagtcctgtaagtaaaagtcataatgatcagttctgcaccagagtaccacgagacacgtgaaaccttgtgggaagcagggaggaccacctcccaaggctaaatactacctgatgaccgatagtgaagcagtaccgtgagggaaaggtgaaaagaaccccgggaggggagtgaaatagaacctgaaaccatgtgcctacaaccgatcaaagcaccttatgtgtgtgatgatgtgctttttgtagaacgagccaacgagttacggtatgtagcgaggttaagtacttaaggtacggagccgaagggaaaccgagtcttaatagggcgactagttgcatgctgtagacccgaaaccgggtgacctatccatggccaggttgaagcgagggtaaaacctcgtggaggaccgaaccacgttgctgttgaaaaagcatgggatgagctgtggatagcggagaaattccaatcgaactcggatatagctggttctcctcgaaatagctttagggctagcgtcgtgaaatgtgagtactggaggtagagcactgaataggctagggggcatagcgcttaccgaaccttatcaaactccgaatgccagatactatcagcacggcagtcagactatgaaagataagttccatggtcaaaagggaaacagcccagatcgtcagctaaggtcccaaagtgtaagttaagtggaaaaggatgtgggatttctaagacaactaggatgttggcttagaagcagccactcattaaaagagtgcgtaatagctcactagtcaagagatcctgcgccgaaaatgtccggggctcaaacttaccaccgaagctacgggttcatactttgtatgagcggtagaggagcgtcgtaatcgggctgaagtcgtaccgtaaggagcggtggactgattacgagtgagaatgttggcattagtagcgagatgtaggtgagaatcctacaggccgaatatctaaggtttcctgagtaaagtttgtcttctcagggttagtcgggacctaaggcgaggccgagaggcgtagtcgatggacaattggttgatattccaataccactataatcgttattatcgatggtgtgacggagaaggataggatgtgccagctattggatgctggtctaagcgttgagggagttagaacaggcaaatccgttctaacaatcccagggcgtgatggggaaggttccacggaaccgaagtatctgatttcatgcttccaagaaaagcatctagaaagagaagtagtgcccgtaccgcaaaccgacacaggtagatgaggagagaatcctaaggccgacggaagaatcacagttaaggaactaggcaaattgaccccgtaacttcgggagaaggggtgcctaccatttggtaggccgcagagaataggcacaagcaactgtttaacaaaaacacaggtctctgctaaagcgtaagctgatgtataggggctgacgcctgcccggtgctggaaggttaaggggaacacttagcgcaagcgaaggtgtgaacttaagccccagtaaacggcggccgtaactataacggtcctaaggtagcgaaattccttgtcaggtaagttctgacccgcacgaatggcgtaatgacttgtgcactgtctcaactgtgaatccggcgaagttgtagtgcgagtgaagatgctcgctacccgcgattggacggaaagaccccgtagagctttactgtagcttagcattgaatttcggtattgtctgtacaggataggtgggagactgggaaattagggcgtcagccttaatggagtcgttgttgggataccaccctgatagtattgaagttctaactggatgccatgaaactggtgacaggacattgttaggtgggcagtttgactggggcggtcgcctcctaaaatgtaacggaggcgcccaaaggttccctcagaacggtcggaaatcgttcgtagagtgtaaaggcataagggagcctgactgcgagacctacaagtcgagcagggacgaaagtcgggcttagtgatccggtggtacctcgtgggagggccatcgctcaacggataaaagctacctcggggataacaggctgatctcccccaagagttcacatcgacggggaggtttggcacctcgatgtcggctcgtcgcatcctggggctgaagtaggtcccaagggttgggctgttcgcccattaaagcggcacgcgagctgggttcagaacgtcgtgagacagttcggtccctatccgtcgcgggcgtaggaaatttgagaggagctgtccttagtacgagaggaccgggatggactgacctatggtgtaccagttgtttcgccagaagcatagctgggtagctaagtcgggaagggataaacgctgaaagcatctaagtgtgaagcccacctcaagatgagatttcccatagcataagctagtaagaccccttgaagactacaaggttgataggtcagaggtgtaagtgcggtaacgtatttagctgactgatactaataggtcgagggcttgaccaatataatcgagttgtaaatacattaattaagaggaaactcgactcacttagttcgctgagtaagttcgattaaccaaatgtaaaatttggattctcacttatgtgcaattttgaaagaacaaaaagttttttcaaaattgagtgaggaaattcactaaaagtgaagagtacataaatctggtgatgatggcatagaggtaacactcctttccattccgaacaggacagttaaggtctatagcgccgatggtactgcatgggagactgtgtggaagagtaggacgtcgccagatattcttattattaaaataagaatattataagatctttgaaaattgaacagaatataatataaacatttaagtaaaccagcaattctttattttgagtaagctaagattaaactttttattgagagtttgatcctggctcaggacgaacgctggcggcgtgcttaacacatgcaagtcgagcgatgaagctccttcgggagtggattagcggcggacgggtgagtaacacgtgggtaacctgcctcatagaggggaatagcctttcgaaaggaagattaataccgcataagattgtagtaccgcatggtacagcaattaaaggagtaatccgctatgagatggacccgcgtcgcattagctagttggtgaggtaacggctcaccaaggcgacgatgcgtagccgacctgagagggtgatcggccacattgggactgagacacggcccagactcctacgggaggcagcagtggggaatattgcacaatgggggaaaccctgatgcagcaacgccgcgtgagtgatgacggtcttcggattgtaaagctctgtctttagggacgataatgacggtacctaaggaggaagccacggctaactacgtgccagcagccgcggtaatacgtaggtggcaagcgttgtccggatttactgggcgtaaagggagcgtaggtggatatttaagtgggatgtgaaatacccgggcttaacctgggtgctgcattccaaactggatatctagagtgcaggagaggaaaggagaattcctagtgtagcggtgaaatgcgtagagattaggaagaataccagtggcgaaggcgcctttctggactgtaactgacactgaggctcgaaagcgtggggagcaaacaggattagataccctggtagtccacgccgtaaacgatgaatactaggtgtaggggttgtcatgacctctgtgccgccgctaacgcattaagtattccgcctggggagtacggtcgcaagattaaaactcaaaggaattgacgggggcccgcacaagcagcggagcatgtggtttaattcgaagcaacgcgaagaaccttacctagacttgacatctcctgaattactctgtaatggaggaagccacttcggtggcaggaagacaggtggtgcatggttgtcgtcagctcgtgtcgtgagatgttgggttaagtcccgcaacgagcgcaacccttattgttagttgctaccatttagttgagcactctagcgagactgcccgggttaaccgggaggaaggtggggatgacgtcaaatcatcatgccccttatgtctagggctacacacgtgctacaatggtcggtacaatgagatgcaacctcgcgagagtgagcaaaactataaaaccgatctcagttcggattgtaggctgaaactcgcctacatgaagctggagttgctagtaatcgcgaatcagaatgtcgcggtgaatacgttcccgggccttgtacacaccgcccgtcacaccatgagagttggcaatacccaaagttcgtgagctaaccgcaaggaggcagcgacctaaggtagggtcagcgattggggtgaagtcgtaacaaggtagccgtaggagaacctgcggctggatcacctcctttctatggagaaatctagcaaacatggcgtttgactagtacaaagatgcaaagtatctataaaaattacaacttgctcaaaggttacttaatgactattgattctgttcaattttgagagatttttaaagctactgcaatatgcagtagctttttttattgcttagaaaattataatgaagtgaaatatcaaatctatgaataatttttaaaatagtaaaagttgtagtattaaaaaaagaaacctaaagaataaagaataattatagccttcaaaagaatccaaaatcaagttgcatgtttaaaaaagtttatgctaaagaattttctttattaaggtattaattttaatagagttgactttttaatatattatataacacagttgccttggcgattttttattgaaaatgaaaactttgtaattaaattgaaagtgaattataactattatagatcttacaaaaatgaattgaatagtaaacttaaattcgacactacaaatttaaaaaacatagtagttttttcttaatttaatgctaaatttagagaaatataatggacgaatccttgattattaaaggggttgctggatttttataaaaaagataaaaaaaataaataaaagtgttgacatatacggattaagtttatataatagtatttgtcgctgagaggtgactaaataaaaataaaaatgttctttgaaaattgcacatagattaatgtatataatacaacaaagccaagaataaatattctttgtgaatgattaatataaccagttttgtatatcaaaacttaaaaaggtcaagctacaaagggcgcatggtgaatgccttggcatcaggagccgatgaaggacgtgataagctgcgataagcttcgggtaggcgcacatagccagagatccggagatttccgaatggggaaacccgcatgagaaacctcatgcatcgtaaagtgaatacatagctttatgaaggaacacctagggaactgaaacatctaagtacctagaggaagagaaagaaaaatcgattttcttagtagcggcgagcgaaaaggaaagagcccaaaccagagatttatctctggggttgcggacagaacataacgtgaaattatgattaaccgaacacaactggaaagttggaccgtaggaggtaatagtcctgtaagtaaaagtcataatgatcagttctgcaccagagtaccacgagacacgtgaaaccttgtgggaagcagggaggaccacctcccaaggctaaatactacctgatgaccgatagtgaagcagtaccgtgagggaaaggtgaaaagaaccccgggaggggagtgaaatagaacctgaaaccatgtgcctacaaccgatcaaagcaccttatgtgtgtgatgatgtgctttttgtagaacgagccaacgagttacggtatgtagcgaggttaagtacttaaggtacggagccgaagggaaaccgagtcttaatagggcgactagttgcatgctgtagacccgaaaccgggtgacctatccatggccaggttgaagcgagggtaaaacctcgtggaggaccgaaccacgttgctgttgaaaaagcatgggatgagctgtggatagcggagaaattccaatcgaactcggatatagctggttctcctcgaaatagctttagggctagcgtcgtgaaatgtgagtactggaggtagagcactgaataggctagggggcatagcgcttaccgaaccttatcaaactccgaatgccagatactatcagcacggcagtcagactatgaaagataagttccatggtcaaaagggaaacagcccagatcgtcagctaaggtcccaaagtgtaagttaagtggaaaaggatgtgggatttctaagacaactaggatgttggcttagaagcagccactcattaaaagagtgcgtaatagctcactagtcaagagatcctgcgccgaaaatgtccggggctcaaacttaccaccgaagctacgggttcatactttgtatgagcggtagaggagcgtcgtaatcgggctgaagtcgtaccgtaaggagcggtggactgattacgagtgagaatgttggcattagtagcgagatgtaggtgagaatcctacaggccgaatatctaaggtttcctgagtaaagtttgtcttctcagggttagtcgggacctaaggcgaggccgagaggcgtagtcgatggacaattggttgatattccaataccactataatcgttattatcgatggtgtgacggagaaggataggatgtgccagctattggatgctggtctaagcgttgagggagttagaacaggcaaatccgttctaacaatcctagggcgtgatggggaaggttccacggaaccgaagtatctgatttcatgcttccaagaaaagcatctagaaagagaagtagtgcccgtaccgcaaaccgacacaggtagatgaggagagaatcctaaggccgacggaagaatcacagttaaggaactaggcaaattgaccccgtaacttcgggagaaggggtgcctaccatctggtaggccgcagagaataggcacaagcaactgtttaacaaaaacacaggtctctgctaaagcgtaagctgatgtataggggctgacgcctgcccggtgctggaaggttaaggggaacacttagcgcaagcgaaggtgtgaacttaagccccagtaaacggcggccgtaactataacggtcctaaggtagcgaaattccttgtcaggtaagttctgacccgcacgaatggcgtaatgacttgtgcactgtctcaactgtgaatccggcgaagttgtagtgcgagtgaagatgctcgctacccgcgattggacggaaagaccccgtagagctttactgtagcttagcattgaatttcggtattgtctgtacaggataggtgggagactgggaaattagggcgtcagccttaatggagtcgttgttgggataccaccctgatagtattgaagttctaactggatgccatgaaactggtgacaggacattgttaggtgggcagtttgactggggcggtcgcctcctaaaatgtaacggaggcgcccaaaggttccctcagaacggtcggaaatcgttcgtagagtgtaaaggcataagggagcctgactgcgagacctacaagtcgagcagggacgaaagtcgggcttagtgatccggtggtacctcgtgggagggccatcgctcaacggataaaagctacctcggggataacaggctgatctcccccaagagttcacatcgacggggaggtttggcacctcgatgtcggctcgtcgcatcctggggctgaagtaggtcccaagggttgggctgttcgcccattaaagcggcacgcgagctgggttcagaacgtcgtgagacagttcggtccctatccgtcgcgggcgtaggaaatttgagaggagctgtccttagtacgagaggaccgggatggactgacctatggtgtaccagttgtttcgccagaagcatagctgggtagctaagtcgggaagggataaacgctgaaagcatctaagtgtgaagcccacctcaagatgagatttcccatagcataagctagtaagaccccttgaagactacaaggttgataggtcagaggtgtaagtgcggtaacgtatttagctgactgatactaataggtcgagggcttgaccaatataatcaagttgtagatacattaattaagaggaaactcgactcacttagttcgctgagtaagttcgattaaccaaatgtaaaatttggattctcacttatgtgcaattttgaaagaacaaaaagttttttcaaaattgagtgaggaaattcactaaaagtgaagagtacataaatctggtgatgatggcatagaggtaacactcctttccattccgaacaggacagttaaggtctatagcgccgatggtactgcatgggagactgtgtggaagagtaggacgtcgccaggtaatcttgtttatcaagattagaaggatctttagctcagttggttagagcaaccggctcataaccggtaggtccggggttcgagtccctgaaggtccaccattttgggggtatagctcagttgggagagcacctgccttgcacgcagggggtcaagagttcgaatctctttatctccaccataattaagactatgaatttattcatagtctttttttatatattgtgtgataaaaacataagagaaagaatattataaaaatgttgttaatctgtttgcaatgaatagtatattagagacataaagatatataaattactaataaaataaatttattttattagtaataattagaattgatctaaatatactaataaaatgagtaaacatagttaattttaagcaattaagtgacagattggataacaataattataatagaagttgaaatgaatttttattgatgtgtaattagggataattttgaatggagatgaaaaatttatggataccaatatggttttagaagatcaattgaaagaattaaaactgacaaaaagaagttttgtattagaagggaaaaatacagaagagcttgattataagataagattagttgaacaggaaattaaggaacatttagaaaaataatattaatttctgaaaataattacgttttagcataaattgcaactacggaaaatagaatattaaagttatgataagatctataaattctatttcatagatggatactttcaagcataatatttattaaggtgtattatagtggtacacgcttaaattagtaatttggaaaggatatggaagctatgataaggactgtagtttgtaaaaaagacggatgcaaaggaaatgaattttatatagtaacagaagataataaattaaaattaacttgcaaggaatgtggaaataattattattatgatgtgagtcattatgacttcactatgttatctaattgtgaaagatgcaataacgatatatttaaggtatttgttgatttggagaaaaaaggagtaatggcaaagtgtactaaatgtggttatcctcctgaaaaagtttttattgatgcagaaggaatacaagttacttatgaggcacatttattgcaagatataaagcaacttatgaatcaaattgaccagagagtatgtaatttagaaatgaaaatagagggattggaaaagggtcaggaacttttagaagaatctcttgcttacattaatagatatatgtcagaaagaaattaatactataataagataaggataataatatgataaacaaatattttacaaaaaagaagtatgttataaatttactactaattgttatatggatgacttttatatttttaatgtctaatcagcctgctgaaacatctgattcacagagccttgggattattagtatattatctaagctaggaattgatatgagcggtatttttggtgatatagctaatttcattgtaagaaaatgtgcacattttcttgaatatatgatattaggttttttaataataaatttaattaaagaagacttaaagctaaaatatattgttttaatagtaattagtggtgtatttttatatgcatgtactgatgaatttcatcagttatttgtatcaggaagagatggaaaccttagagatatatttattgatacatctggtggaacagtatcagcattattgttttatttaaaaagattactaattaagaatagaataaatgaatgaatagagtgaatgcagattttttctgcattcttttttataatttaatcttttaaagtttataaataatcttaaattgtaaaataaatttaagaacaagtactctaaaaaaatcaatgtagtataaataaaaaacagctaataaatatacatatttattatatagatatatataatattacaaaatatactgtaactttattaacatatttaaataaatattgaaaaatatttaatttaattatataatatacgtaaatacagagtatgatgttatttgatgtgtatcatactattttaccaaggaggaaattatggaaaataagaagaaaaagttggggatacttggcactgtagaaaagataggaaatatattgccacatccaactacactatttgtaatattatgtgcaataataatggttgtatcacatattgcgtacaagcttggtgtttctgttacatatgaaggcattgatgtggcatcaggtgaattaaaagagttaacagtaggggttgtaagtttactaactcctgaaggaattagatatgtgttcacaagtgcaattaagaactttactggttttgcaccacttggaacagtgttagtagctttacttggagttggagttgctgaaggaagtggattaatttcaactgtattaaagaaattagtattaagtactccaaagaaatttgttactgtagtagttgtttttgcaggggttatgtctagtatagcttcagatgcaggatatgttgttttaataccattaggagcagtaatctttaaaagctgtggaagacatccattagcagggattgcagctgcatttgctggggtatccggtggatttagtgctaacttacttccaggaccaacagatgcgctattaggaggtattacaactgaagcagcaaggcttgctaacccaacatatgaagttggaatgacaggaaattggtactttataatagcatcagcatttcttataactattcttggaacatttgtaactgaaaaaatcgttgagcctagacttggagaatataaaggcaatgacaacgaagaagtaatggaagttactaaggaacaaaaaagaggattattatttgcaggtattgcattattagtaacattaataggtattttattattagttgtaccttacaatggaatattaagaaatccagaaacacatgaaatattaaaatcaccatttatggattctatagttgtaattattgctatattatttttaataccaggtattgcatatggtatcggtgaaagaactattaaaaatgacaagcaagtaattaacttaatgggtaaaagcatgtcagcaatgggttcatatatagttctagtattctttgcagctcaatttgtttcatatttcagttatactaaattaggaactgttatagctgttagaggagctaacttcttagaagctactggaataaaaggaattccattattattagcatttatagtagttgcagcattcattaacttattcatgggttctgcatcagcaaaatgggctataatggctcctatatttgttccaatgttaatgggaataggatattctccagaattaacacaaatggcatacagaataggagattctgctactaatataatatctcctcttatgagttactttgctttaattgttgcatttgcagaaaaatatgataaagactcaggaatagggacacttatatcaacaatggttccatactcaatagtattcttaataggatggagtattttattaatgctttggtttatatttaaattaccattaggtgttggagtaggaatcttcatgtaattgaagaatagattaaaattatatgtaataaaaagtacgagaaatacgaggtatatcctcgtattttttattgagaataattttaatatattttgcaatgaagcaaattttaaaagtattaaaaataacttatgctaataataaagtaattaaattttatatgatgtataatttacaatagaagaataatattaattatgttttagatcaagaaggtttgttaaacaaattttaatatagtataataataaaagtgtaaatttaatatgtattgaattttccacatattaggaatataaggaatataaggaatgataatataagaaatttgcagtagattttataaaagactaaattttattttaaatatatacagaggtataaaatatgaaaaattatttgaaattaatgagagtacatcattatttaaaaaatgtattaatttttttaccgcttgttttcagtcagaatttatttaatattgatttattaagtaaaacgatatttggatttttttcattcagtatattgtcatctattgtatatgtaataaatgatatacaagatgttgagaaggatagaaggcattctactaaatgtaagagacctatagcaagtggagcagtgtcaataaaagaagcatatgtattagcagtatttattgcaattgtaggaatagcctttaattatcttgcatgtggattaaacattaaggcatggctttttgtaataatgtatgtaggtttcaattttgcttatagtatgggatttaagaatatgcctataatggatattactattttagtatctggatttttgtttagagtattatatggttctgcaattacatcaataaatgtatctaattggctttatttaactgtaattgcaatgtcattctatttaggtcttggcaaaagaagaaatgaattaaaaactgaaggaagcaaaagcagaaaagtattaaagtattataatcatgattttctagataaaaatatgtatatgtgcttaggccttaccatagtattttattcgttatggtgtgttgatccaacaacaatagaaagatatccacaaaataatcttgtatggacagttccattagttatgattatttgcatgaaatacagtttaaatgttgaaggagaatctgatggagatcctgtaagtgtacttcttaaggataaggtcttaattgctttaacgctactgtatattattattgtattgctaataatatatgtgtaaaaaataatattaatttatatattatttgatattgtgatttagaatatgattaatattatttatagaatgagagtacttgtaaaatataaatatttaaaaaacatgaattttaaaatcttataatttttaattataagattttaattataattaaagaaaaaagttgaggataaaattaatgaatgtttatgattttgataaaacaatttatgatggtgatagcactttagatttttattttttttcacttaagaaaagtccaatgcttattaggtttttaccaattcaaattataggatttattaagtatatgtttgggatgtattcaaagcttcaatttaaagaaaagttttattcatttttgaaaggaataaaagatgttgatagtatggttgaattattttggaatgaaaatcaggataaaattaaagactggtatttaaagagcaaagaagagagtgatgttataatttcagcatctccagagtttttattaaatactatatgcagaagaataggcataaagcatttaattgcttcagaagtgaataaaaatacaggaatatgcgaaggtgaaaattgttatggagaagaaaaggtattaagatttaaaaagtactttgaaaaaggtgaaataaaaaaattctattcggattctttaagtgatgcacctatttcattaatggccagtgagagatatatagtgagtggaaataatattcttccgtgggatcagtatagtcctggtaaggttaagaaattaaaaaatatattttttacaaaagagttttttacttttcttattgtaggagggataaatactataaatggaatagtattttcatatgtatattctttgtttttaggtgttaatgtttcttttgtacttggatatgttactgcaatgacaatttcatatattttaaatagtacattagtttttaaggaagatatgggggttattaaatacattaaattctgtatatcatatattcctaattttataatacaaaatatttttgtattaatattctataatatgcttcattggaataaattaattgtatttgcattagctgcaattgtaggtgttcctgttacatttataataatgaaattttttgctttcaataaaaaagataatcatcaggaaatacaagagtaaaaataaaaaagtttagattcagaacgtttttcagaatctaaactttttttattaattataaattaacttagtagttgcttatatattaatagtaacttatttttcatttgacgatttaaaagctgtaacaggaagaattgcaaatatataattaattataaatgcatatctgcattggttttctagtataagaagcattgctccaaatccacataagattatataaaatagatttattattttattatcaatatgttcagttttattaaacaatcctttcattataaataatagaagtattgaataaacaagctgataccataaaaatccttttcctgaaatatcaaaaataacattattttcatcaatgccaagctgagaccagtaagcaccagcattatctccaaatgcccattgagtagcgatttttcttacaaagaattttccaagttctaatggaggtgtagttgtatatctttcaataattcgttctttacatgcttcagcaactgattccttatcagtagtatgaagaaggtcttcaatgaatttagcatcatcaggattccagcttccaccactttctagattacttcctcttacggcagaggtgatgttaggctcacttccattccaaatattcctgtctgtaatattcatttttataagactatttgaaaatactacaaaaagaagtatgaaaggaatcaagattaaaaggatgtttctaagtttgattttaattttctctttgttatatataaatatatacattacataagcaattaaaattatatatgctaccattctaaataagtgtcctatgcataaaagaattccacttaaagcaagtagtaagcagttgttttttttctcaacaactaatatgaataggtatatacttgctaaataaaatggaatagctatattttcagagcaatatacaggaacgtataaaattgcagacggaagtatagaaataaagaatgttccaagtaatacttttttgtagtctttaaatattttattacatataagatatactaaagcaattgctcctgtagaaaatattacatttatcattttcataacaaaaagtgcattgcttccaaagaattttataataagtgaaaataataaaacatatggtgtcatatgaggaaatcttgcaaagtatccaagtcccacaaaagagctattatctcctgctaaaaggttagtagcagaatcatatattgttttaaagtcagaaataggagtacttttagttacaagtgcccatgtaagtcttaaaataaatcctgaaataagaatagcgtaaaacattttcttttttgagatcttttttcttattccataaataaagcaaccagttaatattaagtagattcctattaaaatgatgtttacataattaatatctttgaaattatgatatacagaagaaaaggtcgtagaaaatactattagaaacagtataaataatgagtaaactacaaacttagtaaagtatatactgaatgtatttatggcagatccattttgcttatttagtgaattactattcataaatattaaactccttaataataaataattttttcaaatcaaatttaattataatacaaagaaagggacaatacaaaatcaaggtttaattttcagaaaatttagaaaaataaaaaggttttcataaataagcgtagaattattaattataggtaaaaaggatacatataatatactgaatgtaaataattctagataaaagaataatgtattcttaaataaatttatttttaaaagcaggacattcaacattattgtacatgaaaggcaggtgagagccaatttctaataatattttaggacttggcagaatttatgaaagattatactatcaacaatttgagaaatgttggacttataggacataatggtacaggaaagactgctttagcagaaagtattttatattattcaaaggttattgacagattaggaaaaatagaagatggtacaacagtaatggactttgattcggaagaaaagaaaagacagttttctatttcattatcagtagcaccagtagagttagataatgtaaagataaatatagttgatattccagggtatgcagattttcaaggggaattgatacagggtatgagagccgttgatgtaggtatgattgttgtaagtggtgtatcaggtgtaaaagctggtacagaaaaggcatgggagtattgcaataaaataaaattaccaagaactatatttataaataaattagatagagaaaattcgaattttgataaagtacttgatgaacttaatcagaaatttggaataagtgtagttccaattcagtatcctataggtgctgaggataattttaaaggagtaattaatgttatttctgaagaggcaagaatttatgatatgaagactaaagaaataaagcctattgatattccagaggaattaaaagaaaaagtacatgcatgtaaaataatgattatggagtctgttgcggaaaccgatgaagctttacttgaaaaatattttagtgaaggaacattgagtgatgatgaaatatataaaggtttaataaaaggttgtgcaagtggtgacattgcaccagttatgtgtggaagtgcattaaaagttatagggatggatacattaattgaggatattattgaatgcttcccatcaccagaatatgcaataccacagaaggctgtaaaggttgatacaaatgaagaagtatttataaatcttgcagaagataagccattttccgcaatagtattcaaaactattgcggatccatttgtaggtaaaatatcgttttttagagtaataactggtgaagctcaagatgatatgactgttatcaatacaaataaggacaaatctgaaaagttatcacatatctgttttttacgaggaaaaaatcaaattcctacaaaaagtataaaagcaggagatataggtgctatatcaaagcttcagtacaccaatacaggagataccttatgtagttcagattttaaaataatatatgataaaatgaattttccaagtgttgtttgctcaatgtcggtaatacctaaagctaagggggacgaagataagatatctcagtctttagctaaattgaaagatgaagacccagtatttgaggtttctagggatattgaaaatgcagagactattatttctggattaggagaaactcacattaatataattgcaagtaaaattaagagtaaatatggagttgatatagagttagaacttcctaaagtaccatataaagaaactataaaaggctttgctgatgttcaaggaaagcataagaaacagtctggtgggcatggacaatatggagatgttgtaattaaatttgaatctagagatgatggagaagaggatttagaatttgtagataaagttgtaggaggtgctgttcctagaaactttattccagcagtagaaaaaggtttaagagaatgtatttcacatggagtattagcaggttgtcctgttataggccttagagcaacgcttcatgatggttcataccattcagttgattcatctgaaatggcatttaaaatggctgcttcaatagcttataagaaaggactagaacaggctaaacctattttattagaacctataatgcaagttgaggtagtaataccagatgcgtatatgggagatgtaatggcagatataaataaaaagaggggaagagttattggaatggaaccagaaggtgaaaagcaaaaggttattgctgaagtacctatggctgaaatgagaaagtatgctactgaattacgatcattaactcaaggtcgtggtatgttcagaaaggaatttgcaagatatgaagaagtaccagaggtagaagtggacaaagttataaatagtataaatgaagccagaaataaaaattaattctaataatagaagatttatagattattaaatataaatttatctgtatatgtaaaaaggtagcttataatagaaaaattaggctacctttttgtatataaaaatttaaaaatataatcatttttagtagaataggaatattattatacgaataaagccatactatctgtggatagaaatatacatagcttatagctaaggaggatgaacaaaccagtgtcaaattatagtatgaatattagcggcaatattggtttagaagattacagcaatatatttgactatttaaaaataatagacaaagatgataattttataataaagataaataaaagaaacagaaaagatatagatgtaataaattcaatgctccaagataataagtttattataaattatacagagtatgattcaaatggaaattactatattaatgctaacagaaacaaatgaaaatgactaaatagaaaaataagtttaataatttacttttctatttagttatgaataaaaataatgtgattaacataaaatactattatggaagctctccttgcatctaattttttcttctcatacatagattgatttaattttaggtaagtacttaatggttttctagttttttgtgagtatttccttagaagtaaattgagatgaaaaaattgttcatataaaaagctatccttaatgatatattaaggatagcaatattaaaaaattattatctttttaaataaagcctatctggtatttaataaattatcagatgggtttttaatattgtttcactatttaaattaagagttaaaagcaaaatcaccataattatttcatgctaaataattatggtgatttctaattgtatataaataaaaatgggggagaggcgattaaatattgaagttaaatacttcattataaagtattaccagaaagatttttattatacactttgcatataaaatatttttaagaaatttctattggagaattagatatttcagaaaaagcaggttcttctacccagcctcttgaattaatgttattatccagaggaagggcaacataataccatgtagaatcatttgtattaactttttctaaaattcctacctgcatacccatatctattttttttacaatgcatgaattatttgaaggacttattctaactatagtatttttaggtaataagccgtagtgattatctacagttaaaaattcaagattacagttttgtgttgatgaatctagtaaatcgtacttctctttaatttttgaaagctgggattttaatagcatattgtttttttgaagagcaatatacttatcatcgtagctttttaagaaaaaaaagcccccgcctcctaataaaagaataataagtaataaaaaaatgaataccataactcttctccttaatacagttctaatttaaatatattttgtaaagtagttaataattcataagaagaaaatctcaccataaagaatatttctaaatagcaatcatagaatagattagtaagaaattcatcagcttgtttgcgtaagatttatattaagaatttttcaagtaaaaaagtaaacgctaacaaaaatttggaattaatattcatagttaatcataatatatgaatataatcttcaaaggatgaaaagactaattattaatatataaaatttaaggaggaatgatgatggattttactaattcaccaatcgatgttaattcatatgttgcaaagtacatggatgaaatgggatgtagctttgaacaggcatgcgaagatttaggtttagaggcatctcaagtatttaatagacaatcaggagaagaattttattagaatagtataaaaatttcccccatctataatatatagaaggtctgctatatattatagatggggttttattatgaagttttctaaaagaaatatattttaaaaatgaattatttaaaaatactttaagagctatctgaattgaaatattaaattcagataactcttatttactatatgatacgaagaaaagaaaagttatatatttgagattatatggttaatagtaaaataaagaatactaaaagtaatatatatttgactttcggtaaaatttattataatataaatttaaaggaagtgaaaaaatgggaaaaaatattgcaataaaagtggccagagcccagcttgatatgacacaaaaggaacttgcagaaagagtaggtgtttctcgtcagacaatgaatgcgatagaaaaaggagaatacaatccaactattaaattatgcagatctatatgtaaggtattagggaaaaaacttgatgatttattttgggaggatgatgataatgaaaagattgaaaaataatcttgatgaaatgcaggaacaaaagttattaaaaattgagcataatggaatgtggtttgcattctggggattacttatagctattatagtacaattatttataggagaaggagatacatttagaaatattgcaggtgagtggatagtttttatgtgtctttgcatatatatttttattgattgcatgaggaataatatatgggatagaaaactaaaaccaaatttaaagacaaattttattttaagcactataggtggattagtaactggattaatattttttgtaaaatcatttattcagtatgaaaaacttttaggatctattgctacagggttaattctatttatttttacatttgcattaacaatgataatactaagtatttcatcattattatataagaaaagagtacaaaaagctgaagaatcaacggaaaaagagtctgaagagtaatatatataaatacaggtaactatataaaaatatagttacctgtatttttatagactattaactgcttcccctaaaactttaccaatagcctcatgtataactaaatcagccttgctatcagcagatgtagtgctcttatttataagaataagattcttgcctttaaaataatttataagtccagcagccggataaacaataagagaagtgcctccaattattaaagtatcagcttgagaaatagctgcaattgaaccttgtatagtggattcgtctaatccttcttcataaagaacaacatcaggcttaacttttccgccacactttggacatgtaggtattccttctgaagctaatatgaatttttcgtcatagaaagcattacagtccatgcaatagtttcttaaaactgatccatgaagttcgaaaacatttttagaaccggcagcttgatgcaatccatcaatattttgtgtaactacagcttttaatttacccatctcttcaagtttagctaaagctatatgtgctgcatttggttttgaatctgggtagataagtttatctttataaaatctaaaaaattcttctggatatttcataaagaaagtatgagaaactaattgttctggtgtgaagtttattcttaacttttcattccataaaccatttgaacttctgaagtcaggaatgttactttctgttgatacgcctgcaccaccaaagaaaacaatgttattactttcttttaggattagagttaacttttctatttcattattcataaaatcatctccgtcaatattttatattaatattatgacataaaaaggtgaaaaataaaattaaacagtcatctttaaacttgaatcttatatgaagtaatggaattgatttatgcaacgatgttgtatatgtggattaaatatttaaagtgcccttttgaggacacttttttgaattgaaaaaataaagctattaagaataaataaagctatctaaacatgttccattagtatcatagaatgctgattttactagtgtatcaaatacttcaataataccatactcatagatacaggcaggacctgtaacgatgttaagtctattatcgccaggtatttcaaagggagcaccaccaccaccgcttgttatttgaattattgatttgtttaatgcatagtcagctttaaaaaatacattggtgataaaacggcgattatagctgtgctcgtggccagcgtatactcctgcaattctatagttattaaaaattctaaataaagcttcctgttggtcaaaaggaagtgaataataatcttgataagtcccaataataggacaatgaagtaatataaagttatttgtactattgctactacttaatgtattctcaagccaatttaattgctctggagtaataccaataagctgttgtttatcttcaggatcaccacttgatgaacttttaaatacagtatttagtacaataaacctagaattataataatcaaaataatatactgttttgccatacccatctagcatatcttcattacatgaatttgaaggcagataataaaatgctttattgaaagccttaatactttctttaaaattatccgaattactataatcatgattgcctattgcgggaaatacatagtctttgaggctattaacacctagtgctttttttacgaacatttcccactctaaaagattagaaaaaataaaactagtatttgcatctacatttaaagtagctctacccagaatcatgtctccaccaaacaatatgaagtcgggattatgatacttttttatatcatgcagaagtttacctagaactggtttatttatttgaattgattgagcttttgtacctcttgaatcgcctaatacagcgaatttaaaattaggactcatatttaatcctccaaagttttcttatttacttaacaattaatatattatatgaagcaatagataagagaggtacaagtaaatttatggatgtgttaaataataaaatcagaagtatacagttgtaaggttagtgttattaatttttactataaaatacattgacaattcaaatttatataattacactcgaattagaaaatataaccaataatatattaataagtaaatatttaatatagagaattcttaaagaaatgaaaaaatataaggaggcaaataataaaaataaatagacttaagggggaatttcatatgattagaacaattatttttgatatggatggagtgttatttgatacagaaaagatttatgatgaagcttggaagattattttaaaagaaagaaacgttgaaaatatagattatgttttatcaggatgtcgaggacttacatcagaagatagtgagaaatttatagatgccaattttaaaggaagactttcaggaaaagaatgtttgaacgatcttatggataaatttaatgaaataatagaaaaaagaggagttcctataaaaaatggagtacatgaactgctttcttatttaaaaaggaatcattatgaaattggacttgcttcatcaactcatgagccattagttgttagtcatttaaaagaggttggtatacgtgagtattttacacaccttactacaggggatatggttgaaaagggaaaaccagaaccggacatataccttaaagcgtgtagcaagtttaatagaaagcctgaagaatgtatagctgtagaagattctattaatggtgttacagctgcaattagagctggaatgaatgctataatggtgccagatattgttcagccaacaaaagaaatagaaaaacaactttataaaaaattgaattctttgcttgaggttaaagattttcttgaaagcattaactaagtttttttaatataaagtctggttgggttatttttagatggaggtacaaaagtgaagattgatagattattttcaatagtacagatgttagtaaatagaaaatcagttactgcaaaggaacttgcagactattttaatgtttcagtaagaacaatttatagagatattgaaattttatcagctaatggtatacctatttatgcgactcagggaaaaggtggaggtatatctattttagaaaattattctatagataagactattgtatctgatgacgagcaaaataagattattatggctcttcagagtgtaaatgctacaggacaaattgatgttaatgattctcttataaaattaaaaaatatttttagaaaaaatgatacagactggattgaaattgacttttcagggtgggagcagagcgaagaagagaaaaataattttgcattattaaaagagagtataatgaatttaaaatgtgttagattttcttattataacaataaaggagaggtatctaaaagagtagttcagccatacaagcttatatttaaagggaataaatggtatgtatatggattttgtacaaataaaaatgactttagattttttaaattaactagaattgagggattagaattattagatgatacttttaagagaagaattaatatacctataaagtgcggttatgatgtagaacatagcgagtgtgtaaaaattaaacttaaaataaatatagcttcagcatcacgtgtttatgatgagtttagaaaaggtattattaagattgatggtgattatcttattgtagaatatgatatgcccaaaaaaccatggatttatagctatcttttaggatatggtgatgatcttgaaattctagagccggaaaaaacaaggttagagtttaaaaaatttataggaaatataatacagaaatactcataaagataaaagaggaaataattatattggtaaatataagttaagataagaattacaagtgagattttgataatgatatcatggtaatatgaaaattaaaaatataaattaagtacaagagtgaaaaactgttaatcttcaattcagattaacggttttttatgtaaaaatatatattttatgtaattaattatgtgatataatatatattatttacaatttatggagaaaaaataaaaggaagaaaaaagtcattagatatataaaaagagagaaagatatatatgttctaattattaattaaaaatacaaagtaaaatttatgtatatttttttagaatatatacattagatatttatagttggtaagctctagttaataaatgatttttttgagactttagattaaaaggagtttatttttagatattaatttatacggatataaacaatatataagtatcaacattaaaatcaattattatctatatattaatctaaatatatactgttggagtaaataaaaattattaaagataaagtataacaagataattttaataattatagtattagctattataacaatatttttaattgagttgcattcacacaaatttataaataatttttgcataatgtatgctgtttgtattataatatcaaaaggtatcatttatttttgaaacgtatcaaaaataaataataccttttgagaataagaaagagttaaactaaggagaagagacatgcagagaaaaatgtttggatatgtgagaacaactataaagggaaaaggtaaggaagagcagattgaaagtataaagaaatattgtgcagataatggatttgatataaatgaaagggagattgttgttgatgcaatatcttccgacaatttaaatagagatggttacaaagcccttgtagaatatatggttagaagtggtgatgtgattataataactgaattagataggcttggaagaagctctgaaagtattaaaagtgaatgggaaagattatatgaaaataagattgatatagttatagtagatagccctgttcttagtaccttcaataagaatgaagaagataagataaaaataaatgaaattattgttgaacttcttggttatttaggtgataaggaaaagaagagaaatagaataaaacaagctgatgggataaataaattaaaaagcagaaacaatggtaagggtataggcagacctaaaactgaaataacaaaagaatttaaagttcaatataagctttggaaaaataaaaagcagagtgcggttgatacatataacaatttagggttaacaaaggctactttttataggttggtaaaggagtttgaagaaaaaaggtaattttatatatctaattgtataggaatatatgtataggaaaagaaaaataataatttatagaaaactgtcttaatctttggaaataaagggtttagacaggtttttctttatttattttgataaaaaatgataaaatttaaaaaaagtttgaaaaaagtgttgacatattagtcatatctcgatataattctatttgtgatctggtgatgacggcgtagaggtaacactccttcccattccgaacaggaaagttaaggtctacagcgccgatggtactgcacgggagactgtgtggaagagtaggacgtcgccaggtgagcatggctcgatagctcagtcggtagagcagaggactgaaaatcctcgtgtcactggttcgattccagttcgagccaccacaaaacactaacatatgttagtgttttttttattcgataatagttaaataataaagtaaaaaggcctttatgtagttaatttatttattgattaataaagacgactaattatagaaaatattatgtgagtttataaattaaaactttgaaaataatatttaatataaatttagtcgtcttttatagtgttattgttaatttaaagatgaatttagacttcgcaatcctctatttctattgaatatgttccacattctggacaaactgttatattcacgatgtgacttttatcaattttccctgctctaaataatttattgaaagatgtatcttcatattctttgcagattgtatttataacgtactcttgctcttttgtataaatatagaaatgatattcaaggtagcaataatacttttctattttctcttgaagatcacaagcgcatttaccagcatagtattcttttgaaaaagaaacttcttcattagaatttaaggcttctaaaattgtttctagcgacagtcctttaatttcctcatcattttcaaaaaagataccttcgcagttctttgagtttagcgtgtattccttactgttgtatgtaaatttgtactccatataaaattacctcctaaatttataatatataattatgtattaatatagtgtctagaatttataatattagtaatttatgaatttctagtataaatatactactattatataaaaaatctagataatattctataaacctgatgaatgggtttttaaatttagaaaatatataaaaagagtgttttttgaattaataaaacatatattgaattgagatataaatttagattggaaaagagcatgttaaaatttatagccttttcattcataattatgactataggatgtgccgttgctgataaaattgagggatttgtgggagataaaaataaacatattggggactatgagagatatatggatacagatacgcttatgattttaaaaaattatggattgataaattctgaaaaaattaaaatgtaagaaaacgacagaaagagctatctcaatagaaatataaaacagaattgatgttttatgaaataatagattgagatagctttatttttatatgttctctatttgccagtctattggtttttggttagttgatattaaaaactcatttgttttagaaaatggtttactaccaaagaaacctcttgaagctgaaagtggacttggatgaactgatttaattatcaaatgctttggatttgtaattaagctttcctttgatattgcattgttaccccataatatgaatacaataggagtttctttttcgtttaaagtttttattacttgggtagtaaatgattcccaacctttatttttatgagagtttgcttctccagcacgcactgtaagtactgtattcaataatagaacaccttgatcagcccatttttttaaatagccgttattaggtatgtagcagtttaaatcactatgtaattctttatagatattaactaatgatgggggagtttttacgccagggtttacagaaaagcttaatccgtgagcttgttttggtccgtgatatggatcctgacctaaaattacaacctttgtgtctgcatatgaagtaaagtgcagagcgttgaaaatatcatacatattaggatatattacgttagaattatattcggtttttaagaaatttcttagatttttgtaataatccttctcaaattctgaagatagataatctttccaatcattttttagtatttcagacataaaatcacctcggtttattatagcactatagaggaatattatgtattaattagagaaagaataagaataaattaaattttattgttactatcgccatatactgttaaaataaaatggtatgaataaattttatattaaaaggagagcacacatggaaaataaagtattagctattgcagcaggacatgaaataacagaaaatgatttaaatgcattaattgctagatacccagaacaacaaagagctgcttttaactcagaagaagcaaagaagaacttacttgaacaattgatttcatttgaattattcaataaatttggtcaagaattagaattagataaaactcaagagtataaggatgcagttgcaagcataactaaagaagttttaacttctatggctatgaataaagctttagctgatgttactgttacagatgaagatgctaaaaaatactatgatgaaaacaaggatgcattttctgtacctccaacagtttcagcaagacatatcttagttaagactgaagaagaagcaaataaagttaaagaagaaatcaatggtggattatcatttgcagatgcagcaatgaaatattctagctgcccatcaaaagaacaaggtggaaatttaggagaattctcaaaaggaatgatggttcctgaatttgaaaaggcttcttttgaagcagaaataggggttcttactgaaccagtaaaaactcaatttggatatcatttaataatagtagattctaaaaatgaaggtgctgttaagagctttgaagaagttaaagatagtgttgtaaatgaattattaaagagaaatcaacataaaaaatatgatgatttaatgaatcaattacaagaaaaatatggagtagaaagaaaatagttttttctataaaaaatctgttttgtaattaataagatacatatacagataaaaatagtcctgctgatttttcagcaggactatttgggttttatattaattcaaaatatgaattgatatatttatctgaatgattaattatttcatctaaatcatttaatgaatgtttatcgcttactgcaattacagtcatatcagcagctttagcaccttttattgcaggaagtatatcttcgaaaactatgcagtttttaggatttacattcaacttttttgctgctaaaagataaacatcaggacagttttttccattagatacttcatctgtagttgttatagagtcaaaataatcatatataccattatttttcaagcaagcttcaagaagaggaactgaattgcttgtggctaaggctatttttatattattttgttttaatttatctaaaaattctttaacaccatcttttaattttacattttcagaatagtgattatatgccatgttgttccaatcttttagaatagtatctatagagtcagataggctgaatctttccttgaagtaatttgcagtttgtgtgaagctcaagtggcatatttctgaatttaaattttcaggtagtgcatgtcctttagattctaaataatctatatctattttgctccaaacccacatagaatcaacaagagtaccatctaaatcgaaaatagcaccttttatattttcaagcataatattctcctttatacctttgtatttatatctaaaaaaataaaatataataaaaaaacttaaggaaaaatccttaagttatatggtcggggtgacagggatcgaacctgcgacctcatgctcccaaagcacgcgcgctcccatctgcgccacaccccgacgacatataacattatatagtgaactttaggacatgtcaagggcaagtgtgctgtattatataacaaatttgagtaaaaatcggtgatttactagtataaacgagatgaaatgaccatttgcgagaataagttagtatacagggggaaatgggaagaattttagatatctttaaaataacttaatttctcggataatgagagtattgtccatatttatggaaagtgttataataatgtaagaaattacgaaaataaaggagggaaggttcaaggggggaccgaatatgaatgaaaaaaagaattctggcacttatgctagcaacagttgtagttacgggtattaatataccagcatatgcgacaccagataatagcaagcttaatgagagtagaagtaaatatgctgaaatagaaactaaaatagcaaatattcaagataaaatttatgaattaaatggtcagatagagccattacaggtaactgtagaaaaaaataaaaaagaaataagtaacattaataatgtaattgataatactactaaagaaatagatcaatgtaaggtagaagttaatgaactagacaaagcgttaggagaaagagtaagcgcaatgtacatgtctggtgatttagagttcagttatgtgaactttttattagaatctgaatcaacaggagatttctttactagacttcaagctgtttctcaaattataagcaaagataaaaaagctattgaggaattaacagataaaaaagaagaattagatggtaaaataaactcgttagaagataagaaaaatgaaatcgatacacttaacaaagaggtacaaacgagtttaagtgaattagatggaaagaaaaaagaacaagaagttcttgtaaatgaagcacaacaagaaaaaagtaaatttgattctgaatacttatcagagttagagagagaagttgtacaatcacaatatgctgttataaatagttcaagcagtacatcttcagaccttcaatcggctattactcaattaagaaatattagagataatcagcttaagagtgaaatagttaaatcagaagttaatgatatgatagaaaaaggtaaaacagcgtatagtagtaaaaaagaacaagaagaagctcaagcaagagctgcagcagctgcggcagcaactagcacaagtacgcccaatagaggatcttctaacagttcttcagcaactccacctccagcatcaggaaatgcatcagctgttttaaatgaagcatataaacatttaggtaaagcttatgtttatggtgcaacaggtccaagcaacttcgattgttctggatttactcaatatgtatttaaaaatgcagcaggaattgatataagtagaacaacatactcacaaattaatgttggagttccagtaagtcaagatcaacttcaaccaggtgatttagtattcccacatacaggtcatgttggaatatatgttggtaatgggcaaatgatacatgctccacaaacaggagatgttgtaaaagtttcgcctgtatacaaattctatgcagctagaagagtactttaatttaacataataaattttgagttatatggataaacacagcctctatgcctttggcaggaggctttttataatgtttttattatcagttcttaattaatattatttcacaaaagaaatatcttatacatttcttttgaaaaaaatatagaatgttactttatgatgtataattatatagtagcatatatactgcaatgtatttaggtgatatacttttcaggtaacaaatgaaagtttttagttttttatatatgcaaacttgcaaatgcaatgttattgtgattgaaattaagaaaagtaaaagttttgatattggaagatattttaattatatatttttgcatattgaacaaactgataattatatagataaattaagaaaaaggaagattatatgggtgataaaaatatacaacttattaatgaagatgagaatattgatgacttacaattgaatggattaagtttaattcaaaaaaaagatggattcaaatttggaatagatgcagtacttttatcggattttgctaacgtaaagacaaggcatagagccattgatttatgtacaggaacaggtatagttccatttttactgtatggaaaatatagtcctcaagaagttgtaggagtagaaattcaaagtgatatggtagaaatggctgaaagaagtgttaagttgaattccctagaaagcaaggtatctttcataaatttagatttaaaggatatagatggccttaaggaacttggacgatttgatgttcttacagtaaatcctccatacaaacttaataattctgggataattaaccctttagacaagttggctattgcaagacatgagataatgtgtaatcttgaagatgtaatatatgcagccagagtgttattaaaagataatggaaggatgttcatagttcatagacctgaaagactcgcagatatttttacactaatgagaaaatacaaaatagaacctaaaagagtaaaaatgatacatcctaaagtaaataaagcgcccaatatagtgcttgttgaaggccagagagatggtggatcatatcttaagtgggatgaaccgctatatgtttataatgaagacggaaaatatacagaagacattgatcgaatatatgggaggaaataagacgtggaaaatggaaaattatatttagtacctacgcctataggaaatttaaaagacattacattaagagcattggaagtattaaaagaaagtgatattattgcagcagaagatacaaggcagactttaaagcttttaaatcattttgaaataaaaaagccacttattagttatcacaaatttaatgagcagtccaaaggaaatgaaataatagaactgcttcttgaaggtaaaaatatagcccttgtatcagatgcaggaacaccaggaatatcagatccaggtagtgtaatcgtcggaaaatgtataaatgaaaatattgattttgaagtactgccaggggcaacagcaataacgacagctcttgtttattcaggacttgatactactaaatttttgtttagaggatttcttccaagagaaaataaagatagaagagtaataacagatgaacttttaaatagtcaggaaactttgattttttatgaagcacctcacagattgctcgatacgttatcatatcttatggatgtatttggtgatagaaaaatagctgtgtgtagagaacttacaaaattatatgaggaaatttttagaggaaatttaagtgatgcgattcagaattttgttaataataaaccaagaggagaatttgttcttgttttagaaggaaaaaaaattgaagatataaaagaagaaaagaaacaagaatggattaatttatctattgaagaccatattttgaaatatataaaagatggaataaataagaaagaggcaataaaacttgtcgcaaaagatagagaattacctaaaagtgaagtatataaattttcgactaatatataaaatttgtcgattttatgtttgcaaaataataaaagtaatacgtgcactagggcatgtattactttttattatttaaattcattatgtactatcttattatctgttcttcatttcttcgaaacatttttgacagatattcttacctttgtagtttataacgtctctagcatcaccacagaagatacatgctggttcatatttctttaagattatttgttcaccatctacatatatttctaaagcatccttttcagcgatatctaaagttcttcttaattctattggaattactattcttcctaattcgtctactcttctaactacacctgttgatttcataataaaaaaattcctcctaattacacaattcgacattctacaatgctatattaccaagaatgtaatataaagtcaataaatattttattttttgttataagaaattacaaatttcaactttaaaaaacattatagttaaaatatactaccatattttagaaatgtcaatagggtttttcatgtgaatgagcttaaataataaaaattcttaaatttgtattgtggcttaaatagtagctttaagcatagtgatagtttgtactaaagtatgattaatgaaaaaatgtaataaaaaatttacaaatacaaggataaaagtaattaatcaactctttagcagaaaaaacagaaactataagtgataatgtcgatagattacaaaaaatagatattttttagtaaaccacaaaataaaatatagactaatataattaataaaattaagaataatatatattaagttccaataataaaactttacaagatcataagaaatttctaagtgaggagtgaaagcaatattttatatttttatgtgtaaagctattaaatgttaagtaaaagatacacatattgtaattgacatgtgacaattaatgctgaaattactatatgatttttggattataattataaagttaatagttaaatatgcatattaaaaatagaattatctaattaaaataaatattcatataatttcatttctaactattgactgctaattagaatttaagaatatacttctgtaggggaagataaaaaatatgctataattatcataaaaaaatggaataggattaaatgagttataatgttaaaaataacttgtaataagttcatgtatactatataatataataaaagaagtatgagaaagtgtaggtggacactatgaaaagaaaatttgattctaactatataaaagaattagcagaagaaatgtcaaaaaacagttcaatttcatatgatgatctaccaaaatatgatttatttctatcacaagttatagattatttaaatgataaatttgataatgaaaaattcacaaataatatagttcaaaattatactaagagtgaagttattacaaaacctgaagatggaaaaaagagaggctatactaagatgcatcttattcaattagtgcttcttagttatatgagacctgtcttaacaacagaagaaataaaaaaggtatttaatttagcgtttaatgagataaatgatagaaatgatgatatattatcatgggaagaagcatataagacatttgttcagattcaagaagagagtttagatgattacttaataaattcattaacacatgaggaaaaattagaacaactagttaaggaatttaatctagaagaaaaggatgaagaaagaataaagatatttttattagtattgtcattaatagcagaggcaagcgttattaaaaaattagttcaaaaaatagtaaatgaatatcacgctgaataatatatgaatatttattcgggtaaattagaaacttagttgtagcacttatttaatgaatatttattaaatgttcattaaataagtgttttctatattttgttctatatattacaagaggtattttatggagaaaattattataagagaatctgttagaaatttggtggaattctgtcttttaaaaggtgatatagataatcgcttttcaggaaatgcaagagcattagagggaacaagggcgcatcaaaaacttcaaaaagataatgcaggtatatattctgagtatgaaaaagaggtttttttaacacgagaatttgaattgaagaatagtattataaaagttgaaggaagagcagacggtataatatttgatgatggcaaaataataattgaagaaataaaatctacatataaaagttttgtacacattgatgattctaatgaagttcattgggcacaggcaaaactatatgctttaatttattgtttagaaaacaacttgagcaaaatatttataagattgtcttatgtacagcttgaaactgatgaagttaagagttttgaatatgcttttaacattgaagaattaagggattttgcatttgaaatacttgaagagtatgaaaaattcaatgtttttatatataatgaaaaaaaagaaagaaatgaatctataaaaaatgtagtttttccatttgactcttatagggaagggcagagaaaactaataaatgttgtttacaggactattaaggaaaaagaaaaactttttgcacaggctcctacaggaataggaaaaacaatatcaacaatatttccagcggttaaggctttaggtgaaggaattggagataagataatttatcttacccctaaaacaataaacagagaagtagcaaaggatacttttgacaagctacgtaatactggtttgaaatttaggagtatagtattaactgcaaaagagaaatcgtgtattaatgatcaatttgattgcaatcctgaaaagtgtgtttatgctaaggagtattataataaggttaaaaatgtagtattaatggttcttgaagagaatgagtgtatttccgtggaaatattacaggattatgcacaaaaatataaagtatgtccatttgaattgtctttagacataagtatgtattgtgatgggattatatgtgattataattatatgtttgatcctcgcgtttcacttacaagaatgattgagcaaaaagacaatatagttcttattgatgaatcacataacttaatagatagatcaaaaaaaatgtattctgcatcactaaataaggatcaaattttaaaatgtaaaaaaattgctaaaggtaaattgagaaaacttcattcagttctagataaattaaatagttattttatagaattaagaaatgaatgtactcataaagatgtaacttggttttatgagaatgatggaccaaaagatttatctaagtatttaaatctttatttaaaggaaagtgaagaaatacttgtaaaaggaaataaatttgagggatatgatgaaatacttcagttgtatttcgatattaattcatttaatactattatgcagttatatgatgagaattacgttacatgtgtagaaaaagactctcaagaagttgtattaacgctatattgcgtaaatccatctgaaaatttaaagaagtgtttgaaaaaaaattactcaacagtatttttttcagcaactctgtcaccaataaaatattatatagagatgcttggtggagagaatgaaagctatagattaaaattaccatcaccttttaaaaaagaaaatctcaatgtatatgtaagtccagttaatataagatataaatatagaatgagaactctgccaaatgtgattgataagatatgcagttttgttaataaagagattggtaattatatagtatttgctccatcttatgcatatatggaatcgctttgggaagatattttaaaatgtgatggtttagatatgtttaaacttataaagcaagaatctaatatggatgaaaaagaaaagagtgattttctaaaacagtttaaggaaaataataatcttcttgtattttgtgtattaggtggaatgttttcagaaggaatagaccttccaggagaacaacttatagggagtgttataataggggttggatatcctaaaatagcaatggaaaatgaaataagcaaagagttctttggagaaaatggatatgactatgcttatgtgtatccaggaataaataaagtacaacaggcagcaggaagggtaataagaacagaaaatgacgagggaagagttctattgattgatgatagatacattactcctcaatataatatactgttgccttcagagtggtatcctataaaaaaattttaattaaaaaaatagtattatattgaaaaacaaaaagtttatttatctatttaagtatgttaaaatattcatgttagtttataaataaaaataattaataataaatatattaaaagttaacattaaggagcgaggaaaatgaatattccattaattgacttaaaagctcaatataaatctatttctgaagatttagatagagtaactaaagaagttttatcttctgcagcttacataatgggtaagaacgtaacagagttcgaaaaggaatttgcagaatatataggagttaaacatgcgatatcagttggaaatggaactgatgctttggttattgcattaaaatctttaggaataggccatggtgatgaagtaataacttcaacatttacttattttgcctcagcagaatgtatttcggcagttggagctacaccagtttttgttgatgtagaaaaagatacattcaatcttgacccatcaaagatagaagaaaaaataactgataaaacaaaagcgattattcctgtacatattttcggacagagtgcagagatggatgaaataaatgaaatagctaaaaagcataacttaaaggttatagaagatgcatgtcaagctgtaggtgctaaatataaaggcaagatgattggaacattaggagatgcagcatgtttctcattcttcccaacaaagaatctttcatgtgctggtgatggtggaatgatagttacagataatgatgacattgctactattgcaaaagcattaagaactcatggaagtggggaaacaggtcaaaaagcatataacctattaaataatattacagaagacattaaaacatcaaaagatggtgatgatacagtatataatccattaaaatattataattatctaatcggttttaattcaagattagacgctattcaaggtgctatattaagagttaaattaccacacctagacagttggaatggtaaaagaagagaaatagcagaaatatataatgaaaaatttaaagatgcagatgttgttacaccaataaacagagaagaaaatgaagttatatatcatcaatatgtattacaatgtgacgatagagaaactatgttaaataaactaaaagaaaaaggtgttgcaactggagtgtactatccagtacctttacatttacaaaaggtgtatgcagatttaggttataaagaaggtgatatgcctgttgcagaatatctatcacatagaacttttgcaataccagtttatccagaattaacacaagaacaaatagaatatatagttgatgcgataaaatagttaacagttaaagattatataaaactgttaactgttacttgttaactgaaaaaggggagttaattatggaaaaaaagtattttgtacatgaatcaagttatgtagatgataatgtcaaaattggagatggaacaaaaatatggcatttttcacatgtgatgagtaattctgaaatgggtgaaaagtgtaatatagggcagaatgtagttatatctccaggagtaaagcttgggaacggagttaaaatccaaaataatgtatctgtttatacaggtgttatttgtgaggatgatgtatttttaggtccatcatgtgtatttacaaacgtgataaatcctagaagctttatagagagaaaagctgaatatagagaaactataattggaaaaggtgcatcaattggagctaatgtaacaattgtatgtggacacaatataggaaagtttgcattaattggagctggtgcggtagttactaaaaacataccagattatgctttggttatgggaaatccagctagaataaaaggatatgtatgtaaatgtggtgaaaaattattatttaaaaatgataaagcaacatgtactgtatgtggattaaattatactaaagctgatgaaaaagttgaatgtaacgagtaattttaggataattcaattaaatttataacataaatagtaatatgatcatttgtattgattataggaggtataacatgtcagtgttaaagcaacaattattagataaaataaataataaaactgctaaagttggggtagttggtcttggatatgtaggattaccattagcagtagaaaaagctcatgcaggatatcaaactataggttttgatgttcaagataaaaaagttaatatggttaatgaaggtaaaaactatataggagatgtagtagatgaaactttaaagaagttagtagaagacggttctttaaaagcaactacagattttagtttcgtaaaagatgtagatacaatttgtatatgtgttccaacaccattagatttgtataaacaaccagatttatcatatgtggtttcatcaacaaagagcgttgcacagtatcttcataaaggtatgttagtaatacttgaaagtactacttatccaggaactactgaagaagttcttaaacctatattagaagaaagcggattaaaatgtggagaagatttcttcttagcattttcacctgaaagagtagatccaggtaataaacaatttaacacaaagaatacaccaaaagttgttggtggatgtagtgaagattgtacagaagttgcagcagcattatatagaaatatattagaaggagatatacatacagtatcatcaccagctgtagctgaaatggaaaaaatattagaaaatacatttagaaatatcaatataggtttagctaatgaaatggcaatactttgtaatagaatgggtatagatgtatgggaagttatagatgctgctaaaactaaaccatatggatttatgccattttatccaggcccaggcttaggtggacattgtataccacttgatcctttctatttagaatggaaagctaaagaatatgattatcatacaagattaatagaaacttcaggtgaaattaatgattcaatgcctgaatttgtattagataatgttatgaagattttaaataaacataagaaagcattaaacggagcaaaggttctaataatgggagttgcttataagaatgatatagatgattacagagaatcaccagcatttaaagtaatagaattattagaaaagaatggtgcagaccttatggttaatgatccatattgtccagtatctaagtataaggataaaacatatcattcagtagattggacagaagttatagatgatgctgatatagtaattgtaactactaatcacagttgctatgattatgaatcaatggttgcaagagctaaagtagtatatgatacaagaaatgctactaagaacgttgttaacaatagagaaaagatttataaattataataataagtaaagagcagaaaaattgttactacaacaatttttctgcttttttgtattttataaggaatatgaaaataaactttaataactaagaattatttggttaatctgtcacctttttgacatatgaaaagtgcataatagttattgtaaaaaggatttatttttatataacgttagtaataattatgaagggaatattctgagatgaagataaaaacaagttttttcattgcagcatctgtagttattgcagttatagttggaattaatcagtttttaaatgttcaaataggaattttaaaaaatattaaggacctttcggcatttggaaaacagtatggggaccatattaaggacagcagtataattgcaaaagatattttagatgatagcaacgatttatttttattcggttcatcagaaatgtctattaatgttgaacagaatagtataaacctatttccgataaaaggtgcagattataatataagctgctttggaagaggatatgttcagaatttacagcaggcaacatacattggaggaagtgacttaaaacctactcaaaaggtggcatatatactgtcgattcaatggtttgataatgcagatggcgtaaaggcagataattttgcaacaaatttttcggaaatacagttttataattttttaaataatcccaaaataagtgatgaaaacaagcaatactatgcaaaaagggtttattcgcttttagagaaggctgataaatatccagcagaagcattatatgcaagattatattcaaatcctaatgtattaaaaaaatcacttatgtttattatgagtccgtattataaaataagtaattatctttctggaattaaagataaggcattaatctataaggaaatgaataaattacctgaaaaaaaaccagaagaagaattggaagacataaactgggatgaagaagaaaagcaaataaataaggaacacagtgaagaggtttctacaaaccaatttcatctaagagatgattattataataaaaatataaaagatcatatggattatcttgatggatgtttaaagggaaatgatgctttatcatcagtagaaatgaatgattttaaatttttcttaagtgtatgcaaggatttagacataaagccatatataataatgccaccagtaaatggatggtactatgattatttaggactaagtaaagaagaaagagatcaatattataataaaatagataatttatctaaggaacaaggacttgatgttttagatttaagaaattatgagtacaagcaagattttttaattgatgttatgcatcttggagaagaagggtggcttaaagtaagtgaaggaatatataatcattttaatgaaaaataaggaatttaaaagaacagtattgttgtcagtaacaatttcattagcattagtagtgtattttttctattcagcatgtgatattccatttgtttatagtcaattctgagtattgaagaattaatataataagattatggagaggttaaaatgtcgttagaacaatatggaagttatttttatttatatatattattaatacttttaataccagcagttattttaggtattagaggtaaattaataaggccttatgggatattcttttcagcagtaatgatagtaataattatgggatggaaagttgacactgtgtttggttatcttataaagggagattttattaatgcattaaaatcttctcaaatacaaatattcttatttcttatatttttattaggagaaactatattaataaaagtatattttgaaataagaaaggctacagaaaacaagtatatatatttttcagctttaataatgtgtatgttccctgtaatacttttaaaaatatcgccattaactgatattggtgctattggatttataggactttcatatgttaattttaaggcaatacagatgattattgaaatatatgatggaagtataacggatcttaagattattgatttagtatatttcatagtttttgttcctacattgagttgtggtccaatagatagatacaggagatttactcaggattcaaaatatgttattggcagagacaattatattaatgaatatatttctaaaggaatagaacatattttaaaagggattttatataaattctgtatagcggcattgataagtactttatggatgaataagataccaaaggatgtaaatctattaaattctataaattatatgtatgcttatagtttattcttattttttgattttgcaggatatagtgcctttgcaattggtacgagttattttctaggaataaagacaccagagaattttaatatgccgtttttaagtaaaagtatgaaagaattttggaatagatggcatatttcattgtcaaagtggtttggagattacatttattctaggtttgttttaaatagtatgagaaaaaaaagatttaaaagtagaatatatgcttcacatgctggacaattaattacaatgtttataatgggagtttggcatggattaactccatattatattatttatggtttatatcagggcgtagcgttgatattaacagatatatatgagagaagatcgaagttttataaaaaacataaaaaagaaaaatggtttcaatatatgcaggtagtaataacctttaatgtagtatgttttggattattaattttctcgggatatttgtttggtaaatagattagagtatcatagtttgaaagtatatttagactatgatactttttttatttataagaaagtataatgttttaatatatttgtaaaaagaatggtgaacataagaatattatatttgaaagtagagtagcatatagtatatgatataatctacagggaagaatatattagaaaaatttatggaaaggaaatttggtgattaaatgagcaattttaaatttagtataagacgtcaaataaacttattaatacatcttattgtgaagataaagaaggatgacgtttttgcattatcatctcagcttgcatattatttaatattatcattttttccattcatgatatttttgataacacttataggctttagtcacttaagttctgtagaggtattagataatttaaatgcaattcttcctacaagtattgttgatttaactaaatcaattattgctgaggttgttgataatcagcatacaggattattaggagtatcagttttgttaatgatatggacttcttcttcagcatttagagctgtaattaaaggtgttaataaggcatatggctttaaagaaaacagatcctttattaaaaggtcaataatttctatgatagggataatattacttgcagtaataatattgcttgcattagcaatgcttgtttttggaaatgtaataggagcttatataataagcagaatacctttttataaaataataatatttttgtggaatatgtttagatatgcttttgtatttattgtaatgatatttatatttgcattgatgtacatgtttgcaccggcaaaaagattaaagttgaaagaagtggttccaggttcagtgtttagtactatgggatggattggagtatcttttggattttctttttatatcaataattttgggaattattctagattttatggaagccttggagctgtttttattttaatgacatggttatttttaatatcaatgatatttattctaggagtagaaataaattgtgttatgagtcaaataaaatataaatctgtaaataacgaatattaggtaatatgtaacaatgtatgttagaatttctacgaaatttattgtattatatcagaagttatattatatattttgataatgatgttatacaacctagtattatataaagagaaatataaaaaatatttaaaattttgtatattattttgttttatggatataaattaaaaggaaaattactgtggaggtatatttatgaacaaaataatattattaggacgcttaataaaggatccagagttgaaacagaatgaaaatggagataaattatatacccgttttgtaatagctgttcaaagaaactttaaattacctgatggtacaagagaagctgattttataacagttgtcgtatggggtaaaaaggctgaaattatatgtaagcatacgcaaaaaggaagccttataactgtaagtggaagactaagaacaggaagttatgaagataaggatggaatcaaaagatatatagcagaagtagttgcagaagattttaaatttataagtactaaaaaagaagtacaaaatgaagttgaagaaagctgttagctaaaatgctagttgtaataaagaaaatttattgaaaataaattttaaatgttttaaaaaaaacatattaaaaccattttaaaaataaaaatatattcaataaatgtaaaagatatattttgtctattacatttattggaatataaagaaaaataacattaaatataaaaaaacttgcaaaaattgaaaaatatgatataataaaaatgtaaacgatatctaagcgtttttcaattatggtttaacaaaaaaagagattatgagataaaaaaagagttctgttgaactctttttttatttgtaaaacatattaaaaatacacacgttataagtagttataaaaatctataattcgacaaatataataaaataatcgacaaaatttaaaggtattatgttggaaaaaacaaatgttgagattttattgtcaataaaaaatatacgattctttaatattgtgtacatgctttgacaatttataatttaataatgtgctaatattttattgtaatattgtttgaggggttgaagtattatgaatattgcagatgaatatgtatgtaatagaaaagaggataacatggaattcaattacagttacagactaattaagtcagattatagaggaacaccagtatatggaatcgaaatagagagaaaggattatatagggataaaaaatattaatatcgaaagagataaggtgactatgatttcatttgaaaaggataaagcagaagatatacttaaaaaactttatcaaaatcaactatcgcccatacatttagttgacataataggatgttatgctgacgaattttcatatgaagcggattatagaaattatagtgaaaaaattaactaaacattgatacttagaattatttttttcgcttctatgtggtaagatattactaaaagtgaggcgataaatatgattatagggataggaacagacataattgaaattgagagaatcgaaattgctgttaaaagaacaaaggggtttataaataaattatttactgaaaatgaaataaatatatttgaatcaagagggttcaaaagtgaagttattgctggaaattttgcggcaaaggaagctgtaagcaaggcattaggaactggatttaggggttttggagtaaaagatattgagatattaagagatgaattgggaaagccagtagttaatttaaatagcaatgtatatgaaattttaaaaagaaaagatgttaatatacatcttagcatttctcataatagaacaagtgcaatagcttatgctgttatggaggtagtagaatgatagaagtttttcatagagataaatgcagaaaaatggatcaagaagctataaaccagtatggaattccaagcattgttttaatggaaaatgcggcaagaggtatttttgaagatatatattataagtgggattcgtttcttatattatgtggaaagggaaataatggaggagacggattagcattagctagacatcttgctattgagggaaaaaacgtaaaagtagtcattataagcaaggatgaaaattatagtcaggattttaaaactaattttgatattataagaagaattcttgataatgataagataacgtacatcaaaaatgaaaatgatatcacagaagagtttatcaaagatttaacatattatgatgttactatagatgggatttttggagttgggttaaatagaaaattagatttttggattcagaatcttatatgttgtatcaataaatatggaaaatatatagtttcattagatgttccttcaggtttagactgcaatttaggggtagagttagatattgcagttaaagcaaaaataacatatacatttgaagtcataaaaaggggttttttaaactacaacgcatttaaatttataggaaaagttaaaattataaaaataggtattccacaagtggtaagaaaaaataatagtgataatttatatattcttgaaaatgaagaatacaagaatataattccatcacgaaagttatatggtcataaaggtgattacggaagagctttaattgttgctggtagtaaagggttttcaggtgctgcatatattacaacagaatgtacaataagggctggtgctggtcttgtaactttaggatgtaaagaggaaatacaagatatattggctgaaaagttaattgaagccatgacagtttcatgtgagtcttctaagtttgggtcaatcatagaaaaatcagattcaattgcatttggaccgggaattggaactgataaatatgaagaagaattattacatgaagtgatagataaaagcaaatgtccaatagtaattgatgcagacggcattacaattttagcaaaaaataaagggatgttagaagaattaaaagatagagctataatcactcctcatccaggagagatggcaaggcttttagggttaactgtaagtgaagttgaatcagatagaataagaatagcctcagaatttgcgaaaaaatatggaataattgttttgttgaaaggttacaatacaataattacagatggaaataatacttatataaaccctacaggcaatagtaaaatggcatctggaggaatgggggatgcattgactggaataattaatgcatttatttctcaaaaggttaatattttagatgctgctctaataggagcatatatacatggatatatagcagataagttaagcaaggaagtttacatattaaatgctagagatattattaatgaaatgccgagagttattaatgatatttgtttaaaatagaagaataaaagtcctttaagtttcataatagtaataaagtaataataaatcttggaggactaatggattcggataataaaaaaaataaatttaaaaaattactttggttattgatttttgtgcctatatgcatttttgcagttatcatttttagcaggaaaatggtgacaccatcaaatgaagaaattattgataagctatataatacaaaaaattatagttgtaaagttgaatatacttttattaattctaaagatgagtataaagaaaatactatgcaatactatagtggagataatggaatgcgcatagaatttcaagatgccgatggacgagtaaaagtatataaaggatcagagattcagatgcaaggggaaaatggcaaggattatgtagttgataaaaacatagatgaaatatatcctttggcgtttataaacaatattttagataagagtgtaagtggagagctagaaacggtagatacggaatggtcagataatgaatatataaaagtaaatatagactatccagacggcaataaacatattgataaaggtgaattttatgtagataaaaaaacaaaatctccagtattattaaaaatatttgatgatgagggtaaggagagaatacttatatcatacaaagagttcaaatcaagcaaagagagtgatgaaagtttattttagaaatataattaatgatttactaagaaaaatgagtgggttacatatagattaaggaatcattaaaaacaaaagatgtttaaaataaatataggaatgtcttaaattattaacattgtgatatttataagagtgtttaatacataatatatgcacgttttttggagggtacttacaaaattcaataaaattgtacattaaaattgtatagaatatatgaatttttgacaaattgacataaattgtaatataatcatagttaggtaaaatatttacttctatggaggcaaagatgtcaataattgatttaaatagaataaagaacttaaaaataaataataaaaaaattataaaaagtagtagagttaagggtaaatcattaatacaatgtattgatgaagatatttcagcagattttgaagaaatgatgaaaaggggttacattgaaatggctgaaataaatctagagtactctatgataggctctgaatatatgttagacgatgttaatgagtatgaggcatggatttgcggagtgtgataattagaaatggcaaacattgtggtaaaaagaggggaaattttttatgcggatttaagtccggtaataggttcagaacagggtggaataagacctgtaattataattcaaaatgatattgggaatagatatagtcctactgttattgttgcggcaataacatctcaaataaataaagccaagctacctatacatgtggagatatcttcagaagaatatggactcaatagagattcagtagttttattagaacaaataaggactttagataagagaagacttaaagaaaaaataggacatatgactgaagctgatatgaagaaagttaataaagctcttgctatcagtttgaatctatcttgagttaaaaataaaaagaattttaagggttatatagtatactatataaccctttgtgttattctaaaaacattaataaaaataaaagtatatcataaatttaaatagtgtatacaaaataaaaatattatgttacaatgtaaaaagcgaaaaacaaaataattaaacttttaccagggggttcagcaatgaagaataaacaagagctagaaaatatttctaagctaattagaaaagacatagtaactatgcttacagaatcagcatcaggtcatccaggcggatcattatcaatagcagatataatgtcagttttattttttgaagaaatgaacatagatccaaaggattctaaaaattcaaacagagatagatttgttttatcaaagggacatgctgcaccagcattatacagcgctttagcaagaagaggctatttagaagtagaagagttaaatacattaagaaaaatagattctagattacaaggacatcctaatatgaatgatttaccagggattgatatgtccacaggttcattaggtcaaggtatatcagcagcagtggggatggctttagctggaaaattagataaaaaagattacagagtatttacaatattaggtgatggagaacttgaagagggtcaagtttgggaagcatctatggcagcagcacattataaattagataatttaactgcctttgtagataataatggattacaaatagatggaaatattgaagatgtaatgaacccaggtcctatagataaaaagtttgaagcatttggttggaatgttttaaaaattgatggacatgattttgatcaaataagagacgctataagtaaggctaaagaagcaaaaggtcagcctacagttatagtatgtaagactataaaaggtaaaggcgtttcatttatggaaaatgaagcaggatggcacggaaatgctcctaacaaagaacaatgtgaacaagcgcttaaggaaattggaggggaaaactaatgggaaataaagtagcaactagagaggcttatggaaaagcgttagtaaaactttcaaatttaaatgatagagttgttgtattagatgcagatctttcaaagtcaactaaaacagcagattttaaaacagctgcaccagaaagatttataaatatgggaatagcagaaggtaatatgatgggtgttgcagcaggtcttgcaacatgtggaaaaataccatttgcaagttcttttgcaatgtttgcagcaggaagagcttttgaacaaataagaaattcaatatgttatccaagattaaatgtaaaagtatgtgcaacacatgcaggattaactgttggagaagatggagcaactcatcaatcagttgaagatattgcattaatgagagctatacctaacatgacaattataaatccagttgatgcagtagaaacagaagctgctattttagcaattgctgaatatgaaggtccttgctatgttagattaggaagactagctgttgaaactgtaaatgatgaaaataattataagtttgaaatcggaaaaggaatcacattatcagaaggtaatgacgtaacaatagtagctactgggatgatggttcaattagcattaaaagctaaagaagagttgtcaaaagaaggaataaatgctaaaataattaatatccacacaataaagccaatagattgtgaattattagttaaagctgcaaaggaaacaggagctattgttactgctgaagaacacagcatagttggtggacttggatcagctgtttcagaagtcgtaacagaggaattcccagttccagttgttaaagttggaattaaagatacatttggtgaaagcggaaagccagatcaattattagaaaaatatggcttaactgttgaatcaattgttaatagtgcaaagagagctatatcattaaaaaaataatatattaaggtatatgcttcgattatagagataactacagagtatagaattttaataattctactctgtagttttttgcattattaaggcattataaaaaaataaaaaagttaatccctatgccaattttttataatatttggacttgctattttctctagtacgtttaaataataaatttcctttgcataagatagataaatttaacaacaatataaagtgaaactttttagatagagttttttctatagataaatttagttaaacttatcctaaagttttcagtagctatacatggtgagaggtagagttactgatgttagctataggataagtaacaatatgcataaaggggaataaaataatgaataaaaaagattttaaaagttattcaataattacatttggaattatattagttgctatttcagtagagtatttttttgcacctaataatttagcagcaggaggagtaacaggagctgctattgtagtgaatgctttaattcctaatttatcagttggagtattgacctttattatgaatgctgcattatttgtggtggcatttatgtttattgatggaaattttggggttaaaacaatatatgctagcttaggtttatcagtaatattatggattattgaaaaattctttaatcctgtagctataacaaatgacgttcttatggctactatatttggtactattatttctgctataggaatggctattgtatttaacgaaaatgcatcaacaggaggtacagatatattagctaagatgctaaataaattttttcatttagatattggtaaatctcttttagttgttgatttcgtaataacatttgcaagtgcacttgtttttggaatagatttaggactatatgctatattaggtgttattttacttggaatacttgtagatagatttatcgaaggatttaatgcatgtaaaagtattttcataatcagtcagaaaaataaagaaataagtcaatttataatgaaggaattagacagaggatgtacttttctaaaagcagaaggtggttatacaaatgcagaaaacaatgtgatttatgcagttgtaagcagaaatcagtttataaaacttaagaattatataaaacaaattgatagcgatgcttttattgcagtaggagaggtacatgaagtactaggagagggatttaaggacataaaacaggattaaatgttaaaaatagatttttatgtataattttatacaattagagcacgaaaaacaacaaattttattaatataattgtaaaaaaattacgataagaaatatatatttaataaaattgtataacatataaaactattcttatgttataattaattttgtagattttgcaataaatttgcaagatatacagattaaaaaggagtgttcgagtatgattgaatttagaggtgtatctaagatatatgataaaaatgtaaaagcgctatcagatgttaatgttgaaatagaagcaggtgaattcgtattcttagttggtcctagtggatcaggaaagtctacgtttataaagatgttattaaaagaagtagaacctactaatggtaaagtaattgttgcagataaagatttatcaaagattactagaaaacaggttccttattatagaagaaaaattgggatggtgtttcaggactttagattaataccaaaccttaatgtatatgaaaatgttgcatttgcaatgagagttgtagaagcatctccaaaagaaataagaagaagagttccaatggttctatcattagttggattatcacataaatataaaatgttccctaatgaattatcaggaggagaacagcaaagagtttcccttgcaagagcattagttaacaatccatcagtgttaattgcggacgaacctacaggtaaccttgatccagatacagcaatggaaataatggagttacttgatgatataaataaatctgggactactattttaatggctactcatgctaaagagatcgttgattatatgaaaaagagagttatagctattgaaaaaggagaaatagttagagacgagaagagaggtaagtacgaagatgaaaattaatactataacctattatattaaagatgcttttgtaagtttaaagagaaacaaaactattagtattgcatcaataataactgttcttataacgttttttgttcttggaatatttatgcttgttgcaactaatatcaataaaggaatagaaaatgttcaaagcaaagttgaaataaagatatttttaaaagatgacataaagcttattgatcaaagggaaattgaaataaagctaagagaaatagatggtgttaaagatgttatatattcttcaaaagaagatgaatatagaaatttccaagaaactactaatgaaaatgaaggtttattaaaaggttatacatttgataataatccatttcaggcagcatttacagttaaactagaatcaccagaatatgcttcaaatgtaggtgaaggaataaaagattttgaaggtgtagattcgattcaagatcaacaggcattagttgataaagttgttggtatagttaaaggtgtaaaaactgtaggtataggattgtttgcagtattagttggtgtttcaatattcttaataatgaatacaacaaagcttactgtttattcaagaagaagagaagttggaataatgaaatttgtaggggctactgattggtttataagatggccgtttgtcattgaaggtatggtaattggtcttgttggagcagtgtttgcatgtgtagcattattctttgcatataaaggattatttgtttggattgcttctattttatcatttgtaagcatagtaaatcctatgtatattataagtaatttattatggcagtttgcaattggtggaattgtggttggtggaattgccagcgtaattgctttaagaaaattcttaatagtataattttaaaaaaaaagcataaaataattagtgttaatgcctctatgagaaaagattacttttcttataggggtttacatagtaattagactaatttattatgatttttatgtatagttttatacatggggaaggaagttttatacatgaggaagtcgaaaaaaggaacgtttgcaaggaataatacaaaaacttcaaaaaagtcaataatattgattgcatcattgatgataattttaagtgtatcttctttaatgattggaaactatatagctactaaaggcatattttttgtgaaaacatcagaaaacgttaagagtacagcatctcaaattaatgatgccagtaaatattcagcattatttacagtaagagatacattgattgaaaagtatgatggagaaataaatgatgatgtattacttgaaggtgcgattaaaggtatgacaagtgcactaaatgatccatacacagtgtttatgaataatgatgaatttgaaaaattaataaaacagagtaatggttcaatgacaggtattggtgttaatattgcaaatttagataataaaatagttattgtatcaccaattaaagattcaccagcagaaaaagctggtataaaaagcaatgatgttatagaaaaaataaatgatgttgcatatacaggggatcagcttagcgaagctgtaagtgttatctcaaattctgtaggaagcgaaattaagtttacaattgacagagaaggaactaatccatttgatgttgtaataaagcctcaagaagtaaaattaagtgtaattgatggtgaaatgcttgattactcaatgggatatataagaattcactcatttatgaatgagaacacaacagaagattttaaaaacaaaattgaagaacttaaaggacaggggatgaaaggtcttatagttgatttaagagaaaatccaggaggtcttttaagtgaagcagttggtgttgcatcgcaatttattcctaaggataaaattataacttatactgtagacaaatatgaaaatagaaatgaatccttatcagttggaggaattgcagaaggaatgccattagttatacttgtaaatgaagatagtgcaagtgcatcagaagttgttacaggtgctctaagggattataaagcagcaacaattgttggaaacacaactttcggtaagggaatcgttcagcagacagtaaggtttaacaatggtattggaggactgaaagtaacaatttcaaaatactacacaccaaatggagaaaatattcacaagataggaattgttcctgatgttgaagtttcaacagataataagtttgattctcaaggatataataaagatcaagataagcaattgaaaaccgcaatagatgaattaaataaaaaaatgaattaaataaaaaggggaattattgtatggatatagttatttctactttaagaagtatatgtagtgcaatcttattccccccatcagtatttatattgttagcactgcttgttattttttattttaaaaataaaaaaagagcagcaatgcagaaaatgatagttggaggtagtgtagaatcggcaattgaacttacactatctcaatttgtttttggcgtatttggggggattataggaagtgtaattttaaatttatgtggagttgtttttaatgaaaactgcagaatagagatattattttttacatcaataatattaatggctataaaaccatctttagtatgtttttcatattcagcttcacttttaggagcaataagcattatattgaagatatatggaatgatatcttctgatgtaaattatacaaattattttaatttggacatactttatataatgatatttgttggagttatgcatgttgttgaaggaatattagtctctttagatggtcataggggagcagttcctatacttattaagaaggaaaatgaaattctaggtggatattcattaaaaagatactggatacttcctttagctataatgattatggctaatatgagtgagttgtatggtggatttaataatgtatctttaaatgatataccagcttattggactctatttaaatctcaagatcagattgatttattaaggtcaatatttatatcattgttgtctttttatgcagttgttggatattcatcagttacatatacaagaacaaaacgagaaaaagcagtatcatcaggaatacatatttctatttatggagcgttattaattcttgtggctcaagcagcaagaataggattattgggagaaatatttgtggttatttttgcaccagttgcccatgaatttatgcttaagattcagagaaataaggaaatgaaaaggcaacctaaatttataagtgatgaaaatgggcttgtaattttagagataggtaataattttaaattaaaagatttcaatatggacataaatagcaaaataatttctgttaataatgaatctttaaacagtgaaagggatatttattctatacttaagaaaaatttatcgagagcggtaattaagtttgaagattgtaacggtgttataaaagaggtaaattatgtacatgataatagtagaattggagctctatttgtaccgtttaataagagtgaatctcaaaaaactgatgattcagagataagagaaaaaagctttaaagatattttgaataacgtaaataaaaacaataattaaaagtatttataaaattcaagcagttatgtgaaattgcttgaattttttgtacataataagaatataagaactggattaattataaatcgaaacccgaaatatattaagttttatttatataataacctgttgacttactgaataaggaaaagtacaatagtaaatatattacgaatgtttgttcgagaaaaaattatggataggaggaattaaagtgggagagtttaaaattcattcgaaatttaagcctacaggtgatcagccacaggctatagaaaaacttatagattcaataaaccatgatcatagaggccagacacttcttggagtaactggatctggaaagacttttactatggctaacattatagagaggcttcagaggccaaccatagtacttgcacacaataagactcttgcagcacagttatgttcggaatttaaagagttttttccagataatatagttgagtatttcgtatcttattatgattattatcaaccagaagcatatgtaccacagactgatacttttattgaaaaggatgcatctataaatgatgaaatagataaacttcgtcactctgcaacatcggcattgtttgaaagacgtgatgtaataatagtggcatcagtttcatgtatatatggacttggtaatccagatgaatataaaaagcttacgttgagtttaaggactggaatggaaaaagaacgtaatgagataataaagaaactcgtagaaatacagtatgagagaaatgatattgatttttcaagaggtacatttagagtaagaggagattctttagatattattccagcatcatattcaaataaaggcataagaattgaattttttggagatgaaatagacaggataagagaatttgatgtacttacaggaagtataattggagatagaaatcatgttgcaataactccagcttcccactttgctacatctaaagaaaccgtagacagagcaatagggaaaattgaagatgaacttgaagaaagattaagagaacttaattctcaagataagcttttggaagcacaaagactaagacagagaacaaattatgatattgaaatgataaaagaaatgggatactgtagtggaattgaaaattattcaagaatactagatggtagagattcaggaacaccaccaaaaactctcttagattacttcccagaagatttcttaatgttcatagatgaaagtcatgtaacacttccacaggttagagctatgtatgcaggtgatagatcaagaaaaaatacattagttgattatggattcaggcttccttgtgcatatgataataggcctttaaagtttgaagaatttgaaaagaagataaagcaggttgtatttgtcagtgcaactccttctcagtatgaacttgataattctgaagaaatagctgaacagataataagaccaactggactccttgatccagaaattgtaataagaccagtaacaggacaaattgatgatttatatggtgaaataaataaaacaacagaacgtggattcagaactcttgtaacaacacttacaaaacgtatggcagaagaccttactaagtatcttacagagcttggagtaaagactacttatatgcactctgagattgacactatagaaagaatgaaaataataaaagatttaagaactggagaatttgacgtacttgttggaatcaatcttttaagagaaggacttgatataccagaagttgctcttgttgcaattttagatgcagataaagaaggatttttaagatctgaaacatcattaatccagacaataggaagagcagcgagaaattcagagagcagagttataatgtatgcagataatataactaaatcaatgaataaggcaattaaagaaacggaaagaagaagagaaattcaaacgaaatataatgaagaacatggaataactcctactacaataattaaggatgtaagggatgttatagaagctacaaaagttgcagaagatactgcagaatataaaactgacgaaaataagaagcttactaagaaacaaagagataagcttattaaagaatatacaaatgaaatgatgcttgcagcaaagaacttacaatttgagagagcggcagaacttagagacataattaaacagttaacaagtaacagttaacaagtaacagttatatagaaaagctttcggctttttaattataatgatggattaaaatagattgaaaaagcaatctaattactaaataaaatatagaaatcccttaagggatttcattaaaaacagttaactgataacagttaactgttaactgaaaaaaggggtgtaattagtgaacgataaaatagtaatcaaaggtgcaaaagttaataatttaaaaaatgtaagtttagaaatcccaagagataagttagttgttttcacagggttatctgggtcaggtaagtcatctcttgcatttgatactttatatgcagaaggacaaagaagatatgtggaatcattatcttcttatgcaagaatgttcttagggcaaatggataaaccagatgttgagcatattgagggtttatcacctgctatatctatagatcaaaagacaacaagtaagaatcctagatctacagttggaacaataacagaaatatacgactatttgagattgctttatgctagagttggtattccacattgtcctaagtgtggaaaggaaataactaaacaatctgtggatcaaattgttgataaaatcatgagttatggggatagaactaaacttcagatattatctccaatggtaagaggaagaaaaggaactcatgaaaaattattagaaaacataaagaaaaatggatttataagatcaagaatagatggagaaatttatgatctaactgaggaagaagttactcttgataaaaataaaaagcataatatagaagcagttgtagatagaattgttattaaagaaggaattgaagggaggcttactgaatcaatagaaacagctttaaaaatgggagaaggtttagtaattgcaagtattattgatggcgaagaaactttatttagtgaaaactttgcatgtcctgattgtggaataagtattggtgaacttgctccaagattattttcatttaattctccatttggtaaatgtgatcattgtgatggtcttggaactcttatagaaatagatgaaaagcttgttattccagattctaatttaagcataatggaaggcgctgttgcaacatggggtgctggaagattaaaagatgattcgtggacatatgctatactacaggctttaagtagagaatatggtcttgaacttgataaacctataaaagaccttgataaaaatcaagttgaattattgttatatggaactgatggaaaaagaattaaagttgattatgtaaaagatggtgttaaggctacatataattattcttatgaaggtgaaataaattctcttaagagaagatacaatgagactaattctgatgttataaaaggtgatattgaacaatacatgagtgatgctcactgtcctaaatgtaaaggtgcaagacttaaaaaagatgctcttgctgttactgttggaggaaaaaatatttatgaatttacaataatgtctataaaggatgaattagattttataaattgtgttgagttttcagaaaaagataaaataataagtgaacagattataagagaaattaaaaatagattacagttcttattagatgttggtcttgattatctaagtcttgcaagaaactcagggacattatcaggtggagaatctcaaagaataaggcttgcaacacaaataggatcatctcttatgggagtattatacatacttgatgaaccaagtattggacttcatcaaagagacaacgatagactgattcagactcttaaaaatttaagagatgttggaaatacagtaatagttgttgaacatgatgaagatactataaaagaagcagactatatagtagatattggtcctggagctggggaacatggtggtgaaattgtagctgcgggatccttagaagaaataaaggattgtgaaagatcattaactggtcaatatttaataggaaagaaagaaattaaggccccagaagagagacgtaagggaaatggtaatctaataaaagttattggagcaaaagaaaataacttaaaaaatataaatatttctataccactaggaactttaagtattgttacaggtgtatctggatcaggaaagagtactcttgttaatgaaatattatacaaaggattaaataaaataataaataaaagtaagaatccagttggtaaacataaagagatacaaggatatgaaaatattgataagataatagatataaatcaaagtccaataggaagaactccacgttctaaccctgcaacatacacaggaacttttgatattataagagaacttttctcacaaacaaatgaagctaaaatgagaggatataaaccaggaagatttagctttaatgttaaaggtggaagatgtgaagcttgttctggagatggaataattaaaatagaaatgcagttcttgtctgatgtctacgtgccttgtgaagtttgtaagggcaaaagatacaatagagaaactttagaagtaaaatataaaggtaaaagtatttcagatgtattagatatgaccgttgaagaagcacttaagttctttgaaaatatacctagaatagaaaataagcttaagactttaaatgatgttggattaggatatataagattaggtcagccatcaacacagctttctggtggtgaagcacaaagaataaagcttgcatcagaattatcaaagagaagtacaggaaaaacattatatattttagatgagcctacaacaggattacatatagatgatgtaaatagattagtagaaatacttcaaagacttgttgatgctggtaatactgttgttgtaattgaacataaccttgatatgattaaatgtgcagattatttaattgatttaggcccagaaggtggagacaaaggtggtactattattaagtgtggaactccagaagaaatatgcaaagaggaaaaatcatatactggaaaatatttaagaaatatattataatttatgaattcattattacaaaagtggcatttcttatgtcatattaaattttttgttgtataatcaatatgtgatatagcaaatagatattgaggtgaaaatatgagcttttcaaacataatggtacaatttgtatttaaacctatttttatcatcatattatacgtaatactatactatgctttgaaaataatgtataaggacgttaagaatgggggtaaaaagagaagaccaccaagaactaacggtaattatggattagaaataataaaaagtggtgatgctaaggaacttaaggaaggatcaataattccaataagatcagacttaagtattggaagaaaagatggaaattctataattatggcagatcaacatgtttctggtaatcatgctcagattctagttagaaataatggtttatttttagaagatttaaatagtactaatggaacttatttaaatggaaataaattaaaaggaagagctaagctgtctaataaggatgaaataagaataggaagcggagtatttaagattttaacataattaattaaggctcagcaggtattgccttaggtatttagctgagtcttagaaaaatgtgttattttaaaaataaaaattagcagttgatactagagaaaatagaattactatttttgataacacataaggaaagctgtgattttcgttagtaactgtcaattgtcaattttcaattgtcaattgaaaatgaggtgagatatattgaaaataaaaaaagatgaaattgtattgctgattcttacatacatactttgcatggctctttttattaatttagcaattttaaaagatccaatggatactggtgccataaaaatgggattaatagtatgtgcatttgtaacagcaacacaagtattaatacgtaagttttatccacagggtgataaatttcttattacatttgcttgcatactttctgttataggaatagcagtaatgtatagactggatacaagtgtggcaataaagcaatttatgtggtttacagcagggattattgtctttgtaggtcttgtagttgcaattccagatatacggaatttttcaaaatacaaaaatgtatttttaatttcaacaatattaataatgccaatggcacttattgctggtaaggaaattaatggtgcgactaactgggttaccattggaggatttggttttcaaccatctgaacttggaaagataacctttgtgctttatttatcttcagcattaatgaattatgaagataaaaaggatatgttagaagattttaagcagttatggcaacctgctttagtttcaatgttttctttaggatgtcttgttatgcagaaggatttaggatcggctttaatattctttggtatagcacttacaatgctttatgtctctacaggtaagaaaaaatatgtcgcagtaacagtagttttatcagttataggtgcttttgcagcatatcatttattttctcatgtacaggcaagaatagatatatggagagatccttggagtgatccaaatggagctggatatcagattattcaaggtctttatgcaatttcttcaggaggaatgtttgggagcggtttaggtcaggggtatccaggatttgtcccagttaacacttctgacttaatttttgcagtaatatgcgaagaacttggaatggtatttggacttggaataatgataatatatttcttattcttctatagaggaatgagagcggcatttagagtaaaagataaattttcacagcttaatacaattggtataagtgcaatgattgcatgtcaggtactagttattattggaggagtttttgccgtaattccattaacaggtattacattgccacttataagttatggtggttcttcaatgctgacaatgttttttgctctagctatacttcagaagatatcggaggagggctaaaatgaaagataattcaaatagtataaaacaagtaatgatagtttttctattttgctttgtagctcttatatcttatattgcatattttcaaacattttcagcgccaggtatagcggaacagccaggaaataaaagaatttatgcagtatcaaatgaaattttaagaggaaccatttatgatagaaatggtaatgcattaactacaagcgaaagaatagatgcattaactcaaaaaagaacatacacaaaaggtgatttatatgttcatgcattaggatacaatagttcaatatatggagctgttggtcttgaagcaaaatataataaagaactgtcaacttatagcaaacttcaaaataatttttcaagtattattaatgattttagtattgataaattaaaaagtatgtttgaagaaagaaaagaagatgaagataaaattggaaatggagttgttacaactttagatccagtaatacaacaggctgcatataatgctcttggaagtaataaaggagctgttgttgcattaaatcctaaaacaggagaagtgttagccatggtttctaaaccaacatataatcctaatgatttaaaggcatcaatggatgcagctaatgcaggaagtgcagataattcaccacttataaatagagcaacagctgggttatatccacctggatcaacctttaagacaattacattaacaagtgctctagaaaatataggcggtataacaaatagaacctttaatgatgaaggaaagatagtatttaatgataaacagtcgttaagtaatgctaataatgctgtatatggtactattgatttaagagaagcatttaaagtatcaagtaatgtagtttttggtacacttgcaatggagcttggtaatgataaactaaaagctactgcagaagattatggtttcaataattcaatagaagcagagggaattacaattgaaaacagtagattcccaacgttaactgcaagtgaaaaaggaagtattgctcagacaggaataggtcaaagtagtatacttgctacaccaattcaaatggcattagtatcaagtactattgcaaatgatggaaagatgatggtacctacattagttagtaaagtaatagacaaagatggaaatgtagttaaaactgttgaacctaaagttcgtaaacagattatgaatagtactgatgcaggtataataaaagattatatgaagaatcttgttgattctaaagtaagtggatcatggagctatttccaaggcactaatgcagctggtaagacaggaacagcagattataaccttccaaatggaacacctgcaaaaccacattcatggtttataggatttgcaccagcagataatccaaagatagctttagcagtaattgttgaaaatggaggttatggttctacagcagcagcacaagttgcaggaaatgtaataaatacagcacttagatagttagcggttatcaaggaagaactaaaaagtttaagtgaaaatttttgaaaaattttatagttataatattaggcagatattctaaacgagtatctgcctaatataaaattaaagataagttccttaatagaaacatattttttaaaaataaaatttattaataaagataagctaactgaaaattgttaactgttaactgtaaactgaggaaaaggggaggtatataatgtttgattttaaagctcaacttaagattttacctgacaagccaggtgtctatttaatgaaaaacagcctgggtgaaattatttatgtaggtaaagcaaaagttttaaaaaatagagtaagacaatattttcagaattcaaaaaatcattctgaaaaagtaaaagcaatggtaaaaaacattgcagaatttgagtacatagttacagattcagaaatggaagcattaattcttgaatgtaatttaataaaaaaacatagccctaaatataatatttccctaaaggatgataaattttatccttttataaaaataacgacaaatgaggattttccaagagtatttataacaagaaactttgctaaggatggaaataagtattttggaccttatccaaatgcaggagctgttcatgaaactataaaactcataagaaaaatatttccacttagaacatgcaaaaagttaatctttgaaaatggtaaacatacaagaccttgtttgaattatcatataaaaaagtgtaatgcaccttgtgaagggcatatttcaaaagatgaatataaacgtatgatagatgagattatagatgtattgagtggaagagataaaagtcttattaataagcttaaaaatgatatgcaagaagcatcaatgaacctagaatttgaaaaagccgcatcatttagagataagattttagcaattgaaagtatagctgaaaaacaaaaggtatttaaatcacaagataatgatgaagactttataaatatatataaagatgaaaaagactgtgcagttcaagtgttctttttaagagatggaaaagttacaggaagagaaaatttcattcttgaaaacagtgcttatgaagatgattcagttataatatctcaatttatagtatcattttatggtggaacacctaaggttccaaagaatatatatataccattaagcaatgatgatgacaatgatgcacttgaagaatttctaacaattaaacgtggatcaaaagtatttgttaaggtacctattaaaggtgaaaagaaggaaatgcttgagcttgttaagagcaatgcaaaggtaaccttggatcagtttaaagataagattttaagagataaggaaataaatagactctgccttgaagaaattcaagaattattagaacttgattctatgccaataagaatagaagcttatgatatttcaaatattcagggagttgattctgttgggtctatgattgtttttgaagatggaaaagctaaaaatagtgattacagaagatttcgtataaaaactgtaaaaaatgctaatgattatgatagtatgagagaaatattagaaagaagatttagccatggtttaaaagaaattaaagaaatccaggaaaggcagcttaaattttcaagtggtaagttctctaattttccagatttaattatgatggatggaggaaaaggtcaggttaatgtggcccttgaagtgttacagaagcttggaataaatataccagtttgtggtcttgttaaagacgatcaccatgcaacaagagggattatttataataataaagaacttataataaatagaacttctaatcttatgcagatgataagacgagttcaggatgaagtacatagatttgcaataacatatcatagaagtctgagagataaaaagacacttcattcaatactggacgatatacctaatattggtcaaaaaagacgtatggctcttttaatgaaatttggaagtatagataatataaagaaagcaactgtagaggaactgctagaaacagaatctatagataataaggcagcaacaagcattatggcgtattttaaaaaccatgaacaaaataattaaactatgctataataatacggaataaatatttacttaaattaaaggatattgaataaaaatttacttgtattactttaatatatagattattctatatgatgtaaataaagtgaaactgacaaaaaatactttagtcagttaatacatattaaatataagttgttatattcaatatgaaaaaatagattaatattagcgtttgaggagtttttatcatgaatcagtatggaaaatataaagacttgtttagtaaaatatataatgagtcacaaattcaattggatgcaaaaatgagtgaacatatatactttaaagttggagggcctgtagatatacttttgactccaaataatatagagcaattaaaagaaactattacggtttgtaaagataataatattccgttttatgttattggaaatggatctaaccttttagttaaggatggaggaattagaggcgttgttattaaagtatgtgatcttaataaaatagaacgtatgggaaataagattaaagctggaactggtgctttacttaaagatgtttcaaaggaagcaacagaagcagctttagcaggtttccaatttgcatgtggcattccaggcagtgtgggtggcgctgtatatatgaatgctggagcttatgatggagaaatatcatttgtaattgaaagtgctgaagttcttgatgataatcaagaaattagagttttatcaaaggaagaattaaatttaggatacagacaatctgtagttatgcaaaaaggttatgtagttttaagtgctacatttgaattaattcctgacgatcatgataaaatacagtcaagggttaatgatttaactacaagaagagaagacagacagccattagaatatccttcagctggaagtacctttaaaagacccgaaggtcattttgcaggaaagcttattgaagatgctggattaaaaggatatacagttggtggtgcatgtgtttcagaaaagcatgcaggttttgtaataaataaagctaatggaactgcaaaagatgtattagatgtaattcatcatgttcaagaagaagttaagagacaatttggtgttgagcttcatccagaagtaagaattttaggcgaagattaatattaataagattagttaatggaactcaaaagtttataaacttgagagttccatttatatttaggaaaaactattaataattattaatataggtatatattgcagttgacaattgacatatgacaatggaaaattaagttgaaaatccatatagaattcttttgagtttaatacggaaaatttagtataaaatatatattatgtaaatacaaattaaaaattaagatagtaaagtattttatcaattgactataatattatgttataattttaatattgaaaaagtatctttagcaaaaggggagtgtgtaataatgagatttgttatagttacaggattatcaggagctgggaaaacacaagctacaagagctttagaagatttaggatatttttgtgtagataatcttccacctaaattaattccaaagtttgcagaagcatgtatgcaaagcaatggaaatatagaaaaagtggcgttagttatagatattcgtggcggagtattttttgatgatttctttggatcaatcaaataccttaaagataatgaatttgaatatgaaatattatttttagaagcaaccgatgaggttttaataaagagatttaaggaaacaagaagaagccatccattatcacctgatggaagagttctaacaggaataacacttgaaagagataaacttcgagaaatcaaaaatgctgcagacatgataatagatactacaaaatatgaaataaggcatttaagagaaaaaattaatgagtcttatggagataatacttatccagaaaaacaacttaccgtaacagttttaagctttggatttaaatatggtattccagttgattctgacttggtttttgatgttagatttataccaaaccctttttatattcctgaattaaagcagtattcaggtaatgatgaaccagttaaggattatgttctaaagcaggttgaaacaaagacgtttatagaaaagttaatggatatgcttagatatttaattcctaattatattaaagaaggaaagagacagttaataatttctataggatgtacaggcggaagacatcgctctgttgcaattgcaaatgaattatatgaaagattaaactctgaaagttataattcaaaaatagaacatagagatgtgacagaagatcttcataaaggggaaaagaaactatgagaatacgagattggcttaaaccagggattaaagttaagcgttggttagcatttggagtatttggagtattattaatagcatttggatttactgaattagtaacacatagattatatgatttttattacaaggtattttatattttcttgaatctaacaggattatttgtattgtatgtttcagttactgaaactatgaaatcagttattgctcttattaataaaggatatttaaaggtatcattagatagtgaaaaaattgaaagtttgatttatgaaaagagacttttagttaaagggccgaagatagttgttataggaggggggactggactttctacaatgcttagaggtcttaagtactatacttcgaatataacagcaatagttacagttggagatgatgggggaggttctggagatttaagagaagaccttggtatgcttcctccaggagatataagaaactgtattcttgcacttgctgatacagaaccattaatggaagatttacttcaatatagatttaaagatggaagacttaaaaatcagagttttggtaatctgtttcttgctgcaatggcaggaatttcagataattttgaagaagctgttcagaaaatgagttctgtacttgctgtaacaggtaaagttatacctgttactttagataatatgcagcttattgcaaagcttcaaaatggaaatatagttgaaggtgaatcacagataccagaagaagcaataaagcaaaattcaagaattgatgaacttagaatcaaacctgaaaatgcaaaacctttaaaagaagctttggatgctctaaaagaagcagatgcaattgtaatggggccaggaagcctttatactagtataacttctaatttacttgtaaaggatatatctaaggcagtgagaaaaagtaatgcaattaagatatatatatctaatatcatgacacagccaggagaaacaactggttttaaagtatctgaccatttgaaagtattacgtaaatatggtggaaaagatattgtagattatgcaattgtaaacacaggtgaaataacagaagaactaaaggaaaaatataatcaggaaggcgctgaacttgttaaacttgatgaagaagatatcaagagtatgggaataaaaatagtaggtgaaaatctggttaaaatacaaaatggaacagttaaacatgattcagataagcttgcagaagttttagctgatactattatggaaaagaaacttctatacgataagaagaagattattgaatatatgtatttatctcaaagagtaaaagctagagatagagaagaaaaaggtaaacaaggcgaaatttaattaggataaggaaggaaaaaacatgtcattttcatcaaaagttaaaggagaaatatgcagatatgttgatatttcaaaggaagaagctctttctgaaatatcagcaataatgaaagttagtgggacattagcttttagtggaagtggattaagctttaagatgactacggagaatccagctagtgccaggcttatatttaccctgttaaaggatcactttgatattcattcaagactaatggttaagaaaagcaattcacttaagaagaataacatatacatggtagttattacagaagaaatgggcgtaagggatctgcttagcgagacaggaattttaaaagaaattgatgggataatgagtcttgactatagaatagaacgtcatatttttgatgatgatagtatgaagagagcttatataagaggtgcttttataggtggaggaagtataagcaatccagaaaagacttatcatcttgaatttgtaactcatagtgaggagtatgcaagagatttatgtaatctggtaaattcctttaagcttaattcaaaggttattcaaagaaaaaacagctttattgtgtatataaaggaaggcgagcagattgttgaccttcttaatataataggtgctcattcatcattattagaagtagagaatataagaataatgaaggaaatgagaaacaatgtaaataggcttgttaactgtgaaacagcaaatctttcaaagactgtaaatgcagcagtaagacaggttgaaagcattaagcttatacaatcacagataggacttcagagacttcctgaaaatcttagagaagtagcagaacttagattaaactatccagatgaatctttaaaagaacttggagaaatgcttgatcctccagttggaaaatcaggtataaatcatagacttagaaaaattgaaaaaatagctgaagagcttagaagttagattacagttaacagttaacaagtaacagttagcagtttaaggataaaatctcttagagattttttatattatatatttatgatgaaaaaattaaatcaaagatattttgtaagaatgttaaccaaaactgttaattgacaactgttaattcttaactgaagaatgggggagattttatgttcacacatattgtattattcaaagttaaagaaccaacaacagaaaatttagagtttttaaagaaaacatttttatcaatgaaaggcaatattgctgaattgaaagagcttgaagttggtgttgatgttgtaggaagtgatagaagctacaatataggcattataacaagatttgattctaaagatgagtatttagcttacgatgttaatgagttccatgtggagaaggttaagaaggttataggaccatatgttgaatgtagtaagacattagatttctaaattaaatataataatagttatatgtttcaattgacaattgtccatgaaggtaagatccttaatatataactattatttttttattattcaagaaaaggtttacaaaaataaaaacttatagtataataaatacataaggaattgatgaacaatcaattctagtatatagggaaaagagaatttatgagaaaagaaacttggagaagggtactccaagtttttttgcgtttaaattattcttaaaaaacaataaaaaagttgaaatagaatattgagttgaaaacttagaaccatgtaataaatgaagctaagcctctatattgtgcatcaccatttgctaaatagttatataattttaaaactgattctggagctttaaaattatgttctcgaacgtatgatgcaataatatgagtcaattttgtacaaactagtcgatactcttcaccattttctaatttatatttatatgatattaaaacattagttaattcttggttgattttaactttaggatcatctaatgtattttgtaattcgtttattaaatttttatattttttattcactatatttctccttctatataaattatttttatttgtgagttaagatctgagttgtatttaaataattaatcaattatggccatctttttttcttttaataagtgatagtatatataatacaatagcaactgaaattaatattaattgtattatagatataaaagataataaattgtgatttagcattttatctaaaaaaagaactctacaaaaatcaatgaaaaaaaataataatagcattaataattgtaaattttttctatttagataatagtttaggaatagaaagaatataataaattttattataattggcatatatagatatctcctaatttaaagtattcaatcactcataacaatgctatacagctataagtattataatatataaaaaaaggcttaattacaaatttttattaaaatattaaaaaaaggaattttggtataatagaataacatacaaataaaaactattgtagataaatgggagagaagcaaatatgtatgttaaaagatattgattatgacaagaaaatttattttttatattaaagtataattagatatgatggttagaatattgtgttttagaacatttgaaagtaggatataatataaagagtttagttgaaatattacctgaagctaaatttattaatgaagtaaaaaatgataataaagcatagagggacttattttatttgataagtctttttttatagtttgttcagtgtaattttagctatataaaaatttattcatgattgttataattaagatgaatatacattgcaattgacatttgacaacaaaaattaatgtggaaattactacataatttataattacaattgcaaatttcatagttcaacatatatattaaaatttaatataaatagtgattaagagaggaggagcttaatggagaatgaaaaaaagtttgtacacctccatttacatacggagtatagccttttagatggttctggaaagattaagaaacttatgaaacaggctaaagaacttggcatggacagcatagctataacagaccatggtgttatgtatggacttgtagatttctttaaagcagcagaagagtatggaataaaagctatacttggatgcgaagtatatgttgctgcaaagtcaatgcatataaaacagccagataaggaaaattcaacgcatcatcttgttttgcttgtaaagaatgaaataggatatcagaaccttatgaagattgtatcaatggcttcaattgaaggattttattataagcctagaattgatcatgagtatttaaaaaatcatagtgagggtattattgcattaagtgcatgtttaggaggagaggttcagtctgatcttcttaatgataattatgaaaaagcaaagaaagatgctctaatgtataaagatatctttaaagatgggttctatttagaaatacaaaatcatggaatggaagagcaaaagaaagtaaatgaattaaacataaagcttgcagaagaaacaggaattccattagttgcaaccaatgatgttcattacataaaaaaagaagattcaaaatctcatgatattttaatgtgtattcagacagcaaaaacggtggatgatcctaatagaagaagatatccgtcagatcagttttacttaaaatctccagaggaaatgtgggatatgttttcatatatgccagaagcgcttgagaacacggttaagatagcagatgagtgtaacttcaaatataagttccatgagtctaaattgcctaaatttccacttcctgaaggcaaggatgatccatatgagtacttaaaagaaacgtgttatacaggtcttattgacaggtatgatgtgtttaaggatctaagagaaaaagaacttgattatgatgaagtgaataaaattgtggaaaactcatctgaagcacaggaatttgtggatagacttgaatacgaactaggtgttataaagcagatggggtacattgattatttccttatcgtttgggactttataaagttttcatatgataacggaatacctactggacctggaagagggagtgcggctgggtcaattgtagcttatactttgggaattacaaagatagatcctataaaatatagtcttatatttgaaagattcctaaatccggaaagagtaagtatgccagattaaaaattggttatcctaaaaatatatagatttttaggagaaaattaatggctaaaagatatgaacttgataaaaacaaagataaaataatagatttatatataaacaaaaaaatgtcatgtaatgatatttctaagaaattgggatatagtttatgtggaatatatgatgctttaagaagatggaatgttaaaacaagaaatttaagagaaagtcatataatatatgagtgtgacgaaacatttttttataatatagattcagaagaaaaagcttattggcttggatttatatatgcggatggatatattacagcaaataagcttggtattgcattggctatgagagatatagaacatctagaaaaatttaagaagtgcattaaagcaacatatccaataaatacatatatgtcaaattcaaattacaaatctatagagtattgcagaatattgataaatagtcctaaacttgttagagatatcaaattaaagggagtagtgtacaataaatcactaattataaaatatcctaataaagatatgttagatgaaatatactatagacactttattagaggatattttgatggagatggtagtttggtgttgtcaaaaaattctattaattttaaaatttgcggaacaaaagagtttttagaaaagttaatagaagtatttaatagctgttcaaaatattcttttaagaatgttttatttaagagaaaaaaagacaacaaaaataattactatttaagttttggtggaagatataaaacactatctgtaatgaattatttatatgataaatctgaagtctatttagacagaaaatataaaaagtttatattgttaaagagcatgtaattataatagccaattaatagtcgtgcatattagaaataatatgcttaaagagcctcgaattgctggaaagtccttagagtcctttaaaccaaagcagaaggatgaaataagcttaaatgttacggtggtttaaccataaaaattaaaggaattggataaccagcagccaagtttcgaatagaaaaaggtccaacgactagtgcaaaggcacgtagcttatgtttcttacatttgcgaagcggggcatcccaaaccgtaaaggtcggtgggagaagatatagtctatacccactgaaacattattcagtgttaaagtatttcgaaagaaagggtattaataggttgattctgacttttgttacgaaagacgtcaagaggtaattgattatgttgtacgcaaatacggtaaggattgtgtatcacagataattacctttggtactatggcggcaagattatgtataagagatgttggaagagctatgaattacagctattctgaagttgataagatagcaaagatgattcctacaatgttagggataacaatagaaaaggcattagaccttaatccagagcttaaaatagcttatgacagtgatgagagagtaaagaatcttattgatgtatcaatggatttagagggactgccaagacattcatctactcatgcagcaggtgttgttattgcatcaaagcctttagttgagtatgtaccactacaaaaaaatgatgaaagtatagtaactcaatttgggatgaatacacttgaagagcttggacttcttaagatggacttcttagggttgagaactctgactgtaatgagtgatgcaataaaaatggtaaaggtaaatagaggcgtagatatagacttagataaaattgattttgatgataaagaagtctataagatgattggtgaaggaagaacagcaggtgtgttccagttggaatcgccaggaatgacatcattcatgaaggaattaaagccagataacctggaagatataattgcaggaatatctctttatagaccaggtcctatggcagagattcctagatatatagagtgtaaaagaaatccagataaggttgagtatgaaactccagaacttgagagtatacttaatgtcacatatggagtaatggtgtatcaggaacaagtaatggaaatagttagaaaattagccggatattccatgggacgtagtgatatggttagaagagccatgtcaaagaagaaacataaagtaatggaagaagagcgaaagaactttatccatggaattattgaaaatgatgaagttgtcgttccaggatgtattagaaatggaataagcgaaaatgtggcaaataaaatttttgataacatgatggactttgcaagttatgcatttggaaaatattaatttattataaataattattactagaataaggcattataaattcgaggtatgttatatgactaaaaattataatcaattaactagtaaagataaagaaaatatagttgaatattattatttgaataaaaaagtaaatatgaataatatagctagaaatttgaatgtatcaagacgtagtataagtagagtattacaagaaaagagcgttaacactagattgaaaaatagatatgtattaaatgaaaattactttaatgaaattaatacagaggctaaagcttatattttaggttttatttatgcagatggatttgttggaaatgagaattttaataatatcgtaattgctgttaatgatttagaaatattagaatttatagtaaaagaaattgagtttacaggagaaattagaaaaactaaaaaaggtggatttactaattctaaatgtgggtattcattaaatttttcttcgagaataatggctgatagattaaggaatatagggttatatcctaataaatcactaacaattgatagtattcctataataagagaagagctagtaaggcattttataagaggatattttgatggagatggaagtatattattatcacataactctagctattataaaagttatgatgggattataaaatatgtatatccgacatataatttcactatattaggaactaaaaactttttgaaacagataataagtaatgcagagtttaaatatgcaaagattagaaatacaaaaacagaacagataaaaagtttaaatatatgtgcaaaaaaggagtttgattatatatttaactatttatatttagattcaactataaaattagaaagaaaatataataaatggtatgaaataaagagtgcctttgcagcaggagctgtaaagcaaatgaggtgaattgcgggaaagaccttagagccttgaatactaacttaatatagaaatattattaagggcctagagtaattaactaggataaagtaaaaagtttagggattggttaatccgcagccaagtgacctggaaacaggttaaaggttcagagactagataaagtaatctaagtgattatcacatatcatatgatgaaatatccacgagtgcctcatatcctataatttaggataatgatatagtccgatctttatagaaatataaagtttaaagattaaatgtctttaaaataacattgatgtcaacaagagtcatgcagctgcctatgcagttgtaggttatcaaacagcttatttaatgaggtattatccagtagaaatgattgcagcaatgcttaattcaattatgggtacaagtgaaaaagttgctcattatataaattttgcagaaagtcttggaattcaggttttaccacctgatataaacgaaagttattcaagatttactgttaaaggagatactatacgctttgggatggcagcaataaaaaatgtaggcgctaatgtagtagatagtattgtaaaagcaagagaaaataaaggaaaatttgaatctttagttgattttattaataaaatggatgtttcaacaataaataaacgtgctgttgaatgcttgataaaggcaggagcactagataattttaatgtttacagatctaaaatgcttgctgttcacgaaaaattgattgacagtatttcaagtgacaaaaagagaaatattgatgggcagataagtctatttggctcaacagaggaattaaaaaatccagaagtaagttatcctaatattaaagaattcgacaaacgaaatcttcttgcaatggaaaaagaaatgactggattatatattacaggacatccattggatgattatgcaaaaagtttaaaaatgcagactactattgaaattgcaaaaatattctctgtacatgaaactttggatgaagtactcgaagaaaatattccagatgttaatatttttgaaggaaagaacattcttaaagataatgatagagtagtacttggagggatacttgcaagtgttaatcaaaaagtaacaagaaataatactataatggcatttttaacacttgaagatttgacgggttccattgaagtaattgtctttccaaagacacttgaaaactttaaaagcctttgtattacagatagccttgtgattataaagggaagaataagtcttaaagaagatgaacagccaaagcttctttgtgagtctattgaaccactagaaaaaataaatagctctaaagtttatttgagagcagataatgaaattgaagcaaaaaaactcaatatgaacttaaaggaaatattaaaagatgagcataagggcgatacacctatttatctcgttgcaatgagagaaagacagaaatttagagttcctagagataggtggatttcattagaaagtgatgctgtatctgtattaagagatcaacttggagaagaaaatgtaaaagttgaagataattaatgtgaaatacacagttaattatatttatttatataatttttataaaagtaaaatgtaattaaaaatttgaaataaaaggatttatagatatatttaactataagtccttttgttcatattccattttatgtataaaaattatgaatttatttcagaaattatatacataaattaatgaatacttaaatgaaaattgttacataaatgaatgttataaaattaataagaaattatataaatttaatattaaatggttataataaaagagtacacatggaattatgtgtgcgaaaaagataaagtatataacattaaacacagttgcatagagtatttatataattatgtattctagtaaagaaatttttataaaattaagagatttattttagaataatattaaaagttacccaaatatcattgataattaatagatttttatgtacaataattcttgattaataaattatggttataatatgtacataagggacgattaatgtccccgaaggtatttaaggaggaaatataatgaaaaagatagctgtgttaacaagtggtggagatgcaccaggaatgaatgctgcaatcagagcagttgtaagaacagcacttaataacggaattgaagttatgggtgtacaaagaggatatagtggacttataaatggagaattattcagcatggataaaacttctgtatctgatataattcaaagaggtggaacaatcttaagaacagctagatgtcctgaatttaaaaacgaagaagtaagaaaaaaagctgctaaaattttacaagcctatggggttgaagctttagtagttataggtggagatggatcatttacaggagcaaaattattatcaaagcttggaataaagactattggtcttccaggaacaatagataatgacttagcttacactgattttactttaggttttgatacagctttaaatactgttgttgatgctataaacaaaataagagatacatcaacatctcatgaaagagtttctattgtagaagtaatgggtagaaattgtggtgatttagctttatatgctggtatagcaggaggagcagaatcaatcatagtgcctgaattaggatttgataaagatgaactttgtaaaacaatcttagaaggtaaaaataaaggtaaaatgcataacttaataattcttgcagaaggaattgggggagcatttgatttagctaaggaagttgaagaagttacaggaattgaaacaagagcaactattttaggtcatatccaaagaggtggaagcccaagtgcaacagacagagttttagcttcaagaatgggagcaaaagcaatagaagttctattagaaggtaaaacttctagagtaataggaattagaaataatgaaatcatagatcaagatatagatgaagctttagatatggaaagcaaattcgacaaagaattatataatattgctcaagtattagcgtaatttcaaagttaacaagaattcctgttaattttattgaaagagaaagtttgaatattagaggcatggagttattacataattaaagtattcacactttttactacatgtttgcgtagaaaaataagatttatgataaaattattaacttaatcagcttatagtttatttatataaatttataattaatccaagaaagaggagtgttagttaaatgagaaagactaaaatgatttgtactataggtccagctagtgaagacagagaaacattaaaaaaagtaatgttagcaggtatgaatgcttcaagacataacttttcacatggtgaccatgaagagcacaaaggtagaatagtaaaggtaagagaaatagctaaagaacttggaagagaagttgcagttattcttgatactaaaggaccagaaataagaactggtaaattcgaaccaaacaaagttgaattacaaaaaggtactgaatttacagtatatgctggagatatgtcagtagttggtgatactactaaatgtgctgttacatacgaaggtttagcaaacgacgttgttccaggaaacacaatcttaatagatgatggtttagtaggattaactgttaaatctatcgaaggaaacgctgttaagtgtgaagttcaaaacactggtttagttggaactcataaaggagttaacgttcctggagtatctattaaattaccagctttaactgaaaaagataaaggtgatttaatatttggatgtgaaatgggcgtaaacatgatcgctgcttcattcatcagaaaagctgatgacgttagagctatcagaaaattattaaacgaaaacggtggagaaagaatattaatatgttctaagatcgaaaaccaagaaggtgttgataacatcgatgaaatcttagcagaatcagatttaatcatggttgctagaggagaccttggtgttgaaatcccagtacaaaacgtacctgcagtacaaaaaatgatcatcaagaagtgtaacgaagctggtaagccagtagtaactgctacacaaatgttagactcaatgatcagaaacccaagaccaacaagagcagaagtttcagacgtagctaacgctatcttagatggaactgattgtatcatgttatcaggtgaaagtgctaacggagattacccagtagaagcagtaagcacaatggctaaaattgctgaagaaactgaaaaaactttagaatacaaagtagctgtatctaaggctaaatctcatactccagctatttcaggagttatctcaagagcagcagctaatgcagctaatgaattaaatgcttcagctgttataacttcaactcaaacaggagctactgctaagagaatttctcaatgcagaccagaatgtccaattatagctgttactccagacgtaatagttgctagacaattatcattctcatggggtgtatatccagtagttgctgacaaaatggcttcaactgatgaaatgttagaaaaatcagtagaaatcgctaagaacagtgaattcgttgcagctggagatacagttgtattagcagctggtgtaccagtagatcaagttggtgctactaacttattaaaggttactgaagttaaatagttttaataaatagatattttaaaacaataaaaaataagagttattcttaagattttgcgtaaactaatatttatataattaaacaggaatgatagagacataattattgaataaataattatgtctctatttatatttattcaattaagatgttttataatgattaaaatttaactcttttaatcattaattaaaatgtatactgttaaatttatttaaaataaaaaaagttaacagaaaattaacaattatttatgttatagttattatataatgtatattatcgcgttgaatgcggaatacttattatatatggaattaaatggcaactgattctgtattggcaccttcgggtgctctttttttatgtgaaattataataagataacatttatggtatcaaaatagtctggattttttattttgactaatttgttttattagatttgtttgtaggatataatataagacatagaagtaagtaagtaaggattgtgattaaagtgattgataaagaaaaaattgaaaaaattatattagaaactttaccacaagataaaacagaaggtatttatatatttggaagttataatactgagttttttgatgaagattcagatattgatattggatggttttgcaaaaatgtaacagatgaacaaagagtcttattagagtatgaattagaacaaaaaataggaagagaagtagatcttgttatacctaataaaaatagaatactatttttaaatgaagtattagcaggaagacctataggaaaattatcagaggaattttgtgagtggtttgatagaaatattgatgaaataatgtatattgctcaagatttaattgcaatgatgtagggaggattttctatggtatattataattatggaagaataaaggcgataaatgcaaatataaaagagagcttaaatgatttggataatgcatttgcggtctatgataaattaaaatatgatagtaacatggaatcaattataggaaatagtataagaatgagttttgtacaaattagagaagagattttttcagctataactagtatattaaagagttctggattatcagtaaataattttcaaaacaatatggatatgataaatcagtgcagaaacaatggatattttactaatgtagaagacacattttttataattttgaataagtatagaaattctgcatgtcatagatataaacagcctactgttgaagatattaaattattttatgaaaataagagaggtcagatattatttatattaagtgatcttgagagaattactaaagaaaagaattaaagttaacataaataataaaaaggacgtgtacaagtggtagaaaaagataaggaatatatattaaatattgaagccctaggttatgaaggtgaagggatagcaaagatagatggatatcctgtgtttatatctggagctttaattggagagaaagtaaaagttaacataataaaggttaaaaagaattttgcttatggtaagcttatagaaatattagaagaatcaccagagagaagagaaccaaaatgcagtagttacaatatgtgtgggggatgtacattacaacacttaagttatgaaggacagcttgattataagttttcaagagtaaaagactgtattagaaaaattggtggtcttgatgaaagtattgttaactacccaataggtatggatggtgtatatagatatagaaataaagttcaatttcctgttgggcttgttaatggaaagttatctataggattttttagtgaaaagagtcatgaaattatagatatggatacttgtttacttcaagatgaggaatcagaaagaatagtaagtataataagaaattggatgaataagtattctataatgccggctaaaaaagatggaaagctatttaaaaatggaattttaagacatatagtaattagaaaagcatttaaaacagatgaggtaatggttatattagttacaactaataagaagattccttatgtaaatgaacttatagacagcttaaatagtaataataattctataaagagtataattcaaaacataaatgataaagacacaaatttagtaatgggagaaaagtgcataactctttgggggtcagattatatatgtgactatataggtgaatataaatttaatatttcaccattgtcgttcttccaagtaaatcctgtacagacagaggttttgtataacaaagcattagaatatgcagatttaaatggtgatgaaattgtctttgatgcatactgcggaacaggaacaataagtttatttttatctcaaaaagcaaaaaaagtctatggagttgaaataatacctcaagctatagataatgctaaggttaatgcagaaattaataatattaataatgcagagttttttgtaggtaagtcagaagaaataataccaaaattaattgatgatgggattataccagatgtaatagttgtagatcctccaagaaaaggatgcgattcaaaacttttagatgctttaggaaaagcaaaacctaagaagattgtttatgtgtcatgtgatccaagtactcttgcaagggatttaaaatatttagaggagcagggatataaaactgtagaagtacagccagtagatatgtttcctatgacaaagcatgtggaaaatgtagctcttttggttaagaaatagagttatttataaatattcatagctacacattcatatatataagtaatagcttaggttattacttatttttattgattaacaatagttctaataaaagtgtgctggagtacaaataattttatgctacatgtcatatttaatatattaaaagtgtgatatagtaataaaaagataataattaataaaaaaagacaaaggcgtcaataaaatggtacctatgaacaggacactttgaaaaaaagtgtctcgtttataggtacttttttgtataataataatatctatattggaggaaaaacatgagtaagataacatttgataaagaaactattgaattactgaatgaaaatccttatgtagttaaagtaagtgaaaaatctataacttactctgacgagtttaagcgattatttatagaagaatatttaaaaggaaaaacacctaaaattatttttaatgacgctggttttgatacacaaatccttggacaaagaagatacgaacaagcggcagctagatggataagatcttatagaaaagagggtattgtaggattaagagatactaggaaagaaaactctggacgaccaagtgaaaagcaattatctaaagatgatattattcaaaaacaagaagctaaaattaagttattagaggagcaattagaactgttaaaaaaattagacgtgacagaaaggaggctggtaaacagcagcgtaaatctagaaggtaaggagatatttaagttaatatatgaaactatcactaataatagctataaaaatatggtttcatatttctgtgatcttttaaatgtttcacgctcgggatattataattatctaaatacacttgataatcaaatattaatggaaaataaagatttggaagctagagacaatattcttatggcttataattacaaaggttatagcaaaggatcccgttctataaaaatggttttagaaaatgagctttctataatttatagtagaaagaaaattcaacgtattatgagaaaatataatattaaatgtcctattagaaaagccaacccgtaccgccgaatggcaaaagcaaccaaagaacatacagtagttccaaacttattagaacgtaattttaagcaaggagtgccgggaaaggtattattgacggatattacatacttgccatatggaaataatcatatggcttatttgtctaccatcaaagatggtagtagcaacgatattctagcttatcatgtttcagattctataaaacttgatattgctataactactataaataaattaataacgcaccataaagatgacttacatgaaagtgcatttgttcattcagatcaaggattccattatactagtccaaaattccaaaaacttctaaaggataataatcttggtcaatcaatgtctcgtcgtggcaactgttgggacaatgcgcctcaagaatccttcttcgggcatatgaaagatgaaatagactttcaatcatgtaatacacttgaagaacttattgatatgattgatgactacatcaactattataataattacagatatcagtggaatctaaaaaagatgactcctaaacaatatagaaatcatcttttattagcttcataacactttttttatagtgtccttgacacaggatccattttatattctcttgtttttttatatttttattgtatttaacttgaatcttacttaagccaactttcctattataagcctataaaccattgaaattactaggttttattcttttctgataactataagataaattaaggattagaagagtttcgcagaaaagtttggctaatgtacgcaacaatctcaataataaaaaaggattttcttattcaaaagaatggactatatgttaaatttctatttatttagaaaaagtaatggctatttcccccttaccaactattgctataagatcagcattattaataaaacctaaatttatagattcattttcagtatcgaatctgttataaaatttttgattaccagttgagtcaactatacttaaacttgtaatgccaccatttgctttaacaagtttagctgtagcacgaaatgggtttgcttcagaaatgtcataaataccttgtttataaacatctgatttaacaagagcttttggggtttctgtaaatgcaattattgatattaaaaaaattgctaaaaatttattgattttcatactaacacctcacttcagtctattttttgtgtttttgattaaaatatacattccatataatatccaggttagcattattttttacaaaattctaaaggatcaatacccaaataagttcagttttacactgtcaagaactgagtgttacatttttttgtgttgaaccattctaaaaggcaaaaattttagtttcgtatcgtcactatgagtactttgaatttattaaaagtcgtatgggagagattcatgtgtatgagtttatgagaaaaaggaactaggaaaaatatttttgagggttacatacttaattgtttcactagatagttgtcagcatagtatgtttatatatattaatttagagcgtggttgttatggctgagatacaaagagaagtttcttctaaagctgacgtattaataggattattaactaatgtaccaaaagaaatattggatgagcttggatataaatatcaaagtcaagataataatctagaacttactatcttatataggggtactccagaacaaacaaaagcattcattgaaggattaggtggaaaatttcaagatctaggatttaattttgctgtagttaatatacctagagaaaagttagagcaattatcattaagtaatgcaattcagtatatagaactgccaaagagtctgtatgaacaagatcaggaaagtaatagagtctcttgtattgcccaattagctcctaactttgatgtttcaggtgaaggagtattagttgggtttgtagattcaggaatagattatacacatccagcatttatgaatactgctggtacgacaaggatagaatatatctatgatttaagtactggtggaaatatttataataagcaaatgatagaggaagcaataaagtcttctaatccatattcgatagttccgtctattgataatacgggacatggaacacatgttgcaggaattgcatgtgctggtggtaacataaaccctatgtatagaggtgcagcgcctaatgcatcaatagcgatggttaaagcagcaagaggaactgcagttttaagttcacagattatgcagggaattaagtttctactagatagaagcaaagaactaaatatgcctttagttattaatattagcttaagtacaaatgatggagctcacgatgggagtagtctattagagcaatatattagaacggttcaaagcctagagagagtagctattgttattgcagctggtaatgaaggagatgctggacaccatgttggaggcgaactaacaaaaactcaaaggaaaatttttaatattgcaagtgaagagaagtcaattgttatgaatttatataagccgattttacctgatatatcaattaatgtaataaacccaatgagtcaaagtagtggaaatattactatacgggaaggatacattcaaggaactataggaagtaatagatatgatatatatgtatcaggtccaaaaccttttgaactaaatagtgaaataaaaataatactttctgctagaactggatttcttgctgaaggtgtatgggcattggaaataaatgttttgaatgaatatttaggcgaatattcaatatggctcccagtacttgaagggcttaatccagcgacaaaatttttagaaccaaaccaatataatactttagggataccagcaacagtagacaatattattgcagtagggagctataattatagaactaacaatctatcgtcgtttagcggacggggagcacaaaatagagggaatttagtaaaacctgatttagtcgcaccaggagaagagatagttggaccagtaccaaatggaggatatgacagtaaaacaggtacttcaatggcagcacctcaagttgcaggaatatgcgcattaatgatgcaatgggggataatcaaaggaaatgatttatatctctttggacaaagattgaagtattatttattaaaaggtgctcagagaagacgtacagatgtaacgtatcccaatccattatggggctatggcgaagtatgtgcacttaatagtttcaatttacttcaagctgacttaaatgctattttatctaggcgatatgtaaaacagaaagaagtgatagtaacaaataatacttttatagaatataatattatgaaaaaaaatataaagaggaaatttatgaataatagaagtaatggaaattttagagcagacgttggtggattaaagattcaatgcttcagaggtgatgattatattcccattgatggtgctaggataactgttagtggaacaacaggttttgaaaatgttaataatattgagttagttacagatgtagttggactaactcaaatagtagagctgccaacaccacctgtagaatattctttagatccgaatattaatcagattccatatagtttatatgatctaactgtagaaagagatggattcgatacagtaataataaggggatgtcaagtatttcctactcaaattgcttatcaagtagttaatttagaaaacaatttaggaagaggaggtatgagacaagaagttataaatataccacccaatactttgaacggggattatcctcctaagataccagaggatccagagaaaccactgccaccgccaacctcaggagttgtattacctcaacctatagtaccagaatatattattgttcatcaaggagttcctgatgatccatcagcaccaaattataaagtaccttttaaagattacattaaaaatgttgcttcatgcgaaatatattcaacttggacaaattcagcaataagagcaaatattttttgtattatatcttttacattaaatagaatatatactgagtggtatagaggtaaaggaaaaaactttgatattacaagctctacagcttatgatcatgcattcgcttatggtagaaatttctatgataatataagtcaaattgtcgatgagattttttccacatacgtacgaaggattggaaggaagcagccacttttaacacaatactgtgatggaaagcgggttagctgtcccgaatggttgagtcaatggggtagtcagaaattaggagtacaaggtaaggtaccatatgagattttgagatattattatggaaataacattgaattagttacagctgaaaaagttgctggaagccctcaatcatatccaggtagaccattaactattggttcatctggttctgctgtaaggactattcaaagtcaattaaatagaatagcaagaaactacccattaattccgagagttgctgaggatggaatatatggaccaaagactgcagaggcagtaaagacattccaacaaatatttggattaccacaaacaggagtagttgattatgcaacgtggtataagatatcagatgtttatgttggagtaacaagaattgcagaacttactactactgaatcaagtcgaatagtgagacaaaatatgtttatacctccaattatacctggcttggataataaaagaggaattccaaaattttattattaaataaattaagataaaaaaatatttttttacgcaattctaaaattgaacaaattgtagatagtataagttaatcatgtaaaaaatttgaaaggataatcttaatgtaatgtgtggagtgattacaatcgctacattaagtagttatttaaagggagaaacaactacttctccagtgccgagcactatcccaatatctccctcatgaagagtgcctagttttacaatttcatccgtttcatctaagtgtataaattgcataagcttaccgatactatcagctgttattaaggcagcagtggcattttgagttataatttcgcaggaacctcatatcaattgaacaaagaaagtgaatagataccttgtttataagtggttgaaatagggaatatttgttgttctggaacttcagcaattggagatggttgtatttctgcaattatagtaaagttgaatatatattccatgtatagctaaattattcaaactataattagttatcactactgtttaattaatagttaacattaccattgactttctcaaaaattgtgtaatatcctatgtggaatatatatccaataaaattgaatatgaaaacagaattttgggtggatattttttcttattaatgctatatcttcactttagaattaggaactattgaaaatataagaccaattgaatttatcagcttcgtaaatctcaaagagattagcttttatagctctttttatttcaattagtgtagtttttgtttgaataaatggttctataagtttaaatactgcgaaggtcataatcccagtgattatctgaatcatcactgagtttaatgatcgccctacaaaagttttaaattttaaattttgttttatccacttgaaaaaaagttctatttcccaacgctttttgtatagaaacgcgatttcttcactaagaagatcatcaatatttgttataaattaagctctttacctgttttatctacaatttttataagtcggtattcttgttttgtttgataagtatatttagatccaagctttactattttgtcacagattattttagttcctacatctaaaaggcgttcataactataacttatttttaagtcttcgacttcggtaactactgcattatgctttaatctagttacaaaatatttttcgtctttagtgtattgatcaaatttttcataatctaaataacccttatcaaatacatagatacaatgtctactatcaattaaggaatccatagcagttttatcatgttcgacagcatttgtaacaacaaatgcatcgggaatacctttattcaaatcaaatcttgtatggatttttactcccgctttggtagacctaaacagtgcccattggtaaagatttaagctcatacttatggtagtagaatctattagtttaattgaaccaaagcgctttaaggactcatttactgaacctgtacttaaaactttattaatgagttcatataaaactggtaaaaacacttcataatttcttttattattatggtatgataaagtactcaagctaacgcttgctacggtttcttttaatttgctagacatagatataccaaagcttaaatctcttaaactatctttttgagagatatggtgataaatcattgattttagatgatctttagtgaaaaattttgaaactttattatcagtatttaacttaaatgctgtatgtttcaaagtatcccaattaataaattctataattttatcgaataatttgatataatcaaccacgtagtcagtaacctcctttggttttattgttttgtggtaattacattaaatcaaaggttactggctattttcacgtataaatttatggtgacatatgaaattataaccatgtacaatttgtcaatggaaattttaatcaatgtttaaacagtagtgataatttatatatatttttattggctgggtgtaataatatctcaataaatggttctgcatatataacagaagaaaataaaaaattaattggaacagaaacaaagtatggtgaatttaagaatgttacagatacattaaaatctaataaaataataaaaaaaatgcaaccggaaataaatttagattgtgcatcaatcaatgcatttcggacaatagaaaagaattcaatatatattacaccagaaattatacaaacaaatggaagtataggtatattcactaaggaaaatgattgtggatggaatttgaaaaaagggcaaaatataaaatttaatttcgaaaagtataagtctcaagtagttgaaaatcaaactgctattataggatatataaaaaatggagaaatgattaaaggtgaagaatttaaaaatttatatggggaatataatttaacaatagatgagatggagaatattacatataaacttgatagaggagctaaaattaatgttattataagtccatagtcagatcatgttggtagatataataaaatacacttatagagggcaggaatgttttgtatttcgctgaactttataggtgtttttgttttaaggagaaataaatttaccaataatatttataaaatattaacgccaataataaaatattaacacaaaatttatatccaagctgatacactatctcataggagatgaaaagcatgggatatattatagtgatagtatctattctatttattttgttttttggaatttatggaacaaaaaaagtggacagatttatagaaattaatcaaagctcaacagttgaaagaaatgaagaaaaagttcttataatgggaaataaacaagtaactaaaagcatagaaagttaccttgacacaaataatatacaatatgacattatctatgacaataatatgcaaagattaaataatagttataaatgcttgataattttgtttaatgatgatttagataatttaatggcatgtgcattaagtagaaagtggtataacatagaaagtgtaatatccgtgtgtaatgattttgaaaatgaaagaatatttgatgaatatggtgttatgagaataagcataagcaatatttgtaataaacaatgtctttcagctataaaggagaaaattaaaaatgcataaattgaaaaaacctaattttacttatagtcaaataagtgcaattagttttatgagtattattttaattggggcattattgttaactttaccaatatcatcaaggtcaggagaagcaactccatttatagatgcattatttacatcagcatctgctacatgtgtaacaggtcttgtagtttatgatacgtatactcatttttctttatttggacagatagtaatattaagtcttatccaaattggtggtctaggatttatgattatagcaaccttattttctttaatgctaaaaagaaagataggtttaaaggaaagaggaatgcttcaagaatctgttagtactattcacattggaggaatagttaggcttacaaaacatatattatttggaactgtaatatttgaagcaataggagcaataattttagctttaagattttatccagatatgggattaaaacaaggactttataatggagtctttcactcaatctcagcattctgcaatgctggctttgatttaatgggaagatttgaaccaagttcatcacttactttatatagcggagacatagttgtaaatttagtaataatgagtttaattgtagtaggtggggttggatttttagtctgggaagatattttcactaataagttaaagttttgcaaatatagattacatacaaaaatagtactagtagttacagctacattaattatagtaccagctattattttttatagtattgaaagaacaaattcttttgcaggcatgggaactactgaatcatggctagcatcattttttcaatctataacacctagaacagctggatttaatacagttaatatagcagagttatcagaaggatcaatacttcttacaattatacttatggttattggaggaagtcctggttctacagcaggaggagttaaaacaacaagttttgcagtaataatactatcattaatagcttcaataagacatacagaagatattaatgtttttaacagaagattagaacgtgatgtaattaaaaaagcatatgatgttattactatttattttatgtgttgtgcattagctgtattgttaatatgtgcacttcagccttttggacttaaggaagtattttttgaggttgtatctgcattaagtacagttggaatgtcaacaggaataacaccagacttaaattcattatcaaaatttataattacgttgttaatgttctttggacgagtaggaagtttatcagtagcattggttttctctgaaaagaaagaatatatacctataagaaaacctgttgaaaaaatatctataggttaattatatatcaattaaaaattaacatttgatgcctgtttcgggcactcattgtaagtaattgataattgatgtggaaattactatgtgatttctagattataattttaaggttcatgtgtaacataaataaaattttattttctaaaatacaaaatcacaatgatgtgaagaataaagaatcagaggatagaggagaattaaaatgaaatcagtattaattattggaatcggacgttttgggagacatttagctagaaaatttgttgaacttggaaatgaagttatgatagttgatatagaagaagaaaagatgagtgaaattgtatctattgtcacaacagctcaaataggagactgtaccaatgtagatgtattaaaatcacttggagtaagaaattttgatatatgttttgtctgtataggagataattttcaggcatcactagaaattacatcattacttaaggaattgggagcaaaacatgttgtatctaaagcgaatagagaaatacatgcaaaattccttttaagaaatggagcagatgatgttgtatatccagaaaaagatatagctgaaaaagcagcaataagatatagtgctgatcacgtttttgattatatagagcttacacctgaatattctatagctgaaattccaccagtaagtggatggattggaaaaacaatagctgaaatatcagtaaggggtaagtatcagatgagtatattagcaataaaggaaaatggagaaattctacctctacctaaagctgaccatgtatttagagaagaagagcacctaattgtagctgctaaaaaaaatgacttagttaagctaattaaaaagatataaacttataaaaaaagcagctatgctgcaaccaaaatccctagcctattaagaaagcagatatgctgcaattaagatccctagcgtataaaaaaagcagctatgctacaaccaaaatccctagcctattaaataagcagctatactgcaattaagaattatagtttataaaaaatcggttatacttgagctaatatctttaatgtataaataaagtagttatgtaataacgcaaattgtttattactgacaaggagtacctagaagacgccttacaggtcaattgaaaatagtccataaataagtaatattatgctataattgggttgaggtgaataaagtaacatgaataaatctagtattggttatagtattaaacttatttcggtcgtgttattatcaacaataatatctatgataatgagaaaattaggaatagaaaaagatagtataatgatggtatttctcgttggggtacttcttgtaactgttattactaaaggctatttttatggagcagttgcatcaatattaagcgtattaatttttaattatatatttacagtaccagtacatacttttgagatatatagtacaagtgacataacgttattgttatttttctttatatcttcaattatatctagttctcttacatcaagaattcaaaaacaagctgagattgcagaaaaaaatgaatgtacagctagattactatgtgagataacagataatttttctaatattacaggtaaaaagaatattgttattcaaggaatatcatatatttataatcatactggttgtaaaagtaaagtaactttatctgatacaaatgagattttttataaggatgaaagtatagatgaatcaaaatgtaacatgaataaattaaatttagatatacatggaattaataaaaaattaggtgaaatagaaatattcttttcagaggataatttatctttagaaaatgaacttttgataaagatggttgctactcagattggaatatctctagatagagaacttatatattatgaacgagaaaacataaggatagagatggaaagagagcatcttagaagtaatcttattagaggtatttctcatgacttaagaacaccattaacagcaattgtgggagctagtggtgtggtaatggataatattaacaaacttccacaagagactataaaggatcttgtaaaagatataaatgaagaagctttatggctcaacaatttagttgaaaacattttaaatatgacaaggattggtgaaggaaaacttgttataaaaaaacaggatgaagttgtagatgatattgtagatgaatcattaagacatatatcaggtttattaagtaacagagatgttcaagtgagccttcctaaagaagttatatcaatacctgtggatggaaagcttattgttcaggtattaataaatcttcttgataatgcagttaaatatacggatgagaagtgtacaatatatttgagggtttttcaaaagaatgattttgttgtatttgaaattgccgataatggagaaggtataaatgaatcaataatcgataagatatttgatagttttgtttcatattcaggaaagatagttgatgggaaaagaggtatggggcttggccttgcaatatgtaaggcgattattaatgcccatggaggggaaattacagcaggaaagtcaccagaaggaggagcactttttagctttacactccctttataataaaaataattgctgtaatggaggatttagaatgaattattcgagaatattaattattgaagatgataaatacatattaaatttcatttctctttcattaaaaacaagtggatataattttcaatgtgcaagtacaggattagagggattatcattattttattctaataaacctgatatagttctacttgatttaggtcttccagatagtgatgggatagaaattataaaatcaataagagagatatcagaatgtccaataatagtagtatcagcaagagggcaagaaatagacaaaatatcagcacttgattcaggagctgatgattatgttacaaagccatttcatatgggagagctgcttgcaaggatacgtgttgttgaaagaaagatgaatcgtgataaaatacctgtaaaagatgaactttttaaatgtgattacttaacaatagactatgaaaagcgtaaagttcttgttgatgataatgaaatacatcttacaccaatagaatataaattattgactttaatggttgcaaacaaaggtaaggttcttactcataattacatattaaaagaagtttggggatatggtgaaaatggggattcaaaatcaataagagtatttatggcgagtcttagaagaaaaattgaaaagaatactgcaaagccacgttttatattgactgaagtaggaattggatatagatttgcagatgattaagtaaaataaaaataaagcattaattacttttattgacaaatattcaggcttctaatatcattaaatataaatatacggattggaggcgttttgtatgccatttataggatcaaaagtaacagtgaagatttcaccggaaaaagaagagataataaaaaagagattaggaaaagcaattgaacttataccaggaaaaagtgaaacatttttaatggttggatttgaagacgaatataaattatatttagcaggagaaaagcttgaaaaaggcgcatttgttgaaataaaagtatttggtagagcatcgaaagaagcctttgataaagttacaagtgaagtatgcaagatttatgaagaagaacttggaatacctcaaaataaaatttatataaaatatgaagaagttgaaaattggggctggaacggaaaaaatttttaattaatatgaagcaatgaggctgttttaagattttttataatcttgaagcggctttttatattgggggtatgaacatgattattggaattgtacaaatggatattgaatgggaagatatatataggaatatgaataaaattgaaaactttgtaaaagaagcttgtgagaaaaaaatagaactgttattgtttcctgagatgtctttaacaggttttacaatggatatagataaacatactttttcggaaaaagaaatcagtaactggataagcaaaatagctgtaaaatacagtatgaatatagggattgggtttggtgttattgtagatgaaaaaggtttaaataaatatataatagtatcaaatgaaggcaatgttattgcagattatagtaaaatacatccttttagttatggtggtgaagataagaaataccataaaggtaatgagataatatcatgtgttttagaggatataaatataactccatttatatgttatgatttaagatttccagagatatttcagattgcttcaaagaagtcagagttaatatgtgtagcagcaaactggccaaaggaaagagaaaatcactggataacattacttacagcaagggcaatagaaaatcagtgctatattgcaggaataaacagagttggtactggtgatggaatttattataatggagcttcaatgattattgatcctgaaggaaatattttaaatgaaattacttctgatgaaggaattataaaagtagatatatgtaaagaaaaagtgataaatataaggaaatcttttagcttaaagaaggatagaagagaaaaactatatagaatttattgataaagactgtatttaggttttaagcctaaatacagtctttgacatttacaataataaatttatatgttatattaatgataatcattatcgataagagattccaatgagtatatagtagtatatgctctcgttttatgtgtttttaatgatagataataattgagaaggagatagttaaacatatgatgattaacaaaagactcataggaatatgcagtgagtcaaaaaagtatattgcattaacagtattaacaagctggatatcaatcatttgtaatatattgattattcttatggttggtcagtttataaacaaggtttacacagtaagaggattattagttaatctagaaatagataagttaagcactcttcttaaatttaaagtaaatgaaaatttatcattagccggtacaattgcaataatagcagtgttattgataataagatattttagtaatataatgtacggaaaattatcttatttagcatcggatagcgtaagagttaatcttagagaacttatttataaaaagttattaaaattaggtgttggatacaataaggttcaaagtacatcaacaattgtacaaatgactgttgaaggagtagaagcgttagaaatttactttggtagatatttgccacaatttttctattcaatgcttgcaccaataactttatttgtttttatttcatttatatcaattaagtcagcagtagtatttatagtatgtgtaccgttaattccattatcgattattgcaataatgaaaattgctaaaaagatattaaaggagtattggaacagttacgcaaatcttggagatacattcttagaaaatttacaagggctgactacattaaaagtttttgatattgatgaagaaagacatagaaaaatgaatgaagaagctgaaggctttagaaaaataactatgaaagttttaagtatgcagcttaattctataaatattatggatttaatagcatttggaggagcagcacttggaactatagtggcattaatagaatttaaaaatggaaatctttcagttggaaatttattggttattattttactttcatcagaattctttataccattaagattattaggttcatatttccatattgctatgaatggtatggcagcatgtgataaaatattttacttattagatgcagaagaaaaagaaaaagatatatgtaatgattcagcatcaaagcttaataatctttcagttagcttagaaaatgttaaattcagttatgatggagaaagaacagttgtagataatgtaaatctggatataccaaacaaaggtatagtagctattgtaggtgaaagcggaagtggtaagagtactatagcatcacttataatgaatacaaatagcgtaaatgatggagctataaaattaaatggaataaatgttgaaaatatatcattagatgatatttataataagatttcattagtatctacaaacagctatatattcaatggaagcataatggacaacctacttatgggtaaatatgatgcaactaaatctgaaattaatgatgcattaaaaaaagctagattatatgattttgtacaatcattaagagatggattgaatacaaatgtaggtgaaggtggaagctcattatcaggaggtcaaaagcagaggttagcactggcaagagctatcttaggaaatcgtgaaatgattatatttgatgaagccacatcaaacatagatatagaaagcgaagaagctatatgggaatcaatttatgagctttctaaagataagacaatattagttatttctcatagattagctaatgtagtggatgcagacaacatatacgtaatgaaagacggaaaaatagttgagaatgggaatcatgatgaattgactgatataaaaggtgaatatttttctatggttaataagcagaaccaattagaaagtacaagggaggtatgctagatatgaagagaagatcaggctttcagataatggcaaggcttatagttgagttaaaacccctagcaccagttatgttaattacaataggaatgggagtcttaggatttttagcagcaatagcaatagcaacatttggagctgttgcccttggagttttaattggtgaagtaacctcatttacatttaagtcagcagtaatagttatgattgtttgcgcagtacttagaggattatttagatattgtgaacagctgtcaggacattatatagcatttaaaatattagtgattttaagagataaaatttttacagtattaagaagattagcaccggctaagcttgaaggaaaagaaaaaggaaacttaatttcacttataacatctgatatagaattattagaagtattttatgcacatactatagcgccaataacaatagctataataacaaataccataatatctattatattatttagaattaatccatggtttggtatattaggagctgtattctttttaatcgttggttttgcaataccatatttatcttcaaagatggcaaaagaagctggagttgaatatagaaataattttggtcaaagcaattcctatatacttgattcattaagaggattaaaagaaattttactgtttaatggtggacagagaagattaaatagcataaatgaaaaatcaagagaacttaataaaagtttatctaagataaaagatcatgaaggtgtaataagaggtgtaacagatcttacaataatgttagcaatattaacttttgtaggaacgggttttggattattgattgctgacagtatttcatttatagaaattgttattgctgtagttatagtagcatcttcatttggaccagtagttgcattaagcaatttatcaaataatcttcttcatacatttgcatgtgcagaaagactttttgcattattagatgaagaacctaatgtggaagaagtagctggagacaaaaaagtagaaggaaattctataaagtttaaagacgtagagttttcatatccaggcagacaagaaaaaatattagatgatatttctattaatataaataagggtgataagatagctcttattggtgaaagtggaataggaaaaagtacatttataaaacttattatgagattctgggatgttaattctggacgaatagatatagacggcataaatattaaagatattcctacaaaatctttaagagcaagccagacactagtcagccaggaaacatacttatttaatgaatcaatagaagataatataaaaataggaaatctaaatgcatcaagggaagaggttatagaagctgctaaaaaggcatctatacatgattttatagaaaagcttccaaagggatatgatacaaaggctggtgaacttggaggaatgctttcatctggagaaaagcagagaataggacttgcaagagcctttataagtaacggtgatgtacttattttagatgaacctacaagtaatttagatacattgaatgaaagtgaaatattaagatctattaaggaaaactgtgaagaaaaaacaataatacttatatctcacagaaaatctacaacttcagtatgtaacaaggtttataaacttgaaaagaaaaaacttgtattaaactgatattttaaaagaaaataaaaaataaatttggaggagtagttactagtcctccaaatttatgaaaaatagatgataatgaatttcaagagatattatatggaggatagctatgggcaagttaggtagggttgatcatgaaaaacaagtaattaaacttatgatagaaatttattgtagaaaaaaacataaaggtaataataagctttgtgatgactgtcaggaattattagactatgctcattttagactatctcactgtaggtttggtgatgataaaacgacttgtggaaaatgtaagattcattgttacaaaaaagatatgcgtgaaaaagtaaaagatgttatgaggttttcaggtccaaggcttattctatataagcctattgagttaattaaacatatgctttattgaatacaagcttaataactttataatgattttgcaattaaagaaattaaaaatatattttaaggagatgacagatgaataagattaaaaaaggcctatatatatttgctggttttttagctttagcatttggatttataggaataatacttcctgttttaccaactacaccgtttttattattggcatccatatgcttctttagaagttcagaaaaactcgataaatggtttaaaggaacatcattgtataagaaaaatttagagagttttgttgtaaacagagcaatgacaaaagcacagaaatggagaattttattatttgcatattttattatgatgtttccattaatttttgttgataaatggatagtaaaaatattaatagctttagtaatggtattcaaattttactattttatgtttagagtaaaaactatggaataaatcagaaattccattgataagagaatttaattaatttaggagataaagaaatgaataaacagcatattaaatattgtttagatatcataatgactatatgttttatatgcataatgaaaattatgataacaggaataggttggcatgaaaaattaggattaataattggtggattagttatacttcatcttattcttaattatagatggataaagggaatggcatctagaatcttcgatacaaaacttaattttgccactaaattttcggtggtacttaatatattattggcagtattaactgcattagtaataataagtgggatattgatttcagttactatatttaagggcatagcagcagagaatagacaactgtgggctagtatacataaaaattcagcattattaatattcatatgtatttcaatacatataggattacattggaaaatgataatgtatggatttaggagattatttaatataaagggaattaattcaataagaatatatatattaagaactctttcaataataatcatgttacttggattatttgctttaagcaataattcaatagtaaaaaccatgttgaaaatgaataaagaaacagatgcacgtaataaatcaactaaggtacaagtaatagtagaatatgcatctattatgggcttatttattggaggaacacactatacattaaaaacagctaatgataagtgtaaaaagaaaactaattaatatacagaaaatatagggggtaactaacatgaaaaaaattatgtcaatgattttatcattaactattgttttaggtcttataacacctgtacaggctactgaaacattggtaattaataatgaaaatgaagagactatacacttagaagatatagtagattcagaaaatattgaactagaagaaaacgaagatgaaactagtgaacttattaataaggatacagaggttaatctagaggggatagataaaactgtagatgatgagaaagctcatagtgaagaatctacagatacagaagtagaagataaagaattggatacaccatcatatacaattgatggtgatatggaaaactacttagaagaatatttaaattcattaaacaaggaagaatctaatgcggatttagaaattgattctgaaatggaagaatatttaaattctttaattatagatgaacagttatctgaagaagatttagaagatgggatgtatacagcagattttgcagcaaataaaacaggaacatcagattcttcatcaatggcaaaatacatagatacagaaaaaagcagaataaaaataaagaatggaaaaataacagtacaattagtaataaatgattcaaatatggtagtaagtacaagtgcatctgtaaatggagcatcagttgatactaaaagaatagatatagatgatacaagctatatagctgaatttaaattaggttcaataaaagatgaaataaacataacagtagactgtaattatgcagctataataccatcaatgggaattaagcagcatgattttgatttgctaataagtgatgttacatacttagaagagcttccagaagaagaggaagaagaaaactttgaagacggaatatattctgtagactatagtgtttataaagaaggaacatctacagatggaacttttgtagaatctacattaaaaaaatatataatagattcaacattaaaagtagaagatggaaagaaaaaattagtacttaatatagataatagtacaggtatgattggaaatttaactgctagtgtaaatggcagtgaagcagaagtaaatacaacagaaaaagataaagttattacaatggaatttgaaatagggtcaatagaagatgaaataaatctaggaatgactgttactataagcgaaactatgaaaatgactcatgttgtagactttgtcataaatacagttgaatttaaggaagaattacctgagatagaagaagaattacaagatgggatgtatacagcagattttgcagcaaataaaacaggaacatccgattcttcatcaatggcaaaatacatagatacagaaaaaagcagaataaaaataaagaatggaaaaataacagtacaattagtaataaatgattcaaatatggtagtaaaaacaagtgcatctgtgaatggggtatcagtagatactaaaagaacagatatagatgatacaagctatatagctgaatttaaattaggttcaataaaagatgaaataaatataacagtagactgtaattatgcagctatagtaccatctatgggaattaagcagcatgactttgatcttgctataagcaatatcacatactttgaagatttagatgataaagatgaagatatagaaaatccagatgatggttcaggagaaacttatccagaggaagaaaataagactttatcagatgggacttatactatagaaagtacatttttaaaggataattcaactagtacttctgcagcaggaaattatttaaatagtaaaagtacattaacagttgaaaatggaaattacacattaactttaaatattagtcaatatgcagatgcttttagtgacttatcagctactgttgatggagtaacaacaaaggatattaattttgttaaaaaccctgatgggacaggaactatttcttttagtataaattctttaagcagcagtatatcagttggatgtacacttactataaaagaaataaattatgttaacactacaagttttgatgttaaactggatacatccacaataaaagatgaaaatggtaatgatgtagaagctccagaagaagagatacttaatgtaaagaaagatgctatatattctataaacaataaggttgtagcaggttcaaatggaactataccagaaagtgctagatatttagatacgtcaagttcagtagaagttaaatatgaaaacatatttgctactttagtgttcaatatggctgattttatggataaaagaacaataacattaaatgaaaatactagtgcaactccatattcagtaaaaactcaagataataaaacatatgttagttttatgattacatctttaagtgataaaattcatatatcaggtaaatctacaaaagatacagatgatagttttactgtagtttttgatagtgctactttagtggaaattaaggatacaggaaatagtgggagtgatagtggctcatcatcagatagtgatgacgatgatgatgatttagatagtggaacatatacaataaaaaataaggtattaaaggaagattcagatagtgaatctcatgcaagagagtatgtagataaagaaagtgttgttactgtaaaaaacaataaaatatatttaactttaaaatttaaaaatgcttcagtaataaaaggtgtttcaataaaggttgaaggagataagacaagttactcaactgttaagaagacttcagataagttatacattaaatttagaataggatcattgagtgatgaaattttagttacaacaaatcttgatttatcagattttggtatagagaatcatgatgggttagcatttagagtattattaagatctagtactttagaggaagatgatgatgcagacaactatgatgacgaagaagatgatgaggatgaaactgcaacagatacatcaattaatgataacggaacaattaaagatccacaaaatgatattgtgaatgcaccaccagttaatacaaattctcaatataaaaagacaacttatagagttaataatgagataataactgaaagttcatttggatatcaagcagcaagaggagctgttaataaagttagttactatgaaatcatagatgataaaaaatatataacattaggttttagccagactgatataatgaacaatataagactttctattaatggaaagcagataaactatgacgttgtaagcaaagatgatagtaaaaagactttagatattagatttgaagtaccatcaatttcaactcaagttactgtaacaactaatgtaactgcaatgggtagagatatatcatttggagttgaattcttagagtcaactttagaattaataagtacagaagaagctgaaagtttaccagaattagctggaaattcatcaggagtttcagaaagtaattcatcaggcagtgtactttcaaaaataactaatgccttttcttcaaataagactaatagcgaagataaattagtggtagaagaagaagcagcaaaagatttagcatcattagctaaggaatactttaaaaagtatactgtaactaatgaaatagttagtgatagtgcaataggacgtactatggcaagaaaatatttaaatcaaacaagtattattgaagatattgatggacagctttatgcaacaattacatttagtagttcaggttcaatgggtaattttaaaatagaagttaatggagaagttgtagaacatactgtaccgctaaatgatatggctaatgaattaatatcactaagattccctattaataatgtaaatgatgatattaaagcatatatttatatcaatcctatgagaatgaatattaatttcggaattaaatttttagaggattctatgatattaatagaagaaggaacagttggagaagaggggaatattgaatctagcagtttagcagatactctatctcaggttaatgaaagttcaaaagatagtaaagaacaaactagtgcagtaaaaatagctgcttcaacttcggttatggtaatagtgttaaatcaagtgatttcagcattaggagttcttttaaaaagaataaaagcaaaatctcttttaagaaagattgcagaaaaataataatataaagcaatgagtaagttgatataaaaaataccacagaaaatttggcgtaattaatatattgatttctaaagtattactgggaagtaacatttccagtaatatttttttactttatataaaattgtatttattaaaaatttgtatattttttgcaacatactataaagaaattaagaaacagatagctaaaaatcatgatgttacatagttagtaattataatcttaccttgtaaacataatagttatgctataatacgtataaaaaagaaataatagaataattgtttataaagtaaagcaggtgtaagattgaaagatttatttacaataggagaaattgcaaatttatttgaaataaatataagaacgttaagatattatgatgaaattaacttgttaaagccagaacgcatagatccaaattcaaagtataggtattattcaactaaacaatttgaacgccttaataccattaaatatttacgaactttaaatatacctatagcgaaaattattgatttctttaacaacagagaaatagaaacattagtttctatattaaaagaacagcagaaagaaattacacaaaaaaagagtgagctggaattaatagaacataaaattaaaaatcgtattatacaaattaaagatgcaatttattctgaatactatcaaatagaagaaaaatggattccacgtagaaatatcgctattcttaagaaaaatataaaagttggagaagatattgattatccaattgttgaacttggaagaaaacatcaattaaatacagcaatttttttgggaaaggttgcattatctattgataaagacaatatatcagcgaataaatttgacgaatttgcttctgttattataatcattgaaaatgaagataatactagtgtaaagggtaaatatattcctgagggggattatctaactttgagatttaagggcactcataaagaatcaaaggaatattatattaagatattaaattatatgaaagagaagaactatagtatttgtggggattctatagaaataacattaattgattatggtatgacaaatgatacaggtaaatttgtaacagaaatacaggttccatataaaaaagtattgactctctagttactggatggtttaattttatttctataaaataaatgaaatttataggagtgatttaaatgattggaacaattgtaaacacaggaacaattattacgggaactgttgctggatgtttagtaaagaaaggaattaaagaggaatatcaaggagcgctttttaatgctatgggatttgcagctactgctttaggaattaattctattgtgagccatatgtctgaaagcagttatcctgtattgtttataataagtcttgctgttgggagtttgataggttctataatcaatattgatgaaaaatttcaaaatatgattggaaaatattcgaaatcaaaccttggacaaggactttcaacagcagtattactttactgtataggtactctttctatattaggtccagtaatgagtgctatttatggtgataatacatatttatttactaatgctactttggattttgttacatcaattatatttgcatctacatatggtataggaatgttatttgctgctcctattttgtttatatggcagggaagtatttttctaatagcccattttttatcgggttctttcttttcagatgctttgattacagaactttctattattggtggtgttttaatagcaagttcgggaataagtattttaaaaataaaagagtgtaagacattaaatatgcttccggcattattagtccctattatattttttatattaaagagtgtttttggattttaaacagtactaattataccattacactgtgcgttgcacctgatattgtatcaacttttgtactttttgaagaaactatagcattaggtacttttgggttaaataataacttgtcaattcttattattttatataaatattaaatatgttaagatatttatattatattctacattttcaatattttgctgaatattattagttaaggggattatatatttcagtttgagataaatatttaaaaagttaattgaaatgggagaggaaaaatatatggcagaaaatttaaatgaaaatgcatgttatggaaagaaatttttaaaaaaagatataaaaaatacagctggaaagtgtgctgtaatattgcttattttatctgtattaacatattttcttggaagtttaataattagaatattaaagataagatcatcgttgttaggcagtaattcaaatactggaatgattttaggactttcaaatgatgcatataatttctgggttggatattttccttgtatagcagctgatgtagtagcaattatagcctgcttttttatatttagaaagggaataaataattatatatcctttaaaaaagaggtgccatcagattttattgtatcaggagcctttgcatcaatcggagttggaataatatcaagtattatatttttaatatattctattattataaattctcatggaattgaaataccatcaccagattttagtattccaaaagagactatttatcttatcttatttttttcatatacatgtattattgcaccagtgtttgaagagataatttttaggggatatattttaaataatatgaggaagtatggggattttactgcaataatagtaacttcaatatttttctcaatgtttcactttaatcttgtacagcttgtaaacccaattctaatgggaataatactagcatttgttgcagttaaaagtgaatcaattgttccatctataattgttcatatgtttaataatattatggctatgattacaacattaatttcaactactaactcgcaaaatattcttttaatatggagcagtatttattacatatgtggagtttcagcacttttatattttttatttaagtatggaaaagagctgattgacatatgtaaggaaaagaatgaagttttaaaagtaagaaataagattttttattcatttactaacaaatggtcattaatgtatttagtgttttatttatttattatattagtaacaatggtagctaagaattcttaagatatttaattatatatataaggcattatcaagaaatatagcatagaaagtttaaggattaaatttagcaatatcaaagagggggaaaacaatgattaatacaaatctacttacaatattagaaaatcttgaggaagaacttataggcctatttcatgaatttcatagacacccagagttgtctaatgaggaatttgaaactacaaagaaaataaaagaattattaggacaagttgatatagaggtattagatttaccattaaagacaggtttagttgcacaagtaaagggaaatcctaatggaccagtagttgcaataagatgtgatattgatgctcttccaataattgaagaaacaagcctttcgtataaatcattaagtaatggtaaaatgcatgcatgtggacatgattttcacacggcagttgtccttggagcagcttatcttgttaaaaagtatcaaggatcactaattggaactgttaaatttatatttcagccaggagaagaaagtggggatggtgcagaaaaaataatttcaacaggtgctttagatgatgttgatgcaatatttggaatccataatgtatcagattttgaagtgggagtaatgggacttaaagaaggtgctatgacagcagcagtagatagatttgagattaagattacaggcgtgggaagccatgctgcaaagccagaaaagtcaatagatcctattataatatctacaaatataataaatgcgcttcagactattgtaagcagaaatataagtcctactgataaagcattattaagtgtgactcatgttgaatcgggtaatacatggaatgtaattcctgaaacagcatatatagaagggacagtcagaacacttgatgaacatacaagagagctaattcctgaaagaatgaaagcacttgttgaaggaatagcaaagtcctatggaggaaatgctgaattaatatggcattcaggatcgccagcaaccaagaatgatgaagagtggactaactttgcatctaagctaggtagaatcatgggatacgatgttaagagaatcacaatgggacttgaaggagaagattttgcttactatcaaaaggaaataccaggagtttttattgtagttggaacaggtatatcagaagcacatcatcatccagaatatactgttgatgaaaaagcaataataaagtgttcaagatattttgcaaggcttgctgaatgtgcattgaaaaaaatagttgataaaaattattcgtcaataatttaatagaattatataaaacctgtctttataggataaagttattcaatattaattttttcttgtgatggcaggtttttataattaatgcaattaatgaaacaatttttaggtgaaatagatttcatattagaaactatatttttaaattttcttatatctgataaaataagattggaagaatttaaattagaaaaattgtgggtaataaaaataattaaagttataaagaataattgtaaagggggcagatggagtaataataaatgagagataaaaaaataagcatacttgaaaaatatcatacaaaaatagtaagggtagttattgcaatttttatcgtaggtatagctacaattccagtcaatgccacagcaagatattttttaataaatgaatatggtaaatatgagctatttatgtctttagtagctgcatttgaaataagtatatttatatatttatttaaagttataatcattaataataaacttagcatagagaagtttcagatgactaaaaaattaatgtgtatttctgtaattattgattactttttcattggatttttaaagtatgacataaatattggatataaatcaatatattttgcaattgtagtcgcattatttcttgatataaagatgacaataaaaactaatgttgcattatcattaatgacaatttttatttacactatagaatcaatagttatgaatagacccaatatattaagtattaagttaattatagattctattacaatactaggattaatgacaattttgactacattggtatactttgctgaaagaattttattagaagaagaaattaaagaaatgaaatataaagaagattactataatagaattgagaaaaaacaaaaagaaattaaagaactgagacataatattaaaaatgaaattataatgttaaaaagtcaggtcaataatggaaatataaaagaagctaatataataatggacagaatcatttcaaaaacacaaaatgataaattaggtatttacacagaaaatgttgaaattaactttatgttaaattctaaaattaatcatagtaaaccatataatataaactgggttatagatataaaagtgccgacaaatataagggttgatccatctgatatgggaataattttaggaaatttattggataattctattgaagcatgtagcatgattgaagaatttgaaagaattattaatgtaaatatactttataagaaatctgctatgacaataaatattgagaattcaaaaagtatttattacaattctgaaaaaacttggaaagaagataaagaaaatcatggattagggttaaaaagtgttgaaaaaattgttaataaatatagtggaattttaaattatgaagacaaaattaatagctatgaagttaatgctattatgtggaatgtttaatttattaataataaggataacactaaagagaaaaaatattaattaaggggaatataatgttaatagcagtttgtgatgaccaagatttaatattgaatgaagagatgttcatgatagatgatattataaatgaacatggctataaagcagaggtttgtggatttaaaagtggagaagagttattatataaagtagaaaaaagaaatgtattttatgatatatatatattggatatttcaatatatgatataaatggaatagaaattgcaaaaagaattaggaaattagataaagagtctataatagtatttgtaactggttatgatgaatatatgattcaagcatttgatgtacaagcatttcagtatgttttaaagccgttaagtagagacaaaatggaggtagttttgcataaatgttttaattatatttctgataaaaaaattctctactattttaaacaaggaaaaaatttatttagtataccatataaggatatttattattttgagagcaataaaagaaaagttagaattgtaactaaaaaagaggactattattattacgacacactatcaggtgtggaatcaaaattaagaagagatgtatttgtacgtactcatgtatcgtattttgtaaatatggattacataagaagctttgatggtaaatgcataactttagaaaacgaaattcaaatacctgttagtaaaaaatatgttaattcatttaatgaaagttttatgaagtatttacaaaaaaactgattgttaaattggatttacaatacttatattcaaaaaaaagtaaaaattttagactgaatttttgaagttataaaataacatagaaaattcagtctttttaaagtttatttttaaagttaaattattaaatataagtattacaataatttaacttattgttacattatttaatgttaaaacgatatcatgtaatataatgtattaaaatgtatttaaaagtataaagagataaattatttttgtaaaaattatattttatgttataaattgtgaaatgattgttatttgtatcatgcaaattagtagtacatattgaaatgtaaagtctatagtgcaacatatgtattaaaatattgcaaatttatagaatgataattcatatataaagtggttttcttgcaaaagtaaaaatattgaaaaaaatataaataatatatataatatatattattaagcaaaacttaaaattaaaaggaagttattaaacatgaactatgatgtttttaaggcatttgtagatgaaatgcagcatccagtatggataatggatcgtgaattaaaaattacatatatcaatgattcctatagaaatatttgtggaaaaacagataaagatatattaagtatggattgttctgaaattttgagtaaaagtacatacgatatgattaggaataagtgtaatactgtaattgaaaacaaagatatagtattaataaatgattttgttgatgataaaaatttaaaaataaagcttgttccaataatgaatacttatgatgaagtatctgctattggaggaatgtatatatttgaaaatgtgaatgaaaatatatttaacactgaggacaatataaaaaaattggaatctttaaaaaataaatataaagaattaaaaaaattaacatttacagatataatgacacaagtatataacagaaactattatgaaaaaatatgtaaaaagatagttaatgaagataattttcctataggtttaataatggcggacgctaatggattaaaattagtaaatgatacattaggtcattcagaaggggataaattactaataaatatagctcaaattttaaaggaagcatgtaattctgaggattatgtttttagaataggtggagatgagtttataattttaactcctaattctgatgagaataaatgtgaaaagttaatgaaagatattttggataaatgtaaaaagtatgaggatatatttattaatcctagtatttcattaggattttctattattgatgataataattttgatattaacaaggctttaaaggaagctgaagacaaggtatatcttcagaaattacttcagaaaaacagtttgagtagttccatattaaattcattgatgataagtatggaagaaaaaagttatgagacagaagaacattctaatagagtagttaaatattcaattgaaataggaaaacgtgtttctttatccatgtcagcaatggatgaacttattttggtggccaagctacatgatattgggaagataggtattgatgaagctatattacttaagtctgggaatcttacagatgaagagtatgaaatagctaagagtcatacagaaaagggatatagaatcgtgaaagcttccaatcagctagacagtgtggcaaagggagttttaactcatcatgaaagatgggatggaaatggatatcctttaaagctaaaaggagaatcaattccacttgtagcaagaatagtggctgtagctgatgcatatgatattatgactactgatacagtttataagaaggcaagaacaagggatgaggcaataggcgagttgaagataaatgcaggtcatcaattcgatcccaaaatagtagaagtatttacaaattatttagaaaagagtaaggatgtactgaaaatatgataatattttttagtgcatctttatttatgtacatgaatttataatgataacataatatgtagattcagtgaattaaacagattttaatagttgaaagtaatatatttagaattaaaataaaatttttgataacaatatgtatgaagatgatattgagttacagatataattcatgttgaatttactaagtaatttaaaatatatagttgacaaaagtaaaaaaaaagattaggataaatacaaataagacaccccacgggggggaggagtataaaatgagtgaagaaagaaaaaaagcagttcaatctttaaaaacagctaaaggacaaattgaaggaataataaaaatgatagaagatgatagatactgtattgatgttgcaaatcagcttttagcagtacagtcgcttataaaaaaagcggatttaatgatacttcaaggacatcttagacattgtgtaaaagaggcttgcttcaataataatcctgaagaaaagattgaagaattcaataaagtattagaaaaattactttcaaaataataagttttattttaaaagtaatattcattaaatataaggaaggtataaattaaaatgaaaaaatcattaaagatagaagggatgacatgttcagcctgtgcaaacaggatcgaaagatttgtaagaaaattagatggaataaatgaagctaatgtgaactttgcagtagaaacattaaatgtggattttgatgaaaataaagttacttgtgatgatatagaaaatactgttgttaaatgtgggtataaggtaaaaaagaatcttaaaacttatacatttaagattgaaggaatgacatgttcagcttgtgctaatagagttgagagagtaacaaaaaaacttgatggtgttgaaaactcatctgtaaattttgcaacagaaaatcttactgtaaatattgatgaagatattattggttatgcaaagattaaagaagcagttgataaagcaggatataaattaataaaagaggaagaaaaggattctggaaaatcaaaaatagatgaaagtaaattacttcttataagatttatagtttctgcatgtttttcaattccacttctaataataactatgggacacatggttggaatgccacttccaaatataattgatcctatgaataactcgttaaattttgcaattatacagataattttaacattgccagtaatgattataggttataaattctataaagtaggactaaaaaacttatttaaattaagtcctaatatggattctttaatagcaataagtactcttgcagcatttatttatgggatattcggtatatataaaataaaagctggtgattctcactatgctatgcatttatactttgaatcagtagctgtaatattgacactgattactttaggaaaataccttgaatcagtctcaaaaggaaagacatctcaagctataaaggcacttatgggattagcacctaaaacagcaactattataagagataataaagaaatgacaattcctatagaagaagttatctctggtgatatagtcatagtaaagcctggtgaaaaaattccagttgatggtgaagttattgaaggtaacacttcaatagatgaatcaatgcttacgggtgaaagtattcccgttgaaaagactataggaagcagtgttgttggtgcaagtattaataaaacaggatttattaagtatagagctacaaaggtagggaaagacacagcactatctcaaatagttaagcttgtagaagaagcacaaggatcgaaagcacctatagctaaaatggcagatgtaatatcatcatattttgttccaacagtaataatacttgctgtgatagcatctataggatggcttattgcaggtgaaacgccattatttgcaattacaatatttatagcggttttagtaatagcgtgtccatgtgcattaggtcttgcaacacctacagcaataatggttggaacaggtaagggcgctgaaaacggagtattaattaaaggtggagaagccttagaaacagctcatcttataaatacaattgtatttgataagactggaactataacagaaggaaaaccaatagtaacagatataataagctcaggaatatctgaagatgaacttttagttattgctgcaagtgcagaaaaaggatcagagcatccattaggtgaagcaattgtaaaatgtgcagaagaaaagaagcttaattttaaaaatatagataaattcaatgctattcctggtcatgggatagaagtaaaaatagatgataaagaagttttacttggaaatagaaaattaatggatgataaaaagattaaatttgaaaatatatcaaaatcaaataatagtgatttatttgaacagggaaataatcttgctgagcaaggtaaaacaccaatgtatatagctattaataataatcttgtaggtattatagctgttgcagatatcgttaagccaagcagcaaaaaggcaatagaatcacttcataatatgggaataaaggttgccatgattactggagataataagaaaacagcagaagctatcgcaaaacaagttggaattgatcttgtactttcagaagtacttccagaagataaggcaaatgaagtaaaaaaacttcaaaaggataatttaaaagtagcaatggttggtgatggaataaatgatgcgccagcattagctcaagcagatgtaggaattgccattggttctggaacagatgttgcaattgaaagtgctgatatagttctaatgaaaagtgatttaatggatgttactactgctataaaattaagcagagcaacaattaaaaatataaagcagaatttattctgggcatttggatataatgttcttggtatacctgtagcaatgggaattcttcatatatttggaggacctcttttaaatcctatgattgcagcagcagctatgagtttaagttcagtttcagttcttacaaatgcattaagacttagaaaatttaatccagaggtatagatagtttgtattaactattaagtattaatttaaaaaataggaggaatgtaatatggaaaagaaaattttaattgaaggaatgtcatgtaatcattgtgtatcacacgtaaaggaagctttaagcggaattgatggagtgttatcagtagtagtaaacttagaaggaaagtatgcattggtaaatgctaataatgttactgatgatcaattaagaaatgctatagaagatgaaggttatgatgtagttgaaatcaaataacagatcatttaggaagttgatagtggaaactgtcaactttccactattatttatcaactaaaaagtgtgcgtagccacttttaatatatatgttgtatttttgttatccaatcatttctttgattttattaaatgcatagtcaagtgcgccatcaagatttgcattgttcttaccagctccttgagccataaaaggacttccgccaccttttccatcaataagtgaaatagcatcttttagaacttcattgacttttatttctttaattccttttgtacatgcaaagataagattaactttatcttctgactttacagccattaatgtaactgtatttggagtttcaacaagctttgaagtaagattatttatatattttaaattttcattatcaaatatactttttattattttaaattcacctacagtttctgcattatcaataagttctttaacttgataatttgcaagtgttatatttaaagatttatttatttcattagcttctttaagattgttatttaaatttttaattccatttacagcttcattttcattacagttaagatacttacatattgaattttggaattcatcttttttataagaatcttctatagcacgatttccagaaaggaattcaattcttgttccttctttatgcttttcaaattttttgatttttataagtctaagatcaagtgtactttttggatgaagaccacaacatgcattaatgtcaaaatcatcaccaattttaactattcttatgtcttcctttgtattaggaagagctcttcttaatgttaatttttttaattcagatttagtaggaataaaagattctacttttaaagcatctccaataaccttattagcaagtctttcggcagctcttatttgttcttctgtaagaacaccataaatatctactgtacttatatcggcacctaaatgaattgcaaatgtgtttgcattgaaaagattgaagaaacatccagaaagtacgtgctgtcctagatgttggcacataccatcagttcttctttcagaatctattttacacttaacattatgtatttttataggcttcttttcaactatatgataaacaatatcattttcttcataaacatctataactttgtggtcaccaatcataccagtatcacagctttggccacccccaccaggaaagaatgctgttttatctaatgttacacgaaattttccaaggtgttcctcaatattaactatttcagctgtaaaatctcttaaatagggatcatcgtaatataatttttccataaataatgcctcctgaatgtttagtaatttattagcaattattaaataattatatcagactttaataaaaaagtagcatttaataaataattcaattaataattcatgtgaaaatgcggatatttttttgattaattatgtaaaataattaacttattataatcctttttattagaattattataattttgaaaagtagaaatattaaattagcatatgcataaaagtggcttatatattaaaaattacataatatgaagtaaggataaattgctaattatgtagggataataaagttatcttaagtgattggtggtaatgtaattatgtatttattttttacatttataatttattcttttgctggatggataatagaagaattatattcaaagtattctacaggcagatttaaaaaggatggatttcttaaagaaccattgaaacctatgtatggaatagctattaccatattaataatatattatgaatttttagaaataaggggaataccttttatattcttttgcttgatagttccaactactgtggaatatataagtggatatttacttaagcatttatttaataaagtatactgggattattcagatttgaaacataatattaatggatatattagtcttattttctcaatatattggtgtattttaagctatattggagtagtatatttaaatccattaattactagtacatatatgttgtatggaaatataataaatcctatgctgttattcttaggaattatttttgttttagattttatggttacaataaataaatactataaccataaaaaatatatagatagataattaacattgcaataatatgcccaagttgaaaaaaatatttattaatgttattcttataatgaaaaagttgtataattttataaaaaaatacaattaatactttaaaatcataaatagggataaaaaatatatacaatacagtaataaatagggaggcatattcatggaagaaaataaacaaataagcttttttaaatctgttaaggtaaggttatttcttatctatatgataatgatattaaatggagtaattataggaatagggtttaagacaagtgttacagtaacaataatatcaattgctatagcgattgtaattggtgggggattaatattctctaccataagcagtatgttaaagcctttagaaaaaataaagcaattggcagatagaattagcatattagatatttctcaagatatagacataactatggataatgaatatggtgctattgctaattctttaaacaaggctcagcataatttaagagaaataataaagctatgctcagataatactaaaaatgtacttacattaaacacaaacctttcagagacaataaatcaattatgttcaacacttgaaagtgcagaagaatatatagagaaaatagacaaaaatgcagaaaataatagtggaacagttgaagaaatatatgcttcaattgaagaaataactgcaaacatgcaagaattatcagctagagctgaaactggcacttctaattctatggaaataaaagaaagagctgaatcaatacttaaaaatagtaaattagctattaataatacaagagatgtatatcatgaaagagaaagatatataaataaagcaattgaagaatcaaaagtagttgaagaaattaaggttatggcagaagcaatagcaggtatagctgaacagactaatcttctagcgttaaatgcagctattgaagcagcaagagcaggagaatctggaaagggatttgcagttgttgcagaagaagtaagacaacttgcagaagaatcttcagaatcagttggaactattcaaagtacaattgaaagagttgaagcagcatttaaaaatctttccaataacagtagtgaaattttaaaatttattaaaactgatgtaaaagaagatttgaatcaatatggtaagattggtgaaacgtataataatgatggggaatttataagcaaaatgtcagatgagttatcaaagatgtcagaggctgtagcatcatcaattgagcaggtaagcatagccatttctgatacagctaaaaattcagaagaaacagtaaagaatacacataatattaaggatcgtgtaaataatgcaacttcagctatgaaacttgcactatactctgtggacaagggtgttaaagacgcagagaaacttaataatatgattgataagtttgttatagaataattgttttagtggttaataaaaatattagtttccaattaaagaataaaaatgctgatgattatatattactcatcagcatttttattaattttaatatatggagaaaaattataaatttatattgagtgtagaaaggaaatttttattttacttgaagatcaaaatcgccacttgtagtatttacgttaattttgctagatttatcaccattagtcatattgttttcagaattatttaaagaaccagaaattgtattgaaatttgcttcatatccacagaaggatggaatatgcaaattaacatctccagacatactacttaaaaaagtattatttaaattatctttaaaagtaagttttatatctcctgatgatgtacttccagtaagcgctccaaaatttccatttccattaattgatcctgataatgaggttaaatttgtttcattactagtagttgaagaacttatattcatatcaccacttgaacttgatagatatagatagtttaaattagtgctgcttaaatttatatcaccacttgcacttgatgcatttaaagtatttgtggataaattgtttatagttatatccccgctacttgtagtgatttttaatgttacttttgatgataagtatgatggcatacttactatgatatcagcactgttaggaatatctacagttggagaaaatgtcatcttattattactgtttactaaatttagttcagcatttgatgaagaaaaacttttaatttttatatttaacatactattgttattattgataacttcaatgttctgagaattaagattaaaatctaattcagatatactattatctatatcatagtcatgagaagaatatgaattagtgaaattcaaaaagttattagtaaaatctagattatatcttagtgaacttgggtgtatattaaattcatctgaataatctgatagattgtaattgctctgaataagaataatacatcctgaagcgtaaaatataatagataaaataaacataactaaaagaaaaattttcattttagtagagattaatttcttattcattaaagatacctcctttagactttaagaagtcaagcagctttttgcatagtctaaagaaaaatttgcatgaataataaaatgtgcaaataagaaatacagataaacatacagatccaatagtaaacaatactattgctggatagggaaaatcagtaataaactgaggtatatgaggaaatcctataagatttgtaaaagttcctcctattaaaataccaatactaccagctaaaagacttaaggcaacgcctagtattccaataattattccagctatacttgtaagaataggacaaaaaactataataccaaggattataatgcataactttaaaaatttatcaactttaggtgaagatttagtatgatatctattggcattttgatcattattaaaattataattacgattttgatctttatttttacgattactttcatcattacttgctacattaactgggttgatgtaatcagttcgttttatttgagaaagttcatcaatatggtcattatttgattggtttttgttaatattagtagaagataaagttttatgatcttcttcaaaaatttcagaatatgaagaagagtttatatattttttacatattaaatacggatcaccaaaatcttttattatttcagattcattttttccttttgaaacttctatggaaattttatttttataaaatgaaactatcttttgtaaatctaattcaggcaattctttaagttcatccattagaatgttaaaaaactcatttcgagtcattttttaaacctccatatcttgatagtgtttattgaaagatatataagtaaattaaaaaaattaccattatcttcgtttctagtatattctaagagattctatataacaatagaagttatatcattttcagtatttattaaggtctttaataataaaatttaggctttgttaagaaaaaattaacaagtgtacaaatccacaaaaatataattgtggataaaaatgttaataacttttatgggacatttaaggaatgtgataaaacaagggggttagggggtgttattagtgtgtatataattaacttatctgtggataactatgaaaaataagatgattattactaaaaaaagtataaattttttatgacatagatatagagattaaaaatataattgtaattcggtgaaaaaaataattgcaaatattaaatgtatattatataaatagaattgtaagtttattttatagctaatatctataattatctgtaacatacaacggttacacactattggacgagttatatttttatagaataagtttaggtataacataaaagtctgaattaaaaatttgattttatgaataaattaacaaaaatgtggataaaacctgtggataatgtggataagttgcactaataattagtgcaattgtaaaatataaagtagtataatattattagactttgtgtaagaatatattattgtggaattggagggagcttgcatgagtaatcaaaagcaaggtaaaaatatacctgagattaaaggaacattaagaaaacatgtcgtagaagttccaaaagtaattagagaatgtagtggaattaagatttttggtaagagaataaaatcgttactatttagtactgatgttgcaataattaagaatacaaatgcagacgctgtaattgcagtatatccatttacccctcagccattaataactcaggcattagttatggcagctgatattcctgtattttgtggagtcggtggggggattacccaaggcaagagagtcgttaatttagctcttgatgctgaatttaaaggagcaatgggtgttgtagtcaacgcaccaacaagcaatgaaataataaagcatataagagaaacaatagatataccagttatagtaaccgtaattgcagaagatgaagatatctcaaagaggatagaaagtggtgcaactataataaatgtatctggtggaaaaaatacagctaaaattgttagaaacataaaaaaaatgtatccagattttcctgtaatagcaacaggtggtccatgtgaggaaactataaaagaaactatagaagcaggagcaaatgcaataacatttacgccacctacttctgcaagtataatgggcgaattgatggatgaatatagaaagaggtaaaatttataatattttacaaataaaaagtattgaattaactttaaaatatggtatcataattttaatagttgaataaaatggtaatataacatgacctgaggtagaggtgctgtgataaatagtaaatataatgagtctggtagactatgacttatattgaaaggtattacggccgaaggaataagttaaaccaaagcttatttctgggtattcataaaatatgtggataactgtcacgaaagtgttgagctacaaggcatatcttttaattagcaaaatatgcagcttattattaataggaattgatgatgatttacatacattaagacttaataaatagtagatggataggatgctgaaaaattgttgtgcatcaatgaacataaatcagcactagcgctatcactcgtcacagaaattatctgtgacgttttttttcagctagtattgtacattttttaatgtcaattgttaattggaacatatataatattttagtttaaaaaggtttaattataattattcataatcaaatttaggataactgaattgtgtaattattaattaacaaatattaataagcaataacaagttaacaagtagcagtaaacagttgaagattataactgatagctgttaattaaataaagttttgggggtaacaaaaatgaaattatttggtacgatgaaggttgaagataaccaattaacaattggaggggctaaggctagagatttagtaaaagaatatggaagtcctctatatgtttttgatgaagaattaataagggaatactgtagagattatagaaattattttagatgtgaagaaaataataacagagttgcttttgcaggaaaggcttttcttacagttcaaatgtgtaagcttttaaaagaagaaaatatgtcactagatgttgtttcaggaggagagttatatactgcgtataaagcaggatttccacttgaaagagtaatgttccatggaaataataaaacattagatgaaatcgaacttggagttaagcttggagtaggaaattttgttgtagataatcattatgaaatggaagtcttaaatgatattgcaaagtcatatggaaaaactcaaaatatatatttaagaataactccaggtatagaagcacatacacatgattatattaaaactggtcaaattgattctaagtttggttttgcaccagtaggaactgtaatagaggatgcggttgaaaaggcaataaatcttgaaaatataaaccttgctggtatccattgtcacataggttctcagatctttgaattacagccatatgaagatgccgttgaagttatgcttgacttagtaaaaaaaatacaagaaaatcacggatattttataaaagaagtagattttggtggtggttttggtatatactataataaaggggacaaacctagaacaactagagaatattgtgaaacaataattaacaaagttgatgaagtttgtagaagaactggtcaggaaagacctattcttacaattgaaccaggaagaagcattgtagccaatgctggtagtaccctttacacagtaggcagtgttaaagaaattccaggcgtaagaacttacgtagcagttgatgggggaatgactgataacataagaccagccctttataatgcagcctatgaatgtgttatagcaaatagagttaatagcgaatgtggacaaactgttacgatagcaggaaaatgttgtgaatcaggtgatattttattagaaaatgttgaacttccagaagttacaagtggagatatacttgcaattttaacaactggagcatatggctattcaatgtcaagcaactataatagaataccaaaaccagcagttgtaatgataagagatggacaggctagactcgtttgtaaaagagaatcctacgaagatataatcagaaatgatgttttataaaaatttagaattaaaattttaaatttgaatatactattaatgaaaagtaaatgcaattaaatttacttatttgattatattttttaactaagctttttattaatattctttcccaagattataaatatataaagactgatatgcactaactattttagttagtgcatatctttttcatatagaaatttataatgactaagagttaaaaattaataagttataaatattttatattataaattatggtatactatttagtgtattttaaagtgggatattattcaatttaattgatatgtgatgccctttgtgggtactccctgtgaataatttacaattaatttggaaatcactatgtaatttctaaattacaattgtaaagttcatagttcaataaacatattaagatgtttatgtattgaagaaaaatctgatttttataaaatataaaatggtaatatatggggagggatagttgtgagtgaaattagagcaaaagaaattatacaaggtcaaaatcccaacagtaaaaaaaataaaagatcatttttaaaagaatgtgtaatagatatttcaattattgctgttgttgcattagtagtatggcgctttgtaggatatggagtttggattacaagtggttcaatggttcctacacttgaagttaaagacagattaattgtttcacgagtatacaatgtagataatctaaactacggtgatattgttctttttaaaaatgatgaatataaaaataagacacttataaaaagactaataggaaaacctggagataaaattgaaattgttaaaggtactgtttttagaaatggagaacaacttcaagaagattatgttaaaaataatgataaatatgatggtaattttgaagttcctgaaaatgagtatttctttctaggagacaacagagcagaatctgatgatgctagatattggaagtatccttatattaataaggatgagatagaggcaaaggcagagattagatactatcccgtaaaagattttggatttgtaaaataagaagtcttgaaaatatttaaatcatgattgacaataataaattagaatatatatttaaattaacaatccatgttgaaaacagtatttgatttctaatttataattataacgttaatagttcaacatatatatatcaatattttgaaaaaacatgaaaggacgaaattgtctatgaaagaaaatgatataattgaaaacaaggaaatagaaaatgatggtgaatcaaaagaaaagaaaggaaatttctttaaggattggataattcctatattttgtgcaatcgctattgctgttgcaatcaataagtttgtatttattaatgtttatataccaagtggatcaatgattcctacattaaatataaatgataaacttatagttacaagaatatggaataaagacagcataaaacgaggagatataattgtatttaaatcagaagaacttaatgaaactgtaataaagagagttataggacttccaggtgatcatgttgaaataacagatggcttagttaaagtaaatggtgaacaaatcgatgaaagttatgttaaaaataatgaaagttataatgggatatttgatgttccagaaggaaaattattatttttaggggataatagagctgtttcttatgatgcaagatattgggaaaatccttatatcgatgaagatgatgttcaaggaaaagcacagttgagatattacccaattagtgattttggacttgtaagatagagtttattattatttattttggacaatattatttatatgaagtttaaaataaaaataaccttatataatatagacttagataaagggtatgtctttgggagagtgttatgaaagatcaaataaaaaataaatctaataacaaaaataaatataagtttttcacagagtggataatacctgttattgccgctcttggaattgcgttattaataaacaggtttttaatatttaatgtttatatacctagtacatctatggtacctactataaatgttggtgatagacttatggtaaatagagtatacacaaaggataatctaaaaagaggagatatacttgttttttattccaatgaacttcaggaaacacttataaaaagggttataggacttccgggagatcatattataataaaagatggaattgttaatgtaaatggagaagatctacaagaggattatgtcaaaaataatgattttagtgacgatgaacttatttatgatgttccagaaggaaaatacttctttttaggagataatagaccagtttctaaagactctagaagatggataaatccttatgtagatcaagctgacataaaaggaaaagctattttgaagtattatccacttaaagactttggaagtatggattaaatttagattttgcttgcatatacagcaaagatagatgataattataatattaataaatttaatcatttaggcgcataaaagaaaatagtcagacagattgacttgttatttttttataatgccttaaatggatatagagtaaatttattaattaaaaaaggggttaaattaaagtatgagtgaaagttttattattgacagaattgaaagcggttttgttgtagctgaaactgaggatgaaacaatggttaatataccagaaaacttaattaaaggggattttaaagaaggagatattcttataaaggaagatgaattctttaaggttgatagtgatttaactaaaaagcgaaaagaagaaatagatcacatgcttaaaaatatgtggcagtaacttacagtggaagggaatggtgattaaatgcaggataataatcataaaaataatggcaagaaaaataaaaataagtcatataccgtagttatcacttactttatcattgcatttgcatttgtaatggcgtttaatgttgctaaagataagagcacgacgaaagaaattacatataataaattcatagaaatgcttgataataaggaaatttctaaagtcgttataactagtgataatttattaataacaccaagtgaagataatgaagaatataaaggaaaaactttatatacagctcatattaccgatgatacactaattgataaacttcaagcagcacaggtagatttcacaggtaagaatcctactgaaagtccatttttaaatattcttatgagttggatacttcctattggatttttcttctttatgtggaaattccttttttctaaaataggtggcggcggtggcggcgtcatgagtattggtaaaaataatgctaaagtttatatggaaagtgaaataaaagtcacttttgatgatgttgcaggtcaggaagaagctaaagaatctttaaaagaagtaatagatttcttaaactgtccagcaaagtatacagaaataggtgctaagcttcctaaaggtgttcttcttgtaggacctccaggaacaggtaaaactcttattgcaaaagctgttgctggtgaagcaaaagttccgttcttctctttatcaggttcaagttttgttgaaatgtttgtaggtgttggtgcatcaagagtaagagaattatttaaagatgcagttgcaaaagctccttgtatagtatttattgatgaaattgatgctattggtaagagcagagacaatcaaatgcagagtaatgatgaaagagaacaaacattaaatcagttattatctgaaatggatggattcgattcatctaagggtgttgttttacttggtgcaactaatagaccagaagtacttgataaagcacttcttagaccaggtagatttgatagaagagttatagtagatagacctgaattcaaaggtagagaagctatacttaaagttcatgcaaagaacattatcttaggtgatgatgtagatttagaagaaatagctagaagtactgcaggtgcagttggtgctgatcttgcaaatgtaattaatgaagcagctcttagagcagtaagaagaagaagaaaagttgttcttcaggaagatttaagagaagctgttgaggttataatagcaggtaaagaaaagaaagatgctattctttcagaaaaagaaagagaaatagtatcatatcatgaagtaggtcatgcgcttgtttcagctatgctgaaaaacacaaagccagtccataagattacaatagttccaagaatgacaggttcacttggatatacaatgcagatagaagatgaagaagaaaaattcttaaagactaaagatgaaatgatgaatgaaataaaaattcttcttggtggaagatcagcagaagaagaaaagtttgatttagtaacaagtggtgcttcaaacgatattgaaagagcaactcaactagcaagagctatgatttctatgtatggtatgagtgagcaatttgatatgatggcattagagtcagttcaaaatagatatcttgatggaagagctgttagaaactgtagtgagcagacatctacagttttagataatgaagtattaaaaataataaaagaagctcatgctgagtcaagaaagattttaagagaaaacagagaactgttagataaaatttcagctgttcttatagaaaaagaaaatatttttggtgatgaattcatggatttaatttatgaagtatatcctgaaaagaaagaagaagctgaaaaagaaaagatagaaaaggaaaaaagacttaaagaagttgaagaaagaagagctagaaggcatgctttagataaaccaattgaagaagaagttaataaaactattaatttatctgcaggttttgaaaatcaggaagtaaagccaataatagagaatactgactcagtaatatcagaatcagaagaatcagcttcaagtcatgaagataataaagtaatagaagataataaagtaatagaagatgttaaagatgatgatactaaacaatagtattagttgatttacgttgataatttacaatgaaggtgaaaatccttataggattttttgaattttaagtctgagcctaagtctaagtatatatacttagacttagagtatttagagagtttaatacattaaaatattgagataagaaatggcttaatcgaaagattaagtcattcttgccttaataaatatggatttttaggcttgattacagcagcaagacattaaacaaaacaaaaaggagttgtaagcatgagcagacagatagattttttaatggaagaaaacaagttaaatgaaataaaggaaatattaaatgaagaagttttaaaatatttagaacgaagaaaattagtgacaaatcaaatgcttgaagcgagaaagaagtatattgaggagtataaggatgatgaagatcaggttatagattactttgaccatgaaaattatgttacagaagaatcttataagactatagataaaagacttatggaatttactaaacttaaagaatcaccttactttggaaaagttacttttaaagaagaagacagccttcctgaggatatttatgttggaagatatggattaactctagaagatgcatatgagcctttaatagttgactggagagcgcctattgcttcactattctataagggatcagttggaccatcaagctataatccaccttcaggagaaattaaagctgatattttatcaagaaagcagcttataataaaaaaaggtgagttaaaaggtgtatttgattcagcccttgatgttaaggatgaaatacttcaaatggttttaacaagtaattcatcagaaaagcttaaagatattgttatgacaattcaaaaggaacaagatgaaataataagagaagaaagaaataaaattgtagtagtaaatggtgtagctggttctggtaaaacaacaattgcattacatagagtatcgtatcttctttataattttagaaaacaatttggtgataaggttcttatctttggaccaaatgatatatttatggattatatagctcaagtacttccaacactaggtgaaagtggaggcattaagcagactacttttgaaaactttgcaaaaagagaacttaatttagaaaatgaaaacataaagagttttggaaaatatattgaagatgcaatgaataataatcatgaggctttagaagaatataaatataagagttctaagaagtttgtagaagtacttgattctaaaattaaagaattaaatgaagattattttaaaattcagcctgtcatcttcaacaatgaggaaatagtttctgttagtgaagtagaagatttatttaataattattataaggatatgcctttatttagaagaagtgaaaaggtaagaagaatccttacatctaagattaaggataaaagagatgaagctgtttataaacttaatgaagaaataaaagagaaagctaagaatctttcacaagatgaagctgatatagaaaagaacaacttagagtttctaagaagaataaaaataagagaaattgtaagagaagttattaattctagaaaaactcttgataactggcttaagattgaacctataatagatatttacaagagaataataagtggagaaagtataaacaaacctgactctgcttttgatgctgaagctataatagaatcctcaaacaagaaccatattgagcttggatacatggatttaagcggtatactttatttaatggttaaacttgaaggattaaagattaaggatgacattaagcatatagtaattgatgaagcacaggattatagttatatgcagtttgaaataataaaggaagtaacaaagtgtagcagctatacaatagtaggagattcaaatcaaaggcttataacaactgatgatgaacctgcaatgcttcatttagatgaagtttttggtgatatgaagactgaaataaagaagtatgatttaaataagagctatagatctacacaggaaataatggagtatgcaaatagattcttaaaggaagaccgtattgtacctttagttagaaaaggtgaagctgtctttgaagaagaaacagaaaatgcagaagattgtatagaaactatgctttcgattattgaggattacgaagaagatggatatgaaaatattgcagtaatatttagcaatacacatgacttagaagaatatgcaccaattttaaaacaaagaataggaatacaaaaccttgataatgaagatattctttataaaggtggaaaagtaatcatacctgcatatcttgcaaaaggattggaatttgatgctgtaataatagttgaaaataataatgttcagccattagtgaaatatataatgtgcacaagagcacttcacagactttcagtaattaaaaatatataaatatagttttaattaagaatatgaaagaaataataaattaaagtatgaggaaaatatttttcattatacaagtaactagaattcataatattcatttattagaaattattatgactaagtataatggaaaatagcaaggtggattgatttattattttttgataatgatttaatatgcataaaatatggattttcatattttatgcatattttttgttgtaaatatgcataaatctgattttattacagttaggtataataattgataaattacatataaatatatataagttttaaaatatagagaaaaataacatgaaaaaggggatttaaaactattttgatcattactttttcatttttttgttaaaaaatattaattgtagcatagtattacaaaataaatccgaagattaagaatagttataaccataattttaatatttatttataaaaaattaaaatatatattgaataattataaaaatgtatgtataattatactaaagaaaagagaaaacaattatcttaagggggtacaatatatgaaaagtgcattagtaaaaaaaatagcagctgtagctgcagtagcagtattagcaataagtatggtgggatgtggatcatcaagtgatgaaaataaaacagcgttagataagattaaggaaagtggtaaacttgtagttggaacaagtgcagattatccaccttatgaattccatgcaacagttgatggaaaagatgaaatcaaaggttttgatattgatattgcacaggcagtagcagatgatttaggggtaaaacttgaaattaaagatatggattttgatgggcttctagtagcacttcaaggtgataaagttgatatggtatttgcaggaatgactcctacagaagaaagaaagcaaaatgctgacttctcagatatatactatacagcaactcatcgttttattttaagaagtggtgaagaaggttcagttaaatcatttgatgatttaaaagataaaaagattggtgttcaaaagggatctattcaagaaggtattgcaaaagataactttgatgcagcaaatattaaatctttagctaaagttactgatttagtgttagacttaaaaaacaacaaagtagatgctattttaattgaagatggagttgcaaaaattaactgtgacaagaatgaaggaattgctatgtctgactttgtagtaacagatgaagatggtggatcagcaatagctttaaagaaaggatctactgaattacaaacagaagttaacaatactataaataaattaaaatctgaagataaaataacaaaatttgtttctgatgcaaatgatttagcagctgaacaataaaaatcaatagttgattgttgatataaggaaagttgatgatttaataacgactgagatgagttaattaaaaattggaattccaatgaattttaatcttatcaagttgacagttaatgtggaaagctgatggtggggatgaagcagaataagctgtttctaagaatcactttttagaaaattagtctttttatccactgctatcaactttcaattactctaaaagagtacagacagaaaagagtggcatcaactatcaacttataagaaaggatgtagggattttgaattttacgtttttagaaaagtattttggatattttgttaaaggtgcagaaataactatagtgctagctttatttgcagtgctatttggtacaatcttaggccttggaattacattaataagaagatcaaagtttaaagcaataagctttataggaacagcgtatgttgaatttatgaggggtacaccactattagttcaaatatacataatatacataggattacctaaattaataggaattgatttacctgatatggcaacagggataattgcattatcattaaattcatcagcatatgtatcagaaataataagagcaggtattgaagcagtggacaaggggcagatggaagctgcaagaagtcttggtatgaatcaaaagcaggctatgtttgaagtagtaataccacaagcgtttaaaaacatattaccagcattaggaaatgaatttatttcagtaataaaggaatcttcaatggtatcagttataggtgtagcagagcttatgtacaatgcaggaattgtaagaggaaatacagcgttaggacttgaaccagtagtggttgcagctataatttactttataattacatttacattaacaagagtactgggctatgttgaaaggaggatgaaggcaagtgatatacgttaataatctttataagagttttggaaaaaatgaagttttaaagggaatagatgagcatattgcaaaaggtgaagttgtagttgtaataggaccatcaggttctggaaagagtacatttttaagatgccttaatcttcttgaaacacctacagatgggaaaatcacatttgaaggaaaagatataacttcaaaggaaacaaatattgataagatgagagaaaaaatggggatggtatttcagcagttcaatttgtttccacacaaaacagtatgtgaaaatatctgtttagcaccaatgaaggttagaaaattatctaaagatgaagcaaagaaaaaagcaatagaattattaaaaaaggttgggcttgaagataagatagatgcttaccctgcatcactttcaggaggacagaaacagagaatagccatagcaagagcacttgctatggagccagatgttatgctttttgatgaaccgacttcagcattagatcctgaaatggttggagaagttctaaatgttatgaaggacttagcaaaagaaggaatgacaatggttgttgtaactcatgaaatgggatttgcaagggaagttggagatagaataatatttatggatggaggaaaagttttagagtcaggaactccagaagaaattttccaaaatcctaagaatcctcgtacaatagattttttatctaaagtactttaaaattacactataaaaagtatccagaattaatattttgggtactttttttgctttaaaatcaaaatttgttcctaatatactattaatcattaaaccaatcaaactttgggattattcaaggtttcaagaagtatatttgtatggtgaagtttttagtattgagccattttggaaatttaattaattgtttaggaaaggtgaagaataataaactttagagtaaatatccctatttatacatattttaggtataattatatatgagtataaataaagctagatatattctaagaataaaactttatagaatgtaaaaaatttagcacaattgtctattgtaaaatatcagttgttatatatactaaataaaaagcaagtgaggtaaaatatgaagaagaatagacggattgttagcctgttagcaggagcagcagttataatctcaatgattacgccactatcaaaaggatatgcagcagaaagaactggaacttatgatttaaagactgttaacataagtaatgtaagagcacaggatgatttttatgaagctgttaatggagagtggaagaaaaatgaggaaaacaatattaatgatctttatggtgaaaagagtacttatagtgatataaaagaaaataacgacaagatagtaaagtcagaatttgagagttttctccataataaaaataaatatggagaaaacagtgatgaaagaaagatggcagatgtatatgaaaattatattaatagagaggcaagaaattcacaaggaatagaacctatggaaaagtacctttcgaaaattgattctgttaatacaatggatgacttagctaaattattaggtgacagtgagattgatatactaactaatcttatagattttaatataaaagagaattacaatggttcagcatatgaaatagctatagatcccactgaattaagtttagttgattccggaaagtatggatcaaatggagattatgaatattattcaaaagtcagggatttttatatgagtcttttgagtaaatgtggatatagtgaagtagattcaaaaaagatgattgatgatttgtttaaatttgaaaattctattgcagggtcaattttaagttatgatactgatgaaagtcagattgataaaagtcagtataatattttaatgaagatagatgatcttgatagagaagcaccaaatataaaattatcaagtatgatgaaatcgctaaaaattgataaagcaaattatattgaagtaagtgaagttaactggttaaaaaaactaaatgaattatggacacaggaaaatctaccattgattaaaaattatatagagttgaatgtaataagatcatcaggaagatatctttcagaagacatggacaaactgtattataattttatagaaaatattttaggtgtgaaattttcagatgtatcaatacaaagtgaggcatacagtaagataagcagcgtttttccaatatcacttggaaaattatacacagaaaagacttttaatgaagctgagaaggctgatgttcagaacatagctgatcaggttatgaatgtatataaggagaagataaagagctgtagctggataagtgatgttactagagaaaacttgatggacaagttaaataagatgaaaataaatataggatattcaaacagtaatcaggattattcaaatgcagaaataaaattgtattcacacggtggaagcttattagaaaatatgataaatattgcattaacagcaagagataatcagataaagactttaaatactccaataaataaaaatgaaattattgatcagataataccacaggatgtagtggcagaatatcatacattaaataatacagttgttataactccgggaattattcagcctgaattatatgatatcaatgattcaatagaggaaaaacttgctggaataggcatagttattgctcatgaaataggtcattcattagatattttaggagcattttttgatggagaaggaaatgttaaagatatatggacgaaagaggattttaataaatataaagaaaaagcattgtatataatgaattattatagcgaaattgaagcattacctgggaaatatatcgatggtgaacttactttgtgtgaaaatatggcggatatacaaggaatgtcatgtattttagaattattaaaaaatacaaaagatgctgactataaattattttttgaatcatatgcaaaggcttataagagcataaagaccaaagaatcatacgaacaagcgttagtagatgatgaacattcaccagataaggaaagggttaatgttgttttatctcaatttcaaaagttctatgatacttatggaataagttcagatgataagatgtatgtaaatccagagaatagaatgtctcctttatggtagaaaatattaaaaatatatattaaaaagtcggctaatcagccgacttttttgttactaatactattaagtataatgtttatcaacagtaatcaatgttctataatcaggatgtactttttggacatgatcatttatattactcttgatttcaccatcacttagtgagattttctttgatgtatctataaccacatcaaaaattatatttttatattcaccttcaccaataactctgaaatcatgaatagaatcaacatattcaaaattgtttaaataatctttaatataatcataaatttctttaacttcaccttcgattatacagataggatctatatgtataacaagataaatattaagttcatttgaaatgtctctttcagctttatctataatctcatgtatttttacaagacttatatcacttggtatttcagcatgaattgagcacatacatcttccaggaccataattatgaattataagatcatgagttcctaagatgttgtcataagacattaccttttcatttatagcatttacaagttcagggtcaggtgcttctccaagaagtggatttaaggtttcttttacaagattaaatccagaataaactataaataatgcaactcccatacccatgtatccatcaattggaattgatgtgaactttgcagctaaaaaggatatagcaacgcagcttgaagtaaatacatctcctaaagcatcaacagaagctgcctttaatgcagaggaattaatcgtatttcctatgtgtttattgaatcttgaaagccatactttaagaagaatggaaactaaaagtaagataaaaggtattaattcaaatacaacaatatcaggatttattattttctgaaatgaggatttgataaattgaacacctacaagcataaccatgaatgctactattaatgcagaaatatattcgattctgccatgaccaaatggatgctctttatctgcaggcatgcttgaaagtttaaatccaagtattgttataattgaagatgctgcatcagataaattgttaaatgcatcagcagttatagatatacttgaagttattaatccaacagaaagtttgattgtgaataaaacaacatttactaagataccaataattccgcctaaaaatccataagaattacggacttttatatcatgagtattatcatgatcttttataaatttatttactaaaaattgggacaacataatatacctctcctttgtaaagtttaaataaatatatatgctctaattatcaattaacatttgaggttccttacggatactcattatgagtaattgacaatgaaagtaaaaatcttataaaatttatttaatttataagattaattgtccatcttaaattgtctattgtcaattgaaacatatattataaattttttaaaattaacttatttcaattatttccttaatagtattatttatttgataaaaatatattctaattcatagtattcatttaatgtgatataattataatcaaagaaataatgaattagcactcatataaggaataatagaaatatgttatataacactatttattgtaaaattaataggaatatgatgtcaattcaaagtataatattttggacaaaaatattggggctgaatgcaaaatattaaggaggattatattgatgaagaaagtgatttttaaaggggcagcagtagctattgttacaccatttaatgaagaaggaattaattttgaggaacttaaaagacttatagactttaatatagaaaatggaacagatgctattgtaatcgctggaacaacaggggaatcatctacaatgagtgatgaagaacataaagaagttattaagtttacagtagattatgtaaataaaagaattccggtaattgcagggacaggatcaaatgatactttatatgccttggaattatctcaatatgctgaaaaagtaggagttgatggattattaattgtcactccatattataataaaacaactcaattaggattagttaaacattataattacatagcagacagagttaatatacctataattttatataacgtgccatcaagaacaggtgtaaatataactccaaagacttgtttagaattatcaaagcacaaaaatattgtagcagtaaaagaagcaagtggaaatttatcacaggtggcagagataagagcattatgtggtgatgaacttaatatttactctggaaatgatgatcagatttcaccaatattatcacttggtggaaagggcgtaatttcagttctttcaaatgtggcaccaaaagaaacccatgagatatgtcagttattttttgacggtaaggcagaagaaagtgcaaagattcagttagaatacttaaatcttataaatgctttatttatagaagtaaatcctattccagtaaaaacagcattaggtcttatgggatataatgtaggacaacttagaatgccattatttccaatggaagaatgtaatcttgaagttttaaagaaagaattaaaagctagaaatttaatatagattcagagaacatgacataatttaatatattataattttaatgctacagaatggaacttttacattctgtagcatttttaatatataaatgtatttagtaaataatatacgttataaaattaaaaggcttatagatacatacattaaagctataagatgactcaagaataagattataaaattaaaagagtattaatgcagtatgtatttaacttgttttttattgtaaatattatataatgtataattaaaattctaattgtttagacatttattaaagcaatatgtagattcattatgagaacttatatataataattcataagaaaaaaattgggggtatagtcgttgaagaaagttaatgagatactaaataatacaatatataagaaatgtattaaagagatagaagttatggaacaagatagagtgttctgtaggcataatataaatcattttttagatatgggaagaatagcatacatacttgtattagaagaagggcttcaatattccaaagaagttgtttatgcaataggtctgcttcatgatataggaagagcgcaagagtataaaaataacataaatcatgatgaggcaggtgtgatcatatcagaaaaaatattaaaagaaacatcatatagcactgatgagataaatttgattttgaaagctattgcaaatcatggtaacaaagatgtggaagataaatttttaaacataatatacaaaagtgataaattatcaaggaattgttttgattgcaaggcagagaaggaatgttactggagtatagagaaaaagaatatagaaataaagtattaatagacatgatataaaatagtgttaaaatagtattattaaatagacaagtaaatgttaaaaggttatacaaaggaatggtgattattcatgaaaataggtaataaggaatttaaactaggggaaagaacttatgttatgggaatattaaatgctacacctgattcattttcagatggaggcaagtttaatgaagttgaaatagcattaaaaagagttgaggaaatgataagccagggagcagatataatagatgttggaggagaatcaacaagacctaactttacagtagtagaagttgatgatgaaataaatagagtagtgccagtaattaaagctataaaagagaagtttgatattactgtttcaattgatacatataaggcaaagactgcagaagcagcaattaaagcaggtgctgatattataaatgatgtatggggatttaaaaaggacaagaatatggcttctgttgcagctaaatatgatgtaccatgtattcttatgcataatagagaagataagccatatgaaaatttaatggaagatgttaaaaatgatttaatggaatctataaaaattgctatggatgcaggtgttaaaaaagaaaatataatattagatccaggtataggatttgcaaaaacatatgaagaaaacttaattgtaatgaaaaatgtaaaagagataagagatatgggttatcctgttttacttggaacatcaagaaaatcaatgataggaaatactttaaatctacctgtagatcaaagagtagaaggtacacttgttactacagtaatgggaataatgtcaggttgtgaatttattagagttcatgatgtacttgaaaacaaaagagcatgcattatgacagataagattttaagtgtttaggaaaagtattataaactaataaacaaaatgagtaaattatataaaaaggagtatctcatggataaaatatttttgaagaatgttgagatttttgcaaaacatggagtttttcaggaagaaaagactcttgggcaaaagttcatattagatatagaactgtctcttgatacaaaagaagcaggagtaacaggggatttaactaaatcagttcattatggggaactatgtcatagaattgaagagattttcacgaaggaatcatatgatttaatagaaacagcagctcaaaaggtagcagattacatattatataattatgatatggtacatagtacaaaagtaacattaaagaaaccttgggcgccgattggaagacatcttgactatgcaggtattgaaattgaaagaggatggcatgaagcttatttatcaataggaagtaatattggagataagcaaagcaacttaaaagatgcaattgaaagattatcattattaaatgaaataaaagttgaaaaagtttctgaatttttagttacagaaccttggggatatactgatcaagaagaatttttaaatggagcagttaaaataaaaacaacattttcacctaaggaacttgtaagagcattattaaaaattgaaagtgaaatgaagagagaaagaattataaaatggggaccaagaataatagatcttgatgttgtattttacgatgatttaataagtgatgatgaagaaataatacttccacatccaagaatggaagaaagggaatttgtacttaagcctctttcggaaatatgtccatataaaattcatccagttttaagaaaatctatagttaaactgcttgatgaattaaattaatttggattaatgaatgtgtgacatgttttatattaatagtagtacaactttttattttgtatgaattttagatgtgttatataaaataagaactgattttaggaattattttatatatagactataaatagggtatatgtaaataagaggttggggttgttatgttaaataataggtaaaacctttttaaaaataaatgttggtaagactataaatataagaaagtgtcaataatcatagataagtgattttagctaatataatttatattagctaattcaattgttaagcctatttaatggattgacatttatttaaacaaacttaagtttaggtgaatttaaataaatgtgtattaaaggagttgttatctatgatagaaagagattgggagtttgagaagataaaaaaatataaagaaaatgcacttagagaaaatatttataataagggaaatgttaaaaaatataaagaatgtccttactgtggaagcaaaagttttataaaatatggaaattataatagaattcagcgttataaatgtaaaaatgaagagtgcaaaaaaacattttcaaatacaacaaattctgtatggaagtacttaaaacataaacctgagaaatggtttgagtttattgagcttatgggtgaacacacaacattaaatgagtgttcatataaattgggaatatctatagtaacggcgtttaactggagacataaaatatttcatgctattgaaaataactataaaccagaaaaatttgatgaggttgttgatgtagatacttactatacagaaaaatgttataaaggaagcagaaataaaaattatacatatgctgataaagtaaaaaataaatttgataaaatgtatggacttgtacctagaagcgtaagtgtgctgatagcagaagaaagtgggaaaatgccattaataagaagaacagaaaatggtgaaacaatagtaaataattttaataataatgtgttgaaaattgcagttaaagattgttatatgcgtacggattatttcacaaacaaaaaattaaagaataatttgctacaatataataaaaaactttcaaatgagacaaaaaagaaatatggattaaaaattataggaaatagaatagaagataaaataaaagaagataaaaagaaaaatatcatagcttatttaactgcatggttgagtagatataagggaattgctacaaaatatataaaccattattataatttttattcattaattgattcagaaaaagtttttgattatatgagtatcttttttgagcttttaaaaaatggatcttatacatctgttgaagttttaaggacaaatcatgttgaagattattaaaatatttaaaagagcgttgtttaccaacaattatctttaaaaaggttatcagtataaattaataatatatagatgtgtaccaaactatttttcatataatttattgagtggatttttagtataaattaagcatatataggtgcatacttttaattttaattttgaacttaatgtacaaaagaacaatatatgttaaacataaattgtttgaatctatttcatataatttaataaatttattgcaaaatagactaaatatggattagtattaatagtgaagtatatattaccatattaaacgtaaacataaaaagcataagcatatttaggggagctagggcacttttatttaaatcttgtatattacaaatatattttaagatttttatggacagtttttattaatatgataactgtcttattaaataaaataagctaatagcaagaaggagaaaaatatgagtaatacaaaacaattattagattttatcaataaaagtaaaacggcatttcaaggtgcatatgaagtaaaagatatattagacaagaatggttttacagaattaaaagaaagtgactgctggaatttaaagcatggtgataagcattatataatgaaaaatgattcagctataattgcttttgaaattggatgtggagaaattgaggaagatggatttagattaataggggcccacactgattctccaggatttagaattaagccaagtgctgaaatgacagttgaaaataattatgtaaagttaaatactgaagtttatggtggtcctatattaagcacatggtttgatagaccattatctattgctggtagagttactttaaagagtgataatgtatttaagccagaaactagacttgtagatataaataaaccagttttaataatacctaatttagcaatacacatgaatagaagtgttaacgaaggttatgagtttaataaacaaaaagacgttttacctttattagcattatgtaatgaaaaattagaaaaagataattacttaatgaatcttttagcagaaactttaaatgttgaaaaagaaaatattcttgattttgatttattcttatatgatgtttcagaaggctctttagttggtttaaatgaagaattaatttcagttggaagattggatgatctttggatggtatttgcaggattaaaagcattaactgaaagtaataaaataaaggcaactaaagttttagtagctttagacaatgaggaaataggaagtttaacttctcaaggagctaactcttcaatattagaaaatatattagaaagaatagttttaggattaaacaaggatagagaaggatttagaagagcattatcgaattcagttatgatttcagctgacttagctcatgctattcatccaaattatactgaaaaatgtgatccaactaataaaccattattaggaggaggtcctgtaattaaaatagcggcaagtggaagttattcaactgacagttatgctgcaggagtatttaaaggagtatgcgaaaaggcaggagttccatgtcaggtatttgttaatcgttcagacatgagaggtggaactacaataggtcccataacagctgcaaaacttaatattccagttattgatatgggtgcaccacttttaagtatgcattcaataagagaattagcatctgttaaggataatgaatatacaataaaagcatttacagaattctttaattaataattttctattttatttgcaattatgtaatgaaaatttaaagtaaaatatgtgactagtaaaactataaatatgtgattttttatattgaagtataattaaacatgtattaaaaatgaataaaataagattaagttcttttaatcaaaaaagatcagctatttgctggtctttttttgtgggaaatattgaagtaaagaatttgaggttataaaaggaaagtgtttagtgcttagggaacaataaagatacattagagtacttctagtaactaaaaagtaactagttgtaatattcctaatatcaaattattatgggtttattgatatttaaaggaagaaaatgaaaaaattaagataagtagaatttttgagtgataaatataaaaatgtaatttatataatcaaaaaatggagggaatataatgaaattagcaataaaaataaggatagtattttttattattctaacttttacaatagttatttctgctttatcatattatgaaataaagcaagctaaaaatagcattgaaaaacttgctgttgaagaacagtatttaactaaaactattaacaatatgaattttaattttgtatcaaaagcagctaatataagaggattcgcactaacaggagatgaaaagttaaaggatgaatatttcaacttatcaaaaaagaatgattcattagaagaagaacttatgagtatgttaaaatcatccgaaagtaaaaaatatttagagcaatttaaggaacaagataaggcttattctagtactgttgaaaataactttttaccatttatttatgaaggaaaactaaaagaagcaggtgataaccttaaatataatgctttaccaattggtgaaaaggctaaagacgcaatggctaacctactaaatgtattggataaagaacgccaagatcgtactgataaatttcaaagggatatagaagtttcaaaaaatgtaattacaataatgtcattaatagcaatattgttaagctttttaggcgcaatttggattatacgattaattatagaacctataaataagctgtctattggtgcaaatttaatttcaaaaggagatttgactcaagaaattaaattaaaatctaatgatgaactaggtcaattaggaaaggcttttaacaagatgtctaatgatttaagagacataatttatagaattatagattcagcaagtactttaggagcagcaagtgaggagttattggcttcagctcaagaaacagcttcatctacacatcagataaatatttcagtaagtaatatatcagatggagcagctcatcaatctaaatctattgaaggtgctacagatgtagttcaaaagttattaaataaaattaataatgtttcaaagtatattcaagatacagatgaacgtactattaaagcagcagaagattcgaattcaggattaaataaagttgaagaagctgttattaaaattgaaaatatacaacattcagctacagaaatgagttacgcaattgttaatcttgataattattctaaagaaattggaaaaataactgaagttattcaaaatatttcagatcagacaaatttattagcacttaacgcatctatagaagcagcacgtgtaggagaacatggaaaaggattttctgttgttgcagaagaaattcgcaaattggcagaacaatcaaatgattcagctggaagtatcgccatacttatagaaaatattaaaaatgaatctgaaaatgttatgaaatctatgaagaaaagtagagaagatatagaaaatggagttaatgctgttatagtagctggtgattcttttagtaatataaatagagaaattgatcatgttgtaaaaggaactaattctattactaaaatgtctgaagaaattcaaaatgatgctaaagaaataacatatattatggaaaatattaatgaaatttctcaagaatcagtatctggaatggaagaaatatcatcagcaactgctgaacaaacaagtgttatggaatctgtaacagaagctttgaaaaatttaactgatttagcagaggagctacaggttactgtaaataactttaaggtttaaattaaatattattcaatagtaatttacatgattttaaaatgtatataaacatggtgaagtgatgcattatttatagtccctaataagggactttttttatggataggaaagtataaaaattttggaagccaagcctagtcatatcaatagattgaaaggtacaaaaagtgtaaagtattattcacgaagtgagcgtggcgtagccactttttattatcttataaaattatattcgcaaagaatctttggataacttttgaagttagcagaaacacatagtctgaaaagcagattttttcattaggcagaaaattgtagtgcattgaaagttaagaattaatatttaccgaaactttcaaccttacatcatcaattatcaactttttatatttaataattatttgagtataatatgcaaaatatgaataatttatctagcaacataggaaaatatgaataatgatataagattttataatgtcatgctttttattatttcaggcggtggaagaatagattttaaagtattaaaaaatatagaattatgaacattgaagaaagtatagttgtagaataaaaaaatatagaaccgataaactttaaaaaatatagaaatttatgaattttagaaagtatagaattatgtgctgggatgtgtttttagtgataaataatatgcatgaaaatttaaagcagaagataataaagagatttttattattaaccatactttttatggtctttagtaaacctatatatgcggttgaggaaatagaacttactgaaattaaagttaatggaataaaaattacaatggaaagtggggtttctaaagttatcaataatttaaatgataatggtgagcatgaagtacatggacatataaatacagaaaatcttgaggaaggatattatacagcatttatatttgatacattaaattcagactggagcagttatgatggatttgcatttcatattgataataaagatgatgaaataattaagattaatattaatcttcaaagcaagaatggagttaatcttatagctgaggatggaaggataatactaattaaaagtgacagtagcagtatgatagaaaaagttactgtgtgtgatggaggtattaatatataccctggctttgatggtaatatttatataccctttgtaagtttgatagcagaacagggtgataatcctgtctataaagatgattataaaagtgctttgacagaaataaatttatggggaatacatatgacctgtgaagaagatattgaggctaactttaagttaagcagattttcagtaataaattcaggagaaataaaaggagaatatttaactaatgattttgaaataacaggaagcagcagagtgatgattcctaaaaatggtgaagctataagtaagtatgaagttaatggaaaagataatatgttttttgaaataccagaacatataaacaatgtttctattacaaaagatggagttcttagtattaaggattctgttaatttaaagagaataaggatttgtgctggtgatggaaacataagtgaaactaaggaaatagaactttatgactcatatcaagataataagtttttaaataataaatttatcttatctttcataataattgttgcctcagcttttgtattattatggatattgtttttatattggaggagcagatttaagactagaaaagattaaatcaaatttatgaaagtatattttgaagggatgaagatatatgaagaaaggaaaagtattaatgggtactgtagcagctattatccttattgtaggtatggtaatttcatataaagctgttgaaaaaaacattgaggctaatagaaaaacatcttttcataaatgcatgaatataggaaatgcaattgaatcaccaagaaatattccaggggatttacaaatgaaagctgaatatttcgacataataagagatgctggttttgatagcgtaagacttccagtaagattttcagactatgtagataaaactacatatattcttgatgagcagtttatgaacacaatagataactatataaattatgctttaaatgataatctaactttaattcttgatatgcatcattttgaagaaataatggaaaaaccagaggattataaggatatgtttttaagcatttgggatcagttaagtagtagatatgctggatcttcagataagcttgtttttgaacttttaaatgaaccaaaagagaatttagaaggagaattatggaatgagtatttaaaaaatgctgttgaagttataagaagtcatgataaaaagagaaagataatagtaggtcctgacagttgttattctgttgaaagattatacgaccttattattccagaggataaaaatcttatactgacatttcattattatgagccagaaacttttacttttcagggagattcatatcataaggaatatgaaaatttaagaaatataaaatggaatggaacagatgctgaacttaatgttatggataataagtttgatattgcaaaaaagtattcaaaagaaaataaaatcccagtttttttaggtgagtttggtgtaaataaaaaggtaaaggaacaatatagatataaatggatagaatcagtaagaacagaagctgatagctataatttttcatgggcatactgggagtttgcttctaactttggaatatataatcttaaaaatcaaacatggggagatgaacttcaagccctaataccttagaaagatatttttttatcattgatatattgtaattgtctgctttcaattgggaggatataagggatagttaatcaactgaactttttatggataattttttcttttaagagaattatttttgaatttttggtaaaaataactttagcgttaactgaactaggtgatgaagggaagtgtttttacttgagtaagaataattattatgaacttagaaaaaatgttctaagggagttagctgatggattttcctgcattcatgataattttaaatatttcaaaacattaaataagaataaagttaagattattggagcagcagaatggctccttgataatatttatcttattgaaaaagaatataaatgtgtaaaaaagtgtatgcctttagaatactttaaaagtcttccttatggagaagagtatctaaagtatataaatgttaattatgatgatattgtaactgcttgtgataatataaatgctaaaaatgctaaatcagaaataaatagaaagagcagtttaaacaaatattcagacatggaaaataatattcctcgtattttaatagttgctaaaaggtatataaatgaaaaaaggaaccttgaaattaatgatttgatagattacataaaatattatgaggattttgaagaaaacaaaaataatagtgattattgctttacaatgggggagttatgggcattccctcttatgcttagaataggaataatactaaatttagcacactatactgatgaacttgttaacgttcaaaaggatgtccttagggggaaggtgtatgctgaaaagattattgattataaaaataatgaaaagattaaagaacaaattgattttagtaaagagttttcagacgttaatattgatttgtcaccattatttttacgagagtttataagaatattaagagaaaattccattgaagataaggatatttctaattattcaaaattaaaattgaatctagatatggattataataagctttcaataagagcaaaccttaaagaagaagatcttgaacataacataagtcagtatataacagcgattagaactgttgaaggaataaactggaggtacttttttgaaaagacttcagttgttgaatccatacttgaaaatgatccagctcaagtttataaaaatatggattttgaaacaaaggattattacagacataagcttgaagaaatagcacgattaataaaaacaagtgaaataaaagtagctatgaatatacttgatcttgcaaaagctagtagggaaaaaaatgaagaagaatataagtgtcatgttggatattatattattgaacatggaagccgtatgcttgatggatattatcatgatgtgacggaagtaatttcacatggaacatacatagcaataaacattgttacaacggtagtgttgagttatatatttttagttataggggcagctactggagttagatatacattaagagagcttataattggatttttattacttttcattcctataaatgagatagtacttggaattgtaaattatattgtaggaagaacggtaaaagtaaggcttgttccaaagctagatttaagcagtggaattccacaagaatacaaaacagttgtagttatacctgccattgttaatagtgctgaaaaagttaaagaacttatgagtaaactggaagtttatcattgtggtaatgatgatcctaatgtatattttgccttgttaagtgatttttgtgatagtgaagatgaatataatgatattgataaaaaaatagtagattgcggattaagatgtgcatcccagttgaacaaaaaatatggtaataaatttttctttttaagcagaaaacgaacttataatgaaaaaatgggcgtttatatggggagagagagaaagcgtggtaaacttttagaatttatgtctcttataagaggatactcagataatacttttgatgtaataagttcacctattgatgatataagagatgcaaaatacataataacactggatgaagatacttttatgccaagagaaactgtatataagcttgttggagctatgagtcacgtacttaatgtgccttacgttaataaaaagaatgtggttataagaggatacaatattatgcaacctaaggtaagcataagcatggaagcaaaaaatgcaacgagattttcccagatatttggtggtgatagtggcgttgatggttactcaacagcttattctgatacttatgaggatctttttggtgaaggatcttttgttggaaaaggaataataaacatagatcagttttatgacataacaaaacaatcaataaaagataacagagtactaagtcatgatcttcttgaaggagcattaacaagatgtgcacttgtaacagatgttgaacttgttgatggatatccaccatattatgaaggaagttgtagaagactttatagatgggttagaggagactggcaacttatcggatggttattttctaaaaagataagttttttaaataagtggaagatctttgacaacttaagaaggagtttattagcaccagatttacttttgcttctaataatatcactgagtgattcaatgaaaaatcgtcagattgcactattatgttttttagtgtttattatgcctcttgtttttactgtaacagattttgttgttacacctaagaataggcttatgggagcttttaagacttttaaacagataatcttaataataagttttataccatatgaggcgtttcttatggttaaagctataggaactacgttatttagacttattttttcaaaacgtaatcttcttgaatggcagtcatcacattttgcagataagtctgtaaaaaatgatttaaagtcatatgtattaagaatgtggtttgcaccagtaatgggaattttcatttttcttattgctttaaatgattctgtgggagtatggatttatagtttgataccagcagtattatggatatgcagtccttatacagctttttatataagtaaagatataaaagatgaaaaacaaactattgatgaaaatgaacgtgaatatttgagaaagctttcaagacgtatatatgcatattatgatgattttgtaaatgaggaaaacaattatcttgcaccagataattatcaagaaaaaccatttaagggggttgctcataggacttcacctactaatataggaatgggacttattgcaaatgttacagcatatgatcttggatatataacatttcaggatcttataaataaaacaaagtccattttaaatagtatgagaaccttagaaaaatttaatggccattatctaaactggtacgatacaagaactagagcacctctatatccaaggtatgtttcaacagttgataatggtaatctccttgcaaatctgtggatacttagagaagcaatggaggaacttaaaacagcgcctataataagaatagaagaagttacagcaattaatgatatatatagaataattgaagaagaaaatccagaaataagaataagattttcagaagatatatatactggagaatattgtagcactcttgaagaaatacttataaaaattgactcacttgatgaaaaatttgatagtgaagttgaatactggcttaataagctattttgtgaagtaagcaggaaaatagaaaactatcataatatttttgataatataagcaatctttacagtaaggagttttttgaaggagttcctaatgtatatgagattatcaagaagtgcaaaaagacaaaagaaatttctggagataactttaattgcaatctaggtgtaaaaattgagtattttgaaaaatgcctaaacagtataaatgacataatagatgaaattgatgaaataagtaatgaaatgaactttaatttcttatatgacacaagtagagggttattttcaataggatataatgttgaagaaaattctcttggaaattcatattatgatcttttagcatcagaatgcagaattgcatcttttgcagctgtttcaaaaaatgatgttccaaaaagtcattggtttaatttaagtagagcaatgactaatgcatttcacactcattcattggtttcatggagtggaacaatgtttgaatactttatgccttctcttgtaatgaagaattatcctaaaacattgcttgatcagacatataagagtgtaataaaagcacagatgtcttttgcaaagcaaaagaaaataccgtggggtatatcagaatctgcattttatgagtttgataatgacgataactatcagtataaggcatttggggttcctggtcttggattaaagaggggacttgaggatgaagtagtagtttctccttattctacaataatagcacttccattttgtgttaaaaaatccatcgaaaatttgaagaaaattcaagggggcggagcgttaggcagatatggatttattgaatctattgactatacaaaagcacgtgaggataaatttatttctgcatatgatgtgaataataatagtggaaatgtggataactctgtgattaatgtggataagtgtggatatatagtggataatgctgttgttaacaatgacgaattatgccctgtggataatgtagataatgtgaataactttgtagaaaaaacaagaaaagaagatatagcaatagaattagaaggcgataaagaacaaaataatccacaaaatgataagaaaaatgaaaaaaactttactgtggaaagttatccacagaattatgatgatatttacaatgatggtgtaaaacctaataaagtaatcacatatatggttcatcatttgggaatgtcaatcatggctctagataacgttttaaaggataatattttaataaataggttccacaaacagccacaggtaaaggcttcagaacttttattaaaggaaaagataccatatcatgttacatttgaaagaaacgaagatttttcagtaaaaaatagatactttcaaggagaggttattgaaccaagggtatttaaagctattgatgaaacttcatttgatgaacagcaggttcttcttttatcaaatggagattattcttcaatgataaatatatgtggaagcggatattctaagaaaaatgacatgatgctttatagatggaaaggaaacagcactagtgatgatagtgggctattcttttatataaaaaatttaaactcaaatgattattggagttctacatttgagccatgtaaatcatttggaaaagaatatgaagcacagttcagccttgataaagcaagattttcaaggtgtgatggaaatattgagagtataactgaagttgctctctctacagaggaagactttgaagtaagaaaaataacattaaataatactggagaaaatggaagaagtattgaagtaacaagttattgtgaaattactcttgcatcttttggtgcggattctgttcatcctgcattttcaaatttgtttattcaaactgaatatgatgaaaatgaaaaaatacttcttggaagcaggcgtggacgggtaaaaggtgcaaaagttccatatatttttcaaaaaataattgtagatggtgagagtgaaggtgaaataacctatgaaacttcaagggtaaactttataggaagaaatagagatcttaagaatcctagatctatggacaatgataaagccctagataacacaataggaactgtactcgatccaatactaagcatgagagtgcgtgtacgtattgaagctaatgaaaaaagggagatattttttattacaggaacatgtgattctaaggaggaagcacttgaaataggaaagaaatataatgatccttcaaaagctgaaaaaatctttgaaagatatagtgtgggagttcaacttgaacttaaaaaccttgaaatgagaagcattcaagcagatttatttcaaaatttaagtagttatattttttatcttcaaagaggacgaaaagacagagaagattatataaagaatataacaaaacaccaaaaggatttatgggcatacggaatttctggagatcttcctataattcttcttgcaatcgaagatgaagaagatataaatcttgtaataagcatgataaagttttattcgtacttaaaattgaagggtgtaaagactgatcttgttatatataacaatgaagaagtatcttatgatgaaccacttcaaaaaagtataatgcaggctgttaatatggttaatgcgggaaatagtcttaataagtctgcaggaatttatattcacaataaatcaactatgaatgaagaaataaaagatttcttagtgggaataagtaggatttatattgattctaagaatgggactttattagaccagtttaaaaagtatgctgaaataaaagaagacaatgatatttcagcaagatcacttatgtattcaagatataatgtgttaagtgaaacacaaaatgctgatgtaagtgaattggagagagcagaatatggagcgaaagcaatagagagtagtcatattttggataattcacataatccatatgaaggaaaagcattcaagaagaagaataatgtatcgcctaaaaaagaagtatcaaaaaaattatccaaagagcatagcaagttatctggaaatgataatgaagaattattcaaagaggataatgaattatctagaaaagataatttagatttaggtattaaagaaattgattctttaaatcttgaatttgatgattataatggagaaaaagtcagcaacaataattctgatgtaaattatagtgaatatgatcatgatgtggactttattgaaaaaactgatttaataaatggcattgataaatcagaagatgataataaagaagataaaaacataaatagtaatagtgttgcacagcatgatgatagtaaaaaatatataagtgatagtgaatttaataaaggaaatgaaaaaatagtaaatgatagtgaagcggaaaatgattatgaatgtgatagtgaagaatattattctaaggcagatttagatttctttaatggttatggaggttttgataagagagacggtacgtacataataaagctttcaaattataagaatactcctgcaccttggattaatgtaatgtctaatagtgattttggtttccacatttcagagagtggatcatcttatacatggtgtggaaattcaagagaaaataaaattactccatggagtaatgattatataagagatcctgttggagaagctttttatataagagatgataaggatggcagatatttttcaatatgccctaagccagttagagataagaatgaatatataataaaacatggttttggatattcacaatttatgcatacttcgtgtgacataaagggaacaatgaaggtgtttactccaaaagatgaaaaggtaaagcttcagataataaagcttgaaaatttattaaatgaagaaagggaactttcattattctattatgcaaagctagttttaggagtttacgggtatgaaagtgaaagatatataacaacttatacttttaaagacaataatgctattgaatatattggtggtaataatccttacagtgaatatttcggaaatcttcatgcatatctaacaatacttggtggagagaatattactgtttcaggagatactaaggagtttattgggtttggcggtgaagctgaaaaacctaaggctatggaattcagcaatttaagcaataaaacaggaagtatatatgatccatgtttaagtgcgtgtagcagaattaaattaaagcctcacgaagttaaagaagttgtaatagtgcttggtcaggatgaacaagaaaatatcattaaagttattgataaatataaagatattaataatgctcatactgcccttgaaaatgtaaagaaatactggaatgacttacttggaggtattcgtgtatcaactccagatagatctatggactatatgcttaatggatggcttttatatcaaacatttagttgtagatatttaagcagaagtgctttttatcaaagtggaggagcatatggattcagagatcagcttcaggattcaatggcacttggagttgttgattcagaaataacaaagtctcagattataagaagtgcatctagacagtatgttgaaggagatgttcaacactggtggcatccagttgttaacagcggtataagaacaaggttcagtgatgaccttttatggatgccttatgttacagcagaatatataaattcaacaggagattatgaaattcttgatataaaagcaccatatcttgaagatgagcctttgagggaaggtgaagatgaaagatatacaatagtaaatatgtcatctaagaaaggaactatatatgaacactgccagaaagcaatccagaaggctttaaaatatggccagcataacatacctcttatgggaagcggagattggaatgatggaatgagtactgttggaaatgagggaaaaggtgaaagtgtatggcttggatggttcttatatgatatattaaacagctttattaaaattgcagaatataaaaatgattcaagtagcgtagtttattatagacaacagaaaaagttcataaaggataatcttgaaaagaatgcttgggatggaggctggtatagaagagcctattttgatgatggaactcctcttggaagtcgtgaaaatccagagtgtcagattgattctttagctcaaagctgggctgtaatttctggtgcttcaagaattgataattctgaagatgatagcatgataaataatagtgtgatagataatgattcaaatttagaagttcattatgatttagataataataaagaaacaacacaaccaaaaatgaaatttattaataaaaaagaagaaaactctgaaattagtgcaaataatattgataatttaaaagctgaaaataaaagcgaaagtgcaaaatacagtgaaagagcacttgaagctatggaagctgtggatagaaatcttgttaaaaaagataaggggatgattttacttttagcaccaccatttaataattcatatctagaacctggatatataaaaggatatgtacctggagttcgtgaaaatggaggtcaatatactcatgcagcagtatgggttatactagcaatcactaagcttggctttggcaataaggctgtagaatattataatatgataaatcctataaatcattcaaaaactgagcttgaatgtatgttatataaaacagaaccttatgttatgagtgcagatgtatacataagagagccacacggtggaagaggtggctggagctggtatactggagcctcaggatggatgtatagggttggaattgaaaatattcttggacttagaagagttgaagataaaggatatgagattaatccttgtattccagaaagctggaatgagtatgaaattaaaataaaaaatgaaactgaggattatactatacagattagaagaataaatgatggtttaagattcagtaaaagtacttcagaaagaataacaaaatatactatgattataaatggaaaagtgtgtgatgaaaaaataattccaagacataagggaactatgaaaatagaagtatttttttaggtaaaagatgatgagatctagtctcatcatcttttattatgtataagtatataaaaataattttaatataaagttttcctttatcagtcaaaaggggtatttttccagtttacatattatacttatatatctacaatttattgtagtaaattaaaataaattgtaggagtttttagatgaatgaaaataataatagattgagatatctaacacaagatgaattaagaaatttattttatgccattgaaacatatagtggacataattccttgagagatttagctatatttagagttgcatacagatgtgggttaagagctacagaaatttcattgataaaatttgatgactatagtattagaaaaagtgaactttactgtaaaagactgaaagggagtagaaataatactataagattagatttacagacaaaaaatgttttagaagaatatataagtcaaaaaggtatatataatagtgatgaaataatatttaaaagtcaaaaaaataatcccatatctagaaaaactctagattatcttatgaaaaaatattgtaaacttgcgaagatagatgatgttcgtaaacatcatttccatactattaagcatacaacagctgttcatttagctgattcagaaatggatattaaggagatacaatggtggcttggtcacaaatcggtaaataatacagagatatactttcaatttacaagtaaacagcaagaaagaatgtatactaagcttgaagaaattggggaaatgatataaattaaaaactggacattatgaatattatgtccagtttttttgctttttacaaaataatattaacaaaatattatttttttatataattttttaatattttgtaactaaatttttttataatagctaatttattgttcattttgtataaaacaaataaaaaaataagacataatattcattttgtcttattatttatataaatagtataaaaattcctataaatagaaaaatttaaacatattttctgatctactatactataaaatttgtaaaaaaataaaataatatgtaattcgtattataatatggagagggacatgtgaagtttatgaatataaaaagtagcatacagaaaaatgatatattagaagcattaaaaagaaatgaattttttactttatatcagccaaaagtatattctgaaagtggaaaattagcttctatagaagctttaataagatggaaaagaaataattctattatctatccattagaatttattcctatgtgtgaagaaaatggactagtatatgatattgatatgtacatgataagacaagtaataactcaaatcaatgagttaaaaaaaaacaataagaaaataatacctatttcagtaaatatatataaaggtaccttaatggaagagaattttattgatacaattgatgagttatttggaaatatgaatataaataattatgtggaatttgaaataaccgaaagaggaatattaactgaggatattgataagatagcagaagtattcaaaaagcttaaggaaagaaattttagaattgctgtagatgattatggaacaggtagttcaaatttattatttcttgcaaaaactaatgtagacataattaaattggataaatccattataagtaatattcatgaaaatactaaggctcaatatataatagaagctcttataactttatctaaaaaattagatacagatttagttgtagaaggagtggaaaatataaaagaatttaaattcttaaaggatattggatgcaaaataattcaaggatattatttttctaagcctgtaaatatatcggatataaaattgtcctatgatatattctaaagatgtacataaaaattaattaactttttattcttgagaaactgatgaagtatacgctttgtcagttttttttatcaagaatacaccaattaatttatattaatgtaaataatttaagaattatatcaataatatttgattttaagggagattatattattcatataaattaaaatctatcaatatgataaataattacaaataaatataaaaactgtataaaaatgaataaaatgtattataattgtatttacaaggggaaatttgttaataacatttgggaggatttttttatgagagaagaagatatagaaattgaacttaagaacattttaaattcaattccgtatgaaattacaattaaagatttagattgtaactatatatatgcaaatgaaaagttttgtaagaatttaaattgtgattttcaagaaatttataaaaaaaatatgagtaacttttggagtcataaagattatgaaaaaatacgtgaaatagataaggaagtaataaaaaaaaataaagggattttttctgaaagaaaactaagaaaaattaatgacaatgagagatggttttacatgtataaatcaccatttaatatgaataatgaaaaatgtattattaccatatcacaagaagtaacgctaaataaaaaaatggtgaatttactagaagatcaaataaaaaattattcactttctacttatggatattatgatatattttatgatacagaaaatcgaaatgctttgctagatgataactacaaaaataaaataaaatcaatatgtaaaaatttatgcgaacaattagaatcatcaaatataaatatatacttatatgatgaagaacaaaatgatttgaatttatatatatcttcacatgaaatagacactattgaaaagaaaaatataaatttaggtaataggagatttttaaaattttcaggcgtgaatctaacaatagattataaaatgttacataagttatacggtaataaaaaatacaatgtaaaaatatataaaataaaatatggcagtaatataattggaataatgaatgtgtattatgataaaaatcaaaatttaaatgttgaagataaagatttaataaattcaatatgctataaatttggattattgtttcaaaataaaattataacaagaaaactaaaagaagaagaaaataagaaagtaaaatatagacaagcattagaaatagaaaatttaaaaacagagttctttttaggtttatcacatgaaattagaacacctctaaatattataattacttcaatacattcaatagatgacattttaaagactcatgaatgtgaggggtatagggatagaataataaagagtttgaattatattaagcagaattcaaataggttgttgaggcttataaataatattagcgatgtaaaaaaattagatcatatgtgctacgatgttaattatactaattgtaatatagttgaggttatagaaggtatagtcatatcagtttctgattatataaaggtttcacagagaaatataatttttgatacagaagaagaagagataactacagcgtgtgatttagataagatagaaagaataatgctcaacttattatccaatgcaataaaatacagcgatgaaaatacagatatattagttaagataagactaagtgaaaaaaaagatgaaataatagtttcagtatgggatgatggtgtggttattgaaaagaaagatagtataagaatttttgataaatttgttcagcttgataaattattgaatagaccttgtgaaggcacaggtataggcctgttcttggtaaagtcattattagaaattcaaggtggaagggtatgggttaataatgaagtaatcaagggtgcagaaatagattttagccttcctgtaaggactgttgaagaaaaagaggataagcataatataactacatcaccacaagacaaagtagaaatatataatgttgaattttcagatatttattcattataaacccttaagttattggaaagaattttattgtaaacattttgaattttcattaaatttttattaattttatgtagttattgaaatataaacatagtgaaaaatattatataagagtgggagctttacattattaaaaattatatttaaataatttttaataaaaaacagcaagagtaaataaaataatttagtcttgtaaagtattgaaaatacagagttagcgcagatattctaatttattcttttgaaaataataaattagtgattttttgtgaataaaataattaatttgattaaaaatatagtatagaacataaagtttttagatgaatccatgaatttttaagagtttgaaacattgtaaaagttaggttataatgaaatctatgagataaggaggacattttttatgcacaacattaaaaaattacttatgacaatttctatgactttagctttcagctgctcattattaagtacaggcgcttatgcagtttctaataagacaagcagtgatgtttctagcgaaagtacacaaaaaacagacgataaaaatagtacaagcaattcagataaaaattcatcaaaaacagataaaaaagaagataagaaaaatcaagattcatcaacgattaaaaatgaagatattgtagatggagaagaacaagacgagacaagcactaaagacgatgaggttattaaagttgaaatagttcctcattgggaaaatataaacggaaaacttcactatgttactaaagatggaatcatcgaagaagaaggatggttcaaagaaaaggatgaaaacccagatgctgataatgataatgaatactatcttgatgaaaatcatgcagctgtaactggatggaataagattggcggacaatggtactacttcaatgaagcaggagtaaaacaaacaggatggcagcttattaattatgaatggtatcatttagacaaaaatggcataatggaaaaaggctggataaaagatgatggagcaaagtattacctaagtgatgctggaacaatggttgtaggtaaaaagtatatagatgataaatggtacttatttgctaatgatggaaagcttcagactggattctatacatataaaggaaaagattattattcagataaagacggggtaatggttactaaccaatggataaaaacaaaaaattatcagtattatgcaaaagcagatagttcaattgctaaaggcaatataattattgatggaaagcttcaagtatttgataacaatggacgttttattgaaagtgaagatgcagataattatttatttgttaaatatttaagtgtaggtaatgctgattgtcagtttattagacttccaaatggtgaaacagcattaattgacactggagatgttacaacaagagaacaattagttaattttttaaatgaacaaaaattaagaaaaaaaggcggcaaaaagttaattgattatgtaataatcacacatggccattcagaccatattggaggacttgctgctgttcttaacaattttgaagtaggtaaaatttatatgcctaaaaatgcagctatgcagaattggtattcaggactaaaggtaaatgatgaagttagtcaggcagatatagatatgcttaaatatgactatcaagtttataaagaagctgctaaagcagtaaaagataacggcttaaagttcataaatccaacaccaggacaatatattgattcaaatgaaatattacagtttgttcaatcaggaaaggattttggtccaataggatctcagaaacatatggctgaatactggggaataaatgaaaattcagctatagtatacttaaattatggagatttccaaggattatttgcagctgatatggaatggacttcagaaaaagatttctgggtaagtgatcttcttgatggaaaaaaagttgatttattgaaagttcctcatcatggatacaatacttcttcaactggagatttcttgaaatatgttaatgcgccagttggaattgtaagtagagctgaagatagtattgataaaaatactgcttttaataacttagttaataatggtgtaatgctatatgaaacaagtcaaagtaaaaatggtggtatttctgtatatgctacagaagataactggagcatggaagatgcaagtaaagataattagtcttaatttacatttgatgtcttttaagagtggctcgtaagcaattaaaaattaagctaaaaatcataaaagtatctttttaagttatatgtaaaagataatataaatttataaagtaaaagtttcctataaaattttttataggaaactttttttgagtgggcataaattataaaattttagcgcccgagtattatggggtacaatattattttatccattaataaaaaaaatattcaccataaaggtgaatattaaaaaaattattagaaagatggagtgtatattacagctaacaactagttgttagctgtaataattaatatttttttgtgtgttttgagttttgagaaaaatcattaatatccattaaatcctgagtgtaatcaaactcctgacttgcaatgttgttaacaacaatagaatcagaagcaggatttggaatgtttgttgtttggccaactccagtagaactttgacaatcagaattacttggatgatagtctgttcttacctttggaagataaggcttatctttatgagtcatatttatcactccttgttcagtatgcataacaaaaattaattactatgctttaatgaatatttagaattggtgttatacagttgtatttataattgttgggttgtcaagtaataaccatagatattaacacacaaattgtatattaatatttacactatatagtgtgtactaaatatttttttatattcaatttgtatatgtattatataggtattaatttattccaagtgattttttagataaatgttgcgacatatatttggatgagtttttagatgatatataggtaaaatgtgtagttaacttttttaaaaataaatgttggtgaagtagtttgaagaagtagtatttgataatggttcatttaaattactgtagatttaaaatttaggaaaatttaatatttacgtaaggtaaatattataaatgaatgataaagttatagatattaatgaaataatggcaggtatatttcaatttataatagctttaagagttaataactaatatatatatgttgcaatatatttttttatgaatttattagcatcttataaatcattaaaattaatgtaaaatcacttacattatagtatttttttgtttatatagaaatacttattttaatttggatatatgtataaatacaatacatatattaacaaaaaattaataattataaatgttagaatatagtatacttaaatagttatatatttataactatatcttatagctatatctttagggaattgttattttgactatattttcaattgctataagttatatacattgtaattcacatagaaaattaatgggactgaaggcacttcttgtgagtaataaatttaaaaaagatttactaagaaagtaaaataggaaatttaatttttaataataatgttagatgattttaggaggataattaattatgaataagaatgttagacatttaattgctgcagctcttgttataagcgctttttcagcagttgctccagcaaatatttttaatttaggtgttattgaagctaatgcatcaacttactcaggtgcatcaaatggacagttaaagtcattatctgtttatagaagtacaggtaaggaagcacaactatacagcaatcttgcagcaacaaaggaaactgaattaacaagcagtactgattattatattgatttaaagggttcagatggtgttgaattagatgctgaagttgaaggcgatgattatgtagttaaggtgtttaagagtagtgataaagatgctgaaggttatgatccttcagatttaggtcttgttccaatagactctggaagtacaaaattatatttaagaacatacagaagcgaagacgattataaagatgcatgggatgatgggaatgttaagaaatgtttaaaaacatatactctacatatctctaaagataatgtgaattcagatgaagaagatgatgttgagtatccatatttaagttcaatttatttaagtgatggatcaattaattttacaaaaagtaagacaagctataaggctaatgtagatgaagatgttaaacagattcttgtaagagcaaaaccacaagacgatgatgatttagttgaaatcaatggtgattctgtggatgaagatggggattacgaaaagaaggttagccttgataaaggtgaaaatactattgagataacagttgaaaatgatgatgaaactacaacttatactatagttgtaaatagaggtggtaaatcatcagattcatcagatgaaaaagatagcacaaatataataactggttcagattcgtttttatacaatagtggaactatgaattcatgggtgagtaaaaacggcaagtatatgtatatggatggaacaggacaacctctaaagaacaagtggtggtttgatgtaagttcagcaagtgattactattttgataaagatggatatgcacaaactggatgggcacaaattaatggaaaatggtactattttgataatagtgggaagatgcaaaaaggttggataagtaatgatggaaaatggtattatttaaatgtatcaggagctatggtaacaggatggtatcaagatgcaggtaaatggtattatttaaacagcgatggatcaatgaaaactggatggttaaatgataatggaagctggtatttattcaatagtgatggatcaatggttacaggaaatgttttagttgatggtgttcaatacagttttgcttcaaatggagtaatgatatagattagttagtagttaatgattaacagttaatacttaatagttaatagttaaggtgaaaatccgtgcaggatttttccatttgtatataaaaaaactcaaaatttaatgactctgtataagcaaaatcatttaaataatatataaaatacttaaaataatccaaataggtcccatataagacatttacaagtgtattttcttatgggacctatttttgttataagcttaattatgatcattataaggcttcaagtgtatatagtttaatcgaaaatttaaatgagagtaataaatatatgtgtatatggggtataatggaatagaagtaatgacattttagtgaacttagtaaacatatgtgatgaaatttaagaaaagaatttaggaggtaaatcatgaacaagaatataaaaaaaattattgcaatgactcttactttttgtgctgtttcagcagtatgtggtgttaaaaatttaaatttatcaggggaaggaactgttgctgcttttgcttcagataagagcagtttaaatcttgaatctatttcattaagtactggtaaaatagatttctcatcagatgttacttcttataaggtatattacaataaagctgttaaaaatatagatataaaagtatctccagaaggcagtgataaaagaatcagagttacaataaatgatgaaagtgtttcttctgatgacagctataaaaaaaattttaagttaagtgttggagaaaatatctttaaaataaagattgaaaacagagatgatgaatcacaaagtaaaacttatacattaaaagcttatagaggaacagatgaaaatgatcaggaaattgaacaagatctttacattgattaccttacaataaatggtaaagaaatgagtttatctaaagataagaaagtttatgactataaagtggacaaagatgttaaagaagcaaaaattgtaattgaaccagatcagaagtattatacagtgaaaataggtgatgatacttatgaaggtgaagaaagtataaagaaaacatttaccttgactgaaggtaaaaatgaaataaaaataaaacttacagatggtgaagatgaagaaaagaaacaaagaacatatactttaaatatatatagaggtgttgatattccaacatcaagtacaacaaccaataatactacaagtacaggaaatagtagtacaaacacaggcaataatacaggtactaataattcaacttctacaggaacaacaaattcatcaagttcaacaacaaatacagtatcaaattcaggaaagtggcaacagaattcagcaggaaaatggtactatgttgattcaaatggaaatgcagctaaaaataaatggttctttgttcaaggcgatggaacaatggcaacaggatgggttagctttggtggaaactggtattacttaaatgatgatggaacaatggctactgaatggttaaataatggtggcaaatggtattatcttggtagtgatggagctatgaaaacaggatgggtacaactaagtggaaattggtattatttatattcagatggatcaatggcaagcaatacaactattgatagctataaattaggttcagatggagcatggatcaaataataaagtataaaatgggttaagagttagtagctcgtatggctcataatcagccatgattaaataataaagcatataagcataaggatgggatttcacatgaacaagaatttaaaaaaggtaattgcccttactttagcagtaaacgcaattgcattaatagaacctgcaaaggaaattagtatttttacagaaactgctcatgcagcaaaatatgatgatcctcttttaagtgatttaaaagtaagtggctatgatgtagattttgataaagaaacttattcatatagtataaaagtggacaaggatgttgatcaaattacagttacagcaaaacctgaggattcagcatatgaggttagtgttaatggtgatgacgcaaaagaagatgataaatataaggttaaagttgatgttaagcaaggaaaaagcacaattacaataagggtaaaagatgaagaacatgatttaaagacaacttatgaacttgaagttataagaggttcagcaagctatggagaagatcttgatgaagatgatgtttatttagataatatcactttaagtgctggaaaaattaatttttcaagtaaggtaactgaatatacagtaagtgtagatgatagtgtaagatatcttgatattaaggcaaaaccaatggattcagatgaagagtatgttgaaattaatggtgaagaagcagaagaagatgatgattacgaacaaacagtaactttaaaagatggtaaaaataaaattactataagaattgagaattcagaaaaatcaaagaaatatattttaaatgtatataaaggggttgaacctccgaaaaaagatgattctgatgaagatgaagtaaaagaagatagcaataataacaaccaaaattcaaataataactcatctcagtataagaaccagtgggtaactacacaaggaatatggctttattatgatgagaatggaaatatgatgaaaaatcaatggtttaacgatgttaatgctaaaaaatcatatttcttaaatgaaaatggagttatggtaactggatggcttcagaaggatggtaattggtattatctaaatgaagatggttcaaaacatataggatggaaatttgtcatgggattatggtattacttagatggtgaaggagtaatgaagacaggatggattcaggacgctaatggtaaatggtactatttaaatagtaatggtgcgatggcttctaatacaactattggaggctataagcttggagctgatggagcttggattaagtaatatacaatacaaaataaaaagcgtggcaaaactacgctttttattttaactaagaaatatataatgaaaatttataaataatatatattgtaatttatgatttacaggtgatatcccttataggtactacttgtgagtaataaattttaaaaatcattatttgatttttagattataattgtaaatttcatagttcaatatatatattgttatagatgaaaaaaatttttcgccaataaatataattattattttacaatttaaagattatttttaagaaataaaagaatctatatatttgtactgaaatataaatgtcgaaacttaataaaaaattaaggtcatgcaatggtttagagccttgtagattcgttgtataaaggtataaatcatggtaaaattaattgtataatggcaaaagggggaagaatatgaataaaaggataaaaaaaataatagcacttactgtagcttttagtgctgttacgacaattgcgccaaagacttttttaggattgacatctaagccagcttatgcagcaagctacactgcaagaaatggagaactaacttctttagttattaaatcaacaaatggagacaagcttagccttaaagatggctataatggagatacagttaaattaagtgatgagaaggaatacttcataaagcttacagatgacagcgaaggaatagtaataaatgctgaagctaaaggttctgatcgtatagtaagaatattccttacagatgatagtgatgcaacagcatataagcctggagataaattatatttaggtaaaggtaatactactgtttatgtaagaacatatgcttctttatctgatttcagacaagcaaaagataaagataaggatgtatctatctgtgaagaagaatatgaagtaaatgttaaaaagactacaggaagttcttatgaggacacaactcaagatcctgtatacttaaaagatttgtctttaaataaaggagacataactttcttaaagcaaagaacaagttacaatataaaagttgcatcatctgtaaatgaaattaaaataacagcagaaccagaagatgacagctcaagagtaagaattgatggaagtcttgttgatgaagatgataattatagaaagactatatctttagataaaggtaaaaatgaaataaagataaaagttacagatgataaggacaatcaaagggtttatacattaaacataacaagaggaagttcatcagatggagacagccaaggtgatgtttacttaagcagccttgaacttgatgaagctgatttagattttgaagaagataagacttcgtatgaagttgatgttgatgaagatgtaagtaaaattcttgttacagcagaaccagaagatgaagaatatcttgtaactattaatggtagtgaagtaaattccggtgatgaatatgaaaagaaggtttcgttatcaaaaggtaaaaatactattacagtagttgttgaagatgaagttgaagatgcaaaaagaacttataaagttacagtaaacagaggaactgtaaaagatgacgaagatgataaagaagatactgatgataagaatgacaattcatcagatgacaagaatagtgtaggctgggtgaaggtcgataatgactggaagtacagaggtgaagacggaaagttctatgttaataagtggctttatgataaggaacaaggggtttactgttatcttaaagcagatggatttagagcaactggatggcttcaagaaggtggaaactggtatcttttagacagtaaaggagcaatgcttactggatggcagtatactggtggacaatggtattatcttcaatcaagcggagcaatgaaaactggctggcttaaggaagaaaaaactgtaactgtagaagatacatcaactgcaactgataagaaggaagatgaaaaaacttcaacaagtgtatctacaaataaaacagatacaagcaagacagatgataaaaaagaagatactacagctaagacaaagaaagttgaaacatggtactacttacaagcaaatggtacaatgaaaacaggttggcttttagataatgataagtggtattacatgaacttaagcggagctatgcagacaggatgggtaattgataataattcaaaatattatcttgatcaaagcggagttatggctactggaactaaaactattgatggaaaagaatataagtttacaactagtggagctttaattagttaacagttaacagttaacaagtaacagttattagttagcaatgtaaataatatatgtgaaaagatatcggataagtataatattatgcttatctgatatctttttttattaatagattaggtatgtttataaaaatagttcaattggattatatactgtagtacttttttattttatctataactacatttctttattcattaaaattaccacatcctcacagaagagttatagataagaagagaataatttagaattgaagtttaaatagatactctattagatttatgcttgaaaatttaatatgaaagagtgacttttagaatacaaaaactaaaaaaaataattttgtaaaaaatcacaaaaaacttaaaaaggttatgttttcataattaattttaattaaagtaaataaagagataactaaattttaacaagaaaaaaattttataacatgcgataaggctagataaatcaaagggttataaatagtgagaaaattctaaaaaaagtttgttaacaatttgttcaaaagtatataatcattgaaaacggatactaagctaaataatggaaaaaaataaagctaaacattaaaaaaaagtatttgaaaaaagaaaaaaatgtaatataatatataatatgttatgaaatattaacaaaatgtaaatagaatattaacaagaggtttataaatggacaacttgttaaaataaatttcaaaaggtaattttaggaggtatttaataatatgtttagaagatcaagcaagttaacagctattttagtagcagcagcggctgttgtttcaatagtaccagctactgcagcagaaagattaggaactaaggacggtaatattgaaaatgcaactgcttttgaaggtggatatatttacgatggttacagaactgatgatgatgatacagcactttattacaataatggaactaaagatgtaaatgcagataaagatgaagattacgatacttatgatttaagtagatatgggaaaaaatatgcaactgttaaagatggtagtgatcaatatttagtagatttatcaaatggtaaaattgatgatgaagaaactttagatgataaattagaaaatgctaaaaataaattaaagagcaagataaataaagtagatagatatgaaaaatttgatgcattcgtatcaaatgataaatatgataaagataaagatgatcaaaactatgttgtaaaagtacttgatgataaatacggagacgtatggtataagtataaagctaagggtgataatgatgcagaagatagaacaactggttcagcagtaggatattatcttggatttactaatgattcaggtcaatatatagatgtaacacaaactgctaatatgtatgtctatgataaaaaagaacataaaacagtaaaagttgaagaatatggtaaaaaatctggagaaaataatatcatagtaagattagatgatgttgatatattaactcaagataaagattacatctatacagtagcaaaagtaactgttgatggagatacacaatatttcttccaaaaaatttctaaagaacaaggtgacaagaaagatggtgcttatctaccaaaaaatgtatcatcttatcaattagataatgaaacactttatgatgatggtgatatgcacactgcatataaagtattagtacagaaaaatgatgacataaaagaagatggaactaaagcaggacatgaaactgttaatgttgaagtaagtggtggtatggtatatgtaactactgttagtaagggtaatgacgaaaatgccaatgttaaaatttataaactaaagtttaaaaaagataagattaatgcaaaagataagacaaagaatgtagatacatctgtaattaaaaaagatggagatggagatcacgacacagtttcaagaaacaacacagataagggtgatgtttactctattgatgctaatggtaatacatggattttagataaaggtaagatatataaagttgatggaacagactttaaagaagtttatactgttgatagatctcttaataagttagatgtatatgatgaaaacaacttaattgcttgggattcagaaggtgaggtttatacaacagtttcagaaggtaaaaagcaaacagaagcagatgctggagttgacgaagataagaaagacgaaacaccagtagttaaagctggatgggacaagaacgctgatggaacttggacattctacaaagatggagctaaagctacaggttggttaaacgataagggaacttggtactacttagatgcagctggaacaatgaaaactggttgggtacaagctggagcttggtactacttaaatgcatcaggagcaatgcaaacaggttgggttaatgataacggaacttggtactactgcaatggatcaggagcaatgcaaactggttggttattagatggatcaacttggtactacttaaatgctaacggatcaatggctgcaaacacaactgttgatggttatgttttaggtgctaacggagcttgggttaaataatataaattaataaaatttttaagaagcaggtagaaatatctgcttctttttgttgagctttataattataaatatgaatattttttgaacaaaaggtttacaattgttaaattattatgaaataaaaatgaatttttttaaagtttattatgtaaattaaataaaaaagtgattatttattaagataaaaagaacgaaaaagtaaatgaaaaaaattttataatcactatgaaatgtttaaattaagccatagatagttattttaatcataataacattagaaaaaggtaccaaaaacaaaaaagatttatgtaatatattgattgtatattaatgaaaataatacattattaaacattagaaatggtaaaaaattaaaaattgtacaaataataaaagtgtgctattataatttacatgatttgcaatagataaatataccatataaaacataatttgattttaaagtatattattgatttatatgttaatttaattaaattacttttaatacataacaaaatttgttatgtgatattgcaaaatgttaaaatacaaaaatagtattctaatttttaggaggaaatataattatgtttagaagatcaagcaaattaacagctatgttagtagctgctgctgctgttgtttcaatagtaccagcatctgcttcagaaagattaggtaataaagacggacatatttcaactggtatcgcatttgatggtggatatgtttatgatggttacagaactgatgatgatgacgcagctctttactacaacaatggtagcaaagatgtaaatgttgatgaagatgaagattatgattatgatagtatgactaaatatggatcaaaatatgctcttgtatatgattcaaatgaaccatatttagtagatttaacaacaggaaaaattgaagatgatgaatcattacaagataaatatgaaaattcgcaaacaaaattaaagactgcattaaagaaaactgatagatatggaaagagtacaacagaggctgcattaactttagttgatgctgaagttggtgctactggaaatgatgcaaaatatgtttcgggaaaattaaacgatgtttggtacatgtacacagtagataaagcattagttgatgatggatcagatgatgctgcagcagctggaaaattatttggatttacaaatgaaagtggtaaatatgttgatgcttcaaatttagcaaatctttatgtttattcaccagaagaagataaaactgttaagatttcagaatatcgtgatacagaaaagaatattacagctgaattagaaaatcttcaaccaatagctcaagataaggattatatttatgcagttgcaacagtaacagtaactgatactaatacaaaaaaagcagaagctactcaatatttcttacaaaaaatctctaaagaacaaggagataagaaagatggagcttacgtaccaaaaagtgtaacttcttaccaaattgatggtggaacaatatacaaagatgatgatatggaagatgcaaacggattattcccaactacaacttctgttgcacctgtcaattctgatggatacaatatggttaattataatgtaaaaaatggtaatattatagttactggtgtaaaagctgattcagttaaggttttcacagttaagttaaagaaagctaaagtagattcagtagaaggttctgaagatagagatgcatatgtagtaatgcaagatgatgatgcagatcaagatttaactgatttagcagaagtaaaagtaaatgctgataaaacattagaagatcgtgctaatacatcacttaaaaactcagcaatttctattgatgcagaaggaaatacttgggcattagataaaggtaagatttataaatttgatggatctgactttaaagaaatgtttacttgtgatagatctcttaatagcatagatgtatatgatgaaaacaacttaattgcttgggatgcaacttcaggcggtgatgtttacacaacagtttcagaaggaaagaaacaaacagaagaagatgctggagttgaagaagataagaaagatgaaacaccagtagtaaaagctggatgggacaagaacgctgatggaacttgggcattctacaaagatggagctaaagctacaggttggttaaacgataagggaacttggtactacttagatgcagctggaacaatgaaaactggttgggtacaagctggagcttggtactacttaaatgcatcaggagcaatgcaaacaggttgggttaatgataacggaacttggtactactgcaatggatcaggagcaatgcaaactggttggttattagatggatcaacttggtactacttaaatgctaacggatcaatggctgcaaacacaactgttgatggttatgttttaggtgctaacggagctatgctttaataattaaaaattaatagaggatatgtaaatattcttttaaaggatacccctagaaattttctaggggtatttaatttatttaaatgtaaaaacataccctaaaattataaagacagttgtattatatagtgaattaataaaaagcgattattaataaaatgtacatataactataatggagggagaatatatgagaaaatcttttaataaagcagcaacattacttttatcattagcaattatgaatgttatttttccagttaatgctgctgaaaaaaaacaatatgaaacaaatattgaagttgaaaataataagttacaagtagatgatgaaggaaatgctgtacttgaactagtatgtgatagtaattcaggatttgtaaagaataatggaaaaactgaattttatgatgtttcaggaagacaagctaaatcatcgtggataaatattagtggaaagtggtactattttgatttgaacggaataatggtaacaggatggcaacgtatatcaaataaatggtactattttttagaagatggatctaaagttacaggatggattatggatgaaggtcattggtattacttaggtgaagatggtatgatgaaaagtttgcaatgggtaaatattgatggtagttggtattattttaatgaaaaaggaattatggaaaaggatactattattgatggttttaagataaatagtaatggaatttcagaattaaaattatagaaagtttgtaataattatatatttttataaaaaaaggcccaaaaatggcaatacaaactgtattatatatcgaacaggaaatgttagataaaagttaaaactttaaaataagttaaactttactatataaaaatgaaatcttaggagggaaagaattatgttaagaaagtcaactaaagttgcagctttattagtagctgctgcttctataacatcaattatgccagctagtgcagctgaaagattaggaacaaaggatggtactgtaacaagaggatttgcttatgcagatggtaagtacttatatgatggatatagaactgatgatgatgatgccgctatttattttaatgacggtaagaaggacaagcaaatagatgattatgatgattacgatatgaatgaagatgaaaaaatcttctatggaacaaaatatgtacaagttgaagatgatggagatcattacttacttgacttatcaacaggaaaaattgatgatgatgaatctgttgaagataagaaagataatgctaaatcaaagctttatacaaatttaaagaaggctgacagatattcagaagctaaaaatgttacaggtggaaaagataaaggaattgtagctttcaatcaaatattagaaggtaaaagaggagatgtttggtatcaatacactgctttaggtgatactacaagtgcaggagtaaaagttgaagcaactacttcagcagctataaattatgctgaaggtgttatacgtactggttttacaaatgaaacaggttctaaatatattgatataacacatgaagctaatatatatgcacttgtaagaagtggaaaagatgaagaaaaattaaaaactactaagctaagtgaatatgataaagaaaataatggtgttgaagcaaaattcttaggaacagaagcgattgctcaagataatgattatatttatgcaattacaactgtacaattaacatatttagaaggatatgcaccaaatgatactattaaaaacaataataataagacaacacaaattttcttacaaaaaattgcaaaggctcaaggagataaagaagatggggcttatattccaaagagtataacttcatatcaattagatgcaggagacctttataaggatgatgatgtaactgaagcatcagaagtaataggtgcaacagaatacaaaaattataaaatagttaattatgaagttaagaattcaactttatatgcaactggtgttaagagtgataatgtaaaagtatgggctataaagcttaaaaaagcaaaaatagatacatctttaactaaagatgttgatacttatgtagcaattaaagatgatgatttcgatcaagatattgtaaatgaaaatgcatacgcaattgatgtggatggaaatatttgggctttagataagggtaaggtatacaaattaaatggaagtgatttcaaagaaatgtatacttgtgatagagctttagataaattagatgtatatgatgacaataacttaatgatctgggaaactgatggagatgtatacactaatgtagctgaaggtaagaagcaaacagatgaagatgctggtgttactgatgaagataagaacccaacaactccaacagtagggtggaatcaaaatgctaatggaacttggtcattctacgatgcaactggtgctcaaatgaaagctagctgggttaaccttggtggaacttggtactacttaaaggctgatggtgttatggctacagggtggttattagaaggtggtaactggtacttcttaaatccagtatctaatggatacttaggagctatgaagactggttggatccaagataatggaacttggtactacttaaatgcatccggagctatgaagactggttggttccaagatactaacggaacttggtacttcttaaaatcaaatggtgctatggctgccaatgaatatattgatggatattatttaggatctaacggagcttgggttagataatatttgaatgaaaaagatgaagcattttgcttcatctttttttgtacaagtatatattaaattttataaaaaagttattaatattgagtatttaaatgtcttttgattataaaaatatatcctaatatttaacactatatattttttataaaaataagaatgtaaataaaaaataaattaaaaaaataaattttcaaaaaggtccccaaaataaaatgtaaaaatgtattatatattgcgataacaaaaatggttattgttaaagaattaaatttgaataatattattagattaaaatatagaattcagtataatataggcaaaaatattgtcataacattcaatattatgaaacatattactttacatgaaataaaattgatgttacaatttatctgaatttatattacttaggaggaaataaaatgtttaatagaacaagtaaaatgacagctttattagtagctgctgctgctgttacttcaatagtacctgcaactgctgctgaaagattaggaactaaagaaggaactatcacaaatgcaattgcattcgatggtacttacgtttatgatggatacagaactgatgatgacgatgcaggtttatacttcaataatggaaaagataaaatggttgatgaagatgaagattatgattacaacctagctaaatacggaagtaaatatgctttaatccaagatgatgaagatttcttagttgatttatcaaacggtaaaattttagatgatgaatcagttcaagataaagaatctaatacaactactaagttaaacactaacttaaagaagactgatagatacggaaaaactacttctggtgctgttgaaatagatagaatcagccaaggttcatttggtgatgtatggtacatgtacactgcaactccagcaagtgatgcagatgttgatgcagaagaattagtagatggtaaattagttggatttactaatgaatcagctaaatatgttgatgctacaaagacagctaacatatatgtatactcagctgcaaaagaaacaacagttaaagtaagtgaatttaatgatgaagttgatttcacaggaaaagataagaattcttataaagttgaagctaaattagaatctttaaaagctatagctcaagattcagattacatttatgcagttgcagaagtaagcgttgtagaaactaagaaggaagatggaacaactactccatctactcaatatttcttacaaaagatttctaaatctcaaggagataagaaagatggagcatacattccaaagagtgttacttcatatcaattagatactgatatatatgatgatagtgatgttaatacagctgcaaacttattaactttaggacaagataaagaagcagatgcaaaatattatgttgttgaaaatggataccaagtgaaaaatggtaacttatacgtaactgctgttaattctagtaatgaagatggaaaaggtgcagatactgttattgtttacacagttaaattaaagaaaactaagatagacacattagctggtgttaaaaatgtagacgcatatgttgctatttctgatgatgataatgatcaagatataatcaacactgctgataaagcttctatatcaatcgatgctgaaggaaacacttgggcattagataaaggtaagatgtacaaatttacaggttctgaattcaaagaaatatacacttgtgacagatcattaaacgttcttgatgtttacaacgaaaagaacttaatagcttgggctgaaggtgaagatgtatacactactgttaacgaaggtaaagaagtaacagatgaagaagctggaaaagaagacgataagactgaagaagtagttaaatcaggatgggataagaatgctgatggaacttggtcttactacaacaacggagctaaggctactggttgggtacaagctggtgcttggtactacttaaacgctaacggaatcatgcaaactggttgggttaacgacaacggaacttggtactactgcaatgcttcaggagctatgcaaactggttggttattagatggatcaacttggtactacttacaagctaacggagctatgaagactggttggttattagataacggaacttggtactacttaaatgctaacggatcaatggctgctaacacaactgttgatggttacaaattaggagctaacggagcttggattagataattaaatctaataagttagaattactctaatatatataaataccttatatggtggactagctatagtccacttataaggtatttttttataaaaaatcaatggcatttcgacatataaatgcataactcggtaggtgacagtcacctattaagtacctaaaactgaatataactttgtattatataatgagtaatgaaataagagttcaatttacttaaatagttatatatggtaatattataattataatgaaatagggggaagaaatatgaataaaaatatcaaacgaacagtggctatggctcttacattaagtgctttagcaacaattgaaccagcaagttcaataaacatactaggtgcacaagaagctaatgcagctacaagtgacaaaatttactttgattctttaagggtttcgggagcaggaagtattaaacttagtgacagcaaaactaaatatagtatatatgttccaaaaagtcaggaaagtgcaactattactataaaaaaagatagcagtagcgatgaaatagaatgtgatgatgatgcagttacaggtattactggaaaggaatcaggagaaagtacttgcaaaattaaagttgacctagatgaaaaaggaagcactgcaaatgaatttgaagtaaaagtttctaatggagataaatctagaacatatacattaaagatttacagaaagaatgtttcaagcgatgatgatgaagataatgatgatatatacttagattcaatcaatttaagtgctggaagcattgatttttcaagaaaaaaagcagaattcgatgttgttgttgataaagatgttgactcaataaaaattcaagcaaagccagaagacgaagattacaaagtagaaatcggtggcgaagaagttgatgaagactgtaagtggagaactgaagtagatttaaaaacaggtaaaaatgtagttgaaatctatattgaggatgaagatgatgatgatgagcctcaaagaacatatacattaaatatatacagaggaactaagccaagctctaatacagctacaggtgaaatagatactaaacaagatgaaatttatgtaaagaaattagtattaaatgatggagatgttccagtaacttttgataagagaataacttcgtatgatgtaactgtaaataaagatcttgaagatattattgtaaaggctgagccagaagataatgatgatttagttaaaataaatggaagtaaagctgatagcagttacagaaagagagttgctttaaactcaactggaactactactatagaaattaaagtttataatgattatgatgatgacgaagatgattatgaagaaagaatatataatcttaatataaagaaggcaggaactactactgattcaagccaaaataataataatagttcaaataacaacaattcgaataataacaacaatggtgatgctggtaataatactactgtaaatccatcagcaaaagtaaatcaatgggttaaaaatgaatatggtttatggcaatataatgatgctttaggaaaaccacttttaaatcaatggtttaaagatggagctaactggtactatttaaatgaatatggaataatgcaaacaggctggataagtcaaggaagcagctggtattatttaaatgatgctggaataatgcaaacaggatgggtaaatgatagaggtacttggtactatctaaatgataacggagctatgaaaacaggatggcacaaagattctaatggtaaatggtattacttaaatgaatatggtgttatgctaagcaatgtttatgttgacagctatagattaggtgctgacggagctatgattaaataataattttagaggatattcataaggagtatcctcttttttgttttataaaatataagtaagtatgttttttacattatatttataaagctaaaatctgcatgcattaaaaacaggctatgataataagaaattatcatagcctgaaagaatgtatattatttattttcagcttttttatttataaagttaactgcggcacctactccgagtataatccagaatataggagcaacacatattactgagtcattgaataaacctgtaaataagtaacctataacacttaaggcaagaattgatccaagaatttgtttttcgtcatatttattttttaatgcgtataacttaaagctatcaacaatataaaccattattaatataacaaaagcaatcaaggcaacaacaccattattaagtccaatttgaaggaataagttatgggccttacttataatcatattagtagttccataagcgtaaagcttacctaacatatcatgctgagggaaatcaaatgagaaagtatcaggaccagaacctaagataagtgtatcttttagtaatggaagtgatcttgaccatatgtatcctcttgcagatgctagtttttcttttccgttaaatcctatagtttcaggaaactctaaatcaatttcttctaatgttttaggatctattaaatgcatactattatcatctcttgttataaacatgaattcattgctaccatttaatataagcataagaccgtcattttttgtctttgactttatcttaccagatctaaatgaaatattagagaaattagcatctgttgtaatataatcatatgctttaatttttgaattaaattctgatttataatctacaacttcatttttagaatttctaaatacataatcattgttttcaaaagatattgttaaggtatctgtaggtaatgttagcacaatattattatctatatgttctatattttttacaggaatatgatctctgtaatcaaaatctgtattgcttttaaataaacttaatccatcagcaactaaactaggtattctattgaatatttttccgcttgttgcaaagtttaaacctacagtaaatactgctaaacatgcaattgtaataagaattgcttttttcttctttaatagtaatttaccaaagaatatacatgcaaaaacaattattgcaccaaatcctattagaccagcacgggatgtacttccgaatagaagccataaaccagtaacacagccacccatagaaagaagttttaagaatatgtcatcttctataacgcacgcaccgaataaaataggtaatacaagggctgtaaagcttcctacataattgtagtggtatagagtaccgtaaatagtacctgattcatatgcaagggataatttactaggatcaatattataagaactaggaatagcaattaatccacctaaacttgtttttattaagtcagagccaaaatattggaatagacctaagaaaccattgatataaactaaaataagaataggtataagtataaacttaaattcttcagtctttttaaaagtataaattgagtatatgaataaaagaatataacatgctattgttataaaaccttctgatctgtcatatattccccaaaaagcaacatgcttatattttgagaataatgttgataagaaagtgaaaccaagaaaaattaaagaacaaattatcattatattgattaatttatcttttttctcatagaattttttaaaacatgttatggcaataattaaaattattgcagagagaaatattaaacagatttctttattttgagtaaataaatctgaatttgcactagaaccgtataattttaatgtatcttcatcaggttcagatattctcatacgcacaattaaaggtacgattgtcagaacaagtgcaataggaaagaaaaatgttattgatttttccttacagaatttctttaagttttccatttgaacacatcctataaataaattttttactaaataactttcatcacaaatatgtaatattatagcattgtgaaggagattttacaaaatatatattgtttattttaagaaatcctttagtagggtataataaaaaaggaatacttgttttttataagaagttgatatgaaagaaaaggtgatattatgcagatttatcagttgatgaataaagataatttagttttagagtttataaaagcagatacattagaaggacagtttaaaatacttagtgaaaacaccaaggcaaattcaccatatcttttaaaaaataataatggtgaactagatacgtggattaataatagaggaataccaacaaatagagaacacattgaaaaagttcttttaagtcttaatttagatagcaaggaaagatttaatttattaattgtaaatcatgctgcaagtttaaatgacacttattggataaaagaaaaaaatgaacttaatattgatggtaaaaatttagagtggaaagatgtgagtttgtatagaggctttaaagaaaaattgggacttatatcattttttggaaatatatcatcattgggaggaaaaattaaaacaccagaattaacaacccagggaatgcttagaaaagcatggagaatggtaggaaatgatatttatttatataaagctaatactcatggatatgctaatgcaggtaatgagatgtattcagaaattattgcatggcagatagcacatattttaaatctgcattatgtaaaatatgagattgaaaaatggaatgaggtatattgcgtaagaagtaaactttttacaagtgaagaaacaggatatcttactatgacagaatacctcaataaacaattaggaagtagaacaaaatggagatatggtgatgtatgcaatgttcttcctagaaactttatagatcagcttaatgatattatgatatttgactttattattgagaacaaagatagacattttagtaattttggatttttaattgataataatgacggaagcttaaaaagtcttgctccaatttttgataatggatattctcttttaaattttgaaatggaacaggatttaattaattatgattataataaaagtatgatcggtacatttgatattgaaaataaaattcaagctaaagaaataattaagaaagatccacaaaagtataagaagtgggctaatattttagccaataatattaataaaattgattttcatgaagttcctgaatacagatcagatgcaatgaaaaaacttattttaagcagatgcaagatgatgcaggaattttaaaataaacaataaaaaggactttaaaagtccttttattgtttatttattgattttaagattgctatatcagtccagttttgagctgttgctacttcaactctatgcatatcattagtcatttcatcaactttacattttattgaatcaactgttagcttaatagctttttgaccttcttctagtctagtaattttactattcatagttgtcatctcagatttcatgcttgttatctcagatttaatacttgttatctcagatttaatacttgttatctcagatttcatacctgtcatttcatacttcatatctgcaatatcagaagaatttttatctaattttgcattcattacctgtagaagttctaaaattttatcttccataaataaaacctcgcttcaattgttatagtgctaatattatatcaaataatatagtattagtatatagatttgatactgaaaagtcctagtttttaagcgattcatcctgacagatttctttattggtaataataagtttttcgttatttttaaagcctttaaaagcagttttaaaaataatttctatgtctaataaaatactccagctttctatataatgtatatcaaattcaattcttttctttattgaagtgtcacctctaaatccatttatttgagcaagtccagttatgccaggtttaacttggtgtttaaccatatatagtggaacttcatctttaaattcatcaacaaagtgaggaagctcaggtcttgggcctactagactcatatcgccttttaacacattgaaaaattgaggtaattcatcaatagaaaacttacgtataaatgaaccaaattttgtttttctaggatcattgtttgtgctccagcctgttgtttctttagaatttactttcatggatctaaatttatacattgtaaatatgcttttatttaatcctacacgctcttgtctgaatattattggtccttttgaggtacactttattataatagctgtaataatcataataggacttgttaatgaaattaaacataaagatcctaagatatctaaagttcgcttcataaaggcattaccaatgttatctagaggaatccttcttatatttattaaaggaagatttcctatctgatcgatataaggctgactaggtatgtatttgtagcaaaatggaattatagatatttttgttccacttttttcacagtcagaaactatcttttctatatattctgcatcctttaagtctagggcacagaccacctcatcaaatttatactcgaataatatatctagtaattggctgtaatcacctaacttctctccataaaatccagaatcatttgatacatatccaacataattgtaaccataggttttattattttgtattacatccaaatattcagatgcagtttttcctgcacctacaattaaaacatgctttaaattcaatcctttttttcttaagtttgaaaggattcttcttaaaaatcctcttttaattataatcaaagttgtatttacaaaatagaagattacaattacaagtcttgaaatatgtacaagtttaaaaacaaataaagaggataatgctattgtaattaagattaaatttgcatttataattttgctgcattcttttgaaaatagagaagttcttactggatcatataaattaaaaaatacatacaaaataagatatattggaattaaaattactgtaaattttaagtatgtatataattttatataaaattcatcatgataaagtaaggtaaaacgtatgaaatatgatattaccatggatacaaataaaataagtatatctgtaaatgcatttattttattcagtaagttttgattttcttttatcattttattatcctccaccctttctttatatattgacagatactaaaatctgttaatgtatatatggtgcaataacattatgacattaataatataattagtacaagttattaattaaaatataaataaaatactacaaagattctctctattaagtattattttatctattaactataattgtccattgtcagatctaaattgtcaattacaatatatattattataaattaatttggtgatagttccaacatgcatattaatcttataattgatttttatggtatattgttttaaattgggagcaatataaaaatatatatgtggcttcaaaggcaactataatcctataattctttgatttatattatatgtatgataaaatatatgtagcaaattagatagtagatatattttccaaaggggaatattgcaaggaggagaaaatgactaaaggaataatattagctggtggaagtggaacaagattatatccattaacaatggttacatcaaaacaacttttgccaatatatgataaacctatgatatattatccactttcaacattaatgttagcaggaataagagatatactaattatttctacacctaatgatctgcctaactttgaaaaattattaggtgatggttcaagatatggaataaacatatcatataaagtgcaaccttcacctgatggattagcacaagcatttatcttaggagaagagtttataggtgaagataattgtgcaatgatattaggagataacatatttcatggaaatggatttacaactcagcttaaaaaagcagtagaaaatacagaacgtgcaactgtctttggatattacgtagaagatccagaacgttttggtgtagtagagtttgatgaaaatggaaaagtaatttcgttagaagaaaagccagaaattccaaagtcaaattatgctgttacaggactttatttttatgataataaagtgtgtgaatatgcaaaaagtttaaaaccatcaccacgtggagaacttgaaatcacagatttaaataaaatataccttgaaaaaggaaaacttgatgtaataactcttggacgtgggtatggatggcttgatacaggaactgtagatagcttgagtgaagcaagtgaatacgtaagagttatagaaaatagacagggacttaaaatttcatgtattgaagaaatttcttataaaaatggatggataaataaagaaacattacttgaaagtgcagttaaatatggaaagagtccttatggacaacatttaaaaaatgttgcagaaggaaaagttatttattaaccgacaatgtaagttataagggagagtttattatgaatttgattaaaactaaattagatggtgtatatatagtagagccacaggtctttggagatgaaagaggatggtttatggaaacctattcggcaataaaaactccagaaatagtgtgtgactttgttcaagacaatcaatcatattcaaaagaaaagggaatacttagaggaattcatttccaaaatggtgagcatgctcaagctaagcttgttagagttgttaaaggtactgtacttgatgttgctgttgatttaagaaaaggatcacctacttataagcaatgggttgctgttgaactttcagcagagaataaaaaacagttatttattccaagaggttttggccatggatttgttactttaagtaatgatgttgaatttgtatataaaacagataattattataaccatgaaagtgatagaagcattaggtttgatgatccagaaattggagtcgaatgggggatagaaaacccaattctttccgaaaaggataaaaaagcaccattattgaaggatagtgattgtacttttatatataaagaataaaagtaattgaaaggatagttgaatatatgaaaataatagtaactggtggagcaggttttattggtggaaattttgttcactatatgttaaataaatataatgattataaaataatagtagtagatagcttaacatatgcaggtaatatggaaactttagatagtgtaaaagatagcagtaatttttcattttacaaaattgatattgctgatagagaagctgtatatgaaatgtttaaaaaagagaatcctgatatggtagttaattttgcagcggaaagtcatgttgacagatcaatagaaaatccagagatatttttaagaacaaatattatggggacacaagttcttatggatgcatgcagaaaatatggaataaagagatatcatcaggtatcaacagatgaagtttatggagatttaccacttgatagaccagatttattttttacagaagaaactccgttacatacatcaagtccatattcgtcaagtaaggcatcagctgaccttttagtaggagcatattatagaacatatggattacctgtgacaatttcaagatgttctaataactatggtccatatcatttcccagaaaagcttatacctttaatgattgcaaatgcgttaaacgataaagaattgcctgtatatggtacaggagaaaatgtaagagattggctttatgttgaagatcattgcagagctattgatttaataatacataatggaaaagttggagaagtctataatataggtggacataatgaaagaactaatcttgaagtagtaaaaactgttctaagagagcttggaaagccagaaagtttaattaaatatgtatctgatagaaaaggtcatgatatgagatatgcaattgatcctacaaaaattcacaatgaattgggatggcttccaacaactacatttgatgaaggtataaaaaagactgtaaaatggtatttagataataaatcatggtgggaaaacatcataagcggtgaatataaaaattactatgagaaaatgtatgataacagataaacctttagtatctatattgttagctgtctataagcctaatgagaattggcttatagaacagcttatttctctgaataagcagaattatgaaaatttgaatttatatgtttatgatgattgtcctgaatatcctaccaatacagagatatttaacaagtatataactaattttgagtataagattatacgtggagaagttaacaaaggatctaataaggcttttgaagagttaactaagattgcggatggagatttctttgcatattgtgatcaggatgatatatgggaaacaaataaaatttcattgatgatggatgagttcacggaagatgttactcttgtgtgctgtgatttgagtataattgatgaacatagcaacaagactcatgaaagtttatgtgatattaggaaaagaattgtttataaaagtgggtatggcttagctaaggatttgcttatgactaattttgtaactggatgtgcgatgattgttaagaaaaacattgcaattaaggctgttccatttattgatgaacttgtacatgatcaatggatagccgttattgcagctttaggtgggaaaattaagtttgttgataaatctttggttagatatagacaacatagtaataatcaaacaggtattttaactggagttgttgataaaacaagttattatgaaaaaagaattgatgatttttatagcagatatttagtctataataaagcaattggaaatgaagaagaagtaaaacaaacaatatatgaaagtattaaatggatagaagctagaaaaagatattcacaaaaaatatcatttaaagatttgaaaattatgataaaatacagagatattcacaaggtatctatacttatagaaagtatattgccttttataccgaattttatatttagatatattattaaattaactaaaaaaggattgttgtaattttaggaggatataaaatgattttagtaactggtgttaatggacagttaggttacgatgtggttaaagtattaaaggaaagaaacatagaatgtttaggaatagataaagatcaattagatataactgatgaagatgcagttaataaatatattacagatttaaaaccagaatgtgtagtacattgtgctgcatatacagcagttgatagagcagaagatgatgaagaagtatgtacaaaagtaaatgtaaaaggaacagaatatatagctaaagcatgtaaggcaatagatgcaaagatgatatatatatcaactgattatgtttatgatggaaatggagatgaaccatttgaagttgatggacatatagaaccacattcagtttatggtaaaacaaaatatgaaggtgaagtaaaagttcaagaaattttagataaatattttatagtaagaatttcttgggtttttggtatcaatggaaataattttgtgaaaactgtgcttagattaggaaaagaaaaagaaaatttaaatgtagtatgtgatcaaataggaagtccaacgtatacagcggatttagctccacttttatgtgatatggctgtgtcggaaaaatatggtgtttataatgctactaatgaaggcttctgttcatgggcagaatttgcagcagaaattatgaagcaagctggattaaactgcaaggtaaatcctattcctacaagtgaatatccatgtaaggcagtaagaccttttaattctaggatgagtaagaagatgcttttggagaatgggtttagtttgttgcctgagtggaaagtagctttgaaaaaatatttaaaggaaataatgtgaaggaaaagattatgattaaaaagaaaacaatgaaatatataatagtagttgtattactaattattgttaacatattaacttttaaacattgtaacttagaagataaaaatataggattaaattataatttgaagtcaaatgtagaagatacatatcaacttttttatagtaatgatgaagaattaaaatggaaagaagagaattcacagaatgtaatttatagttatgtcaataaaaatgctaacatgaagtatttaatatcaaaagatacagttggttttagagttgatttaggaaacaaaccagcagaaatagttatttctgatattaatttatcttattatggaaaaaaaataaaattagataaaaatcaaatgttagatataaaaaatcaaaatcaaattgaaaagatagaatatattaatggaaattataatataaaaacaaatggaaatgatgcttatataaaatatagattaaattcaaatgaaattattaatttattaaaatataaaaatagtttgaattttaaattgaaaattttaatttgtatattaattgatatattaatttatatattttttattaaatcaaatagcataatgaatttattagaagatttatatttgaataaacgacttatatggaatttatcaaagaatgattttaaaactaagtatgcagggtcttatttaggaataatttgggcatttgttcaaccaatagtaacaatattagtatattggtttgtatttcaatttggacttagagctgtatctccaataaaagatgtaccatatatactatggtttatgtcagggttagtaccttggtttttctttcaagattcactattaagtgcaacaaattgtatgattgaatatagttatttagtaaaaaaagtagtatttaaaataagtatacttccaatagtaaaaataatatctgcattatttgtacatttagtatttatatgttttttatttggagttgcaagtatatatgacttttatccttcacaacatatagtacaattggtgtattattcattttgtacatttttaattacattaggaatatcgtatgcaacatgttcaatagttatattttttagggatttaggtcaaataatatcaatttttttgcaagttggaatgtggatgacacctataatgtggagttatacaatggcatctccaaagtatcaatggatattaaagttaaatccgatgtattatatagttgaaggatatcgagatacatttattaatcatgtgtggtttatggacagatatttccaaacagcttatttttgggcagtaacattgggattgtttataattggaacaataatatttaataagttaaaaccacattttgcagatgtattgtaggagagataaatatgaatgatatagctataaaagtgaataatttaagtaaaatgtataaattatatgataaacctatagatagacttaaggagtctttgggaatcacaaaaaaaattctatataatgaacattatgcattacacgatgttaattttgaaataaaaaaaggagagactgttggtataattgggaccaatggttcgggaaagtctacaattttaaaaattatcacaggagtattaaatgccactaaaggtgacgttattgtgaatggtagaatatctgctttgctagaattaggagcagggtttaatatggagtatacaggaatacaaaatatttatcttaatggaacaatgatgggattcacaaaagaagaagtggataaaaagttagataatattatagaatttgcagatataggtgagtttattaatcaacctgtaaaaacttactctagtggtatgtttgtaagattagcttttgcagtagcgattaatattgaaccggaaatattaattgttgatgaagcactttcagtaggagatgttttctttcaagcgaaatgttataagaaatttgaagattttaaacaagaaggaaagacgatattatttgtgagtcatgatttaggtagtgttggaaaatattgtgatagagttatactgttaaatagagggataaaactatgtgaaggggacacgaaggaagtaattgatgtatacaaaaaggttttagtaaatcaattagagagtacaaataaagaaaaaaaatgtaataatattatttgtgatgataaaaaatggaaagaatttataacacttaatccagatactattgaatatggaagtaaatttgcagagattattgatttttgtgtaattgatgatgctaataatattaccaataatatatttaaaggaaaagaatttagtgtgaagattaaggtgatttttaatagtagaattcaagaaccaatttttgcatttacgattaaggatttaaaaggtacagaaattacaggaactaatactatgatagaaaagtcagatgtgaatatagtagacaaaggtgaagtgaaagaaataacatttaaacaaaaaatgaatcttcaaggtggcgaatacttattatcattaggatgtacaggatataaagatggtgattttacagtttatcatagattatatgatgtatgtaatattactgtgatatcagataaaaatacagttgggtactatgatatgaattctgaagttgaagtaatataaatattattaggaaggtaatttatatgtttgataaagttgaaaatataagtttggattatactaattactcaggagtagatttatacagtgacggtgttattgaagatgaacttttagaaatagtacaaaattatagtaaatatgaatttaatagaattattgctgaacgtaaaaaatggccaattatatatcatttatctcatatacgttccaatataatacaatggcttcctattactaaaagtgatactgttttggaggttggatctggttgtggtgcaataactggaacattagctgatatggctaaaagtgttacatgcatagaactatcccaaaaaagaagtttgattaatgcatatagaaataaagaaaaagaaaatataaatattttattgggaaattttgaggatattgagagaaacttaacagaaaaatatgattatattactttaataggagtttttgaatatggtgaatcttatatttcagaagataatccatatgaagtattcttaaaaaaaataaaaggccatttaagtgaaaatggtaaaataattattgctatagaaaataaattagggttaaaatattgggctggttgtcaggaagatcacgtgaatagatattttgaaggaatagaagactatactaatacaatcggagtaaaaaccttttctaaaaatgaattagaacgaatttttaaaagatgtggatttgaaaagtataagttctattatccatatccagattataaattaccaactactatatattcagatgaatatttacctactgaaggtgagttgaataataatatgcgtaattttgataaagaacgtataataacctttgatgaagcaagagtttacaatatgctgattaaagaaaatctatttcctatttattctaattcataccttatagtgttagggattggagatgaaaatcagtgaaacaaattatatattctaagtattctaatgaaagagatgctaaatttcagataagaacagatatacttaaaaatgaaaatggagacagatatgttcataagatagcgttaaatacagagtctattaaacatatagataatattaatacaagttatttactattaactgaattatataaagattctaaaattagtgtacctaaatgtactagaatcgataaaggtgttgagcttgaatatataacaggaaatacttttgctgagaagctagataaactattttttagtgaagattattcacaattagttgaaaaaattaaagagtatacgaaagttataactggagataacgttaaaaaatttacaattacagaaaaatttgttgaagtatttggagaagtacaattacctactacattattggccgcatctgacattaataatattgatttaatatttgataatataattataaataacaaatggaatataattgactatgagtggactttcaattttttaattcctataaattttattatttatagagcaataaaaatttatatagatggttcacaaaaacgtaatgaacttaggcatttaggtatatataaactattaggaataaccaataaagaaatatcagcttacgatgtaatggaagaaaattttcagagatatgtaagtggtaatttggtatctcttaataaactttatggtgaaacaacagatgccaatataaatatttgcaaaacgataaaagatgaaaaaaatgatatgaataaaacttctatacaagttttttatgattatggtaatggattttctgaagtagattcatatagattttatccttcatgtgataatagtggtaatgttcaatttgaaattaatataacacctagagtcaagtctgttagaattgatccatgcaatgtcagtagtatagcaaatataataagcatatctggattcaatgaaaaatattataatattgaatatgcaactaatggaataaatattagtgataatttaatattatatgatcataacgatccacaaataattttaaataatataaaagataaaacgactaaaatacaattaaatttatgtattcaaattttatctaagtatttaataatagaaatgtgtaagtctttagataaaaaagatagatgtatagaagaaaaagataggtgtatacaagaaaaagatagatgtatagaagaaaaagatagatgtatagaagagaaagatagatgtatagaagagaaagatagatatataaaagaaaaagataagttaatacaagaaataatgaacagtaaaggttggaaagtaattcaaaaaatcaagagatttactggaaaataaataatagcaatggattgagttaggagaagaatgttatggcaaattcatatatgtataatattgacaatgtggcttataacgaccagatattagatattagaggatggatttttaatgaagataaagaagtaaatgatataaaattagttgttaaaggcgctcaatcaaaggaacatatacaatgtttatcaaatatattacaggaaagaatagatgtttatgaagcttttaataataaaaatgctttaaattcaggtttttgttgtaaatttgaattaaataatgtttataaagctgatgtatatttagatattaataatgaacataggatttttataaaacgcattgaatcccaaaaaaatggaaagtttaaaaatattatagaaaaaacaaaaaaaatatttttaagaagtgataataatataactatcaaagaattaggtgtgaatttacaaaatgacgattttattgattttagaaaagaaagagttatacagaaagtaatatataatgatgcaatatataagaatataatagatataataataccggtttttaatggatatgattatttagaaaagctttttgaaacaatatcgaatactaaaatgaattatagattaatagtaattaatgataagagtacagatgaaagagtagctgttttcttaagtagatatgctgaaagagatagtagagttgtattgttagaaaatgaagaaaatttaggatttgtaaaaacagttaataaaggacttaaattatcaaataatcatattgctttagtaaatacagatactgagttaccaccaatgtggctagaacgcttgattatgccaattattgaaagcggtaaagtggcaagttcgacaccgtttacaaattgtggaacaatctgtagttttcctgatttttgtaaagataatgtattatttgaagaaatgaatgtaaaagatatagataatgtttttcaaacaatagagccatgttacacacaacttccaactggagttggtttttgcatggggatgaatagaaatgctattaatgaaattggtgtattagatgaaaaaacttttgcaaaaggttatggtgaagaaaatgattggtgtcaacgtgcaataaagtccggatataaaaatgttcatgttgaaaatttatatgtgtatcataaacatggtggtagctttttaagtgaagaaaaaaagaaattacttgaaaggaacagtcaactattatcccaaaaacatcctaattacaatagcgatgttatgaattattgtaatagtgatccagttagtggaataagaaagtatgtaatgttcactttattgttaaagaaagttaatgaaatagaactttactttgatcatagtaatggtggtggtgctactagttatttggagaaaaaaatagagaaaagaattttaaatgaaaaagcgattattattattcgctatgatgttttcaaaaagaaatacttatttaactttaagtataaaaaatatgatatattatatttctttaataccttgaatgaattgttttcatttttaaatgaattaaaaataacgaaaatatatattaatgaacttgtaacatatttaagtatttatgaagttataaataatatattacaattaaaagataataaaaaagcaaaattatattgttatattcatgattattatgctatctgtcctacaataaacttattgaataatgcaggatgttattgtaaattaaatattgataaatgtgatacttgtatcaaaagcaatcaattcaattcatttatgaaatatgaaagtattaatctatggagagaagtgtggggaagattattaaatgattgtgataaagtaatagtattttccaacgattctgaaaagataataaaaaagatatataatactcttgataatattgagataatacctcatgttgtagattatattgtacctattaaaaggaatataaagaaaaacaagactattaaaataggggttttaggtatccttgcaaagcataaaggattagatataattaaagacatgctaagaataattgatgaatctaagttggatataaaaattgttttatttggcagttgtgatgaaaaaatagagcataagaattttttagaaacaggaaagtattctgttgataatatttcgaaattgattttagaacatgaaatagatataatttttattccatcaatatggccagaaacttactcatatactactcaagaggctatagaaatgaaaatgccagttgcttgtttaaatataggagctcaagcagaaaaggtaagtaaatataatatgggatgtgttattgattcagataattcaaagataatattaaatgaaataataaaatttgtacaaaaacttacttagaaaaataaatttgagaaatatgaggaagggcataatgaaaaaagtaaatattataatttcagtagatagtcacataaaaaatttagatatgtgtatggaaagtataatacgctatactgatttagaaaaacatagtgttagtatatttcatgataagaattgtaatttaagtggaaaatatgatgaatatattgataaaacatacaataatgaaaaatgttattttactaaaatacttattgatttaatagaaaaaaatgatgaggatataattctacttaattctaatgtgagagttactgaagaatggttagaaaaattgtatgaatgtgcatatagtgatgaaactataggtgctgtagaaccactatctaataattggagtttttttaacgagagtaagtttagtgaatataatattgatgaattttctaaacaaatttcaagattaagtatgaaagaatatccaagaataaattgtgtagataaattttgtttatatataaaaaaagatatacttaagcgattaaatttacttaaagacgagaaaattcaagaagagtgtgatttattagaaactttttgtattcaaagtaagcaattaggatatcatcaagttctttgtgattcattatttgtttattacgtgaatgaagacataaatttaattaataataataaaaatattattgataatgaatacataaaaaaatatataaagaataatataaaagttgcttcagtgcttagtaataagaaaaaaaatatattatatttattacaatctgattttcatgaagaagctacaaataatattggaggaactcagcttcatgtgaaagatttagtaatggaattaaaaaataaatataatatttatgttgtagcaagagatggtgaatatttacgatttacaatatattcagaagaaaaatgtatttcatataaacttaatattggaaaggtacctaaatttaatgtatttagagataaaatacaaggtgagctatatagaagtatactggagatattctctgttgatatagttcacatacatcatacacttgatttatcactagacttatattatgaagcaagtcaattgaatatacctattattgctacattacatgattatttttatgtatgcccatgcattaaattagtgaattatgaaaataaactttgcattggatcagaaacaaaagaaatgtgttcaaaatgtttagaaaagaagtttggaattgatagaaatattgattttattagaaattggagaaaagagaatattgaagcacttaaattatgtgataaattaatcactccatctaatagtgctaaagaaatttttagttcgtatttccctgagctaacaaataaaattcaagttattgagcatggttctgacaaatatatttataatgaaattacgtccaagaatgatgaatggattgtgacaaatgatatacattcaaattttgaatatgtatttgatgaaccatcaaataaacaattaataaaagggtgggcatatattgcaggaaaagaaagcaaaaattctcatatatatatccaaataatggatgaacatggaaataataaaaatattaaaactaatatggtcaagagaccagatgtggcaaattctgttatggatgcaaaatatattaatagtggattttctgtaatagttccaagagatatttttaaaaatggaaaattgtttataaatataataattgttaatgatgaagtggtttataaagatagtcaatgtaaaacgataaaatataagcattatattgatggaaaaaaattcaatgttgcttttattggaggaatgtcacctgaaaagggaagtcaattagcatacaaaacaattataaattcaccagcagatattaattggtatgtttttggaggaataggggataaagatctggctgaacttgaacaagaaaatttaattaagacaggatggtacaaaagagaagacttacattcattagtaaaattgttcaatatagatttaatatgtattttaccaatatggcctgaaacattttgttatactttatcagaagcattgttgtgtggtatacctgtacttggaactgatattggagctgttggagagagaataaaaaaactagagtgtggatggcttacctcattaagttctacttacgaagatgtgttaaatataatttataagataaaaaatagtacagaagaatataataaagtgctaaatagtattaagaatataaagactaatagaataaatgatatgttagaagaatatattaaagtttatgaatttgaattaggaaataaagtaaataaatattacgaaaatcaattaagtagtaaagcaaaaacagtattattaaataagactatatgtgattttgaaaataatgattatattcaaaaaatacctgaatataattacttaaaatctagagttcaacagttagaaagtgaattgaatttgatttataaatctaaaggatatagtatagtgaattttactagaagaataaaaaataaggtgttatatggaaaaaaataagagagatgaatattgggatattataaaaggattgggtatattagcagtagtgttaggacattcaggctgtggaattaaggctataggaaggatattatatttttatcatatgggattattcttttttatttcaggagcattatttaatgaaaaaaaacactaatgatgtatatggatatataggtaataaattaaagaatttatggtggcctatggctaaatacattataatttttattttattacataattttttcttaaatcttaatatttatagtgaccaaataaaaggagaaatgatttttaactcaacttactatactctatatgatatattaaattattcttttaatacattatttacaatgagttatccagtagaaatggctgggctatgtggtttgtattaccactaatagttagtatgagcatattttgttttgtgagatatttagctttaagaatacactctaaaagaaaagaaataattactactaccattattgttatattatccttaattggaattatttttacaaaaaaggcgagttaaatttgtattgagagttgatttggctactttagtaatgcctcttgtttatggtggatatatctttaaaaattacatatttaaatattttaaattaaattacttgttaatgattatatcagttacaattttatattattattatactaatggtttagatataagttatgcacaaggtaagattgggaatccaattagcttttttgtagtagttttttggggatttatgttaatttgtgcttaggaaaaataataataaaatcaaaaaacattaggaaaatattttgtatattcggtagaaattcatttcatataatggcattacattctttggcatttaaattagttaatataattgatatatatatagtaaagaagtatttcatattgcaaaatatccatattcaaatggagactggtggatattatattttggtgtaggtgtaaatattccagtaatatttatttaagcaaataacatttagtctaacgaaattaaattataaatcaattaaggagaattaacaattattatggttatagaaaagagaaataattattgggatattgtcaagggtttaggaattattttagtagtattaggacattcaggttgccctaataagtttgcaattataacactaaattattatcatatggctttatttttttttgtagcaggttttttttataaggataaaaattcaaataatgtattcctatatataggtaaaaaaatgatgggattatggttacctatgattaaatacatagtagcttttatattattacataatatatttttaaaattaaatatatatagtactattcaaaatgaacatatgatctatcccactgtttattatagtgtaattgatacattaacttactgctttaatacaatattccaaggaaattatccagtagaaatggctggggctatgtggtttgtattaccattgatagttagtatgagcatgttctgtttaatatctcatagtgctattgtacttaactttaaggataagaaaaagtatatatggattagcgtaattattgttatttttgctataataggtttttatttttcatataagtcatggaaatttgcatggcgagtagatattgcactattttcattaccaattatttattttggatatttatataataaaactgataccaataaatcaaattggtatttaataatcatagcaatagcaatcattatatttttttataaaagagaatatatgattagttatgttgaagctaaattgggaaatcctataaaatttatattagtttcattatcaggaatatatttgaatttagctgtcgcaaaatctttgaataaaattaaatacataaataaagctatagcgttggtaggaagagaatcatttaatataatggcattgcattttttaagttttaaatttgttaatttattagatgtaataataagcaataaacctatatattatatagcaaaatatccatattcaaatgaaaagttatggttagtttatctattagcaggtttaataatacctatattatatataaaagtatatagatatattaaaataataatagtaaataaagttcatgaaataaaaaatacataatgtattaagacgactggtaatatgtcaagataaattttaaattaaattggaaatttcttagtttgtcttataaaaaaagagtacaagaaataatcctatattaattaccaaaattttactggcaattaaaaggctgtactgcacatattaaattgtagctttttcaactacctcattagaggtataaagttgattattgcgtagcaaagcaaaaatcaatcttacaagttttcggctagttagtgcaagtgctcttttatgtttatgtactaatgcttcatcagattttttctgataataagcagaatattcatcaatatgcctaatgacgctagcggaagcttctaataagtaatatcttaaatacttattaccggttttggtcaagaaggtgttgtcagcagtaaaattgcctgattgcttcttacgccaagttagaccagcatattttgctacgcaagcttgattgctaaatttggttatatcaccaagttcagcaattattccagccgcaaatactggaccaatcccaggaatagacattaagcattggtactgatggttaccgaagcctttaacggctttttcgatagctttatctaaagatttaacttctttttctaaagcttttatacagtttagtgaagctgcaatagttgcatttaaaggatcatataaggctttatcaagcctataagagtctcttgcagctctttgaagtatttcagctgtagcttcggggtttgaaaatctatttttacttttatcaataagaaaagtaataagattttcaatgcttgtgttagcaatgtcttcagcagacatataatctgttaatacagcttctgaagttgctccaaatatatttgaaaatggagtttcatttttatctaatacagctaactcgctaaattttagaaaaatatttgataaaatataagacttttcacggcttatattttcaattatatgaagtctgcatctagtaagtctttgtaaagctatgtattcagcaccactccatggagaagtagttattttgccaactcgcgcaaaatctgcaatgacaaaagcatcctttggatcagtcttatccatgtcaacaaaagatttcttatatgctgcaataacacgtgggttaaggcagtaaactttaggtttaaaccaaactaatgcctcatgagatgataatgtattcgctaaatgccagctatagaatgaggttgattccatggcgactgttagatgtgtaagattattttcttttaggcaagaacaaattttagataccatttgctccgaacctggaaggttgtttttaacttgaaatgataataattttttgccaaagaaatctagggcaaagacgtaattagttcgagaactaacatctataccaatgaataaggtagttgttaaagcgttattcatggtatcaccacctttcaattaaaataaaacaagaactggcataggattacccctaagtttgtaatgcatcaacaccctcgcactaataagaactaagttattaacgttgatgattagttgctacgctaatcggttagtaacctgaacaacgactgggttagaagttaacaatacaactagggaaacactcttttaaagaagtatcaccgaagtgaccaacaaggagaatctgaatagtcctacgccaattctctaatataaatattgacgtttaggagcaattctataccactcttgtaaatttccagttatctttgcattttgtagttagattagatactggaaattcaataaaagctaactacaaaattaattatacgaggagaatagatatgaaaaaaagtttagtagggtatacaggttttgtgggatcaaatttagctaatagctttaaatttgataacttatacaattcaaaaaacatagaagaagcatatgggactaatccagatttattagtttattcaggggttccagctgaaaagtttttagcaaataataacccagaaaaagacatggaaataatacaaaatgcttttgaaaatataaaaaaaattaatcctaagagaatagttcttatatcaacaattgatgtatataaaagtccaattaatgttgatgaagatactaaaattgatacagaaggtttattaccatatggatataatagatatcaacttgaaacaatggtagaagaaaactttgataatcatttaattgttcgtttaccaggattatatggacaaaatattaaaaagaattttatatatgattttattaactttattcctagtcttttaaatgaacaaaaatacagagagttaattagtaaagatgggtatattaaagactattatttaaaacaagaaaatggattttacaaatgtatagatgtgaatgctgaagaaaaagctaatttaaaaacatactttgagaagactggtttttcagctcttaactttacagatagtagaagtatttttcaattttataatctttcatacttatggcaacatattaatattgctttagacaatggaattcaaaaattaaatttagcaacagaaccagtttctatagaagaactttacaagtatttaaaggggactcaattcatcaatgaagttgcaaaagaaccttttagttatgattataaaacaaaacactccaaaatttttaatagggaagatgaatatatattcaataaaaaatttatattagatgatataaggaaatatgttaatagtagtgaaggaaataataaaaatggattctattaatcaaaacaattataaacaagttagtgaatataatttaatgaaagtaattgcaataattttagtggttataggacatagtacatatttaaaaatatcaggggtagattattcacaattttttggacagacattacaagtagagtttgggaaaaatgtacagagaattgttgatattatatatatatttcatatggcgttattttttgctgtttcaggatcggtatattatattcaaaagaataaattgaacaagtacaagaatgctaaggaacttataataaacaaaataaaaagacttatgataccgtatattttagttggtatattatatgttattccaataaaagtgataagcagattttattccactaattattttgctaatgcaatattttatgatatgttaaatggaataggacatttatggttcttatttactcttttttggatatttatattgttttattttttagaaaagtatatttataataataataaatatattttttgggttatagtattaattacttatttttttaatgatattatatataattttatgccaaatggattaaagagtaatgtacaatatgttatatttttttgtatagggtatttttttgagattattagagaaaaatacaataatagtaaatgtatggttgtaaatacaatcatacttagtgtagttgtatatgttttgtattatgctcaaaaaaatataaattttaaatatgctcaattgctaatattattatttgtaaaaatattattaattttaattgtgtacaacatatcgtatttacttaataaatatttaaaaattagcaaattaaaattatatgaaaagttatataaatataattttgatatttatctttttcatgatccattaaattatttgtttttatatattgcgtcattaatactaataaaaatacaaaatcagaatttaattcaaactcaagtattttcatttttcatgatttttattttgagatttgtaataaatattttcatttgtatatttatagcagttgtaataaataagtttaaacaatataaaaagttaaggagaaaattattatgttggtgtggagtgatgtttgttttatgctttggaatggtgatttatgacaactataataatattcataggacaaataaaatatatgcaccaagattaggtgataattttacaacaataaacttaactgatgaaaattggacaaatggagtatctaatacaatgaacatcttgctttttgaaaataatgaagtaaatataagcatacttaaaaatgcaaagttagtaaaatataataatattaataaaggaatacagaatataaaagaaatagataattcatggatttaccttgaattagataatagagaaaatatagaacaattcgcatatcctaataaaattcaagtgttaaagtaacataaggtatatttattcaatattagtagtagttatttttgaaaggaattatttgcgttaatatgtttaaatcaaataaaattaaaattataaaaatattaccgataattatttgtataattttacaaatagtatctatatctatacgagcacctaaaataaataatgaaaattataaaaattctgatgctacttatcatgtattattaacgatgaaagcctatgacgaaacaccttattcagtacataaatttttgcctatagtttcattaggtggtgcaatggataaagagattaaatggagggctactattccagataaataggtaattattattacacttcattttcaccagctggttttgttattccatatatatttttgaaattcatgaattttgagaggaatgaattgaatttgtatttctttaattcattttgtggacttatatcgtgtatattaacaataatgttttttattaaagtttataaaggaaggttgtctagtagaattataattattttttctactataatatatttatttcagactgaagttattcattcacaaggaattgcttattggcatcaatctatttatcaagtacttatattgctacagttgaattgcttcttatcacaaaaggaaagctgtatgaaaaagataggtttctttatattatgtattattataccatatgttgagtggtttggttatattagtaatatgggttttgcaatagtatcattattagataatagcaataaaatagataggaaattatcatgtaataaaaacaatgtatatgacagtgtattaataacgttgtgtactatagtatcatttataatttttacaattcactatctgttagttgtttcctataaggattattttcctgcgcttttaaatagatttatggctaggagtatgttgaaatctaattttatacaactattaatagaatattggaaatcatataattatttatttatagttttaacaataatgttaagtgttatattattccaaaataacttacggttaaagttgattaacaatataaaaacacatatactaatatatatattactactctttataataattgaaaatataattatgctacagcacgctgttagatatagttatgatagaatgaaattaattttcttattaatgatgttgttttttgaactttatacagttctggaaaattatacaagtgaatgcggcaaaaaattatttgaaagtatgctattttctacattattgatactagcaattaataatgtatatcaatatgtagacaaaaatgatggatatagatggggaattaactatttaaattcaaatagaatattggctaattatatccaaaaaacgtataatacaaatgatagtttattattacaatcatcaccagtgagagggtatgataatttactatttaatcgaggaatatatgaaggaattacagtaagacaaggtattgatattgcttcagaaaaggaaataagatatgttatagagcttgcaaatgaaccacaagaatggactatggacaaatataatggttgcatggtttatgatttgaaaaaaaatactgatcagataattaaaattagtaatgaaaagataattacatcaataaataaaacattttttgcatatgaactcacagatgacaattgggaaaagggtgtttcaattaatagtggaattattcttgtttctaataataaatttaatttgaataaatttgaagatgcaaaagaattaaaagtaaatggaactattaaaaagataaaagaaattgatcaaaataatgaatggatatatataatgttagaagataataaagaagtagaaaaatttaagtttccgaatagaattgaagtaattaaaaataattaataaatgaaaggaataaataatgaaattatcaatatcaaatatagcatggtcaaaagaatatgattatgagatgtatgaatatttagaaaaagaaaaatttgaaggattagaaatagctccaactagaatatttgaagaaagaccttatgaagatttagataaggcaaaactatttagtgaaaatcttaaaaaaaatcaaaatcttaaagtgtcttcaatgcaatcaatatggtatggacgaaatgaaaaaatatttggttcaaaagaagaaagagctaaattaatcgaatatacaaagaaagctattgattttgctaatactataagatgcaacaatcttgtttttggatgccctaaaaatagagttactaatagtaaacaagatgaagaaatagctttagattttttctatgaactaggggaatatgcagaagataagggtacagttttatctatggaacctaatccagtaatatataatactaattttataaattatacaatagaagcttttgaatttgttaaaaaggtaaatagcaaaggattaaaggtgaatgtcgatttgggtacaataatttataataaagaagatttgaatgttatatcagataatattaatttagtaaatcatgttcatattagtgaacctaatttagcattaatacagaaaagagatttacatattaagttagcaagcattttgaaagaaaaagaatataataattatgtttctatagaaatgggtaaatgtgatagcttgcacgaagttaaagaaagcattaaatatataaatgaggtgttcaaatgatttatgaaaaaattgatggagtacctaattttgaatgtaatgaatatgctccaaagaagaccaaatattgcgtctgtataccaatcataaatgaaggtgaaagaatagataaggaattagaacgtgcaaaaaagaataatatagataaaacagtagatataattatttgtgatggtggttcaacagatggttgtacagaagatgaaaaattaagaaatttaggagtgaatacacttttaaccaaaaaggatgtaggcaagcaaggtgctcaattaagaatgggtttttggtgggctctagagcgaggatatgaaggtataattacgattgatggtaataataaagatagtattgaagatatacctaaatttattgaaaaacttgaagaaggttatgattttgtacaaggttctagatttattaaaggtggaaaagctattaacacaccttttatacgacaccttgcagtgctatttctgcatgctccaattatttcattaactgcaagacatagatttactgatactacaaatgcatttagagcgcattctaagaagtatttaactcatgataatgtaaaaccatttagaaatatatttatgacatatgaattacttgcatatttatcaaccagatgtacacaaataggattaaaagcatgtgaagttcctgtaacgcgagaatatccaaaggaaggtaaaactccaactaaaattagtttcttcaaaggtaatagtgatcttttaagaatactattaaaaaatttaaggggagattataatataaaatgatagttaaaataaaaagcaaatttagaaatctaaaatttaataataactttattttaccttcaatagtacttacattagcgatgacattaatatataatcctttaaataatattgctgttaattcatttgatagatcattaggaaatggtttattgaatggtgtggatattactaaaagaattaataatataggattctttaattttatattaataccaattatttttttaattatatactcattaatttctagtttatttgataaaataaacgaagaaaataaaaaatatgtaacatgcattaacaatgtatcagcaatatcattgggatcaataatattttcttacataaataaattttctcaaaaagattattttggagtgggaattaaatttattacatgttttattttgatatgtttagttattttattgattagtcacaagaaaaaaacaatagaatttgatctatttaaatggagcttatttgcggccatacctattactttatttattattgttatatgcaataaattagaagtaaatatttctatgaaaatttttatgatttcgtatggtttaattttaagtagtatattaagaatattaacaataaaatttaattcactaaattttattgctttaaaaaaatcatatactttaattattagtatacctataattgttagtgtttgcttggagttagttaacatattaaatcaacattcaatatttattaattcaaaagctgaaatgactataataatatatatattaattggtgttttatcatgtatatactatttgcgaataatacgaaacagtaatgatgatgtgaaggaatattgcttcgaaaagtattattatccattaattattgttaccattgtgttaatagcgacgcaaatgccattgcaaaatattattaatacagacttttttgaacaatctaatcatggaactgccattagtgaattttttaattatggtaagttaccaataatagaaacatttgacgcacatatgttacaaaatgaattaggtagaattctatacggaatattaaataatgattattatggagctatgtttaatgaatatagtttattaccagtattttatttactttattatttcttatttgaaaagttttttaataaagatatatcattgttattattaatattctttcctatagcatcagataatgcctttcaactatttccattatcaccacttgtaatattaagtttattatttgcatataaacataaaacctataaagcatgtattttattttggtgtagtattatactttcatgtttattaaaattagatatgggattcgcacttgctttttcatcaataattgtttggggaatagtatggctttttgaaagagaaaatattttaatcaaacgactatttttgtcttttatgagtgttgttctaggtggcatacttgtatatattggaatatgtttgatgaaaaatatttcaccaatcttaagaataatggaatttttgaagttatgtcaatcaaatataaattggggatatagcagtattggagattcgcaaacaatagcatttacaatatgttattttgtaatacctataataaatatggtattagttttatatttaatatataaaaatatattaaaaagtcatgattatttaaatgataaaattataattgttcttgtatttggaataattagtgttttgaatttttcaagaggaattgtaaggcattctttagtagaaaatactacaattcacgtagtttccactacatcattatttattagcatgattatatttatgtatgcaaaaagacagaaggtattatcatttatagttagtgaagtagtatttatgatattacttggaatgcttacaagtccgaataatatttttccaaaaccaattatagatggagctctatctaaatttttagcatttgagtcatataaaactgtggcggatagaaaagtagatagggttataatatcagatgatatgaaacaagtgtatataccattgaaagaagtactagatgctactttaaataaggatgaaacatatatagatttcacaaatcaaacatttttatatgcattagttggaagagaaaaaccggtgtatattaatcaatcaccaggcttgttgagtggagagtatacacaacagagatttttagaacaagttaaagtaatgaagcataggataccatttgtattgatgcctattgaaaatatgaatttaagtagaacgctagatggaattgaaaattcatatagatattatttgatttcagagtatataagtaataattacaggccattgtttaaaataaagaattttgctatatggtgtagtaaagatcaatatgatgaaaagtataagctaatatatgatttgataaaagcaaatgaaaacaattatttaacaggagaattaacgaaagataacattgataaatttgtaggaataaatgaagaattatcattaaaaaacgatgaattgatcattaagagcactggtactgatcctattttagaaggtctagaaaaaataataaattgtaaggaaatttctaaacaatttccattaataaatatatcgattgaatatgaatcaaataaggaaggattatttgaattattttatacaacagataaagaggaacaatttacacaagataaatctataagtgcagaaaaatccatgagtggtatttttgaagcaactattaattgtatggagaacactaaaattaggttagatattccagaaggtagtactgtaaaaattaagagtattagatttaaaggcattgaaaaacaaaacaattatgattttaaaaatcaaattcaatttgtagattataaatatttgcaattggaacatcatataagtaatctaggcgatattccttatatttgggcgaatcatgataagattagaattgaagataaagaagaacaattaacgattgataatgcatattctaaaattgatttttctaaattaaacaagcaacaagggaattatttatatataaatggaagttcctctggtgatggaacaatgactgtacatttaggaaacgagtctgaaaatggatttgttgaagtttcacaatttaaattttctttaaaggcaggagaagatcaaaaatatctaattagagtaagtagtgattttatgtggtatagtaatcaaattaattcaataaaaattacatcggataataatacaacggttaataaggtttcaatattaaagggggatacacttaaatgagttatgataaaataataattggtgcaggtctatatggtttatattctgcattattttgtgcaaaacgtggagaaaaagttttagtgcttgagtatgataatgctccatttaaaagagctacatatataaatcaagctcgtgtgcatatgggatatcattatccgcgttcatattcaacagctataaaatctgcacattattttgaaagatttatgaaagattattcattttgtgtgttaacggaatttgataaaatatatgcaacttcagcaaatttttcatggacaaatgcagaacaatttatgaagttttgtaaagcagctaatattcgttgtgatgatgtaaagccttcaatattctttaaagaaggaatgtgtgatggtgcatttttaactactgaatatacatatgatgctaatatattaaaagaatattttttgaaggaattagaaaaatacccaaatgtagaaattaaatatgaagtaaaaataagccatataaataaaaatgaaaccaactttgagataatattagaaaatgaggaacgatattttactgactttttacttaatgctacttatgcttcgtgcaatcagattcttgataaattaggatatgagccatttaaaataaaatatgaattatgtgaaattattctatgtaaggtatctgataaattaaaaaatgtagggattacggttatggatggacccttcttttcaattatgccttttggaaaaactggttatcattcattaacgtcggttacttttacaccacatatgacaagctttgaaagtctaccaacttttgaatgtcaaaaaagaagtaatggtttttgttctccacaacagcttggtaactgtaacgattgcccagcaaaacctgaaagtgcatgggcatatatgtcaaacatggctagaaaatatttaaaagatgaatatgaatttgaatatgcaggttcattattttctatgaagcctattttaaaggcttctgaaattgatgattctagacctacagttattaagcaatattggcgtaagcctacgtttgtaagtgtactttctgggaaaataaatacagtttatgatttagatgaggtgcttttaaatggtaacaaataaagaaaaaaattttatttcagcagtaatatatgttcataataatgaagatgaaatacaagaaaccatacataaaataaatgatgtattgagaataaactttgaaaaatatgaaattatttgtgtgaatgattattctacagataaaagtgttgatgcaataaaggaatttggaactaacattgaaggagcagttgttagtatacttaatatgagttattaccaaggacttgaactttcaatgggagctggtgtagatttagcaataggagattttgtgtttgaatttgattcaacatatatggattataatgtaagtactattatggaggtatattataagtcactacaaggatttgacatagtaagcgctgttcctaaaaagaaaatgagaaaatcatcagaatttttttataatctttttaatggatattcaaataatcccaataaattagaaacagaaacatttagaatactttcaagaagagcaattaatagagttcattctatgaataaaacaattccttatagaaaagctatttatgctaattcaggattaaacatgaacaatcttttatatgaatgtacaaaaaagactaatccaaatagagaagataatgcaactagaaagaatatagcagtagaatcacttatattatttacagacatagcatataaaattgctatattcatgacttttttaatgatgataggaatattagcagttggaatatatactgtagtagtatttatgaaggaacaaccagtagcaggatggacaacaaccatgttatttttatcagttgcatttttaggtgtgtttgcaattatggctgttataattaaatatttatctataattgtcgatttaacatttaaaaaacagaaatatatgatagaatcaattgaaaagataacaagataggagaatatgatgatagagtcactaaagaaaaataaaaaaggaatactattaatgttattgtcatctatctgtgtttgtattggtcagctgctttggaaattatctaatacaaatggaataatgttattgatattaggatttgcactttatggactaggtgcattaataatgatagttgcttataaatttggaagtctttctgtgcttcaaccaatgttaagtttaaattatgtgttaagcataatattagcgacaactatacttgatgaaaaaataacattaatgaaaattattggagttttagtaataatagcaggtgttatattgattggtggtggagatgattaatatgctatattatattttattaattattatgacacttatgggagctattgcatcgctttttttaaaaaaggcttctgggtttaaatcattaaagcaattagtttttaacataaatttatatttgggtggaatattatatgttctatcagctgtaataaatatatatatattacgttttttagattattcattagttttaccactaacgtctattacatatatttggactatgataatttcgtattgtgtatttaaagaaaaaataactatcaaaaaaatgtttggattaatgttagttataataggggtaatgctgattgcagtattttagttaacaaaggtttagttaggggatagtatttatgaataaaaaaattagaaaagcaataataccagctgcaggacttggtacaagatttttacctgcaactaaagcccaacctaaagaaatgcttccaatagttgataagcctactattcaatatattatagaagaagctgttgcatcaggaatagaagaaatacttattattacaggaagaaataaaaagtgtattgaagatcattttgataagtcagttgaacttgaaatggaacttgaaaagcataataaaactgagttattagagttagtaagaaatatttcggatatggttgatatacattatataagacaaaaagaacccaaaggattaggtcatgccataagatgtgctaagacttttgttagaaatgaaccatttgctattcttttaggtgatgatgttgtttataatccagaaaagccatgtttaaagcaacttattgaatgttatgatgaatataaaacatctattttaggagttcaaacagtacccaaggaagatgtatgtaagtatggaatggttgaggggatatctgtggaagatagggtatgtaaagttaaaggcttagttgaaaagccatcagttgaaaatgctacatctaatacagcaattcttggtagatatatagttactccaagaatatttgatatactggataatacaaaacctggtaaaggaaatgaaattcagcttacagatgcattacttgagcttgttaaagaagaagcaatgtatgcttataattttgaaggtagaagatatgatgttggggataagttaggatttttacaagcaactgttgaatatgctttaagaaaacctgaacttaaagatgagttcattaaatatttagaatatatactcaaaaataaaaatatttaataagaaaaagtaaagtcatataaaactaaaacctcgctatagttagtaaatttatagtgaggttttacttataataaatatttaattagtattttgtgacgaatttattttattttttacatatacataaaaactaataatgatatactagtgttataatttaaataaggatatttagaaaggtgaaataatggatttgaaagaggcagaaaaagaaacgatatggacttggataaaaaaatgtttaaaatcgaacaaatatactcatttactttgcaaagcgctaaaatgtttaaaaaataacggaataaaatttactattaaaaaaataaaacaaaagtttaatagtacaagtgtatataaagattatatacaaaataattttttaactgaagaagaaagaaaaatacaaactaatattaagtttgataaaaatattaaattcagtatcttagtaccaatatataatacaccaaaaaaatacttatgtgaaatgatagattcatgtatcaatcaaacatattcaaattgggaattatgtcttgcagatggtagtgataaagaacatagttatgttggcaatataattaataattatgctaaaaatgatacaagaataaaatataaagtacttaagaataatggtgggatatcagaaaatacaaatgaatgtattaaaatgtcttgtggagattatatagggctatttgatcatgatgatttactacatccatcagctttatttgagtatatgaaagtaattcaaaaagaaaatgcagatttaatatatagcgatgaagctgtatttgaaaaaaatctaaaggatataaagacaattcattttaaacctgattttgcaatagatactttaagaacatacaattatatatgccattttacagtattcaaaaagagtttattagataaggttggtatgtttagaaaagaatttgatggagcacaggatcatgatatgatatttagattgactgaacattctgaaaatataatacatatacctaaagtattgtattattggagaagtcatccacaatcaacttcacaagatataaattcaaaatcatatgcaattgataatggaattaaggccgtaaatggacatttaaagagatgtaatattaatggatttgctaaaagctctgaagaatttccaacaatatatagattaacatatgaaattaaagataatcaaatgatatctattataatacctaataaagataatattaaagtattagatacctgtattaattctataatgaagaaatcaacatataataattttgaaattgttatcgttgaaaataatagtacagaaaaagaaacttttgattactatgataaattagagaaatatgaaaatataagagttattaaatatgaaactgatggagaatttaattattcggcaataaataactatggcgttaaatatgcaaatggagaacatttgttatttttaaataatgatattgaagttataagtgaaaattggttgcaagaaatgttgatgtattcacaaagaaaagatattggagcagttggagctaagctttattatgaaaatgaaactatacaacatgcaggtgtcattataggaattggtggctttgcaggacattctcatagacatgttgataggagatctggtggatatttctcaagatgcaagattcaacagaacctatcagcagttacagcagcatgcttaatgatgaggaaaaatgtgtttgaagaaatcaatggatttgatgaaagctttaaagttgcattaaatgatgttgacttatgtatgagaatacgtaaagtaggttatttaattgcttggactccctatgcagaactatatcattatgaatcaatatcaagaggatatgaagatacaccagaaaaacaaaagagatttgaaggagaagtaaagaaatttcaagatagatggaagaaagaattggaaaaaggggatccttactataatcctaatctaactttaggagcagaagattttagtctaaagttaaattgaaaaaattaattgatagaaaatcttttgattttagaaggggtaaatttaataatgaaaaagaaagaattttatattactgcaatttttatactgttgattatatttaatgcatatgtgtctaacgaaggattaatattgaatgaaaaatttataataagaagtatattaatattgttaatatatacattaagtatgattttttctataaaaggatggaataatgggtggaatttaatttttaaacataggtacaagattgcaataagtttatttattttatgcataatattagaattaaatggatcatcaatagcaatgtgggctcaatatattcaggggccagatagcataggaacaggaactattttaggtgtaccaagagcaattagaagtgatgaatgggctcttaatacacctatggcattatcacaatattataatttgtctggaagttttccttattttagtgatactttaagaggcacatctactgatgtatttttggtttatggtcaaccagtatatgatatagcggtaatttttagaccatttcactggggatacttattcttaagtcaaggtaaaggattatcatttttttggtatggtagattaattgcattgtttattgtaacatttgaatttgggagacttattacaaaaaataataaaaagcttgcttttgttttaagtatgcttatttcttttgcacctatagttcaatggtggtttgcgattaatggattgatagagatgcttatatttggtcaacttgcaatacttatgatatataaatatattaacagtgaggattatattaaacgaagcatatatatggctattatagttatatgtgctggaggatatatactaactttttatccatcatggcagattccattattttatgtattctttagtttatttatttggattattttggagagaaataaaaaaataaaattttcatataaagatgcaataataatatgtgtaggattattattatttagtttaataatggggcatatagttataaaatcacatgatacaattagttctattttaaatactgcatatccaggtagtagagctgaaactggtggcggagaaataaaaagtttttttaactatacatttaatatgttcttaccatatagaagtagtggaattccaggtaatgtatgtgaacaatctgcatttatggattttttcccaattggaattattcttggatgtattgttctattttttgaaaagaaaaaggataaattgcttatttgtttatttacagttaatgtaatattatctttgtggtgtattgtaccatggccgagcatattggctaaaataacattactaagtaattcgcaaccatctagagcatttttagcagtggggtttgttaatgtattagttcttattagggcaatgtctttaagagaaaaaaaaataaatgagaataagtcagttttgtttgcaagtatattagcaattattatcgcattaattagcaatttgttatatagcgaatatataacaaaaaagatgtttttaattattataatattcttatttgctatttttatatcagtacttatgtatccccataagaaatataaaaattcgtttattattatatgtataattttaatgattatatgtggagcaactgtaaatccagttcaaaaaggtataaatgtcatttatgataatccgcttatacagaatattaaattaataaatgataataaagtaggcaaatggattgtagatggacttcaataccctgtgataaattatcctataatggcaggtgcacctacaattaattcaacaaatgtttatccaatacttgaaagatggaataaattaaatgataatcaaaatgaagatatatataatagatatgctcatataaatattaatttgcaaaatgttggtagtagtgagtttgtaccaggagtagcaccagatacatttacagttaatttaaatataagtgatttagaaagtttagatgttaaatacatattgactcaagataatattgaaagcatgtcagataataaaattaaatttaaaaaattatatgacgattatggatataagatttatgaaattggtaaagatagttaaattaaaggagtaaatattattatgaataaaatagcagttttaataccatgctataatgagagtaaaacaattgaaaaggtaataaaagattatcaaaaggtattacctgaagcggatatatatgtatatgataataattcaagcgataaaacagctgaaatagcagcgagagcaggagctattgttagatatgaatatagacaaggaaaaggtaatgtaataagaagtatgtttagagatatagattcagattgttatataatgattgatggggatgatacatatccagctgaacatgctaaagaaatagtagacttggtattaaataagggagtagatatggttattggagatagactatcttctacatattttgaagaaaataagagaccatttcataatttaggtaataaagttgtaaggttcttaataaataaattatttaaaagtaatgtgagagatataatgactggatatagaggatttagcaaacaatttgttaaatcattcccagtactgtcaaaggggtttgagatagagacagaaatgacaatacattcacttgataaaaattttttattagaagaaataccagttcaatatagagatagaccggagggaagtgtatctaaattaaataccttcagtgatggatttaaagtattacatacaattgcaacattatttaaagaatataaaccatttatatttttttcaacaatatcaatatctttatgtttattatcattagtattctttattcctgtttttatagaatatttaaatacaggattagttttaagatttccaactttaatagtatgtggctttattgctataatagcacttttaatgtggactagtggaataattttagaagttattgctaagaaacataagcaaaactttgaaattttattaaatataatgaatgaaaaagaaaaagatattgaggtgtaaatatgaaacaattattaaaccagattataaaatttggtatagttggtggtgtagcatttcttgttgattattttgctttatatgttttagtagagtatttacatatatcttatttaatagcctcaggtatttcatttacagtagctgttatatttaattatatagcaagcatgaaatatgtttttgagagaagaaataatataagtttaaaaaaagagtttatagtgtttgtaattttaagcatagtaggattaataataaatcaaataataatgtggatttctgtagataaattaaatattttttatatgttttcaaagatatttgcaacttttattgttatgggttggaattttattagtaggaaaatatttttagaaaagaaataatacaataaaagcattacataatgaaaatgtatcccaatatggaatagttgatggaattgaaatttaaggaagagtatgcaagattaaaggattggttgaaaaaccaaatgtagaggaagcaccttcaaatacagctatattaggaagatatatagtaactccaaaaatatttgacatattagataatattaaaccaggtaagggcaatgaaattcaacttactgatgcattacttcaattagtgaatgaggaagcaatgtatgcttataactttgaaggtagaagttatgatgtaggagataagcttggctatcttgaagctacagttgaatttgaacttagagatgaatttataacatatttaaaagggagtatttagctagtccctcacaagctggtgactaatttctgagatgactataaattcctagcgacaagctttatgcaaaagcataaggtttgtcgctgtttttgtttataatgaaataaaagtgggatataattaaagaatagagttaattaagtgtatttaagaaagtgaggaatttatgataaaaaacaatgtaatagagttattgtaaaaaagcagttcatattatgaaagggtatcagttatgaaaatatcaataatctgcccaatatataatgggcaggattacatagaaaaactacataataatatattaatgcagaaactagaaagtgaacaaacattgcagatattatatgcattgacacgaggcagagataggagtcaggaaatccttgaaggacttaaagattcaagatgcgactatacgttaattgaaccaaaggacttttctcatagcacaacaagggaaatgatgtctaaaaaagcaaaaggggaaataatcgtgtttatttcccaggacataaagataaaaaatgacttgtggctgaagaatcttgtaaatccaataataaaaggtgaatgtgaagcaagttttagcagacagattggtgaagatgacaatatagagaagtacacaagggaaagaaactatccagcagaatcaagaactgtttctaaaaatgagatagataaatatcaaattagaacattcttttattcagatgcatcatcagcagtgttaactaaagtatatagagagcttaatgcttatgatggaaagagaatgcctacaaatgaagatatgtattttgctcataagttaattaatgcaggatatagaattaaatattgtgcagattctgaggtttatcattctcatgattttacatatagacagctatataaacgctactatgatacaggaatattttttaagcagaataaatatttcaaggattataaaagcaatgaaagtggtgtagatttagctaaatatgtttttaaaagatcaattgaagagaaaaatttcaaggtagcaattagtgtgttacctaattttgcagtaagatttatagctaaacttattggtgaacactaaataagtatttcagcagcaaattttgagtttgctgctgttttttgtcaatacttaatattgtcgaatattcttaaggctactatttgtatattattgtattcaataatatacaaaccattagtaccataatatactttattggtatctctatagtcatttatttcttctttaacgttttttatagaaattacttaaagtccattcatattttttatctatattattaaggtttagtgaagcatatagctttacaggaattgattctccgtttactgtaatagtagcttcatattgtttatcgaatattttgctatattctgtttcttcccctagagttaacgtgtctgccatagctactgtaataggggtgttgtctattttttcttttagtagttttgtttttatgtcttctatatttaagctagtaacttcaaccgaatctataactatatcatttttatttctagaattatttactagagatagttcagcgtatactacacctgaaaagttaattttatttattgcaccactagatgcttcaccttgaatttcagctcttatagtatttttttcgtattccataaaattgtttatagttaagttcgtaatattttcttttgtaaatgttaggtatgtgctatagtcatgattattaaaagtatacttatatgggtaactactgcttatatctaattgctctaatataaacttctttttgtcttcatcacttaatgtacttgaaatagactcattttctacaacttcagatggaatataactagtatttaaactccatttattttcattaaagttatagtatattggaaattttattgataccttagagttaattactccgtttgaaagtgataaaattgcagaagcatttttagaagaagcattatcattttcttcaattttaatatctgaaatctctttcaaaataccactacttaagtttaatgatctattcttatatgaaattgaggtatccttaagtaaatctggtacagctttttctaaatcaactgttggttcaatactttttatgccttgtgaatatatgctagattcttcccagttttttgtgtttctattataaaacaattgtaattcaaaatttgaaactactttggcattatctaaatttattgtgatttctccagtaatactgtcactttgtttttttactgactttcttgaaattacttctaaattttctaaattagaatctgtaatttcaatattacaatcttcaaaatagaatgattgccctactacgaattgttttaagtcattatcattaacaggctttccttgcatataggaaaatataccaagtccaccaagtaaaagtactaaaataattgatgaaatcatgacagttaatttattatttataatgaaatttttaaattttcctaagtatacaggcaaattttcttttaaagaagtactgcattcaccaattttattatttatatcttcataaaccttttcgttattaactgtatgatttacttcagtattttctaaggtctcattaagtaattgttcaccacaatatgtacaatagatacagttatctaatatttctcttttacaattagtacatttcatttatattcacctcctaataaaataaattattcattctagtttctaaaactgacattataataaaatagtttataccagaaaataaaactgaattaataatgtaagttagtgaaatagtgtacattagtttgctttttttgccacatataatttctgaaaatccttcatatgttaatattattaggactacaacttgtaccataaaagttattacagataatataatactgaataatgagaataaacaacctataagcattatagagactggtaaaatatttgagtatgtacaaactgataggtattctttgtaatttaaattgtttttaaaaataaacttaccaacaagaaatataatacctgagaataccattggtattgctaaaaaattaaatgtaaataagataaacattcttaaaactaattgagatattatatcgtccattcctatataactaaagatacttcccataccgaaacttctatataaatcatttactaaagttttagaacatataataaaaactagtgaaataatgcaagataatataagattaataataagtgactgttttatttctaatttattatttataagtcttccattaaatggagctttaaatatttctaatatattcataattattatcccctcctaaaagattgatcttaaagcatttcttaatagtatttttaagacaacaaaaactacaagagtagttccagaaattgaacttaaaaatgttaataatgctattttgatattcgtatttaaaaaatcttttagtccttgatacattagtaataatgtaacaaaacttatgaaaattgaaatgataaaaaagaaaataggtgctaagatatatcctaataatgcaccgattaaatttaaaattgaagaaattaattgaattcctaaaattaaatttataaatgaaaaatagcttatatttttctttaagatacctttagatatacaaaatataaaaaaggattctatggcaactattataaaagttgcaaaaatagcgtttagtggagaagcatctaatctaagttctctaccgaagcctttaattaccatggcttcaattaaaataattataagtgccatagaagaagtaaagattggatttacaagtttagtactcctaataaatgctacaggattaataaacatgtacttgaattgtgtaagtagtcttgtgaaaattgaatctgtgtctttaaaattaataaagccacaattgctacagaaattatcttcataagaaatatctgtattacaatatttgcatgtattcataatttaccccctaaaatataaaaaaattacagtcagcttatatggtatcatgaattctaaaaacatgtaaaggcagaaatgttatttttgttttaagaagattaaatattgtctataatataactaaggaaaatatgtatggtgataaagataaataaaagatatgagaaaaggttaagatcaagtgctaatagcttgatcttaaccttttctatgatgtactctataaggtggacattttaggaaaaagggattacttgatttttcataccaagtattacaatggcaacattactcttagtgtaaagatattttcctcagtttcaaatgttgcaaagcctttttgcttttcagcaatcattacaatagaacgacaaccaaagccgtgattatcttggatggaagctggtattccatcttttttttgaatttcgcctaaatatgaatttttgatcataattaaaagcttatttttattgataaagcagtttaagtgaacagtacgtaaagatgtatcatctatcttacttacggcagtaatagcattttcaagaccattggataatatggaacaaaactctgtatcaggaatatctaactttttaggaagttttattttagttattagagttacatttgctttttttgctttattgtcaaaaaaagaaagtacaatatttactatatcattttcacagaatataatcggtgtaatgttatctaaatctttttttgtttgtaaaagataatctttaactttatctatattaccactctctgcaaagccatatagtaatgataaatgatgacgtaaatcatgacggtagatacgggacatttcttgagatgttttaacattttgaatatcatttgatgtcttagctagttgcatagaaagtattgtattataaagttcaattttatttcttttctgtacttcattatgatacataacaataaatagtatataaaacattgccatagctgctggaagtgattcagcaattatagtaacaccatcatacaacatattagtatagactgtagtaaaataatcaaatatataatagaataatggcaaacatccaaatagaaaaagagatcttcttgaatatgtcattgcatagtaagcgggaattgtaaaataacgcttaagtataaaataaaaaattataattgatatagtatatacaattaaataagctaatcttacatcaaaaacaaactctgcaatacttcctacccaacgtggaagctgacaatagaagtatgctgttagtacacttactattgcaattgataatttatttttaaaatatatcacaagtatgagtaccaaaggaacatgagaaataaaaggatagattttttgagtgaatgaaagcccgaagataaatccacagaatgtttgtgttaatagaagtaaagtaataacaaaaaatatgaaataacgttgctttttagtgatatattcatttgcaaaatccactgttaacaaaacaccatagattaaaaccaatgcatagttaaaagtcgttaatacttgttccattaatttttctcctcttcacaaaacatttgttttacgtaggtatctcggatttctttataaagtgatcttgatacagggataattttgccttgatgggtgattattttattttgtgtaagctgatcaatttcatataaattgactatataagatctatgaactctcataaattcaggacgtgtacagagtatattctcaaattctgagaggcgagctgttgcaactcgtatactattgtctgacagatgaaaatatacttttttattcataacttccacataagaaagtcgtgaaaataaaattcgatttatactgtttttagtttttatagttaacccctcttgtggttttttaatatccattaatagattgtccaatacggaaaagaaacgatcttccttcaccggttttaaaatataatctgttgcatttacagaataactttctacagcaaattctggagaagaggttaaaaaaatgatttttgcttcaggattaaaatttcgaatttcctttgctacttctacgccattaactaagggcataataacatctaaaagatatagtgtataaatacagttgttttcttttgaaagtagatcaactccgctgttaaaggttgtatatgtaagaaaagcattatgttcttgcttgtatttttctaaaagtaataaaatattcgcaagatcttctttattgtcttcacatattgcaatatgcaaatttttcgacctcctttaccccatgaaaatctaaaataattatatggcaaattttgtgatttttcaaggaagattttacattatacgctgtttagtactacatttcacgctaataagcataactattccttataaactgatactatatttttataattaagtaatgattatgttttataattcatataaaaattttattatagttttgtagtaaattgattttcaatataggaatagtttaagaaaatcatattaattactattatatagggggataagtaataatgataagtaaaaagacaaagaaaatattagccttaagtatgacattaacagtagctggaactgcaatgcctgctatgaatacacaaaatgtagcttttgcagaggaaaactttgttgaagaaggtaaaatagattcagataatataaacaatttacaaggggatgatttagaaaataatgatagtaaaaataccttcaaaagtaagagtattaaaacaactggagagagcgtaagtttaggaagttatggtgaaatacaaaataaagtagttaaaacaactgatgcaggtgtaactttaatgatgttggattcttggacatctctaaatgatttttctaatgtagatgacaagatagttattaatgatattgaattcaaattaaatagtgataagtcaactgttactgtgagtaagcagaccttgaaagaagatacagaccttgatttaccaggaactataacatgtggaggcaaggactatacagtaacaggaataaaatcgagtgttttttactattgtagatatttaactaatgtgaagattccaaaagaaattaaaaatatagaagttcaggtgttttcgggatgtagtaaattaacaagtatagatgttgctaatgattctgcaaattatactagtgaggatggaatattattttcaaaagataagaaaagaattatgtgttatccaagtggaaaagaaggcgaagaatatattattccagaagaagtaacaagcatagataaatatgcattttgggaatgtggtaaattgaccagcataattcttcctcaagatttagaaataataggtaatgaagcattttataattgcaagggaataactaacataaacattccagaaaaagtaacaaacataggctatggaatatttgagtcgtgtagcggattaataagtatagatgtagacagcaattctacaaattatgctagtgagaatgggattctattttcaaaggataagaaaaaaattgtttgttatcctatgggaaaagaagaaaaagaatatattattcctcaagaagtaacaagtataggtaatggagcatttaagggatgtagtaaattaaccagcataatattaccaaaaaatttggaaagtataggtgagggtgcatttcgaggatgtagtgaaataacaagaataaatattccagaaggagtaacaagaatagaaagtatagcatttggagaatgttataatttatcagatataacattaccaaaaaatttagaaagtataggtatgcattcgttttatggatgttatgaattaaaaagtataaacttacctaataaagtgactagaatagatgattacgcattttaccactcaggactaactgaaatgagcattccgaaaggagtaacatacataggtgataatgcatttctggactgtagagatttaaaaactatgagtgttcataaggatttaggtgatagtagtatcaataatattaaggatgatgtaccttgtataattaaatatgaagaagatgctagtaatatgaaaatatcagatattttatttaatagcagtgattctgatgcaaaattaataattccatcaaaaatcgatgataaacaagttgcaagtataggtgataatactttacaaataattaaggataatgcagagaaaactatagttgaaaacaaagatatgcttaaattattagaggatagtaatgcaggtatagatatagataaaataactataaaatctaataaggaagaacttaaaaagttttatgatgattgtgtaaatgctaattataatgaaaataattatatagcagatacttatactgtttataatactgcaatggatgaagcagaaactgtattaaataatagacattctgaacaagcagaaatagatgctgcacttaaaaagcttaaggatgcagtgaatggacttcaattaaaaccagtttcaaataaatatacagtaacatttaacagtaatggaggaagtgaagtaggtccgatagaaaatgtagaagaaggaacaacaataatattaccaacagcaccaacaaaagctggatatacatttgaaggctggtatacagatgcagcatgtagtgaaggaaatgagtttacaattagtacattagtaaatgctgatatgacagtatatgcaaagtggacaaagaaatcatcaagcagcagtagttcatccaaaaaagaaagaccacttttgaaaaatgaagatggaaagatttcaaatatagttctaaataaagatagatattcaaatgaagttattggtacaatcttatctcatattggactttcagtgaataacgttgatagcttatataaaattaatactgatgcttttaaaggaaatctagcaacatttgatcaaattgttgtagaagaagatggaaaagaaacttcattaagctacatttatgttaaatgcgaaaaagcaggaatcagcacactaaaagttgatgtgtattcattaaaagataaatatgatctttatgtttataatacagatgaattagggaacgtaaaattagttaaagtagtatcacaagataaaataaaagataatgataattttatagatattaatgtagaagatggacaaaattatattgtatcagaaataaagcttcaggaaaaaaatgtagctactgaattaacatcagataatggatggaaacaagttcaagaaaaatggacatatattaaagatggaaaaactgcgataggctggattaaggatacagatggaaaatggtataacattgatagcaatggatttatgaaaacaggatggcataaagatagtgacggcaaatggtacagcttaagtcaaaatggagctatgagaactggatggtttagggataataatgaaaaatggtatttattaaataattcaggagcaatggttactggatggatacaaaatggtgataagtggtactacttaaatgatgatggaagcatggcagttgacactactgtaaatggatattatgtaaataaatcaggggaatgggaataaatcatctttctaataaattttacagtggtaaactttgttgagaataataaagcctgccactgtttttgttttaataacttaaaatttgggatataattaatataataaattgttgtttactttagatttattcgaaaggcgaagtgaaaaatggaaaaattaatgataaaagattgccaattaaataatgaatgtttaaaagatgttttatctataggtatatttggaagttatcatgaagaatgttttgataagaatagaagtgatattgacgttatgatccttttgaaaaaagaattagattttgatgaagaatttgaaattgaagattatttagatggcattttaccagaatactttaatcataataatattcattatacttttatacatgattttcattatccatttagtgaacttttactcatgagtgaagataaaataatatttgatgaagaaaagtatttagattatttacttggatattctgcatttaaaagagatagggaaccattggaagttattagaaatgaaaatttaaaggaattggaggctataaagaatggtttattataagtataagaaagagaaattagaatcgaaattttctgaaagtaaggtatttttacttaagataaaagaatgcataaaaagaaatcctgatggaactgatgatattatagatgaagctatgatttcatattttaattctttttgtgaatttataatagatatgtgcgaaacatatcttgtaactacagaaaattatattcctaataaatcagggcctgaaattattgaattatccagcgactttggatttatttctaaagaagattcaaaaaagcttcaaagtatagtgaaaattagaaatagatatactcatgattactatcagagaaaattagcacgtgaaagaattttaaaaatttgtaagacggaattatgctttttaaagatgtttttaaatatatcagaagaaaaaatttatcttgagttaagataagttttagtggcaagttttatgcaataacataaaacttgccactatcttttggttttgatatctttagatttagaatatggtccattaggaacctataggttaaatatatagaattacttaattataattaaatgttgttatagatattagtagagatgttggtgattataaggtttcaactataacttataagttaccaacatttaactttaaaaaagttacaggtatattttaacgtatataagggcctacgtaggtcttatatacttgcgtgttttaataatttaaagttttggatataattaagatattgatatcaaatgaatagtttaagaatcatactagaaatgagggagttagatgtctttatatttagatagattagagcgtaatttatataaattagcggatattaaaacaattaaagatgctgaaatagatttaaataataacaatgtagagatcggaaatataagaagagatgacaatgatgaaaatataatacacatatttggaaagactcaaggagagagatattatattagaagtcatgtagccattaatacaaaaaaatcacagataatttttaatgattgtaactgcaaatatggatattattcagatgagatatgcaaacatgtagctgcaattatacttttatacatatcagaatctagaagagaagaaaaagaggaaaaaatattacatgataatatgggtgttaatcttataaattatgttaaggtttttaatgctcccaaggaaaatgtaaaattagaagtttttattgataaatatgcacaatctgatacatatgatataagttttaaaataggtcaaaacagaatgtatgttttgaaaagtttacaagactttgtttatgcaagattaaataagagtgatttagaatttggaaaaggctttacttattcaccatcaaggcagagattcaataaaagtgatgaagaagtatgtagatatatagaagaattcgtatcagttgcattacgctctaattacagagagtttattgtaaaaggtaaatatatgtacataagtgatatttctctaagaaagtttttggaaatgaatataggtaaagaaataacactaaatgatgagaaatttacagtattaaaagaagatattccaattaaatttaaacttgataaaaacaatgataaatacatattaaagcttgatgataaaaatgttttttctttaactcctagaaatgacgtttatttatttaatggaaaaatatatcttccttcacaaaatcaaattaagataattactccaatattacagtttatcagccaatataatatagtagagtttaaagaggaaaataaagctgacttatttaacaatatagtatcgggaattgagtcatgtggaaatgaagtagttttagataaaaaaatagataatattataagtgaaaagcttaatgttcaatttaagcttgattataaaaagaagaaaatggttctggatgtagatttgaaatatggaaatgaagttgtgaaattttataatcagtcagacataaaagaaaaaataataattcgtgataacaataaagaacaggatatccttaatacattagatgaattaaattttgaatataataataagcagtttgtgtttgaaggaaatgaagaagatttatataatttcatcaaagaagattataagaaattagaaccatttggagatatatattattcagatagattaaaagaaaaaaaggtatatataaatcctaaaataacagcaggaataaataccagcgataatgattatcttgagtttaaatttcaaatagaagatatcaatccggcagagtataaaaacattcttgaagctcttaatgaaaaaagaaaatattataaacttaaggatgacagttttataagtcttgaaaatgaagaattaggtgattttttaagacttgtagacaacatggataataagaataaagatggaaaaataaatattggtagaaataaagcagtagtattaaataattatattaaggataaaaaacttgattttatagaaggcacagatatcatagaagatatttcaaaaaaattatataatttaaagaaaatcaaatttaaagttccgaagaatttaaatgctgaacttagaaaatatcagattacaggctttaattggtttaataatttaagctatcttggatttggtggaattttagctgatgaaatgggacttggtaaaacaattcagacaatagcttttttattatctgaaaagaataaaactacattaattgttgcgccaacatctcttatttataactggaaaaatgaattttataaatttgcaccttcaatgaaaattggaattgttcatgggttgaaagatgagagaagtgaggttttaaaaaactttaagaattatgatgttatacttacaacttatggaacccttagaaacgatgaagaagaatataaatcaataaaatttgattattgtattttagatgaaggtcagaatataaagaatccagttgcacaaaatacaacaagtgttaaaaatataaatgctgaaaatagatttgttcttacaggaacaccaatagaaaataatcttattgaactttggagcatattcgatttcttaatgccaggatatttagacagtgtaaatactttcaaaaataaatttgtaaataaaaatgattcggttatagaattacaaaaatacataaaaccatttatgcttagaagattgaaaaaagatgttataaaagaacttccagaaaaaatagagaaaaatcattatgtggagcttgctaaagaacaaaagaaattatatgtttcatacgtgaatgagattaaagaaaagatggaatcagaagaatttaaggatgataagataactatattttcttatctaactaaacttagacagctatgtcttgatccatcggtaatttatgataattataaaggaaaaaactcaaagagtgatgaattgatttctattttgcatgattatatagaagataatcacaagattcttgtattttcacagtttacatcagtacttaaaaatatttcaaataaattggatgaagaaaaaattaatcatatgtatcttgatggttctgtaaatgcttcaaaaagattagagcttgtgcaggaatttaatgaaaataaagatataaaagtatttcttatttcattaaaagcagggggaacaggattaaaccttacaagtgcggatatagtagtacattttgatccatggtggaatccagctgtggaagaacaggcaaccgatagagctcatagaataggtcagaaaaatattgttcaggttataaaacttatatcagaaggaactatagaagataagattataaatatgcaggaagaaaaaaagaagcttattaatgatgttatcgatagcagctatacttctgaaaatgtacttaaatctctatcaagtgatgaacttaagtcattgtttgagtaagagtagtgctatattggatatacggagaatattattttttataaggttatcctggtatttctttatgttttaataggattaagtataggttataattaaattaggcaggttaaaatttatatatttaatatgaggacgaaaataaaatattagttataattaagttaaaacagttatgaaaggattgttaagatgggagtagattttaaacaacatttccttgaaaaggaagaatggattgatactataaagtttatgtcgccgagaccatgttataatcacatagagatacaaggggaaatatatttacagtttagacagtattttaaaaagaaatgtaatgtgtctattgaagcagctttatttttaacaaaagaagaaccagaaactataaaaagtgataaaaataaaatagacttattagttaagtctaaaaaggcagaagtagctcctgatgttgcagtttattgtgataagaatcaaattttttatagaggatatataggtataccacagttggttgttgaagtattaagtccatctaattctgacgatgatttaattataaaaaaggatttatatgaaagttatggtgttcctgaatattggattgtatcaccaatgagcaaaaaggtatggatctattcattagttgatgataagtatgaattaaaacatagctgcactttaaatgataaatttaagtccataagattttcagatttagaagtagatttatctgatgttgaattaatagatgagaacgaataatattcaggagtatccataggtgtagaaatttattgaaaatacttaattataattaaatgttggtaaatatattattgattattatagtaataactataacttgtatatcaccaacatttaactttaaaaaggttataggtacatttatacctatagttataccagtatttatatctatatatagtggtaagttttatgcaaaagaataaaacttgccactattttttataactcaaaatctaatcaagcacttttctcagaagaatcacttttattatcagtatcaacaacaactccaagcttagcagaaattatagtgttgagtttatttatagaagttgataatgaactaagctgtttttctaaacgaattaaaagatatgcgcttacagcaactggaaatccattatttacaataagattcattaactcattaatttccatgtaactcacctccataaaaaataggttgtaacagttcataaagttttcttaatgcagtactttttctttttatagcagctgaatatgatatattttttaaaactgagaactcttttagtgtgtgtttagaagaagtttttggaaaaaataagaagattattatttcatgttcagtatgtgtaagtttatttaatgcatttctaatttcagcataatcacattttctacacattaaatcttctgcattaatttcatttgagatcaggcttctttgaaattcatctgttattataaggcagtcatttccatcaaatatttttctgttttgatttttacgtatcaagtcatatagattattctttattccatttgtggcataggcaacaaatctatgattttctaagttatatgatgacacacatttaaagagactttggaagcattcattttgcaaatcataaaaatcatatccgtggatgaaagtcttgctgcataaattttttatataaggggtaaattcctttgctaaattttctttagatatttcattaccatcttttgattgtttgactaatgtttcaatgtatttataatccataaacttatggcccctcccttaaggaaagaaggtaccatttttaaattgatattatatattgtaattggaatttttaaaagttaatttgaacatatcttacaattttgatagctgttaacttaaatatacgtttgataaattaaaagtgacatatcaatataaaaaaaataaaatatttaagtattatttacatctgcagcaaatttaaataatagtcacctatatgaattccatgaccatggatatttttccaatacttaatgatttctaaaagtcgttcttctgagatgtttagatgttctgagaattcatgaatgttgcgggcacctttactgagtggttttaaaagatcatcaggatgtaaaagtatattatgtccttcacgtcttgctataatttctaattttagattttttatattagtaagatctgttatgtttccatatgttttgcgatgatggcctagctcttcaacaataagttctatttttaaactttcaggaatatttctatttattcctatatgaccatcaacatatttggcataaggtataccaggttcaacatcaagctcataaacctttataccttctctctctaaatatataatcagtttttcatatttagataaattatattctttatgaaagtaattcattgatttattccatcctttcttgttgaagttaggcatatttctaaaaattatttcttattcttatcatttaatattgcttgtaaaaatacagcatcaatttctttttccttatcaggatcaattccatcattgtgtgcagctactgttgtaaacatttcttctaatttggctggctgagaagatgaagtatatgtattagtttctgattcattattaagttcagtattatgtttagcttgattagttatctcaatagattggtcacaagtctgtacatatttatctattgaaagaatatcaaagatatattctaggattttttttcttcctatttcgtttaattttagaaaagcattatgtaaatctactatatcaccatcagtttcattttttctatcttgtgatagtagataatcttcatcccatcccataagcttataaggttcaatttcaagtcctttagctaattcttcaaatctatctattggaattctgtttattgctcctgtttcatatctttgaagagtagagcttccaaaaccagttcttttagataaatcttcatacgataaatttaattcttcacgtcttttttttattcttgcgactatttctctcattttcttgttatcgttcataaaaaaatcctccatagatatattataaaaacgaataaatgtaaatgcaatataaatgtaaaaaatatagataatttacaaaataaggttgaaaatattattctgggatgatattataaaaatatcccagaaatgattaaagatatttttgtatagaggtggtgaaatatttgattaatgaaataaaagttggtaaaaataatctgcttgtgagagaagttgcaaaattagcttcaagatatggagtgattataggagaaaaaaggttatggaatattttaagggaatggggacttatatttaagaactcaacagaaccaaaacaatgtggaattgacagaggatactttattgttattgaaggtttcgcacaaaatggtcaatatagatttcctttttatacaacgagagttacaccaaagggacaagaatatattataaatcgaataaggttaatggacagtgaagaatttataattgaagattagaataataaaatttgaaagaatggttaagtttttagattgattatattgtagtgattatattgtagttgttagctgtaaactatatagatttggggatgatgtttatgaatgttatattgatttatgcacgtattaaagacaagctaaccaaagaagatgcatatgaattaaacaagctatatatgagtggattaacttataaagaagcaatggataagttaaaagaaataaaaaataaaacgttttctaaataatgataaaggggggatttttatggctgaaagaagaatgctttcacgtacaatattggattcagataaatttttagatatgccgcttacaactcaggcactatatatacatcttattatgaatgcagatgatgatggatttttaaataattcgcaaaagataacaagaatgataggagcaggaaaaaaagactttgaacttttaatttcagcagagtttattatagattttaataatggaatttgtgcagttaagcattggaaactccataattatataagatcggatagatacaagcctactgtttatcaagatgaattgagcagacttgttattgcttccaataaagtatatgaagaaagtaaaacctacggaaaaacaaaagtctatgaagcagatactaatgaaaagttaagctatagcaatagtgatgatattataccaaaagcagaaataaaaggtgatgataaatcgctaagagataacaatattgaagatattataggcaaggataaccaacaggatatatttttagaatcacaaactgatgcagatgaagaatcatataaaggtgatggaaattatgagttttcagaacaaaaagtagatggtataccaagtggcgaccatatggaaacccagaataggttagatgagattagtgtagataaggatagtatagagaaagtaatggaaaagtggaacttactaggtatttcaaatatatcatgcataaaaaatacaagacagaagctattaaaagcaagaattaaagaacatggtacagataatgtgatcaatgccataggtaatattgaaaaatcaagttttttaaaaggtcaaaatgacaggggatgggtaataacctttgactggtttgttaagcctaataatttcattaaggttcttgaagggaattatgatgataacaatggttctagtggcgagaattttataaggggcagttcaagttcaaagaaactatcttttaataactttccacaaaggcaatataattatgatgaacttgaaaagaagttgcttggatggaattgattatacgttgaaaaaggaaccaccaaaaggcagttccttttcatttatatcttattctgcatcaaaagttgtgatttttctttgagtaagcttggcttcaactttgcttatataagcaccgttctttgtttcaaagatatcattagaaatgatattatccataagagcattagcttgctcagaagtaacatcttccttaacaccagagatagtaagagaatttttcttaccagtttcagtcataaaagttaaagttaaaatatattccatattaaattcctccttaaaatagctcgtgtaatttttggtacacggatttagtttgattattttatttaagagcaatattattgttttagacagattaaaacgtctgcctaaaattagaagggttagttaaaatattatgcctgaattaactgatcacttacagtcatataaacatttctagtctcatcagacaaaactgatttaactgcatttgcaacagcaagtaccttttcaggatctgcaccatcttttacattagaaaaagattttttactgtaagttgggttgccaagtgagtctgtaccctttcttacctcaattgaaaaacttgcactttcagcgattttgtttactgccatatagcattacctcctaaaatctatattttattcacactcttgcatctgcatggtgtttacataatagatatatggatgacattaaaaaagtgcaccttgaagagatatattatttttgttttttataagtttatagatttataagtttataaatttaatttatttaaggtggatttaaggttaataatgttttcatataagattgagatattaatatacagacatggacattacgataaaagatttttggaggagaaaaatgataaattgggaatttaaaaagttaattaagtctaaaagtatgattatttcattattaatcttaatttttacacttttaattacagtatttattaagccaacattagaaacagaaaattcatatatagacgatcaaaaaggatatatacaagacactagagatgaaaatgaaatagctaatgaaaaatttaatattaagctatcagttttgacagatttaagtaatgaagaaaatgatgaaagtgaattttcatcacaaatcgcttctatgtcaaaagaaaaaataaacaatttaaaaagttcaaaatatgaagaagtgagattttggcaagtgtttaattatagagctgctaatccacttataaatatagctatgcttgttattataatgatcattatatctaatctgtacacagatgaaattatatcttctgtaaaagatataatactttcatccaaagaaaagaaaaaggtattaaattcaaagataataatagcatttttgattcctatattgatttacagtatttatttagtggggatttttatcctaacatatattcaacaaggagctcctgttaatgggcatttagaagcttttagaatcgtagataatataacattattgaatggaaatcctaatataagttcatatattttaaataatattatactagcacttttaatgtttgaaggttttgctatgtcagctatgttcttttcatttattagcatatcatctataagttcaataagtatgtttggaatatttattgtatttaataaagtgatttcaactttgaaatttatccctggagtattcttatcagtactttcatatggaaactactatgatttaatatttaatttcaataatttaatgggcagctacatgggacatattaatttatttgaaaatcaatttggacttataagtatagtaaaagttatgttgttattaacatttatcatttcaacaatattgtgctttatagtgagcaagacaaagtatattaatagataattggaggcagaaaatatgaataaactagaaattaaaaatcttacaaaaatatatggtaagaaaagagcaaacgatggaattacagttactttagaaaatggtgtttatggattattaggacctaatggagcagggaaaacaactttaatgaaacaaataactactcttataaaacctgataaaggagaaattttatataatgggaaagatatcttcaacatggatgataagtatagaaatattataggatatcttccacaagaattcggagtatataaaaattttacagcaaaacaatttttgcagtatgttggtgcactaaaaggaatgagtgagaaaaatttaaattctaaggttaatgaattactagagcttgtaggactttatgatgttagaaataaatccataggaaagttttcagggggaatgaaaagaagagttggtattgcacaagttttattaaatgatccgaaaataatagttttagacgagccaacagcaggattagatcctcaagaaagaactagatttagaaatttaatagctaaaatatcaagagataagataataatactttcaactcatataatctcagatatagagtcagttgcaaaagaaactataatgattaaagaaggtaaattactcatgaaaggaactcatagagaaatattatctgatatgaataacaaagtttataatataagggttaataatgaagaagagattaatagaattcaagaaaaatataaagtaataagtattcaaagtgatgttgattcaactatattaagagtagtttcagatacaatgccaaaggaattaaatgtggaatctacatcagcaagatttgaagatgtatatatgttttattttgatttagaaaatgcaaaagaggtgtaactaatatgataaatttagtaaaagcagaattgagaaaaatattatgtaaaaaaagtattttagtgctttgggctttaattttaggttttggtttcattttaattagagattttgaaatgttagaaacatatgctgatatattttataaaattgaaggatctcttcctcttataggattagtaagctttataacaatatcaggtaattacacaagagaatatgaatcaaatatggttggattaataaatacaactaaaaacggaaaaaaatatataacaatagctaaagctgttgcagctggaatatcgattgcattaattaatgtatcatttgctttattagtgggaataaagggatttatgtttgaaaactttaaaggtttagatattccaataaagaatttatggtactttggaaatagtggatcagaaattacagtattacaaatgtatctaataatgttagcttcaataattttaggttcatttttattagcacagataggattaactttatcatccgcatttaaatcagcagctattccatttattttgggaggcatgataatggcaattccatttttagctcaaggctgggtgtcaaaatcaatgcttaatcttatagcattagctcctaactggcttatgatgagtcaattaatggttagatatcaaattccaattttatatagaggattatctgtagtaatatctatagttttaataatcttgttacctttaattgcatataagaattttacaaatagcaaaaggttatagttaggtatttttctaatatgctttaaaaagtatttttataatatctactattaatgtaaaatctaaatatgaaaatgcaaaggaataaatgaaagagggatgaacattgtgaataataaaatactaatagtagatgatgaatatgaaattttaaaattattagaaactgtgcttagaaaagaggggtttaccaatatatatactgctcagacttctaagtcaggtttagaagaatttaaaagaataaaaccagatttagttttactagatgtaatgcttccagatggtgatggatatgaaatatgtaagcatataagaaatacttcgatggttccaatattatttttatcagctaaaacagaagagcttgataaaatattaggatttgctattggtggagatgattatataacaaaaccatttagtcctaaagaagttgcctttagaattaaagctcatttaagaagagtcagttatagcaatgaaggttcaaatgatttaaatgttagtgaagaaaaaataataaaatttggttcttgtattttaaatgaaagtagagctgaactcattaaaaatggtgaagtaatagagttaacagctaaggaacttaaaatattatctttactagcacacaatcaaaatcaaataataagtaaagaaaccttatgggataaagtatggggagaagattactttggatttgataacacaataatggttcacataagaaaattacgtgaaaaaattgaggatgatgcatctaatcctaaatacattattacagttagaggacttggatataaattgtctgtaaaggaagattaaaatgaaaacgaaatggaaggtaactgggaactttgtaattactatagttgcagtagttatgttagtagttataataaatattttaactatctttggtgtttatatatttaatatggtatcacataaaaatacgataacattaaaaaacagtcctgaaacatttgtaagaaattttgaaaaatatatgtatgatgataatggtatattagccttatcagaagaaggctatgaacttttacaggagtctggagcttggatacaggttttaaatgattatggagaagaaataagtaatataaattctcctagtgacgttcctaaaaaatatactccttttgatatggtaaataattataaatatgaggaaagaccatatataaattttatgttagaaaaaaacctaagctcaggtcatgttaatgtaattttagcattacctaataacaatatagagagagtaactttgaatttttctttagattcagtaatgtatcagagcaaaataataataattataactcttattattgatgcaataatagcattaatttttggttacctttttagtagaaaattaactaaacctatatctgaaataataactaatatagatattttatcgaaaggaaattataatttatacacaaaagaaaaaggaatttataaagctgtttttgaaaatataaatgatctttcaagtacattaagagaaaatgaaaatcaaagaaaagaattggagtctatgagggaagagtggcttgccaacataactcacgatataaaaactcctttagcatcaattcaaggctatgctgaaattataagtgataaagattatgagtttacaagagatgaaatgcaagagtatacagaaattatatatagtaaatcaaagtatataagagagttggttgatgaacttaatttatccactagattaaaaaataatgccttaagtttaaataaacaaaatactaatttagtagcattacttagaaatgtagttattgatattttaaatgatagcagatatgaaaacaggaatattgaatttaatagtaatatagatgttattgaaaaagaagtagatgttatgcttttaaaaagagccttaacaaatctaatttttaatgcagtagtgcataataatgaaagtgttgaagtaaaagtagagattaaaaaaatagataaaataaatatatctataaaagataatggaaatggtataaatacaaaagatttgaagcatatctttgatagatattatagaggtacaaatactggtgaagtacataaaggatctggacttggaatggcaatatctaaagagataattaataatcatggtggagaaattcagattaatagcaaattgggctgtggaactgagattttaataacactataaaaaattaattgttatgaaattagcttaaaaaaattaaattaagatatttataaaaattgctgcttgatataattaaattatatttaattatatgtcaagagctatttttattgtgggctaaagtaaggagaattattatggaaattataaaaaaaggaatagatggatttacaataaaaatattagcacttatatttaaaaataatatttagttcttatatttatatgaaataacatataatgattttaggggaaatataataataaatatgttgtttatcataaatttaaaatagatatttaatgaataggggatgagtaattacatgattactaaaaaaataagaaaagcaataattccagcagcaggtcttggaacaagatttttaccagcaacaaaagctcagcctaaagaaatgctaccgatagttgataagccaacaattcaatatataattgaagaagcagttgcatctggtattgaagaaatactaattataaccggtagaaataaaaaatgcatagaagatcactttgacaaatctgttgaacttgaaatggaacttgaaaagaacaataaaaatgagcttttagaattagttcaagatatttcagatatggttgatattcactatataagacaaaaggaaccaagagggttaggtcatgcaataagatgtgcaaaggcgtttgtaggtaatgaaccttttgccattttacttggagatgacatagtatacaataatcaaaagccttgtttaaagcaacttatagaatgttataatgagtataaaactagcattttaggggttcagactgttgataaggaagatgtctctaaatatggaatagttgatggaatacttattgaagacagggtatgtaaagtaaaaggattagtggaaaagccatctgttgatgaagcgccatctaacacagctatacttggaaggtatatagttacaccaaaaatatttgatatactcgataatacaaagccaggaaaggggaatgaaattcagcttacagatgcattactagaacttatcaaagaggaagctatgtatgcatataattttgaaggaaaaagatatgatgttggagataagcttgggtttttagaggctacagttgaatatgctcttagaaaaccagagataagagatgactttattaattatttaaaaagtatggacatttttaatagataaattattggattaattaattttataaatattaagcttatatttataaagacttcgtaaactcatattttacgaagtctttattttgaaagtttttataattattatattttgaattctgatatctgttcttctaagttattaacagcttttccttaagcaacttcagtcacaagttccctcagtagcaccctagagggccagaaatttccagtgacaagttatataaaaataaataaagttagtaatagaaagaaccttcgtggaatatttgttttgcgaaggtttttcatgttcacagatttattataaaatataattttatgtattagaaaattatattttggtatataatgaaaatataataataaaaaaattggcataaacaattaaggagcacatacatgaaaaatgaagctaaaactttacaggaattaaatttagaagatgattttctctttgcaaaggttatgagtgatcatgaaatatgcaaagaatttttagaaaaattactggatatagaaattgaaaaaattgaaatgccaagtagtcagaaagtaatagatttgctcctagattgcaaggggataagacttgatatttatgtaaaagatgaaaaaaatactatatacaacatagaaatgcaaagaactgataataaaaatttaggaaaaagaatgagatattatcaaggaaatatagatatagacttaatacaaaaaggtgaggattataaagaattaaaaaaatcatatgttatatttatatgtacatttgactattttaataaaggccgtcataaatatacttttgaaaatgtatgtttagaagataaaaacataaaattaaaagatgatacacaaaaaataatcctaaatacaaaaggtttaattgatgatatagatgatgagttattagattttttaagatatgtagaaaattcaaatgaaaaaactgcagaaagcacaaaaggaacattagtaaaacacatacatgaaaaagtaatagaagttaagaaagataagaatgtggaggtggaatttatgactttgttagaaagagatcgtgaaaaaatagaagaaggaatacaaaaaggaatacaaaaaggaatacaagaagcaacaaaaaaaacagcaattaatttattaaaaatgggaatgacagaagaaataatttcacaggcaacagggttatccattgaacaaattaaagaaatagctagaaacttgtagtaacttcagtcacaagttccctcagtagcatccgagaggtctaaaaatttccagtgacaagttatataaaaataaataaagttagtaatagaaagaaccttcgtggaatatttgttttgcgaaggttttcgagttactaagttttaatgagattattttgtttataatagaatatttgtggtatataataaatatagtgaatctattattagtagtagtgaggaataaaaaaatgcttaatgaaaagaatataaattcaaagaatttaatactttatcatggaagtaatatagaagtaataaatcctaagattataccaggtaagtttactaaagattttggatatggattttattgcactataaaagaacaacaagcaataagatggtctttaagaacaggaaaaggagtagttagtatatataattataattactctaaaaatttaaatattaagatatttaatgatatgacagaagagtggctggattttattgtgaattgtagaaatggtaaagaacataaatatgatatagtagaaggacccatggcagatgatcaaatttataattatataacacaattcattcaaggtattattaatcgtgagcaattttggattatgataaaatttaattatccaactcatcagatttgcttttgtactgaaagatcattagatactttggtatataaaggatgtgattattatgatgagtaaagaaatgaatgatttattttttgtatgttccatgattgaaaaagtttcgagagaaactaaacaaagacaatcatatgttgtaaataaaatgggaaaagaaaatataggtagattatataaatatgcagatgtttttcattgtgaaaacccagataaaatttcttatgatcttattaaagataatgaaattgaagtaggaacatatgataagatatcacgttgtaaatacaaaataccttcttattgggaaattggggaaatatatgcacgattaattatgaatataaataaagaattattaatagatacattgtttgaagtttataattcatggatagaaaagataatggataattataattcttctttttattatgaatcaccagagtatcatcttgcttgctataatgcaggagaggtattattttagtatgcgagagcaacttcagtcacaagttccctcagtagcacccgagaggtctagaaattatagatattccaaaacttaacgggtataaaatttttcggagtaaagttataaagaaagaaccttcgtatatttcacgaaggttcttttgatttatattttaaattcagttatttgattttctaattctttcactgagtttcctaattcactaaatttttctttattttcagaagctgctttagtaacttcttctgataaacttgcaacttcttctgaacctgcagccgtttcttctaaagttactgaaagtttagcaacttgtacaactacactatctttcatagtgtttattttagaaatattattaaatatttctccaacacctgaatttaattcattaactgaatctataatatttgagaaaatcttttgtgattttattatagcttcttcttgatcaacaacatttttacttgtatcattaactttttcaactgtgatttcagtattactttttatatttttaataatctcattaatttgcttagcagaaagtgcagtttcttctgccagttttcttatttcttcagctacaacggcaaaaccttttcctgattcccctgctcttgcagcttcaattgcagcatttaatgctaataaattagtttgttcagttatagctccgatagtctcattcattgtttcaatttcttttaaactatccgcaacatttttaacaacaatgctaacactatctgtactttcttttgttagtttcgatttatcaattactaaatcagaaatgttaattccttctttaccaagtttgcttgcttcaatagctttgtttgtaacattttcaactatagttttaatgccatccatattgttagataaaacttctaaattagatgatatttcttctaaatcacctgaagaatgcatcgttccatcagctatctggtttattgtttcacttacatcactcattgatgttaatatattttcacccatagttactgaatcttgtgcgctgttatttacaagttctatagaattacttacttgcgcaattaaatttgttacattttcttgcattctattaaaactagtttcaacttctttaaattcagtactgtttccactacttgtaaatctaaaattaaattgacaatctgctgctttatttattgcattcttaacttcgacaattagatttgatacttttatagaagaaaaaataacaactaatattgagaatataattacaaatccactgacaataacattagttattataacttgatttcttaccacattcatttgagatactggtattttaattaataccttccacccagttaatgtttctgtttcaaaatacactttatagtttgtattatcataggacgtatttattgaacctgaactattttttgaaatataatcccagttctcatactcagaggcttctgtacttccagccaaatcgtgattactgctgactataatactaccatcattatctacgattattaaatggccttcatctcctaattttatgtatgataatgattcggataacacagataaatcaatatcaatacctaacactcctaaagcttgtccgtttcttactattttcttgtatatacttataaccatatgttctgttaagttatctttatatggatcaaaaatgaggtattcctcattactactcatagtttttgtaaaccaaggtctttctaataccttataatcttcaggtaagctttctccagttccaaggatcatatttccctttatatcactgtagtaaatgtctaatatgttagaatcagaatctaaaaacattgcgaatttatgttgaagaacatttttatctatttcattatctaaagtactaaattcctcattattagatacagaatttaatatgtctataaaatactccatttcactattaatataattaccacctattttagctaatagttctgaattaacttgagtatcctttttattatttttggatgtaactgatattgacattacacttataactagagatggaattatggctaacagtaaagtcccagctattaacatcgttcgaatactaattgattttttgctttttttatcttttttcatttgtagctccttttcgtttttttcttttgtttcaaattatttttcgacattctatgagatttctttagtgttcagtattagccagtttaaaatagaaaattctatgataaagctttatttagtaaatgtatatagtacacgacttttattttaataaattagaaataattaaaatgacttaatatgatataattagaaaataaagtaaaataatttaatggaggtggagatgaagaataaatttgtattaatagctatatgttttttgtgttttggatttatattgtttaattcaagccagatatctacagtatcaaacacaagaagcagggaagttgttaataatttaattaaagtagtatcaaagactaaagctggtgaaattttattatataaggtaaatgaaactgaacttaaccttatagtcagaaagattgctcatgcatttgagttttttttattggggatagttttatgttttacatttagatattttaagatagatgataataatttacttatatatacgctgtttacagtgctctttgtagctgttatagatgaattttttcagattttcattcaaaacaggacatcaagtgtagtggatgttcttattgattttggtggaggtatacttgctaatactttattttttatattttcaagtgcaagaggaaaacactataaaaagactacacatatgaaaagatttgttatggagaaaaatagatgaaattagtgcaattaaaaaatataaataaatattatgatggtagtaagaagaatagattccatgctcttaaggatatagatatttcttttgaaaggggagaatttattgctattattggtgaatctggtagtggaaagtctactcttatgaaccttattggtgggcttgactctgactatagtggtgacattattgttgaagggaataatataaatacatataatcaaaaacaacttgatatttatagaaaggacaaggttggctttatatttcaaagttttaatcttataccacatttatctgttttagataatgttactatacctatgataattagtggagcttcaaaatcaagtagagtaaagagtggcagagaaatattaaaaaaggtaggacttgaaaaatatgaagataagaagccagataagttatcaggaggacagaagcaaagggttgcaatagcacgtgctttggttaataatcctcacataataatagcagatgagccaacaggaagccttgattcacacaatacagatcagattttaaatcttataaatgaaattgttaaagaaggcaaacttgtaataatggtaactcattctgaaaaagtagcatcatgtgcagatagaatagtagagataaaagatggggtaatagtaaaggatattaggaataaacagataaaagagtatgaggctgatttaagttatggagaaaaatatgagaatggaaaaagattaaatagtaatttacatataaaaaggaaaaataaaaatctaagtgtgtttagtgcagtaaaattagcccttattaatatgaaagaaaaatttcttagaaatattttaatatcacttggagcaagtattggaataatgggagttgttttaatgcttggttttggaaatggaataaaaacatattttaataatgccatggacaattatgtaaatcctcttgttattgaagttaatatgccagaagccgatgaggaatttaaagatagtgataacataatagatatacctaaaatgaatagtgggacagcctttgaagaagaggattttgaaaagttaaaatcaatagaaaatgttgatagtgttgaaaaaggttataacgtaattgccatgggagcaaattctgtaagtacagatcatggcggatgcaatataataagacttgccacagtttcttctggaatacttgaaagtagtctttctagtggaaatattccaaaagaaggtgaaatcttaataaataaatctgttgctgataaattaggagaaaatattattgggcaaaaggtaaagctaagtattcttataggcgagactaaagttaaaaatgaatttattgtgagcggaatatatgaaggtgcatatggagattttaattcaatgataaaatgtgcttttataaattattctgatttagaaaaaatatatacacaaaataaccgagagttaaagccaaacacagcatatattacaagtagtgctgaaaactatacagatggaataaaattaaaagctgaagaaatgggatacacgggttcatcacaagagcagatgacaaatctatttaatgaaatgataagtattacaacatatgttttgtcaggaattgcagcaatatcacttgtagtatcttcaataatgatacttgtagtactgtatatgagtgttgttgaaagaattaaagaaataggaatacttaaggcagtcggtgctagaaaaaaagatataagaagaatatttgtaagtgaagcgtttctaataggtatatttagtggactagctggagttggaatatctatagttattatgaaacttataaatagaatgtcattacagattttttcagttgatttacttttaatagatactaatcatataataactggtatatgtttaagtgtaattataagtattattgcaggtgtaatgccagcagcaaaggcatcgagacttgatcctgtagactcccttagaagagagtagtatataacaattaatatttgacactatataagcgaaagttgaatctaaaatcattactggattttatgatttatgagttattaatagcatatacgttttatgctaattcatgatatatatgttgaattattaactttactattataatttaaaatcaatatgtttattcaaatttagagaaccgctgtgtaccagaccggtacgcacagtggtgtgagaggaggaaaacaaaataattgttttcctcctctcaaatatatatattgcaattgacaattaaggtgaaaatccttaaaggatttttgagattatatgtacaataatcattgcaacatatatattataatgtaacaaaattttttaataatttctaaaggagtaaaaatacatagtttacgaagcagtttttttactattttttataaaaaagtttgcaatttgtattttattcatataaatatattacttaaataaataaaaaagtattaaaaggaataaaaatgaaaaaagaaaacgttttaagagtgaaaaattatacttaaaggaatataaaggttttataggaattataattatattaaaaaagtgttttaaaaaacatgtccctatgttattataagtttgtcgatagatgagacatacagaaaacgacagagatgtagaaaaaagtttaaaattgaaaaaataaaataattttaaatatgacagtatgagaaattagtatggtgtgtcatctacgtaattgaattgactaatttgggaaagaaaaaatttcagggggaaaagaatatgataaaaagaatgaacaaattaacagcattaatggtagctgcaactgcagttgcttcaatagtaccagcagtatcagctagtgctgcagcaaaattagaagtacaagaaggaaacatcgatgcagcagttgcttacggtgatggaaaatatgtttatgacggttatttaactgatgatgatgaaagcggattatacttcaacaacggaacaaaagattcattcttagaaaatgatgaagattatgaatttggttcagaaaaatacggaactaaatatacaatagtagaaaacgatggagaagactatttattagatttatcatctggtaaagttcttgatgatgaaagtattgaagatttaagaaacaacgttgaattaaaattaagaactacattaaagaaagctgatgacagatacgctacagtaaacaataaaatagtatttgaaaacaacgatgaaatagcacaagttcttggaaatcaatttggagatgtttggtactcatacggagttaagagtgcagattcagacaaaacattatacggttttgctaatgaatcaggaaaatacattgatgcttcagcattagctaacatgacagtttcaacaactgacagtgctgtaagagtaactgaattcgataaagaaaagaatgatgctatggtatcattagcagaagctccaaaggtaatagctcaagacagcagctacctatacgctataacaaaagtaaatgttacaattgctggagaagctgatggaacaagaacatacatccaaaagatctctaaagctcaaggagatactaaagatggagcttacatgccaaaatctgtagattcatatgaaatctcaagtaacttctacattgacaaagataatgatgatacagcaaaagctgaagaattattacttgatgaaaacaacatggtaagagttataaaagatacaatatacgtaacaacagtaagcgaagatggaaaagtatatgttaatacaatcaagttaaagaaagaaaaagttactaagaacgatggaactaagaaattagacgtttatgtagcagttaaagatcaagatgatgatgaaaaaatcgaaggtggagcaaatgcagtatcaatagatgctgaaggaaacacttgggctgtaaacaaaggtaagatctacaaattcaatggtacagaattcgttgaagtttacacttgtgacagaactatcgatcatttagatgtatatgacgaaaacaacttaatcgcttggaacaaagaaaacgaagtattcgctacagttcaaactaaagatggtaatggaacagatgaaggcgataaagaagaaactaaagctggatgggttactaacgcagatggaacttggtcatacaacaaggctgatggaactaagactacaggatggttattagatggatcaacttggtactacttcaatgctaacggagttatgcaaacaggttgggtaaatgttaacggaacttggtactacttaaacccagtatcaaacggatacaagggagctatgcaaactggttggttaaatgacaacggaacttggtactacttacaatcaaacggagctatgaagactggttggttaaatgacaatggaacttggtactacttaaactcaaatggttcaatgaaaactggttggttattagatactgatggaaactggtactacttacaatcaaacggagctatggctaaaaacacaactgtagatggttataagttaggatcaaacggagcttggatcagataattagtaagtattaattattaccactaacatactcttagataaatatagtattgtaaatattaaatgtgcaaagtaaggcatattagtgaaaacaatataaattctgcataagaaatggactgttacaagatatcttgtaacagtccttctttattatttctgtgaattaaaatttaatttattaatttttttaatcataaataacatagaacatattttgatttggaacccaaattactaatagtatatttgacaagtataactataaattgataatagtgagaattgtgtaatttagtcagttaaggatgtgaattgactataagttttttaaggaattattaagaaaaatttaagttaaagcttttttatggaggtttacaggtttagtgtatagtgttaacataaacttatgaatgcataataaggagaggaagaatgagaaaattaagagagggcattgcagcaactgtattggcattatattccttaataggtatagaaatgttatcaggcagtttaacatgtgtggaagcttatgcaaaaaacattgaagacaagccttatctaaaggatatatatgtgggtttaggttatgatatagaatttattaaggataaatacgaatatatagttgatgtagataaagatgtagaagatatatatgtaaaaaccagaccagaaaatgacaatgatattataaaaataaacggaaaagtaattacaaaagatgataaattcaaaaaggatttaagtcttgaaatgggaaaaaataaggtcgttatcgaagtaataaaaaataatgataacaatgaagaagaatatacagataatgatgatttttctgaagatgatgtacaaaatgataaagataaatatggatctgcacaagataaaacagtttatactttatatatttatagaggtggagcagatgaggtatatttaaagaatattacacttgataaaagtaatataggttattttgttaataaaaagaactataatatcgaaagtgacgaaaatggacagttggttaagcttgaagtagaaacttttggtgatgagtatagtgtatttgttaatggtaataaattagactttaccaattctttatcattaaaatttaagggcataggtaaatacacaattactttagatgtagttgatgatgaaacaaaaagaaaatcaacatatgtgttgaatatttatagaggaatacctgtaacacctaatgtatctgattcaataaactctgtacttaaacctaatcaatgggtaattgtaaatggaagatggcgatataatgatgctgttggacaacctttgaaaaatacatggttttttgatatgaactatgactcatatttctattttaatggcagaggcaatatgaaaactggctggattaatgaaggcggaaatacatattacctaggaaatgatggaatgatgagaactggctgggttgaatatgaaggtaagtggtattatctagatatgaatggagtaatgagaactgattgggttaaaaataatggtgaatggtactatttagaccaagatggaagtatgaaaactggttggattgtagataaagaaaactggtactatttaaataatgatggttccatggaaactggttggattttagattataaaaagtggtactatttatcacaaaatggagcaatgaaaactggttgggctcaatataaagatgattggtactatttaaataatgatggaagtatgaaatctggtgaatgggttgaatataaagataaatggtactacataaattattcaggaacaatgagatgtggatggctttacaaagatgataagtactattactttaatgaagatggttcaatgagaacagaacctatagtattagaaggatatctttataattttaatgaagatggatcagtgaattttaatgattaatattatccccgaaaggggattttttttattattttgggaaattaggttttttaacgtaaatatttatagaatattaacatgatattaaaaatattaatacaaaatttatacataagctgatacactatcacagggaattgggaagaagtatgattttaaatatagaattttaagttaaatattttaatatatatttatatattttgagtattctaatatacctgtattagaatgtttatatctatattatgaaatattagtatatactttttatggctttaatatataattttggagatatttatatatttttttatagctatacataaaaaaatgtagtattataaaaatattgtttattattaagtaaaaattgtacttaaataattgttcaatagtaagataatattcaaatcagaatatatcataaatagaattatattattaagtgcaaaaggaggataaaaatgtggcatgcaaagattaataaaaaaggtggtaaatatataccgataaagtacaaaattttatcagtaattttaccagtgataatattggcgataggaggattgataactgtatcatacaataaatcaagtaagataattgaagaaaattcgtattcaatgcttgaatcatcagttaaaaatcaaactattcaaattgaaaattggcttgaaaataatttgcagacatttaatacaattaagaagtctttaggaagtacacagtacagtcaagaagaattaaaaaaaatacttaatcaatattacaattttaatagcaattttttagatggactatacataagtgatttacaaggtaatgttataagtgctgacaattcacagatgaaatttgaaaatgcaacttcaagccagtggtttaaagaaggattaacacatataaaaatgcgttatggtgaagcacatgatgattatgctggaaataaagttattagtgcaacaggtttaatagttgacaacgataataatccagttggtgtaattggtgctgatgtaactttaaataggataagcataatagtaaattctttaattgaaatggatgatgctcagtcttttttagttaacaaagatactggaatggttttagcaagtagtgattctttagagccttatacaatattaggtgaaaataatgaaaattcattatactctaaaattgcacaaagtattgaaagcggacagcatagtgcgcaagaaatagaaaataatattgtggacatgcatgatgtaaaaaatactagctggatacttgtttcgtatgtacctaaaagcagtatattaagttcaatgtttactttgagaaattatatggtgataatagctattgtagctttagtagttttagttttaataacacatagaactataaactacataataaatccggtaaatgatataagtaaaaaaatagttaagatggctgaaggtgatttttctatagagatagatgttaagagcaatgatgagattgcagttatgtctcagagtttgaaaaactttatagaatctatgagagttatgcttaatgatataaaagatatttctatggaacaaaaaaatcagtcttttgaaagtaagaatatatcagaacatttatttgattcatcaaaacagcaggcagaatctatgaacaacttaaatattgttgttggagagatggcagaagctacaaatcaaattgcagatacagctacaagtcttgcagggattgcgtgtgaaacaaatgataatgggaataaagtaaaagataagatgattgaaactgtaaaaatgtctgaagttgggaaaaaagatatggaacatgtagagatttcaatcagaacaattgaaacttcaataaaagaattaaaagatgtaattgatgaagtaggaaaatcatctgaagaaataaacagtatagtatctattattggagagattgctgaaagtacaaaccttcttgcacttaatgcatctatagaagcagcaagggcaggggaagcaggaaagggattctcagttgtagcatctgaaataggaactcttgctaataacagtacttcgtcagttaatgatattgcaaaacttataaataatattaataaacttatctctaatgtagtaaacaaagtaaatgaaagtgttaatcatgtaaatgaaagttcagaattaataactgattctgtaaggaagtttgataacatatataacacaataaatgaatcagataaattagttgcagatatgttaaagaaagtagaagaagtaggaaaagcagctgataatatggcggcaatatcagaagagcaagctgcaagttcagaagaaatttcaagtacatcacaagacatgcttgagcattcacaaaatattacgcaaagcagttataatgttgccaaaggagcagatgttttatcagatatagctaaacaattagaatcagaagtagaaaaattcaaattataggaggcaggcttctaatgaaaaagttattaagtttattgatggtatttgtattaatgtttactgctttgggatgttcaaaaaatggttcaaaaggcacatcaataggaaatacaaaagtttttgctagtattgcagatgatgataaatttaagcagaccattgttagcggtatggaatcatatgcagatgaaaataatgttgatcttgatgttgcgattgcacataacaatgtggaaacacaagtacaacagattaaagatgcaaaaactaagggatatgatgttatagtttgtattcttgttgagagtgatactgcacagcagataataaatgcagcaggtgacattccagtgattttcactaatgttgaacctgattcaggcagactaaaaagtgataaatatatttatgttggttctgatgaaaatgaagcagctaaatatacttttgaatctttaaaagagtattttaaagataaaaaatcttttaatgcagttttatttgaaggaagtatggattcaaagagtgcttctgtacgtacagaatctttaaaatcacaattaaagaaaaatggttttgatgtaaattatgtttttcaagatgatgctggctgggatcgtgaaaaggcaaagaaaatgtttgaagcatttttaaaattaaatgtaagttatgattgtattattagtaataatgatgaaatggctttaggagttattgatgctatggaggaaaatggaattgatccatcaaaggtacctattttaggtcttgatgcaacaccagaagcatgcaaagctatatcaaatggaaaaatgtccttttctataaaacaatctggagaaggtcagggagaaagtgtaattaaagctgctcaagcacttaaaaatggtgataaaataagtgaaattgaaaatggagatagtagtggaaaatatatttggtatccatattcaaaagtagataagagcaatgtacaacaatatatgagataagaactaagaaaataaacatatatatagtgtttatataattgttaacaatcagtgagagcaattaatattaaaatgcttatagattttatctagtatattagatttaaaaagttaattttataatagaatcataaatatataaaactctgcaaattacatttgtattatgcagagttttttataataaaaggtataatcaacaaatttttaataaaaatatagagtttatgtaaaaaatagtactcaatgtacgataattaatatgtataatattattgtagagattattatgtatatatgttgcaaattgtagtaaattacttaattttagtagtattttgttgcgtatatataatttcaatatgtatgctgcattatgagctttacaattataatctagaaatccatagtgatttcagcatcaattgacaattgctcataggagtacccacaaggggaattgcatgtcaattgcaatatatatagtataaatatttataacttgggaggacgatttaatgagagcaaagtttaattttaaaagggtatttgcctatttgcttatatttgctatgacctttagctttgtgcaaatgggacaagcaaatcctgttaaagctgccactagtggatcaaaagaagttaacgacagctttaagtttataataggggatgctagtagtggaactactaaagatgtagatatggattatagtggagatttagtattaagatcagtaacactatctcagacatatactataatgcctcaagcaggatacaatattgagtcagtaaaaagtagtagtgataaaatgaaaataactaaagcagttagcggaactactaatacttttactataggtacaataaaagactacagtaactttaaacttactgtaaaagtaaaaaattcaagtggtgaaataaatacttatgatattagagttgaatttaatatagattcatctttagaatttaataaattaagaattacagtagataatgatgatcctgttacactaacatatactcagtgtgatagtgaaggaatatactattatgaagaatccaatccagaagctaaaaaagcaaaaattgaaatgtttgacgacagcaataatgcaatgagctttaaggtaaatggaggaactaataagactgtaaatttagttggtggagataatactattgagttaacagtaacaagtgctggttattctaaagtttatacattggtaataactaaaaagggtgtagccaaacttaaatcattggtgccatcaacaggaagtctttcaccatcatttaattctgatacaacagaatatacagtgacagtacctacaacacaagaaacaatagcatttactccaacagcagttgataattcttcaacaattaaagtaaagaaaattactgttgcaagtgggaaaaagagtcaggatataaagcttgacgaaggagaaaatgagattcctatagttgtaactaataaagatggtgatgttactacatataaagtaacagtaactcgtacagaaaagtttagaagtgcaaatttaaaaagtttaaaattaacatctggtacattatctcctacatttaataaaggtgtgtatcaatatactacaatagtagaaaatacagttagttcagttggggttacgccagttgcagaggatacaaatgcaacaatagaagttaatggaaaagagattccaagcggagctacttcaccttatataaatcttgatgaaggtggaaatgtaattaatgtaacagtaacagacagtaagggtaatgataatacatatgttattatgataacaagaaagtactctaaaaataacgttaatttaagtagtctttcagtaacagatggaacattttcaccaaagtttgatccagagatttatgcttacagtgttaaagttccaagaaatattgaagaagtaagaattaaatttgaaacacaaaatgaaaagtcaaaagtaacaattaacggagtagaatataaaagtggtcagcaatcagataagataaaacttgacttaggtgcaaataccgtagtagttaaggttgtttcagaagataataaatccacagttaattatactttaagtataattagagataaggtacaaggaacattaaatgaatgggttcttgtaggtggagaatggatgtattatgatggagatggaattccagctaagaatagatgggttaaatacgataatcaatggtatcatgtagatgtcaatggatacatgaataaagatggatggttatttgatggcggaaaatggtattatcttgatcctaatggaataatgctttatggctggattaaggacacaggattctggtattacttaagagaaagtggagaaatggtagaagatagctggacaatgctagatggaaattggtatttcttcaatcaatatggccaaatgcaaacaggatggacattatataaaggaaaatggtattatttagatgaccatggtgtaatgcaaaaaggatggattacttacgataagaataagtattatttagatgatgatggtactatgagaacaggatggttatataacggaaaagtatggtactattttgaatcatcaggaagaatggttacaggatggcagactataggaaatagaagctattattttgattcaaagggtgctatgaaaactggaatgttattcttagatggtagatggattaatcttgattcactttaaaaataaatgtgctataacaatatattatcaacaagttaataacatattgttagtaaagcatttgaataaaatatttgaataaagtgataaactcactaaataataaagacatcagaaaaatctgatgtctttattatttccttagtgtttttagaaagaatgaatacttaaatatagaatatatatgagattgtaatataaaacaatgttgtgatattagtgaaatatggggatgagatatgtgaaaaaggggtggggtgttgtgtgaaataataggtgaaacctttttaaaaataaatgttgttaagattagaaatataatagaatgtcaataatcatagataagaaaaactatttaatataatttagttcagttatttgtggagttaattaagtttaaatattaatcgaacataaatttaatctaaatctgaatagtaattgaaaagtgtatgaaaggagttgttatctatgatagaaagagattgggaatttgagaagataaaaaaatataaagaaaatgcacttagagaaaatatttataataaggaaaatgttaaaaaatataaagaatgtccttactgtggaagcaaaagttttataaaatatggaaattataatagaattcagcgttataaatgtaaaaatgaagagtgcaaaaaaacattttcaaatacaacaaattctgtatggaagtacttaaaacataaacctgagaaatggtttgagtttattgagcttatgggtgaacacacaactttaaatgaatgtgcagctaaattagaaatatcaatagtgacagcgttttattggagacataaaatatttcatgccattgaaaataactataaaccagaaaaatttgatgaggttgtttatgtagatacttactatacagaaaaatgttataaaggaagcagaaataaaaattatacatatgctgataaagtaaaaaataaatttgataaaatgtatggacttgtacctaggaatgtaagtgtacttatagcagaagaaagagggaaaatgccattaataagaagaacagaaaatgatgaaacaatagtaaataattttaataataatgtgttgaaaattgcagctaaagattgttatatgcgtacggattattttacaaataaaaaattaaagaataatttgctacaatacaataaaaaactttcaaatgagacaaaaaagaaatatggattaaaaattataggaaatagaatagaagataaaataaaagaagataaaaagaaaaatatcatagcttatttaactgcatggttgagtagatataagggaattgctacaaaatatataaaccattattataatttttattcattaattgattcagaaaaagtttttgattatatgagtatcttttttgagcttttaaaaaatggatcttatacatctgttgaagttttaaggacaaatcatgttgaagattattaaaatatttaaaagagcgttgtttaccaacaattattttaaaaaaagtttttcctataaattacactatgattctaatagatatgtgtatttagtatgtgattatgttaattaaaaaaataatatacccaaaaagtaaattagtaaagaattatgaattttcctctaaaatattaattggcattaaaaatatagattatttaacgtgaattaaaatatattcctgatatattttaaatgattaaataataaaaattcaaatgtattgctgtagaattttttgtaaaacaaagtttttactgttcactatttaataaaaatatcagtaaagatattaataaaaatgttaataaatttaattttgaaaatatataaatataagttctagaaagataaattaaatatatatatttaaaaataattttaggtttattaaaggattatatagaaaaatagatatgttaataaaatttttcttagatatattgaagtttgaataattactaagaaaataattattataatatatatagataatatttgaactgatcagtataagtgttataatattgttatagttttgggagggaaagatatgataaaaagacttaaaaagacaagtgcattaatagtattagcaactacattggcaacaatagttcctgttggaaatacgcagattagagctgaagcagccgataagtatagtaacgaattttcaaataattacaatatcgaatcattagaaaataacataagtttagcatctgaagaaacatcagaagataaacaaattgctggaaaaataacacaatatataaatgggaaatatccaggcgctacagttaaagtgcaatcacctaaatatataaaattaacaatcactaagagtattgcagaaaaaatggcaactcagatatgcagtagcaacgatactataagacaaattttaaaaaatgaacccaatttagtaaaaccaggggcaagtcaagatgaagtaaataaaattgtagatagtatgactgatgagcaaattgagagcgtgaaaccaaaagtttataatgctgtttatcaaactatattggcatttgatggacaaagtgtaccagtctatggctatgaagttgtgagtggtgatcagattgaagatacaggatactttgtagggggaaaaattggtgcattaattatgcaaaaagaaggtaagcctttatgtgtatcaacagaatttattaaagatttaaacaatcagattacaaataaaattttagaggaaataaagcaaaagatatcagaaataattcaaaatagtggaataactgaaattatagataaagttctaaagaaggtaaatagtgtagttagtgatgttactgatactattgaagatttatcagacgcaatagatgatttgactgattccataaaggataaggctgatgatatagatgatgcttgggataaagtctttgatagatttgataatgatgaaggctggggaaagaaagatggctacatgtattattatgataaagatggaataagtttaaaaggtgttcagaagattgatggtaaaacttattactttaatagaattgatggggctatggaaactggctggcagatagttgatggaaagagatgttattttgatgaaaagaaaggatatcagctatttttacaatgggttcaagatggtgaagattggtatttcttaagtgatcaaggtccagttaaaaaatctgaatgggttaatgataatggtagaaaatattatcttaagagtgacggaaagatgactaaggattggcttaagatagatgatgattggtactattttaatggaagtaatggagcaatggagtattcaacatggaaatattcaaatgataagtggtactatttaaatcaagacggaaaagcagcaaatgattggacttatattaatgaaaactggtactactttagagaaaattcgtgttcaatggagacaggctggttcagagctgatggaagttggtattattctgattcaacaggagcaatgaaaacaggatggattcagggggatgatggctggtattacttagatgatacatctggaaagatgaagaaaaatgagtgggtttatagtaatggtagttggtattattttaatataaatggtgctatggtgacaaaagcaagatatattgatggtgttaagtacaattttaatagtgatggaagaatggcttaaaaatatagattagtataggaaatataattaaaagtacaaaagatatgttttgattaagaacatagttttattaaaaatattgaatatgttttgttatatatgctttgcttagaataaacgataatgtagaagaatttatgtgaatatattttatgcgttatcaaataaacatgatgttggtaaatgtttattctaagttgaagcatattttttatttaattttatctcaactttatgatttttatatgacatgaatgttaaagcatatttttgttttagttcaatccctttagtaaaatctgtttagaacgataaataattatataaaaggtactcaaattcaaataatattatgtaatttttattagggtaagaagttgtttgagtttcgaataaaatcttattaaatcaatatgatgcaataatttgaaaattatttatttatttttaaattattagctttaatatgtattttgacataatataaagtcttatattaacaattgtatatttgaaatacttataatttaattttagactttacatatcttatgtcttatatgaacaattgtacattggaaattgaataactgaataatagattaaagttaaaattagtaaaaacataggagggaaagtatgaaacgagatttgattaagaaacttatttgttgcatggctataactgcttgcatttcttcaacaatgcctgttgacgtgtatgcagcaacatggatgaatgataatatggggaattactatttctatgaaagcaatacatacgctgttggatggagaaatattgatggaacagtatattattttgatgcttctggtgtaatgcagaagggatggataaaatacggtgattcttggtattacctagataataatggtgctttaaaaacaggatggattaattataatggtgaatggtattattctaattcagcaggaataatgcagactggtattttattaattgatggacaaacttattattttggaaacaatggtgtaatgaaaaaaggaaatgtaataatcaatggtcagttttatacaataggtgtaaatggggctatagtatccaatgctgtaccagttccagataaagtatttgataggaataacaactgtattaagcagattaattctgtagattcaactacgattatgactccagatggttctaaatatgataatcctattgttgatcaaagtgaggatggagattatgaagaaccagcaagaaagtttactgttacatttagagatgaaaatggtcaggaacttaagacaaagaatattacagatggagatacagtaaaaatgtatgaaccagatgatgaaaatggaaaaggcgatgaggatagaaacttcatagagtggaatacgaagagagatggttctggaaagagctatgattctgatgaaaaagttaaagttacaaaagatttaacattatatgctagatgggaagaacttgaagaacagactcttgtaagcagtatttctattactggaagtaatgaagttgaaattggtaagacaacccaattaactgcagaagttaaacctagtgatgcaactaatacaaaggttaagtggagtatcgttgacaatgcagatggaacagcttctggaaaggcatctattgatcaaaatggtgtgttaacaggattagaaaatggacttggaaagataactgttaaggctgaagcaatggataaatctgatgtaagcactacaaaggttattacagtagttgaggctaagaatctaattgagagcatcaaaattaatggaccagatacaataagtgaagatggagcagttgtaaaattaacagcagatgtatctccagaaacagcaagtaatgcaaacgtaagctggaagattactgatggtagtgaatatgctgaaatagatagagatacaggagaattaaaggcattagctgatggaaaagttacagttatggcatcagcaaaagatggatcaggaatatctgcaactaagacaattaatattactggacagtcagttaaagcaactaagattcaagtttcaggatatgaaaatgttaagactgtttcaacaggaaagaaactacaaatggttgcaaggatttatccagataatgtagcatcagcaaatgatgaggttgaatggagtgctgtatatactagtggagaaaaaattggtgaacaagtcagcataaatgaaggaacaattggggttataggtgatgctgctggacaaagattaaaatatgcagtattaaatcctgaatatagaggtaaggttgaagttacagctaaaagtaagagtgacagtagtatcttaggtaaaactacaataactgtagttaaagatgcagaatctgttgatattaaagcaattgatacttcaggaaatgatattactaataaaccagagattacgactaatgcaggtaaattaaatctaaaagcagtattaaacccatctgacactacagatacttcatcagtaaaatggagcatggaacttgttaatggtgatggtgaagatactgaggtttcaaattatgtaactcttacagcaagtgaaactagtgctgtaatagctgcaaagaaaaatggagagattaaggttatagcaacagctaatgatagtagtaaagctataggcgaaattacaattaaaatagacggtcaaaagatatatgcgaaagaaattagtttatatgaagatggtgatgaatctaaacctataaacgaaggttatgaatttaatattcaaaagggatcatcagtgacagttcaaggtaaagttggtccagataatgcaacaaataaaaatattgaatggtcagttttaggtgctaaagattatgtgacatcaaaaatagagggtaataagcttacaataacagctaacaaagatctttcaagtgaaatggcagcagtaagaataaaggccgttgctgacaatattattaaggaatttaaaataaatgtatatgagaatattcaaggcgttaatatttcgactccaagtgcagttgttttaggacaagattttaaagcaacaagtacattattccctgtaaatgttaatggagataagattaaattatcagtagttactaaaatggatgatggaagtttaacaggaagtgcatttataaatggtgaagtagaagtatctagaaatactacaacagctactattactccagtaaatacaggaacaattaaattaaaagcattagcaacactaaatgattcagaacagacatatactacaggagaaattaatatattgaatcctatagataacattattattgaaggaacaaataattcatttactttggaaaatggacagactagaaatgccaatttaactgcaaaggtaaatggtgcacctgctggtggttatagtagtttccttaaatgggaaataaaatcacaaccaagtaatgtaattgctaaagttgacggtaatacaggaatagtatctgttacaagaactggagatattgcagttggttcccaagttatagtaagagtatctgcaaattatgatagtacaaaatatagtgaatttattataggtgtatccaatgcaccagttgttgatagtacagctacaagttagtgataataagttaaaaaatatttattaagtaaatagattaaagaacaattcaattttaaaagtaagttatttattagagcacatgtggtgaatgaactaaattaaggggtaactacaaatgtaataatattaacaaagcaaaattttgaattaaaagaccataattactagataactacaaatgtaataatattaacaggagataattattatgagaaataagttcttaaacaagttaatagctgtaagtattgcacttacagcagtaactgttatgataccaatgaaaactgaagcagcatggataaataattactatggaggctttgcgtatagtaatggatattatttatcaactggatggaatatgataaatgggacatggtattattttaattctttaggtgtaatgcagactggttggttaaactctaatgggacatggtattatcttgatcaatctggtgcaatgcagactggagtaattcaggttgaagggaaaatatatcttttaggaccaagtggtggaatgcagacaggttcaaacataataaatggaaagatgtattactttggtccagatggtgtatgtatggggactgatgtaccaacaccattgaagggatatgactattatggaaatccagtacagccatatgttccaagtcagatttcaaatccaaatgctgtgatggatagtaatattccattagaaaacggtcaaaagatagaagagcagtatagagtttattataaagatgatgatggagatttaatccttacaaagagaatagatgcagatacaaaaataacattgtatgaaccagacaaggcagggtatgaatttattgaatggaatactaaaaagaatggtaatggtacaagttatgatgctggagataaggtgaaattaacaggagacttaacattgtatgcacaatgggatgaagttgaaactgatgatgatagtgatgacgatactatcaaggtaactggtataacattaggtgcagtaggttatacaggaactacaataaatataagtgttggtgatacagtacaatttacaagaaaaatagcaccaagtactgcaactaataccaaagtaacatggtcagttaaaaatggatcaactggtaaggcagaaataacatctacaggtaagcttacagctctgcaaccaggaactgtaactgttagagcaactgcgacagatggatcaaaagtctttaaggaaatgactgttattatagaaaattaaattataaaaaactagataaaataaaactaatactttggagcattgttaagattgatttgatttttgttatattattcagttaaaataataaaactgttaatgatataaaaaatatcactttaagatggcaatgctctaaattagttaatgtataataagcttagaatattagaactcaatttagatgatagattatatattgtatatgccatatttaagtttgatagtataggtgaaatagagtggcatgttatatgtgggataattaattagattatatatgaaatcaatggttagagtatatatgaaattaatggtgaaactttttttaaaataaatgttggtaataaaatcaaggttagtatttgattaagcacttaagcaagtaattataaaaaataaataaaaattaaatttaatacaacaacatttagctttaaaaaagtttattggcttttaaacatgagtagtagaggatgatccccatcaaactgagttcaacaaaattaaatgtaactattcccataaattaaattttaaaaccaattatttctgtaaattaaactttaattatttttttattttcaagaacacatttttgatttagatacatagagtattaatgcttaaaattggaaataattaattatagataataaattataaattggaaataatccatacatattgcagattgtagcatatgtacatagaaaatctaatgtgatataatgttttagttaatgagacataaaagtaattaaattaataatatataactaaaagtggcagatacctgtggaataaagatttagagaaatagtattaacttaaatatttattctataatatatacttagttaagctaaattctataataatgttataaaatttaattttaaaaaagtataaagtctataatttcttacattgaaaagtctcaagtgtaaaccttaaagtgggactatagaatgaaactagagtataagttttttcacatgaacttaagggtactgtcataaaataaggaggataaatcgttggctgattacataaaagaaattgaaaaaagaagaacctttgcaatcatctcccatcctgatgctggtaagacaactttaacagaaaagttccttttatatggaggtgctataagacttgcaggttctgttaaggctagaaaagcatctaaacatgcggtttctgactggatggaaatagaaaagcaaagaggtatctctgtaacgtcttcagttatgcagtttaactacaatgatcactgtattaatatattagatactcctgggcaccaagacttctcagaagatacatatagaactcttatggctgcagattcagcagttatggttgttgatgctgctaagggtatagaagatcagacaagaaagttattccaggttgcatcacttagagaaatgcctattttcacatttgtaaataagatggatagagaagcgagagatccattccaattacttgatgatatcgaaaatgaacttggaattaaaacttatccaatgaactggccaataggttcgggtaaggaatttaaaggtgtatatgaaagagataataacagaatcatagcttttaatggtggaaaccatggtcaaaacgaagttgaagctatcgaaggtactccagatgatcctaaattcagagaaattttaggagaagctcttcatgataaattaatggaagacattgaacttcttgatattgcaggagatgaattagatttagaagctgttagaaatggtgaattaacaccagtattctttggttcagctttaactaactttggtgttgaaccattccttgagcatttcttagaaatgacaacagcaccacttgcaagacattcaagtgttggagatattgatccatttgaagataaattctctgcttttgtatttaagattcaagcaaatatgaataaagctcatagagatagaattgcttttatgagaatatgttcaggtaaattcaacaaaggtgaagatgtttaccatatgcagggtggtaaaaagataaaacttgctcaacctcaacaatttatggctcaagatagagaaattgttgaagaagcttatgcaggagatattatcggtgtatttgatccaggtatattctcaattggagatactttatgtgctgcatcaaagaagtttaagttcgaaggaattccaactttcgctcctgaacattttgcaagagtaagaccagttgatactatgaagagaaaacaattcgttaagggttgtactcaaatagcacaagaaggtgcaattcaggtatttaaagaaatacacataggtatggaagaaattatagttggtgttgttggtgttcttcaatttgaagtattagaatacagattaaaaaacgaatacaatgttgacattaagatggatagacttgactacagatatgtaagatggatagaagatcaaagcattgatatggattcattaaacttgacttcagatactaagaaagttaaggatatgaaggatagaaatcttcttatattccaaaatgactggggtataagctgggctttagatcataacaaggatcttgtattatcagcagttggtaagaatgatgattaaaataaagtagaagttttcaaaaatgaactacctaattaagtgaattaataattggtagttcattttttttgctcagattataaaaattttttactaagaaaaagcctaaaaataatgttatgttatttatattgattgaccttccacatagggattttaaagttaattataaaatattaatagcaatatacaataaaatgaatgagcatttgataaaatttttgacttttctctttaaggtgatagatttttttgctacaatgaaatttagaggaggtggaggaacattttgaatatttattcgacaattaagaagaaatttactatttttattttagtatttacgatgatattaggtttggttcctacgttaagtgtacaagcagtgacaactgactttaaaataatttcaaaaactgaagttactgctgcacaggctaagaaatgggcacaatcaaaaggtgcaactgacacttttgcagatttggctaagctttattggaaatatgctgaagagtgtggtggagtaaacccaggaatcgcatatgttcaagcggctaaggaaactggttatggaagatttggtggcgttttagatgaaagttataataatccatgtggaatgaaaacttcatctggtggtggcgattatgacaaagaagctcatcagagatttaattcatgggatgaaggtgtacaagctcatatggatcatttagcattatatgcgggagctgatggatatccaaaagcaaatacatatgacccaagacattttgtaactattaaaggaagagcaactacaactaattctttaggtggaaaatgggctccaagtgcaacttatggtgaagaaattggtaaactttatatgagtttaatggattcagcaggagttacttttgaaaaagatgaagacgaggatttatgggaagatgttgaagatgaagaagatacatcagcagcaccaaatccaggaacagtagaaaaaaaaccagcagatttaagtattgaagaagctattaagcttcctgaaaaaattacaaatgatacttctggtactgattcatctcaaggaagtggaaatgattcacctaacataacttctacaattggatggaagaatgttgatggaaattggtattactataaatcagacgaaacaaaggcatttggatggataaaaccagattcgaattggtattatttagatgatgcagatggaaagatggtaagaggatggctgaaaaacaataataaatggtattatcttgatgaaagtggtgccatgattacaggttggaagcttattgatagtaaatggtatttattcgacaaaaatggaataatgacgactggagtacaaaatgatggaaatagtagttattatttagataaatctggagccatgattgaagaacaaggatggaaaaaggttgaagataaatggatttaccttgaaaagggtggaaaaattaaattaggatggcttaaagaaaataatgcatggtactaccttcaaggtgatggaagtatggtaaatggtttaaagagaatagatggacaagtatattctttttatgataatggaactatgcagacaggatggaagagtgtaaattcaaactggtattactttaaatctagtggagaaatggcaacgggatggacttatgatggagatacttgttactatctttatgataatggagcaatggcaaaaggctggattactattggagactcatggtatttactaagctcaagtggagtaatgcaaacaggatgggttacatcaaatggagatacatactacttagataaatcaacaggcagaatggttacaaatacgactgttgatggatataagataggtaaggatggtaagagaaaaggtaaggtaaatcaaggtgattccaattccaacaactcaaactccaataattctaactcaaataattcacagacaggaccaggaagcacaggaaaagttatttatgttgatgcaggtcatgactatggtaaagattcaggtgctgtagctacaataaatggagtaacttatagtgaaacagatcttaatatgcaggttgcagataagcttaagacatctcttgagaatagaggatatactgtaataatgacaagaaatcttggtgaaagaccatcattctcttcattaacagaaagtctttcttatagagtaaataaagccaataatgcaaatgcagatttatttataagtatacatcataattcagcaggtgaaactgcaaagggaattgaaacactttatagtgaagtatctcaagatgacgcttttggtggacaatacgatagtacaagaattgcgaaaagtaagagccttgcatctgaaataaataataatattgcaagtagtcttgatttaacaaatagaggtggaaaatctcaaaacttatatgtttgtagaaatacaaaaatgccagctgtattagttgaagtaggttttataactaatgcagaagaagcagtaagatgttcagacccatcaagtcaacagagagtagcagaagctatcgcagcagtagtttctaaacattattaatataaaatttgcaatggaaagttgacatttgacaataggtgtccttttggatactgtttgtgggaaattaatgttaaaggctgtattgagaaagttcaactgaccaaatatgaaatttggagtttcacttgctcgctgagaaagttcaactagccaaatatgaaatttggagtttcacttgctctctgagaaagttcaactggccaaatataaaatttggagtttcactttttctaccaaaacttattgtagtgttttttagtttttatgtataagatatattatgaaaatacactataatttagaaatattaaataaaatgcaccagatatgttctggtgcattttatttaatattacaaaattatgaaaaatttcaagtaaaattacaataaaggaatgaattttatgaataatttatgaaaatatggtgtcaaattatgtacaacgtacccaaaatagatgttatacttgtatagtatatagcaagacagatttgaggaaataaaaatctgttagtaatatactttataagtgaatggggggagaactgttttgaagataagagaaagattagcttcttttttcattgcgttatttgttgctttttcgtttattccgtctatgaaggtcatggcagatacagtagcagatattaacataatatcagatacaaaagtaacagtagcacaagcggaaaaatgggctaaatctaaaggtgcaacagatacattcataagtttagctgaactttattttaagtatgctgatgaatgtggtaatgttaatccaggaattgcttatgttcaggctgctaaagagactggatatggaaaatttggtggagtacttgatgaaagttatcataatccatgtggaatgaagactagtagtggtggtggtgactatgatccaaatgcacatcagaaatttaattcatgggatgagggtgttcaagctcatcttgatcatttagctctttatgcaggtgcagatggatatccaaaaagcgatacttttgacccaagacattttgttacaatcaaggggaaggcaccaactgtcaactcacttggaggtaaatgggcaccaagtactgtttatggagaagaagtaaattctttatatagagatttactaaagtcagcaggagttacaattggatcagaagaaattccaaatgaagataactcaggcaataattctggaagcaactcaggcagcggatcaaactcaaatggttcaaacaatagcggtacaccaggtggatcgacaaatgttcagcctccaaaagatacagttgaaccacaaggtcttccagtaaataaacctatagctattactgctgataattcaactaatatttcatcaaacattggatggaaacttgaaggtggaagatggtattattacagatcagacggaagcaaggctacaggttggattaaacctgatgctaactggtactatctatatagtgatggtgtaatggctaatggatgggttcaattaggatcatcatggtattacttacaatctagtggtgcaatgaagcttggatggtttaaggatggaagtaagtggtattatcttcaaggaaatggagcaatggttacaggctttaattctattgatggtaagacttatttcttagattcaagtggagctatgagaacaagctggtttaagataagtggtcaatggtattatttcaatactgatggatcaatgcttactggatggattagaccagatggaaactggtactatttattctcaaatggaataatggcatcaggatggcttgcgcgtgatggtgaattatactgtctatcagaaagtggagtaatgcagactggatgggtttatgaaaagggcggttactattatttccatcctacatcaggaaaaatgctaagagatacagtcgttgatggctgggaaattggacctgatggtaaaagaggagatagagtaggcggcggaagttcaaaacttatagttattgatccaggtcacaactttggtggtgatgatggtgcttacggttaccatagtggagttacatatagtgaaagagacttaaatatgcaggttgcattaaagttaaagactaaacttgaagcttatggatatcaagttgttatgacaagaaatgaatctgatagagaaactttatcagtatctgaaagtcttgcaaaaagagttaatcttgcaaacagcttaaatgcagatttctttgtaagtttacaccataactcagcaggttcagaatctgcaaatggagtagaaacttactatagttctaatgcaagtaattcaaataatatttctataagcagaaatatggcaacaaaaataaataatgctattgtaggaaagacaggacagtacaacagaggtgctaaagatggaaacttatatgtatgtagaaatacaaatatgccatcagtcttagttgagttaggctttgtatcaaatccaactgaagctgcaaaatgtgcaacatggactaatcaagaccttgctgcatcagccatagcagaagcaattgcaagttcaatataaggcgttattaaaagataatacgttaatatgcctaattaaaaaagaatatttaattgttaagagtcatatcaaagaaaatctgatatggctcttttttgttaacactttatacaaaaaatatctatataaaagttcataaatacaatgtataataatatatatgttctaattagaaattcatatttaataatctactaaacgaagtttaatcctataagttatggtcacatgctttagtagttttattatttggaactaatataattaaagcttatataattatattaaaattaagatgttttagtatagaacatattattcatgtaaaagaggtgaagattatgaattggtttagaaaatttatgtatggaagatatggagtagatgagctttcaatggtgttagttggagtttcaattgctttgttgttactgtcaagcttacttccaagatcattgagtattctatcattaattgcatatatacctatggtaatatatatttttagaatattttcaaaaaatatttttaaaagacaacaagaaaattataaatatatatcatttaagaattctatgctttcaaaagcaaaaaaatataagggcaaaatacaaggagcgaaaactcataagtatttcaaatgtcctagctgtggtcaggagttaagagttccaaagggcaatggaaaaataacaataacatgccctaaatgtaagacatcatttaaggcaaaatcatagtgtttatctttatcaaatatttgtattttataaagtaaaaaggacctttcttatatagtatttatgtattatataagggaagtcttttttattttgaaagagtatgtaaaaacaacaagaatatatgtatatatattgcaattgacaattgacagtttagaattgtcaattaaggtgaaaatccttgcagaatttttgaaattatatgcagaataattattgcaacagatatatgatttgttaaaaagagtttttgtgttgaaatgaaatttacttataagtatttatacaactatattaaagaaaatttaatatggttcgataaatattctaaaaggctaatttttagaatattatttaaaactatatttataaaacataatttgggagggaaagagtgatgaaaaaaatagtaaaaagattgcttgcactgcttatagtgtttgctagtatgttttcatttcttccattacagtttggagataatggacaagaagctaatgcagcaaatgattcaagtgtagatatatcatatgctgatttaagtctgagagttgttgggggaacatctatattagataagaagacagatgatacagtaggtaagcttccatattacaacacatcagatggtgaaaatacatttgatttaacaataagtgatttttctaaaacggaaaatcaaattaaggaagaattattaaagaagtatccagaaggtggatcaggggaaacaacatatgtatcaaatgcatacatgaacataatttctcttaataatataaaacttgcaacaagaagtggtgcagaaataccagaaggtagagatgcattagatgatttagaaataaagatggaaaaaataactccatcaggtgcattaaacagatttggtgtaagatttgacaatatgcctcttggggttgatagaattgattacaatctattaggtactgtacaaaagataaagtatacagtaaataaagaaacatcaactgttaccttagaaaaatcaggtacttatgataatgtaaatttatcagaaagcattgatagttttataataaataatggtaaagatttcgtaggtaagaatgttgagagttttacattagatcaatatgttggtaagagagacttaatagattctgaagaaactaaatataacaataaggctccattactttatacagcagaagcagaagctgatgaaactataaagatgagatatacatgggaagttccggattcattaactgcattaaactataaaatgaagttcacaatggatttatttaatactcatgataacacaaatgtatatgttaatggtacaaagggacaggggcaagcaatagattcaaatacaatttcaggtttccttaatgatttaagtaacaatgatcagtttgttgtaattaaaactaaaaatggaactgatattgctaagagttattctgcagaaataagatttccaaagaaaaagacagaaaatgacttcagtttaatagaagcaggggttttaaaagcagaatacgctaatgattcaagtgttaaagcatatattggtaagaagtttactgaaacagcaaagacagatgcagatggaaatagatatgttgaatataaaggaacaataactatagatcctaaagcaagaatggtatgtttaagacctaaagttgtttcgggagttaatgtagagtatgagttatataataattatactgtaaatgggataacaaaagcagctaaagcttatgaattaattaatggacaagcatacattgattttaatcttggtgatgaaaatgagttagaattacaaataaaagatgcatctacacaaaagcttctagctaaatatatttatacagttaagcaaagagatgatgcagaaaaagctttcaacgaaaactttatatttgatgataataattcaaatacatatttaacaagagaaggttcaaaagaaaagataagttttaaagttggtaaatctgaaaacagaagtacatttgacttatacacaaaagataaaaatgaagtaaagataactcttgacccagatggaattacaaatagtaatgaatactttaaagtatggacttcagatacattagatggtaataactttacagaagcacaagcttctattgataatgaatttgatataaatagtggtataagagatactgatttatatgttgatataagtaaagcaaagagaataatggttcaggcatattatgatgaagttacagagaaagatggcgtatacacactagtaaaaagctattctttaggttcaaagtatatattctttattcctgctaacataaattcatcagatacagatgataatcaaaaatcagataatgctgtattaagcaatattaaagtaaaaggacaaactctttacaatctagatgaagataaaaatggatttagtattgattctcgtaactatagagtaactgtgcctaaagatcaaacaacagctgtattaacagttgtaccagaagatgaaaatgtaaaatcaatagtagcaactgtttcaggtactgatacaagctatgaattatatccaggtgaagaaacagagtttatgcttaattcatcaggaataacagatcttgaaataacagtaactgcacagaatggtaagaagacagaagtttataatcttagtattataaataatagtaaaggtggaagttcaaaattaaaggatcttatattaagttcaggtgattttaactttgattcagatgtttatactacaaaggtacaagtagaacaaagtgtaaacaaaatatctataacaccaatagctgaagatagtaaagctaaaataactattaatggacaaaagtttactggaaaacctataagtgtaagtcttgcaggaaagcagactacagaagtagatatagaagttgaatcagaagatggagaaagcactacaacttatacattaaagattaagagagtaagtgtgatttcagatgatgatagtgataataatcaaggtacaactgaagatatatactatgattatgataatgactgttgggttgatacaactaagtatgatgaatggggtacaataaagaatagagttatgtacttcgataaaagaggacgtcaagttaaagatagatggatatacacaggtaagaagtggtactacttaaatgaagctggatatagagcaacaggatggaagattgatgatgaaactggccaaagatattatatggataatgtaactggtgaaatgaaaatgggctggatgaatctaaatggaagttggtactacttaggaactacaggagtaatgcatacaggatggttatggcttaataacaattggtattatttcactgaaaatggtgagatgataacaaatcagagtatggttatagatggaaagatgtatagatttgcaactgacggaagaatttattaatataaatatgaaattatatttatattaataaaatattagtatatacattatttaatattatttattaagagaattaaaagacattgtttaaattttaacctcagaaatgcatatagcatttctgaggtttttttattgttgaagaaaatcatttgattataataatctataaatttaaaaacttaaatatagaatatatatgagattgtaatataaaacaatgttgtgatattagtgaattatggggatgtgatatgtgaaataaagtgtggggttgttgtgtgaaataataggtgaaacctttttaaaaataaatgttgttaagattagaaatataatagaatgtcaataatcatagataagaaaaactatttaatataatttagttcagttatttgtggagttaattaagtttaaatattaatcgaacataaatttaatctaaatctgaatagtaattgaaaagtgtatgaaaggagttgttatctatgatagaaagagattgggaatttgagaagataaaaaaatataaagaaaatgcacttagagaaaatatttataataaggaaaatgttaaaaaatataaagaatgtccttactgtggaagcaaaagttttataaaatatggaaattataatagaattcagcgttataaatgtaaaaatgaagagtgcaaaaaaacattttcaaatacaacaaattctgtatggaagtacttaaaacataaacctgagaaatggtttgagtttattgagcttatgggtgaacacacaactttaaatgaatgtgcagctaaattagaaatatcaatagtgacagcgttttattggagacataaaatatttcatgccattgaaaataactataaaccagaaaaatttgatgaggttgtttatgtagatacttactatacagaaaaatgttataaaggaagcagaaataaaaattatacatatgctgataaagtaaaaaataaatttgataaaatgtatggacttgtacctaggaatgtaagtgtacttatagcagaagaaagagggaaaatgccattaataagaagaacagaaaatgatgaaacaatagtaaataattttaataataatgtgttgaaaattgcagctaaagattgttatatgcgtacggattattttacaaataaaaaattaaagaataatttgctacaatacaataaaaaactttcaaatgcgacaaaaaagaaatatggattaaaaattataggaaatagaatagaagataaaataaaagaagataaaaagaaaaatatcatggcttatttaactgcatggttgagccgatgtaagggaattgctacaaaatatataaaccattattataatttttattcattaattgattcagaaaaagtttttgattatatgagtatcttttttgagcttttaaaaaatggatcttatacatctgtgaatcaattgagaaaaactcatattgaaaattattaaaacatttaatataaaaagttttaattatgaagtgaataacttgtttttattaatgttatgtattcaacagtgagattatatgtatttaataacaacaattatttttaaaaaggttatgggcataaaataacattatattaggtagcttaagcttagtgaaaattggatttgagtacatatatttagaaattgaatttttaatgttgattttttatgcatataataatgatttaataagaataaaataaatagtttagtatgaataaaataaaattgacttttggaataaatgggaatataataattatagttcaaaattcgaacaaagatttactatgttatgtaaattttatttaatggcaagttatttataatagtcttaatattatttaatttttctaataagtattaagtaacttataaatatgattacttcataatgattaattaaattaagattaagaactaaattataattcttaaattacgattaataattaaattataattcttaaattgtaattattaattaacttataattagtaatttgctcataagataattaacaggttttaagggagagggtacaatgttagaagatagattagaaatattaaaaatcttaaatgaaaattttaatattaaccagagagaattatcaaaaagaacaaatatgtcacttggaaaagtgaattcagtattaaaggaatttacagaagataatttcatagatagaatagtaaataatagagggattttatataaagtaacggataagggaatgaagttcttagaagaaagcattgcaaatgcaaaaaatacaagattaaaactacatgaagaagaaaagaagatagtaaagcaagcagttatacttgcagcaggtagagcagaacactttggaaagcctgttggacttcttgaaattgaagactttaaattaatcgatagaacactaaacatactaaaggaaaatggtatcacaaaaatagttttagttacaggttatgaaagtgaacaatttgaagagtattttaaaaacagcagaaatattaaaattgtaaaaagtgatatttataaatggacaggaacaatgcattcattatcacttgctaaagaatacatagatgatgactttttattaattgaaaatgatcttatatttgaaaagagagctataaaagaactttctgaaagtccaaatagagattgtatattatttaccaatgaaagtggttcaggagatgaggcttttgttgaaataagagataatcatttatataagatgtcaaaagatatacatcaatttaatagaatagatggtgaaatgatagggcttacaaaagtttcatataagttatatgaaatgatgctagaagaatttaaggggaatgtgaatccttatttaaactatgaatatgtattattagatgttgcgagaaattataacataggatttgttaaaatagatgatcttgcatggggagatgctgattctataaaggaatatgaaaagataaagaactacttatatcctacaataagaagaagagagcttaattatgaaataaataatataaaatcaatagtgtgtgaagctttcaaagttgaagatgaagatattacagaagttactccagctggtggaatgactaacaagaattatagaatttgtgtaaaaggaacaagatatatcttaagagttgcaggaacaggaactgaacagatgattaatagaaatactgaaatgttcaactctgcaattgcttctgaaaaaggttttaatgtagaagttccatattttaatttagaaactggagtaaaaatatctaaatttatagaaaatgcagaaacattaactcatagaagtgtaaaaaaagaagaaaacctaagacaggttacaaagatattaagagatcttcatgaatcagaagatttccgtatggataatgaattcaacatgttcagggaattagaaaagtatgaagaaatattaagaaaagatgaaggacagttctttgatgattatgcacaagtaagagaaaaggtaatggcacttgaagaagaattacaaagatgtgacagagtttttgttccatcacataatgatcttgtgtctgaaaatttagttaaagatactgaaggaagaatttatcttatagattgggaatacagtggaattaatgatgatatgtgggatcttgcagcactttcattggaaaatgagttttcggaagatgatattgaattaatgttcagattatattttaatggtgaagaaccagatgaaaattctagaagaagattgttaattcatcaaatttgtcaggatactttatgggcagtatggactcttattaaagaagcagaaggcgatgattttggaacatatggaatagacagatataatagagctaaggaatatttgaaaaaattatagtttttaaattgaatcatcgttaaaaagtgtacttgacaagaaatattaatattatgatgcctaaatatagattttttatcttaaataatattgttattttaaatgtcaagaacacattttgttgtagagcctttaagcttgttaatacaagtaattcaaatgagaataaactggatatggagttggaaaaatgagagcaatattaatggcagccggaatgggcacaagacttagacctttaacagaaaatacaccaaaatcattaatagaagttaatggaatgcctctacttgaaagacagataattaatttaagagaaattggagttgaagaaattatagttttaactggatatcttcatgagaaatttgatgatatagttaaaaaatataatcttataaaagtagttaatgataaatatgatgtgtataacaacatatatactatgtatcttgtaagagattatttaaaagatgcatttgtaattgatgcagataactatattacaagaaactttttaccaaaagttcaaccaaagacatcagtttattactcagcatgtaaagaaaatataactggtgaatggatacttaaatatactgaaacaggtagaatatatgatgttgaaatagcgcctaagaattctaaagcaagttacataatgtctggtgcatcttattggacagaaaaagatgggaaaatcatttctgaaaaagttaaaaaggctgttgaagaagataagttatttgatatatattgggataatatagctgttgaaaactatgataatatgaacgtatatatagaaaaaattaatagtgatgatatatttgagatagatacacttgaagatttagattatttaaaatcaaaacttaataatatgtaatctacttaacaattaaaaatgaaatagaacagtcttaaaatatttattaaatttagatgtagaatatatattaaaaaaacatatattgaaaatctaattattcaataaaataaataactgtatagtaaaatttttaataaatcatactgaactatacaaagattaaaaagaactcttaaaattatatgagcactgaaacacttgaaattttcagtgctttataagttaaagggttctttttttatgaaacaacttaatcattttaatttgaaatgaagtattttaatttcaatatggaatctataaatcattttgaattttctttagaggaataacattatcagtaggattgttatttgataaaaactttttattgcttatcaactgtgaatatgggaattttattatatttccagagtgcgatgaagtagtatgattggaagaatatatattcataatttttattgatagtgccagtaaattaatatagtcttttgatagcagattagtgtttggaattatcttatgtgaatcatgcgatgtaaacttaagaatattttttattccccagaatttaaggtgcttttttaaagtacgacctgtagatggcaaaaggggaacataatcatttgaaattactaaacctattttatcagccattggtatgtgatttttatgtggcatccatatatatgatagatgttctataagtagcttaagtgaaggtggtagaaaacatcttcttaagctagaacatgctaaaattatcaggtcacaatcacttatagattttgctatcttgttaacagaacaaaaattaaaataatcacagtttcctataagacattgacaataatgcttacagtgaagtgaaaaatcagttggtaaaaagtattctgtacaatttattggagtatttagttttagattattaagtaaaaaattaatatggtcatatgaattattatcctttgaattgtcgtaaataatagttacattcaagcaaatcatcctttcatactatagatgtccttaaattgaaaaatgtgtttttcaacggttgagtaatcctctaaagttaccttatcatcgttatacaataataaaaaaattggtgagaaaaactgtagcgccaaaatataaggatcatttcttattaaaagatttttatccataagatagctaaaaagttttgactcgtattccaggatatcagatataaatatttttttatataatgctgataaagtgggattattaaattgctcaattgtaagcagttttctaaattttatgacattatcattttcgataaaaaattttactatctttaaagtcgtatctataaaatcaatatcacattgttttttgcgattatattttttagaaacaatcaaagaatctagatccattgcatcttttaaaaaatcctcaatgtatttggtgtttttttttattaattcatctaatatttcttgtttattttcaaaatgattatataaagaacttgccttaataccaacatcagaagcgatgtgtcttacggaaacagctttatatccttttgtagaaaatagtgttaaggccacagataaaatcttttctttagtattcattctaaatctcctaactaaataatagattaattaaaccttatatattataaaattaaacacaaaataccaatattatatatttgtgtttaaaaaaatccataagaaaataaggtgtttttcagtttttcttcaaactaacaaacgttagtttaattataccctaaaaatagtaagaagtccattatttttacaaaaaagttaaataaaaaatggaaatagaaaaagagctgtaagtatagatttaaaaacataaaaataggtatttatttgggggataatgacatgaaaaatataagtatcaaaaaagcattttcttcatatttggatttgttattttctttcatatacctaaagaaattgacaatatattttataaaatgtaaacttgtataagataaaatatagaaacaaataagttgaaaagtgtggaggctaattacaatggctaaatctatgtcaaaaaacgctatatttaaagcgatgttaaacttattcaatataatacttcctattatggtaattccacttgtaactagatcagtaggcccagatctttatgggtacatggggtatggagattcattaactgcatatttccttatctttgcaagctttgggatatatcagtatggacttagagagataagtaaagtacgtgatgataaaaagaaattaagacaaactttcaccagtttatgtttatttacatttatgactaatataattgcatcagctgtatatatgatctttgtagcagtttcatatagagataaaccatatatgtacacttgcataattatgggctttaatttagtttttaatatgttctatgttgaatgggtaaatgaagctctagagaattatgattttattgcaataaagactatgatagtaagaatagtatattctgcattaatcttgctatttgtaagaagtgataaggattatttattctatttatatttagttgtaggttttaactttatcaataatataataagttttgtctatgtaaagaagagaattaaatttgatttttcagacctccagtttgcaaaacatataagaccgatgctttatgttgtaatattgtcaaatacaggagtgttatatactcagcttgataaaataatgattaagagtaactctggaacaacagatgtaggatactattatacagcccagagaataatgacaataataaatacattaatgcttacagtcattcaagttactatgccaagattatcaaattacctgggaaatgaatcgaaaaaagagtatttaagtcttcttaaaagagttataaagatttactttctattcttattcccagcctcaataggtcttttatgcctttcaaaagaagcaatatatatgtttggtggagcaaagttcttaccagcagttcctgtaatggtagtgtttgcaatatatatgcttagtataggtgtggaaggcgtaattgcaaatcagatgatatatcttcatggtagggaaaaagatgatgcaatgttagtattaattggaggagtaattaacttaggattaaatgtacttttagttgtgaccggaacatttaatatggtaactgctatatccactacactgattgctaatttaatagttattttccttgaatacaggctagtccgaaaagtaataaagctggatattgaattatttgcatatgaaaatacaaagtatttgttgtattctcttatatttataccgattacatttgtaataaagaaatttgtaggaaatatttttatatgctgcattttagaagttatggcatgcggtcttgcatatttagcaatattaataataacaaaagatgaaactttctttgaattatcacataaaattttaagaaaatttaaaattataaagtaatcaattttaagatgaaaaaataagcttttatgaggtattatatagatatttcgtagaagcttattcttattataaaacaatgataaaatatggtcgtatataatagcaaaacccatcgaatgctgtgagttgtaaaaaaataagtatattatataatatagttatggtaaaaattaacaaaaggtgggaggggttattttatggaaaaaaatttattgcggtatttttctttactagtagtttctttttcgattactacatgtgtatcttttaatacttcagaaagggcttattgtgcagaaagtaaatctgatgatttattgaaagatgaaatcgcaaatcagactttcaatacaaaggatatatacaattttagaataaaaacaggagagccactagtaattactagcaaagatcataatgagtttaaagctgatgttataaataatcaatataaggttcaaatacagtttgacactaaagagggtgttgatataagcaattatattgttgttgggacagataattcaatagtgggatcaatatctaatgagcgaccatatgttttagatgttaacttaaaaaagggagaaaatccaataagaataataaataaacttactaatgatgaaatgtacaaattcaatattaattataaggaaattaaagtgacaggacttcagaatgttaaaaaggttggagatagcagcaaaattgaagctgttttagatgaaaaaatatataatcatgttatttggagtactagtgaaaataatagtattgttgttaacagtaatggagaagtaaccgctgtccaaagtggaatagcatgtgttaatggagctatttatgatgaaagtgataaaaatataattggaagcataactgttgatttttatatatctggtgatgttatgactggatggattaaaaatggagaggtatggtactatttagatggtaaaacaaatgagctaaaacgtggctggctagaagataaaggtgactggtactattttaatgaagatgggtcattatataggggatggactcagcaggatggagtctggtattacttaaaacagacaggaaatatggcagtgggatggtttaaagatgatggaaactggtattatagtgatttaaatggtgcaatgagaacaggatggtttaaagatcatggaaattggtattatttaaatgaaaatggacaaatgcaaacaagtgatttaaatatagatggtattttatttagatttaataaaaatggtgaattacagcttgattagattttatgcttacaatcaaaagtatgattttatattttgattgtaagcataatatttagtttatattaaggaaaagtgttgatcatatatcatataataatggaactcctgaaaatgagttccattatttcatatttcgcaagttaataacattgagaattatctctttttaagtattaaagtcgataaaagaaatttaaaaaatagccatttgatcttgaaagcttatccatttcttttaagatttcaccggctctatctccaatagtgaccttttcaataaaaattattcgataaattgcaccgactaaatgctgtaaaacaacctggggaatttcacctttactcaattcattttgttctttcaatataatatcatcaataattttgtttttaggttcgtacatttctttaaattcatttaataaaagttctgcctgttcatctatctttctttttttcattaaataattacctcactatctctaaaaatcatagtctaaattaacaattgtacataataatgtacaattgttaatttgtttaattatatacctcataagtgcatatattcaaatatttagtataaccatatataaattgtttctgtaaatataaaatcttttaatgctgattttatgtgctttacaagggatagtaagggttatatttataaaaagaataagctatgtattagttatggaatgcttaatattcagaggaatatatctagtatctataaatattataggaaaaatattgaaaaaaatacaaaaaaagcttgaaaaatattctaaatagttatattatacaaatataaagatgaaaacgttaaacagaatgttgttgtacatagtggtgataaataatttaaatactttgtttttaagttaataatattataattattgacttttaatatatttctatagcaataaaataaacaagattatattgttatagcatccatcatagaaaggaggaaaaataagtattagtaaatttacttttttattgtaaagttgagggggagcaagaatgaaaggtaaaaaattgagaaacattatttcagcagctatagtttgtgctagtgtattgactttaacaccagtagaagcttctattgggaaaactggtaacggtaccgaaaaaccattttcttgggataatgcaactgtatattttgcattaacagacagatttaataatggtgattcatctaatgattactcttatggaagaggtcttgatcaaaatggaaagatacaagatggttataaaggcaatccaggtgcgtttcaaggtggagacttaaaaggacttactgaaaagattgaagaaggatatttcgatgacttaggtgttaatgcaatatggattactgcaccatatgaacagatacatggatttacatcaggtaatgatgcagggggaaatgcaacaagtaatggtaaaggttttccttattattcataccatggttattgggcattggattattctaatattgatgcaaatatggggacgaaagatgatttgaaaaaatttgtagatactgctcatgctcatggaataagagttgttatggatatagtattaaaccatgttggatatacaactatgaaagatgctgatgaatatggatttggagggcttaaagatggatggaaagattattattatggtcctctaacaaatttagttggaggtggcacagaggatacaacttattatgataaaacatctccaaactggaagaataattggtggggtcctgactttgtaagaagttcagcaggatatgacggatatcctcagacaccacagggagatggatggacatcatccctttgtggtttaccagacgtaaagacagaaagcactaaagaagtagaactacctccattacttgaaaataagtggaaagcagaaggcagatacgatgaagaaatggcaagtttaaataaattctttagtgaaagaaatcttccaaaaactcctagaaactatattattaaatggttaacagactatataagagattatggaattgatggatttagatgtgatactgcaaatcaagtagatttagattcatgggctgctttaaataaagaagcacgtgttgcatttgatgaatacaaagaaaagaatcaagacaaagttttagatgaaaatgctgaattttggacagtaggtgaatcttggggacatggagtaaagaaggatgcattttttactgaaggtggatttagcgcaatgattaactttggatttaagggtgcaaagatatctaaccttaaaggaatttatgataacttaagtagtgtaaataatgatgatgattttaatgttttaagttatatatcttctcacgatgactcattatatgacagaaaaagcttaaaggatggtggaactgctttattacttgcaccaggtgctgtacaaatcttctatggtgatgaatcaggaagacctcttaaatggacagatagatttacaagtgattataaagatcagtgtttccgtagttttatgaactgggatgatattaataatccaaatagtgatgcagctaagacattagaacactggcagaaagttggagattttagaaataatcaccttgctgtaggtgcaggacaaaatattactttaaatgaaagtccatatacatttggaagagtgtatagtaaaaatggaattatggataaggttgtctgcgtagttggggcatctggagagacaagcgtaaatgtaaatggtgtatttaatgatggagcaaaagttaaagatgcatatactggtaacgtttccgtagttaaagatggtaaggttaactttaaagctgatgaaaatggagttatattaatcgaaaaaggtgataatgctccagatgtttcaataagcaaaattagcagtgagtattattctgatactttagatttaactttaagtgttagtggagctgatactggtagttattctattgatggaaaagaacctgtaaaatttaaaaatggagatgtaataacaattggaaaagacacatcatatgatgtgaaaactacagtttcagtttatgcatccaattctgatggggaagcatctcagacatataattatacaaagagaaatcctaattttacaacaaaggtttatgtacaaaagccagatagctggagtggcttaaatgcttatgtgtacaataaagatggaagtactacaaatgaggtaaaggcttggccaggagttcctatgactaaggaaagtgatggtctttatagttatagtttaccaacaggatttagagatgcaaaaataattttaaatgatggaaagcatcaagatccaggtgttggacaggatggatattcattaaaaaatggaagtaagatgttatatgaaaatgggatttggagtgagtatgttgaatcagataaaccacaagcgtcagtttcaaaagaaaattgtgaattcaaagattcattaacattaacacttggaagcaaaaatggaacaaaatcaacttattcaataaatggtagtgaagaaattgaatataaagatggagataaaattacaataggtgaagatgcaaaaccaggagatacaattaaagttacattaaaagttagtgatggaacagatacagatgtaaagagctatacttatacaaaagcagctgaagttgcagaatcaaaaatatactgcaagatacctaatggatggagtaatgttaaggcatatatctataatgaaaatgtaactcctaagaaagaactagcatcatggccaggtgttgcaatgactaaagaaagcgatggcttatatagttatacacttaaggactgggaagaagatgcttatgtaatatttactgatggtaaaaatcaaacaccagcagttggacaaaaaggatttaaattaacaaatggtagtaatatgatttatgataatggaagttggagtaaatacgaagaaaaaataaatccttgtgcatcaatttcaaaagaagattgtgaatttgatgattcattaacattgacacttggaagtaaaaatggaacaaaatcaacttattcaataaatggtagtgaagaaattgaatataaagatggagataagatcacaataggagaaaatgcacaaccaggagaggcaattaaattaacattaaaggttagcaatggaacaaacacagatgtgaaaaattacacttatactaaggcagctaaaatagcagagtcaaaaatatattgtaaagcaccagatggttggagcagcgtaaaagtatatatttataatgaagatgtaagtcctaaaaaagaactagcatcatggccaggtgttacaatgactaaagaaagtaatggtttatatagctatacacttaaagattgggaacaagatgcttatgtaattttcacagatggtaagaatcaaaatccaggagttggacaaaaaggatttaaacttacaaatggaaataagatgatttatgaaaatggttcatggactcaatataataactaatatatgtaaattgattagcttgttaataaaataaaaatttaataagagtatgtagacaaattctacatactcttattattgtgaagtgcgttaagtgtataatcatgtaattcttgcttatgaaatttatcagactgaagaaagtgagcatagaagatatctaccattactaagatagggaactgtggagaaatggctttcccattatctaaatgctcttttacagctaaaaggataatttcatcacaaaattcttcaaattctttttcttttcttgaagttatcaaaactgtagtggcattacgagattttgcggctcttaatgaatctaaaacctcatcagtttttccactaacacttattccgattacaagacagtcagaatttaaaagaacaaagttcattttcataatatgactatcaacaatagattcaatattaacaccgattctcataaagcggagtttaatttcttgtgctgcaagtgcagaactacctcttccatatacataaactcttttcttttgattaaagagttttgtgattctcaccatttgctcttcatccaaaagagcataacttttatttaaaagttcctgataggtatctaatacttgttttgtataattagtagtaacattagagggtttttctacgaaattttgttcatataaaaatatgaattctctatatcctttgaagccacattttttagaaaatctagagagagcagcttcagaaacaaatagtttcttagaaatatttttagaagaaaaatctattttttctgtgttgtgaataaaaaaattagcaattgttttttcaagtggcgtaaaattttcatataacgattcaatttttggaattatagttttttcatactgttgcatttttattgactccaaatcctataaaaagttaatgtgaatctgctttttttatttaatgatttaatccttgtggatgcttatgaagttataataagcaccaagcattcccgccttattttggttcttagcaaattctaatttagtttttgaacttatagtgggaataagatatttatcaagacttaatcttattttatcatataaataatctttttgtgccataattccaccaccaagcacaacaacttctggatttattacataacatatgttggctattcccatgcctagaacatcaaccatttcatctattgcttttatacagtcttcatcgttatttttagccatttcaaagattagttttccatcaatatgattttcactgcaattttttagttttgcaactttttttactaaaatactggttgcacctagatcttcaaatttacccttaaacatgttcatgtagccaacttcacaagcacttccagaaaatccgtgaaaaactctatcattgattattatagagccacctataccagttccgatagtaaggcatagacttatagaacttccttttgcacttcctgaaaaatattcagctaaacctgcacaattaacatcattttctacttcacatggaattgaaaaaatatcttcaagagtttttttgatttgtgttcctgtataatttggtattaaatctgaagcatgtattatttcacctttttcacaatcaaccataccagctgtagatatacagataccagaaacagtatattcttttttatattcagatactatatttataactttttctagaatgtttttaccgcctttttgtgcttcagttgctacttcaccagaggttataaattttatattttcatctaagataccatgctttatagatgttcctccaatatcaattgaaacatagaatttcattttaaacacctgctttcttataattatataattttaagtaacaattataatattttcagtttttatctgtaaaaactgaaaagtctttgctttaataaagattaataattataatagattaatttgtaattatagattaataagggagtactataaattgctttatagtatcccttaaaataaattttagataataattttaaaaatagctttttttattgtaactggttcatttacacatattgcagttttatgtgcatcatttgggtagcagattaaaaaatcatctttatgtaaaattacatgagaattttcttgtccttctaaaggaagaaagtcatctttttctacaaattctttttgttccatgttatcaataaaatttaaattaatttgttcaataccattaagcataaggtgtaagtcaagatattgtctgtgtgcttcccaaaaacgattttcactgtctgttgttgtatattctactatatttacaaaaaggttttctccatcaattttgtaggttcctttttcgtaagtgtttaaatcattagcttttgcatattcaaagcatttctttatattgtcttttaaataatcaaattcatttaaattctttatatttccaaatatcatattcaacacctcttaataattataaatttatgtatgttattatttgttatatatagttgcatccatattaggaactgaaacgtcattactaagttttcttgtaatgtagcttacaggaattccaactatcaatgaaacagaaactgaaattatagagtatgaccaaattgatacttctggcattttgtatttaacaattatcataacaattgatgctacagtaagtgctgcaaaagctccagctttatttgcaacttttgtaaatgttccaagtacaaaagttccaccaagtacacctaaaacaagtcccatgaagccgttgaaccattcatatgcagatttaacttctccatttgcaagaaccattgatactaaaattgcgattataccaacacctaatgaaatgtattgtgcaatttttgtttgaagttcaaaactcatttcttttttagttaaacgtgtctgaatatcaagtgtccagcttgtagcaactgaatttaatccagttgaaagtgtagattgtgaagctgcataaatggctgctaatagtaatcctgtaataccaacgggtagttgataagcgatatatgaagcaaatatttgatctctttgtactgtttgagctaattcaggattttgattgtaaaatacatataatccagttccgattaagtaaaatacagttgcaataaatatagacaaagctccatttgttaacatcattttatttaattttttagtatctgttgtcgttgtgaaacgttgaactatatcttggcttgaaatatatgaagaacaagtgttaataccagcgcccacaaggataataaataaactgttttttaatatattaggatcaaatataacttcatcagcacctataaatttaccatttgctaaagagtcaaaaattgaaccaaatccaccattaataccatttgctagatagaaaagagcaaatgtaacaccaattaataagactgtaccttgtatgaaatctgtccaaagaacagattttaaacctccagtataagaataaataattgcgataacacccataacgataattaaaaggtttacattaagtccagtcaagtgtgataataccattgatggtaagtacattattatagacatacgtcctatttgatatattataaataatacagcacctaaaattcgtagtgctttacttttaaaccttatttcaagataatgataagctgtatctatgtctaatttactataaataggcaagaaaaacttgattgttattggaattgctaaaatcatacctaattgagcaaaccacatgatccaagtacctgcaaaggagttacctgctaatgataaaaaggaaatagggcttagtaatgttgcaaatattgatacgcttgtaacccaccaaggaattgttccgtcacctttgaagaattctttacctttcatttcttttttagagaagtatagaccagcgaataaaacagctgctaaataaatcactaaaattgctaaatctatttttgtaaaaccttgcataaattaagtcctcctacttgatgatttttcttaagtatattgtgtatagcagaaaaataattaagttatttttctgctatatatttaaattgttagattatgagattaatattaagttgtaaatttatgagagtatgagattaatattaagttgtaaaatttttagtttgatatatattaaaaaggggatggctattttaagtacttatcaaagatttctttggctacagctacttgtttttcatttgcactagccattggtctatgacagtatccagaattaacacctgataattttaataattcttttatagttggatataatccatttccaagaattgcagatattaaatcgttagttacatgttggatttctaatgcttcattaattttaccttcttttgctaattcaaaaatttgtcttgcacgaattccgtttacgttgaaagtagaaccaatagcaccatcaacaccaagaacagttgcaggtagcatcatttcatcaaatccagcataaattaagtgatctggatatgcttttctaagtctttctagtaagtagaaatctgcagcagtgaatttaacaccaataatcttttcattctcaaataattcaccaaattgttctacactcatatcaacaccagttaagaatggaattgaataaattataaggcggttatccacgctatttataattgtgttgtagtaatctttgatttcatcaaaagagaatttatagtaaaatggtgtaacagcagatattgcatcatagcctaaatcagtaacaaattttgcaagttcaacactttcatatacattgatagacccaacttgagctataagtttaatttcatcttttgcttcatcttttgcaattttgaaaatttcctttttttcttcagtagaaagcataaagttttcaccagtacttcctccaatatataatccgtcaactttcattttatctatgttatgacgaattatttcacgtactccttgttcatttatttttccattttcatcaaatgaaactaatagtgcactataaatacctttcatatcttgattgtttttcataataatcagcatcccttctattattcatataaatttatatttaattatttattaactttttatctattgttttctaaagcatgtacaaaggatttagtaatgagttgtggacgggtaattatagatcctacaactacactaaagcatccaagttcaatgactctttttgctttttcaggggtatttatattaccttctgcaattaccttatttgatactttagagataatatctctaattatttcaaaatcgttatcttctatgtgataacctttactttgatctgtgtatccaactaaagtagttcctataaaatcaaatcctaatttgtcagcataaactgcttcttcaacagttgagcaatcagccattaatttttgattaggatatttttttcttatcatattataaaattcatttaatgtaatattgccaggtcttaaatcttttgtagcatcaagtgctatgatatctgggctaacttccataagttcgtctatttctttcattgttggtgttatataaactttactgtcagcataatctttttttacaattccgatgattggtaaatcaactatcttttttatttctgcaatatcttctttagtatttgctctaataccagcagcaccaccttcttttgcagctcgtgccatacggcccataataaatgaagaatgtagtggttcatttggaagagcttgacaagaaactattaatctagcttttaaactatctagattatgattcatatttctcagctcctttcttgaagtattttgtaactatagtataaatactattgaaaatattttcaataatttttaggttttagaaagtactttctaaaacaagctatttatcattagaaattaaaaataattgaaagaacttacaaaagttatttttttctttgctgaacatattgaattgaacattgaacaatgataagataattttgttcataaaatgaactttatattttgaacaaaaaaggttcaaataagatttaagttttatttgaatcaaaatatattattgatatgtgtttcatcattaaataataatgatatcagcatattgcaagcatattagaaattttggtcaagcattgttcttaatattgagagttttattttaagtttaaaatattgtatgaatattttttataattaataagaatgatatttatgaatgaaagtataagagacaatataacaattataaattaagggggattatacatgttaaacagtaaaagcaattataaaatcggagttatgagtggtgttatatcagctgcaacatggggattggatacagttttaatgtcattagttcttgcaatgactccatttttaccaaaggaagcagtattcttagcaccgtttgtaacagcatttttccatgatgtattctcagcaatttggacattcttatatcttgcaggtaaaaggcagcttggaagtttatttaaagcaatgagaacaaaaagtgcaatgtttgttgtaatagcagcacttatgggtggaccaataggaatgactggatatttacttgcagtaaaacttatagggccatcttatacagctattatatcttcattatatccagcagttggagctattttatcttattttattttaaaagagaaattaaataaaaaagcgtggatcggattactttttgcaatagtaggagttacagttcttggatattcttcaggtgaagcaggaataagtatagcaggatttttatgtgctttcctttgtgtaataggatggggaagtgaatgtgtaatttgtgcatatggtatgaaagatgatgaagtgagttcagaatttgctcttcagataagacaacttacttcagctgtagtatatggaattcttatagttccaatagtaggtggaatcggattaagctttgatattttaagaacaaatgtaatctggtggattgcagcaactgcattaagtggaacaatatcatatttattctactacaatgcaatatatagaataggaccaacaagagcaatgggaataaatataacatatgtagtatggtcaatagtgtttgatagattcataaatggaacagaaataagtttaaaaacaatattatgtagtatcttagttattgtaggagtttattttgttgctaaagaagcagatgtggaagaagatggggagaatgctgaagtagcagaagtataatgtaattataaaagatagatattaactaacacaaactattataatttattgagacttaggtgaaaatattatttattaaaatttagaattactcaaaagtatcaaaatataatttcaacattatattttgatactttttttattctttatgaaattatattgaggtaaaatcttaggataattttgaatattaaaaaagttgtattattaactttaaatatataaattgtaaaaaagttcaaaatcatatattatgaattgtaaataaaaaaatatattatgtatgggattataaatatgtactctaatatgttgcattaagacaagtatatttaatgttaaatataaacttaagttatgggaaacataggggttcaaactatgcctaatagtagtaatattataaatagaaaagagtgagtttatgagtatttcagttagtgaaagttttttgaaaaatgatctatattcaactaagagtaaaagaagggatttaaataaaataaaattactgtttgattatagtaaaagaaataattttactatagatgatcaaacctggaatgatttaataatggataatgtatttaatgaattggattcaacttactcagcagaaggtgaagcagctttatatagaatgcttagaaatccaattattaatgaagaagagcttaataaaagaggaaagttaattgatttatttaaaaaagatacaaagttaacagtaaatttaagaagaatattttttgaaatgcgttatgataaaaaaaatagattaattgaaatgataagcggattgctttcagtgagcaaattaaaatattatttgtatactattttcggattaactcctatactttgggttttagcagcaataatattgagagagcctaaaatgattataatattaatgttcgatatatatataaagatatatgtacacaataaagagcgtgatactataaatgccataggaattgtttatttaagagaactaataaatgcaggacaaatattatgtaataataagaatgatgaagttaaatcctatactggaaaaataaaagaaatattaaatgatttaaacactatagataaatcaacatatttacttaaacttactaattctttttggggaattatagacatgctttctgttcctttttttatacaagaaagtatatattataaaataagcggaaaattaatagaaaaaaaggatacaatattagaattatattatttagtaggagagattgatgctttagtttcaattgcaatttatcaaagtaataatgagggtaaatatagcaagcctaaatttatcaaggaaacttcattaaaaataaaagatggggtacatccattgcttaagaatccagtttcaaattccattgaaatatcaggaaaaggtgtcgtattaactggaacaaatatgtctggtaaatcaacttttttaaggatggtgagtacaaacatactttttgcacaaacttttaattttattttaggaaaagaatatgaagcctgtttttttaatatggtatcatcaataagtcctaaagacgatattgttaatggaaagagttattacttgtctgaagcagaatcaattctaagaataataaaagcttctcaaaaggatattccagtattttgcccaatagatgaaatctttagaggaacaaatccaattgaaagaattgcttcctcagcagaaatacttagatatcttaataaaggaaatgctatttgtatcgttgctactcatgatagggaaatttcagatatgttaaaagaaaattatgatttctattattttagtgaagaagtagatagtaaaagtggattaaaatttgattataaattaaaaagaggagtatctaaaacaagaaatgcaattaagcttttagagtatataggatatccaaaagaaataatagaaaactcatatataagaatgaaaaaaattgaaggttttgtttaaagaatgactaggattaatgttaatttataataaaaacttaattataaataaatgttggtagaatcagttatttatcaaatgatagaactaaggatatattttttataattagaaactcacattattataattatttagtatttattttttgaaaatctaagttgaatatatttaccaacatttaactttaaaaaagtttttatataaaatataggatatatactgggtataatatttaaaattagaaaaagcaaaggagccgatttggcagacctttgctttttgctttttaagtaaaaataaaaaaagaaaattgattgtataaggaattacgggcattttacaaggttttctctttaaaaaacgtattgtttttttataaaacaaatgacttttaatacattgatgttccaaaattgtagaaattgaagtatttatcttaagaatatgatattttatatacaagaaatgaaaagcatttcaaaagatgttggaatatatacatgtacataaaaataatgtaattcatttaaggaattgtgtaagattttaactctaattgaaatttagaaattagaaattataaattgttaattaaataagatatacaaaattaagggggacacagtcatgaaaaaagggaaaattaaaatagcaactattggtggaggatcaagttatactcctgaattaattgaaggatttattaagagaaaagatgaacttccaataagtgaattatggcttgttgatattgaagaaggaagagaaaaacttgaaatagtaggagaaatggcaaaaagaatggttaaggccgcaggtcttgattggaaagtgtatcttacattagatagaagagaagctttaaaagatgctgatttcgtatcaactcagttcagagtaggtcttttagatgcaagaataaaagatgaaagaattcctttaagtcatggaataatcggtcaagaaactaatggtgcagggggaatgtttaaagcctttagaacaattccagtaatattagatataattgatgatatgagagaattatgtcctaatgcatggcttgttaactttacaaatccatcaggtatggtaactgaagctgcaataaaatatggtggatgggaaagaactgtaggtttatgtaatgttcctataaactgtatgcatataggtgctaaagttcttgatttacaaccagaagatttaatattcaaatttgcaggcttaaatcatttccactggcacagagtttgggataagaatggaactgaaagaactggagaaataattgaaaagctatatcatcctgaaaagagagttgaaatgaaggatgcaggagttgcaaatataaaagatattcaatttaactatgaacagatagaagatttaggaatattaccttgtccatatcatagatattactacagtacagatgatatgttaaaggatgaacttgaagaatttaagaagggtgaaacaagagcagaagtagttaagaaaacagaagcagaattattcgaattatataaagatcctaagcttgactacaaacctgaacagcttactaagagaggtggaactcactatagtgatgcggcatgtgagcttatagcatctattcataatgataagcacacaagaatggtagtaagtactaagaataatggtgctatttctgatttaccatatgattcaatagtagaggtatcaagtataataacagcagaaggtccacagcctataacatggggagcatttaagtctgcaccaagaggtatggttcaagttatgaagtctatggaagaacttacaatttcagcagcggtaactggaaattataatagagcacttcaggcatttacaagcaatccattagttccaagtggtgaaatggcaaaatcattattggatgaaatgcttgttgcacatgaaaaacatcttccacaatttgctgatagaataaaagaaatagaaagataaatttgtgtaaactcacaatttactaagataaaaatagaatgatatatttatagatgtattatagataaatgtattgaaaaatatgtttgtatggcatctatagaacctatctaaactatgaaaaaagatttaaatacagataatactcaaattgtactgcagttttgagtgttatctgtatttttatgtttaaaattaaggttaaaaacatactgttttacaaaaaaacaaataactatagtatgaaatatgtaactaaattactgttttgtatttattttatgtacagttatgatactgtatagatataggttatgtaaacaattaaataaaaaaatatatattgcaatttacagttgagaattgacaattaatgtgaaaattcttaaataatttttgaaattatatgcagaataattattgcaacatatatatctaaattataaatagaaaatgggggagtgtcatatgctaaaagaatatactaataagtttccaaaggaatttttatggggaggagctacagctgcaaaccaatttgaaggtggttatagagaaggcggcaagggcttaagcacatcagatgtattaacaggtggtactcacactataccaagaagaattacaccggaattagaagaaggaacatattatccaagtcatgttgctattgatttttatcacagatataaagaagatatagcactatttgctgaaatgggatttaaaacttttagaatgtctattaactggacaagaatattcccaaatggtgatgaacttgaaccaaatgaagaaggattaaaattttatgaagatgtatttaaagaattaaagaaatataatatagaaccgttagttacaatatcacattatgagtttccatatggattgactaaaaagtatgatggaagaggatgggcagaaagagaagtcattgactgttatttaagatattgcaaagcaatctttacaagatacaaggatttagtaaagtattggttaacatttaatgagataaatatattagcaagaccttttggatcattttttggaggcggtatgcttcttgatccaaaaggaggcccaataaatgaaattaaagataatgaggaaatgagattccaagctcttcatcatcaatttatagctagtgcaaaagcagtaaagatgggacatgaaattaattctgattttaagattggatgtatgattgcatatgaagcaatatatccatatacttgtcacccagaggatgtaatattagctcagactaaagaagaaataagtaattatttctgtagtgatgttcaggtaagaggagaatatccacattttgcagcaagatactttaaagaacataacattaatattaaaattgaagatggagatttagaaattttaaaagaaggaacagtagattattatactttcagttactatatgtcaggatgtgaaagtgctcatccagaagaggttgaaaacattggaggaaatatgactcttggattaaagaacccatatttaaaggcaagtgactggggatggcaagtagatccagtaggacttagaacagttcttaataaaatttatgcaagatataatattccacttatggttgttgaaaatggatttggagcagtagatcaaatagaatctgatggatcaattaatgatgactatagaattgattacctaagagagcacatagaacaaatgagagaatcaatagaggatggtgtagatctcattggatacactacatggggatgtatagaccttgtaagtgctggtactggtgagatgaagaaacgttatggattcatttatgttgataagaacaatgatggtacaggaaatctagatagatacaagaagaagagcttctattggtataaaaatgttataagaactaatggtgaggaactttggtcaaattaaatttaaaatataaaaagaattcagtaaaattgaattttttacacaaattatagtgtgaaaattgaaagcattaaattattaaatttaaaggatatatgaaagtgattttaaatagggaattctagttttagaattccttattttatttttttatgttatggtaaaataagtgattaaatatacaatataattcattagggggaaatacgatgataaaattgatagcatctgatatggatggaacattaataaatagtgatcacactatatcacaagaaaatttagaagcaattaaggaagctgaaagcagaggtataaagtttgctatagttactggacgagcttatgatgatgtacgtcctttgattgatgaatataatttagattgcgaatgtgttgctctaaatggtggagaatattatgataaagctggtaatgttatagaaggaatttatatagataagaataaagtaagagaaattcttaatgttatgatgactggagagttttcagtagaaatatacactgataaaggttactatactacaaatactgaagaagaaactctaagaggaatgataagaagagcaaaaacatttcataaggatttaaatagtgacagcgaatatataaagtttgcaagggcaaatcctcattttattaatatgaattatattactgatatagatgagtttttaaaaagtgatgtcaaaatagcaaagttcgttacatttggtgaaagtgaaaaggaagttatagaacttagaaaaaaattagaaaagcttagtggattagctatttcatcaagctttataactaatattgaagttaatgatagtaaagcaactaagggagctatacttgctaaggttatagaaaagtttggacttaatagagaacaagttcttgttttaggggatggattaaatgactattctatgtttaaggaatttccaaattgtattgctatggaaaatgccatacctgaaataaaagaaattgctaaatatgttactgaatcaaatgatgatgcaggtgttggaaaggcaattaatcgtgtacttaatggagaaatagaataattgtaattttttaatatctataaattcaaaattatacaaaagaaattatgcgaaaattgtgaaaattaccgaaattattgaaaaacgcgtgttataatggtaatatgtgaaatgtattgtaatttataagggatataaatttaattacaattataataatttaataagtattaatggcaaaattagagaaatctaatgacgcaaagctaaaggagctaaggttaaaaaactatgctagccagttgctaacaattaatcaagattattgtatcaaattaactaattaagtttagcaacgctgtctattttttatggatagcgttttttattgttttactatttgtgcagtgatgatacagtaatttaggttgtccataattttatgaaaacctagaagtatttagtctacgcaacagatttttggtgatttatgtcaatgatacttataaaaaatccaagaaaaacttttataaatcaaaaattgcactctatatattaattttttatagatgatattagtgacttttaaaggtgaattcgtttggattttaaattaaaagtaacaaatgtgtgtaaatagaataaatactctaagcataaattatggagtattaacgaaaggggagaatataaaaaactacagaataagggaaaatataaaatagggggaaatttagttaaatgaaaaagattttaaactttaaattcaatttaaaagacaaaacatcaattaaaagaagattattaactacgcttttaccaatagtaatagtaggtttactaatacttacaatgtgtacgtttattggcgtaaacgtgtatgtgaaaaatgatcttattggattaatggctgaaaaacaagatgaagcagtaaataatattgattcatggattcagacaaggcttgcagaggttcaggaatcttcatacaatacagaattaagaaaaatggcaagtgattatgaagatgtagatttacataatgaagaaataactaataagatagatgaaataaatacagcaagatggaattttgtaaattcaaagtatcctaatgaatatgcagcaatacatgtattgtcagcaattgataaaaatcaatggaaagattcaagtaatgcagataaattattagcacgatactataatgtcagcgctggtaaaaatgctacatcaccatgggcaagtgggattgttgcagaggcatttgaaaaatactcagctacaggtgagccttatgatacaatattcagacctacatattcagaagcatataaaagtaatgtagtaatgatgttttcatgggtaaaagattatatgaataatattaatcttggagtagcagcaagtataaagatagaaaccgttgagaaaaaagtaagtgatttaaagtatggtgataagggttacagcatgcttattggaaacgatggaacatttatagtacatcctaatgctgattatattcttaaaacaaagataaatgaccttaatgataaagaaatgattaacttatctaatgctatgagctcacaagataagggaacagtaaaattaggacatggattaaataaaaagattgcattttatgaaaaagttgaatcaactggatggacagttgtaaacgtagtttatgaaagagaacttttcaaagttttaaatataataatattattaatttcacttatttctgtagcgttaatagtagcaatatctatggctatatacaaaaatgtaactaaggttcttatgccattagatgatataagtttatttgcagataaggttgcacaaggaaacttaagtgatactattgaaattaatacagatgatgaaataggaaaagtagcaaaagcatttaatattacagttgaaaatttaagaaattacatattagaaatagataagacattaaatagtatagctgaaggaaatctggatgtttcattagaaaatgaatataaaggtgattttataggaattaagaattctttagtaaatataatatcatctatgaatgaagtatttagagaaataggcgaagcaacttctcaagtaaagggtggttcagagcaaatagcttcaacttctcaaactatatcacaaggtgctgcagatcaagcaagtggaattgaagaattaacagcttctattaatgaaataaatgaaaaggtgcaaaaatctacaggacatgcaaaagagacaaatgtaatagtagaaaatttaggacttcaaataaaagaaagcaatgataagatggaatcaatgcttatggcaatggatgaaatggaagttgcatctaagaatataaaagaagtaataattactatagataacatagcagaacaaacaaatcttttagctcttaatgcagctattgaagccgctagagcaggagaagcaggaaaaggatttgctgtagttgcagaagaagtaagaaaacttgcagaggaaagttctaatgcagttaagaatacagcagaattaattgaagcatcaataaaatcagttgaaggcggaaagtatatagctgatacaacagcacaatcattaaaagaagttgtggaaaatacaaagaatgctattgaacttgtggataatataacaagagcgtcagaagaacaatctgtagcaatacaacaggtaaatggtggaatagatcaaatagcagatgtagttcaatcaaatttagcaatagcagaagaaagtgcagcagctagtgaagaattatctgcacaggcagaaactttagaaagtatgattagtaaatttaaattaaaatagtctattaaattttcttaaatttaaatgaaatatttttaagtgagaattataaaggtaaaagggagcagttttctgcccccttttattttatagttaaatacatgtaccacttgaatttacataatacccatcaatccatgtatcatgtgccattttaccatcgctgtagttaaaatagtaccagtttccattaattctattccaaccctttttcattaaaccttcaagtccaccatcatcagatttattgaagtaataccatgaattttgcaagtactgccagcctgtaaccattgatccagagttgtttaagtaataatatgctccgtctaaatttataaatccagtagccatcgttccgtcgctatacatatagtaccaatttccatcatcataaagccatgatgttctcatgaatccagcaactttatcaccatctccagattggttaaaataataccagttattattgatatttttccatccaacaattaaatttccaaagttatttccagatgaagggtcaaagtaatattttgttccatttaaatctataaatccagttgcaagctgtccgttactatagaaataatattttttgccatctaagtccatccagccagtctgtagttctcccttagagtttttgtaaaatattttatctccagattcagtagcttttccccatccatatggtttatttcttaacaataagttgaggttgtcttcttgtgcagttttaagaggcttaataagactattgtataaatctactgcaccagtaatttttacgtcactattaaaagagtaaagttgcacactttttaaagtcgatggaatattaacagattgtaatttacagtccctaaaggcattctctccaatagtttctaatttatttgataattttacttttgaaaggtttgagcaggcttcaaaagcagaatctctgatttcaactacgctgtcaggaatgttaatttcttttagagtgttacagccttcaaaagcatgactatttattatttttacgccatctggaatagtaagtgaagcagaagtattcttaccacttattactgagttattgattattactaatccattatcatctctcattttatcaagccatgctgtataaagaaaagtacttccgccaatatttgttgtttttgattggaaatcaacgtcttttaatttgctacatcctataaaagcaaaatcacctactactgtaatacttgaaggaatattaattttttctaaattttcacatcctatgaaggcattagaacctatttctttaacaccatcttctataattacttcttttaagtttttaaaatttgaaaaacatccttctcctatcttttttacatttgatggaatgattacttttgtaatattattattttcagaaaaagtagaactatcaatttcagtaacattagatgaaatagttgcaattccattagaaatagttatatttgaattattttctgtggcaaatacatttgtagtatttattatgttgatactcatagcaataagtatcagctttgaaagttttctgcttagtcttaacattataaacctccttgtaaaaatctatagaagtattatacatcctatattttccatatacaatataaaaaggttaaaatttatagtaaagtatttaatatagaaactaagtgaacttaaatgataattaaagattaattaaaggggaattatgataaaacacaatgttttataaaaaaacaaatgacttaatattggaaaatgtcactaaacccttaaaaatactatatttgaatcatgtttgtgatatactttgttcatagagaaaaacaaataaaaaagcttataatctttaataatatataatatctgagcagacttgaataaattctgaccattaataataaaagtaataagttaccccttttactttaataatatagttaaaaatatgtctgcttagataattaatgaaatcgatttaaaatgaatggagtgatatttatgtttcataaaaaattaaaaaactttcctaaggactttttatggggagcttccacatcagcatatcaagttgagggtgcatctttagaatacggaaaaggtccatcggtacaagatatcaagaaaattccagaaggaactccggattttaaagtatctagtgaccattatcatcactataaagaagatgttgcattatttgcagaaatgggatttaaggcatatagattttcaatttcatgggcaagacttataccaaatggtgtaggagaaattaatcctcaaggaatagagttttacggaaatttaatagatgaatgtttaaaatatggtatagagccaatagttacaatgtatcactttgatttaccagcagcacttcaaacaaagggtggatggtcaaacagagaaactatagatgcatttgtaaactttgcaaaagttatgtttgaaaactacggtgacagagttaagtattggttaactataaatgaacaaaatatgatgactcttgttggagatgttattggtactttagacggaattgaaactgataatgttcaaaaagaattatataaacaaaatcatcacatgttaatagctcaagctaaagctatgaaattatgtcatgatatgtgtccaaatggcaaaattggaccagctcctaatataagtgcagtatatccagcaagttcaaaaccagaagatatattagcagcaagcaactgttcagcaataagaaactggctatatcttgatatggctgtacatggaagatataatccaacagcatggaactacatggttgaaaagggaattgaaccaactatagaagatggtgatatggaagctttaagaagtggacatccagactttatagcattcaattactataatacagctacagttgaagcattcccaggtgaaatcacaaatgaaagatctggtggagatcaacaaagtggacatggtgaacaaggtatgttcaagggtgtttctaatccaaacttacaaaagactgaatttggatgggaaattgatcctgttggattcagaaatacgctaagagaagtttatgaaagatatgcacttccattaatcataactgaaaatggtcttggagcatatgataaacttgaagaaaatgatactataaatgatgattatagaattaattacttaagaaagcatattgaacaagctcaattagcaatctctgatggagtagatttaattggatactgtccatggtcagctattgacttaatcagtactcatgaaggatttaaaaagagatatggatttatctatgttaacagagatgaatttgatcttaaagatttaagaagaatcagaaagaagagtttcttctggtatcaaaatgtaattaagactaacggtgaagaactataaaattccatattgaatttattaagaactgtataaaagttaaaaaacttttatacagttctttttaaaataaaacacatttcgacgaaaaatgaatataattacaagaaagaaatatattattaatatgcgaagtttagtgtgataaataagttggagattagtaaatatgagccttaataaaaaagcttacttgaaatactaaaaagtataatggaaaacataatcactaaataaatagtaagatattgtataaaatggtttgacttaacttttgtcaaaccttaaacttagtttaaaaattaaatagaaaattaattaataagacaaagaagtcaaaaggatcctgaacttctttgtcttatttttttgattggaggtaataaagtgaaatttattaattcaaatgatgattcaatcttatctaaaaaaatagcagtatattttttacagtgtgtatcgttaatgatagtttttcttggaatgttttttagtattttcagtgctattaatcatatatcaattaaagttttaagggtaaatgttagtggtattgtatttggagttttagttttttatttagggattaaatattatttatctgtgtgtaatttaaaagaaaaacttttaaaagataagtacaagttttcttggagtaattttaatttgcaaaagggtagaaaaataagttcctttatcaaaggtaaattttaagtattaacattagagttttaataataaaaaaatttaatcaatagtatggaggtagtatttatgaaaaaatcattgaaattattaggaattattttgtttttgggagtattagcattaacatttgctttagctatatcgccaactagtggatctgatccaactggagcagcgtacattgctacgacgggaaatgaaacaataactgatgttgctactactgctaataaggcttactatggtgctaattatgtgtgggttatgattacaggttttatggtatttttctttcagtgtggttttgcaatggttgaaactggattctgtagagggaaaaatgcagctcatacaatgacaatgaattttatggttttcttagttggagctattggatatttcttaactggttttgcaattcaatttggaggttcaggtggtgctgcagggcttggaacaggtggatcagccttgaatgcaatgttatcaatacctggacttggaggtattttaggatataagggatttatgttatctggtaatggaatatatgatccaggtatctttgcattattcttcttccaaatggtgtttatggatacaactgttacaattccaactggtgcattagctgaaagagtaaagtattcagcagttataatactttcatttttcatatcaatgtttttatatcctctatttggaaactgggtttggggaggaggctttttagctactcttggtcaaaactttggacttggacatggtgttgttgacttcgcaggctcagcagtagttcattcaatgggaggtatgattgctttatcaagtgcaatagttataggacctagaataggaaagtttaaaaaagatggaacagcaagaccatttccaggacatgatattcctatggctataataggaacaataatattatttttctgctggttttcatttaatgcaggatcaactttgaattcttcagattttagattagcagttgtagctactaatacaatgattgcaggtgcaattggtggactcgttgctatgttttatatgtggattaaatatggaaaaccagatccttcaatgacagctaatggtgccttagcaggtcttgttgcaataactgctccatgtgcctttgtaaatggaccatgtgcattcttcataggtggtgttgctggatatcttgtttgtatttctgtagcttttgttgaaaataaattaaaacttgatgatcctgttggtgctatctcagtccattgtgtaaatggagtatggggcgtaattgcattaggtttgtttgcagatggagcatatggagatggaattaatggtgtagctggaggagtaagaggattattttatggagatccatcacaattagttgctcaattaatagcagttgcagttttagttatatggggatttggagtttcatatatattcttaaaggtactcgataaagtttggggattaagagttaaaccagaagaagaattagcaggattagacatacctgaaatgggagtttcagcttatccagatattcagttaataaaatcacctgaacttgattattattctgcggataatattgaaataaaacaaataaagagattcaaagaaaaagtttaattattagattttattaatatagagatgagaatggaggagtataaatgaaaaagctggagatagttataaatagtgaaaaattagaagatttaaagaaaatcttgagtgattgtaatgctaatggtgtaatgatttctaatgttatgggatatggaaatcagaaaggatataaaacaatatatcgtggtacagaatatagtgttaatttgttgcctaaggtaaaagttgaaacagtagtaccagctgatgtagctgaaaaaataatagacaaggtacttaaagaaataagtacaggaaattatggagatggaaagatatttatttatgatgctgatgatatcgtaagaatacgtactggtgaaagaggtaaggatgcattataagtactaaatgtgtaaacagaaaagttgtaatattatataataagcaaagagacacttacagtaggtaggtgtctttaatatttataatttatatgtaaaaaagaagaagtttatatggagaaaaatgtataataatatcggtataaaatttcttttatttacaaatatctacatatattgttaataaataatgatataattttttattgacaataattataatatatgggggaattatcatgagagaaatatgcgataattgtaaaattaataatcgtattgaagaatacaaggaaaagttaaattctagtattgaaaatagaaatggggatttattagatgatgaagtagttctttcaagtcaatttttggataactttgtttataagtgtgtatgttgtaataaaaatataaaacatttatctaagctaaatctaagagaggtatttggaacacatacaacattctattattatggagaacaacacttattagtaaacttatatttttacataaatgaaggaataaaaaataatgaattaatatatatttccatggaagaagaactatataataaattattagattttcttattagtaataatgtttctactgaaaatattaaatttaaaaatgtaaaagaattaattttaggacataagaaaggtggatttaatggtttagtagaaactgcaatgggcattctaggaagtagtaatatggaaaaatataatggtttaagatggattggacaaccaagctttgcaattaaaggtacatcagagaatgactttctagagatggaagaagacttgaataaatttatcaaaaatatgaatgcagctcttctttgcatttatgatgcctatgactatatgcataaaggtaaaattattaataaaaaggttatagaagaatcatttaaaacacattcatttgttttaaataattatgtttcataatagcttaattaaaaatacataaaatatatttgggctatcgcactataaatagtgcgaagctcatctagaactatataagtgtagatgaggatcatggaaatatgatttaaacatctgcacttatttttatttataatatatatgtataattaaaaataatgtattagttaaaaatatattatttaattataaattattttttggatataaaaattgaggtacagaattacgtatattatcattaccaacaactattaaaacatcatttggattaagtgatatatatggtccaggagataataatagttcatcatttctttttactgctattaatgtagctccggtattctgccaaaacattatttcacctactgttttacctatataaagacagttttcagggacaacaaattctaaaggaattatgttgtttacttcattaaatctgcttgaataatctattataccttgtattgattttaataactgattttcaatttcttttctattatttaaaagcttatctatttcagttttataacttcttatactatcgattgatttatttctatttaaaaatgaaattgccttttctcttgatagcaccaatattcctttaccttttatagtcttaactacttcaacatcttctaagagaatcatagatcttcttattgtttcaggagaaacattatacttgcttgaaagagttgagcgaccatgtagtatatcaccttcaagtatattgtttagttgtattttattagcaatatctaatgctatttttttatatgttggaattgatgaattgttcattttcttacctcatttataatataaaatatttctatactaaatatatacaatacaataacagaatgtcaatttaaaaaatctgacaacttgacagaagaaacaacttggtgatattataaagttgttggaaggagatggtattggtgatagagtttaaaaatattaagaaaagttataaatctaaaattattttagaaaattttaatcttagtatagatagtggtaagttagtagtattaattggagcaagtgggtgtggaaaaacaactttattaaagatgataaataggctcatttcaataacagaaggagaaatattgataaatgggaaagatataaataagatggatcccattaaattaagaagaggtattgggtatgttattcaacagactggactgtttcctcatatgacagttaaggaaaatattgaaattataccaaggttgatgaaaatatcagagagaaaaatagaaaaaaagactattgaattgttaaacatggtaggacttgatcctaacgaatatctttatagatatccagcagagttaagtggtggacaacaacaaagagtaggagttgcaagagcttttgcaacagatgcagaaataattttaatggatgagccatttagtgctttagatccaattactagaactgaacttcaagaacagctttttaatatacaaaaagaatataataaaacaattgtttttgtcacccatgatatggatgaggcaattaatattgcagatatgatttgtatacttaaagatggaaaaataattcagtatgatactcctgaaaatatattaaaaaatcccgaaaatgattatgttgaagaatttgtaggtaaaaataaaatttgggctaagccagaatttataaaagcagaagatgtaatgataaatagacctgctacagtttcgataaaaagaagtcttcttcaagcaagggaaattatgagagaaaagacagtagatagtttactgatagtagataaagaaggaatgctgctaggttatgttacattatcagacatacaaaagattgataataaatcaatattagttggtgaggtaatgagacgttcacctgaatatgttacagaggatactaatttgttagatttacttgaaaagttcacaggattaaagcgtggatatttaccagtatgcaatgaaaatggaaagcttatgggacttgtaacaagaagtactctgatttcagtattgagcagtcaatatatagatattggaggtgataattaatgagtgacttttttatgaatctatatttaaagaaaagtgaggttatttcccttttattagaacatatacagttaacattgttagcagttttaattgctgtagttattggggtacctttaggaatatttataactaactataaaaagttagctaaaatcgtaattggatttgcaaatcttgtacaagcgatacctagtttggctatattaggatttttaataccagtagtgggaattgggtcagtaccagccataattatggttgttttgtactcaatgttaccaattataaagaatacttacacgggaattagtaatataaatccagatatgatagagtcagcaaaaggtgttggtatgacaaacatacagatattaaaaatagtgaagattccattggcaatgccaatgataatggcaggaataagaatttcaggagttactgctgtaggtcttatgactattgcagcctttgttggagctggagggcttggatatcttgtattctcaggaattcaaactgtagataataatctaatattatttggagcaataccagcagcaatacttgctttaataattgattatataacatctaaaattgaatatgctgtaatgcctaatggtataagaaaatcagatggtactatgaaggttaaaagagggaataagggaaaaaataaaaaaaataagattatagcattagttacaagtctaattttaattataattttattattttctaccaatgtttttaacaaatcaagtaataaaatagttatagcatctaaaaattttacagagcaaattattttaggtaatatgctagaacaattaatagaagctaaaactgatatagatgtggaaactaaacttaatttaggtggtactcaagttgcgtattctgctttaaagtctggaagtgtggatttatatgtagagtatactggaactgcctatgttaatttgttagatataaaggatggaaatactaatccagatgaagtatatgataaagttaatgaaatatttaaagagaaagaaaacatagaatttttagatccacttggatttaataacacttatgcattagtagtaaggaaagatacagcagaaaaatataatttaaaaagtatttctgatttaaagaaggtttcagaagaatttttaatgggtccaaccatagaatttgctaatagagaagatggtttattaggtttagataaagcatataatattaattttaaaaaagttaaaccaatcgatggaggattgagatatacagctctaatgaataacgaatctgatgtaattgatgcatttactacagatggcctactagataaatttggtctgaaagttttggaagatgataaaaacttttttccaccttattatgctgcgcctttaataagaatggatactttaaaagaacatccagaacttgaagaagtattaaatttactgtcacataaaataacagatgaaaaaatgagaaaattaaattatgaagttgatgttaatggcagagatcctaaagttgttgctaatgagtttttagtatcagaaggatatataaattaacgtttaaatattatcttgggaaagaaagaatctaagaagaataataatgaatttttagattaatatttaaatattatcttgggaaagatttcgaaagtaaaaaaaaactagaattaaaacaatccaaaagttgtgtataaatacttttggattgtttttttattttttatatgctatttacaatgattattttaaaatattcattatatcttctgccatttgttcaggtgtaattctgttcttcttcataagttcatctggaacataacgatctaagaattcttttttgataccataatttaatacttttacatcagaagaaccgtagtgtctagcgattctttcaccaaatccaccttctaaaataccatcttcaagagtaattacaagtttatgctcttttttcaaagtttcaagtaattcttcatcaagaccagttatatattttggattgataagagtagcttcaataccattttcacttgaaagtttttcaacaagtgattgaccaagttgatagaaatctccaagtgcaattacagcaacatcttttccttgttttgttacttggtatttattcaactcagaataatctgtattatcttcatttccactatttattacacccattgctggaatacggatagccactggatgatcttgttgattcatactccatttaagcattgcaaaatattcttctttacatgttggtgcaagatatactaggttaggaatattgctcatcataccaatatcatataatccaagatgcgtaacatcgttcattccataaacagatgctagagttactagtataactgctggattgttatttatacataaatcttgtgaaatttgatcgtatgttctttgaaggaatgtactatatactccataaactggttttccaccatttgcagccattcctgaagctaaagctacagcatgttcttctgcaataccaacatctataaattgtctgcccgcttcagctcttcttttaggagagaaaccaagtactcctggagttcctgaagtaataacagctacagttgggtcttgtttcatttcatttaataaatatttagctgtaagatcaccataatcttcagcatcacccatagggaatttagaatcaccagtttctagtacaaaaggcattccccagtgccattgttctttattagtttcagcaagttcaaatccttttcctttaattgtatgaatgtgaataactactggatggtctgtatctttaactttgttaaatacgcttataagttgatcaaaatcgtgtccgtcatttacataataataatctaatcccattgacttgaagaagttacattcagacttaccatttgtatctctaagttctttaagattcttgtatagaccaccatgattttctgcaatagacatatcattatcatttacaataataatcatgtttgttccagcttcagcagcattgtttaaaccttcaaatgcttctccgccacttaatgaaccatcacctataatagcaattatattatctttttcatcttttaaatctcttgctttagcgagcccacaagcaagacttactgatgtagatgtatgacctatattaaaaaagtcgtgttcgctttcgtgtggatttgtataaccagatacatcatcatatttttcagagttaataaatgcatctcttcttccagtaagcattttgtgaatataactttgatgagaaacatcataaacaattttatcttgtggtgagttaaatacatgatgtaatgcaacagttagttccacaattccaagattaggaccaatgtgtcctccgtgttcacttaacttcttaagaagtacttgacgaatttccgaacttaattcgttcatttcatttatggataaattctttacatcttctggtgaattgattttttctaaatacatagttttgttatcctcctaaaattatcttatttacaatctttattaatgggtttaaatttagtttttacattagttaaaatagtagtcttttctttaaaaattgttagtttatatttgaagtataatacttggagttaacttcaagtcaagaaaaaaatttaattataaatttaaaaaacaacctgttttataaaaaaacaaataacaaaatagtaataaatttcactaagttataaaaagtaaagaaatataaatttattgatgatatacttaactcaagaaattcgttggtatgaattttataaggggatggggtgatgaaacttcaatgaaatcgtttttaaaaagcacattaggttttggaattgcagcaataatattaaatactctttggggagtaattacaagaaggcttggacttaaaggtggatggatatgtggatttatattaacaggtactttgtggtatgttaatcattacttaggaatcgttgaaaatagaaaagaatctgcatttattgacatgggatttgcagttgctatatgttcatttagcagagactttttaaaaaatggtcttgaaggtatagttacttccgccccaacatttatatgtgtaataattggaggaactatagctggagttgttgcaggaattataaaaaggcatcaaaagcagggggaataatatgaatagttttggagcgtttacaacaatttttggatcagctatcttttcatttggagtaataatgtattgggataagtttgtttcattgctcggagcctttggtggttttatagctgcaatgctgattccaggaaccatgtggatattaaatcatggagcagaaaatcatcttataaagcagagtggaagtatatggatagatatggcttgggccgttggaataggagtacttatatcatctattatgcaaggaggcagcttaagaaattctaaatggataatgctttcagctataatcggtggatttattggtggatttcttattaacatgtgaaagagaaattaacaaattaaaattagtatataagattaaattatattgtaattatacgtagtagaataggagaaataattatggcatttaataaagattttttatggggtggagcagtggctgcacatcaattagaaggtggatggaatgaaggggggaaaggaccaagtacagcagatgttatgactgctggagcacacggagttccaagagaaattacagatggcgttattgaaggacttaattatccaaatcatgaagcgatagatttttatcacagatataaagaagatatagcattattcgctgaaatgggctttaagtgctttagaacttcaattgcatggtcaagaatatttcccaatggagatgagcttgaaccaaatgaagaaggtttaaagttttatgatgatatgtttgatgaacttcttaaatataatattgaaccagtaataacattatcacactttgaaataccatacggaatagttaagaactatggtggatggagaaaccgtaaggtaattgacatgtttgtaagatatgcaacagctgtaatggaacgttacaaagataaagttaagtattggatgacatttaatgaaataaataatcagaagcagattggtgttgatatattcccttggacttgttcaggaattatttatgaagaaggagataatagagaggagataatgtatcaagcagcacatcatgaattagttgcaagtgcattagttgttaaaaagggacatgaaattaatcctgattttaaaatagggtgtatggtttcatttgttccaatatatccttattcttgtaatccagatgatatgatgcttcaagttgaagcaatgcatgacagatatttctttagtgatgttcatgcaagaggacattatggtgcatatgctatcaaggaatgggaaagaaaaggttataacataaagatggagccagaagatgcacaaatcttaaaagaaggaacagttgattacataggattcagttactatatgtcaaatgcagtaaagtcagatgctcaaaatacagaagatttactttcaggacactctgcaagtgtaaaaaatccttatgttaaagcaagtgactggggctggcagatagatcctgtaggtcttagatattcattaaatacattatatgaaagatatgaattaccactatttattgttgaaaatggatttggagcaattgatgttaaagaagaagatggaagctgtaatgatgattacagaattgaatatttaaaagctcatattcaagaaatggaaaaagctatagaagttgatggtgtagatttaatgggatatactccttggggatgtattgatttagtttcatttacaacaggtgaaatgaagaaacgttatggatttatctatgttgataaagataatgatggtaatggtacattaaatagaagtaagaagaaatcttttgattggtataagaatgttattgctactaatggagaagaattgtagtttatagaaattattaaaatttagctttcatgaagtagcatccaaataaaagggtagagtttagggcatatggtttgattcagtgggatatggtttaatataatcaaggattccgtactaattttagtatggaatccttgattttttcttttgagatatatttataaattttataatatttttcttgagaatcgcatctaggataactgtgtataattaaaatataatttaattatacacttaatctgatataatctaattgtatagaaggtatttttatatatggaggtacgagatgtttgagtgcgatgagataaaaaacttaaatgaactagaattatcattatatgaatatataatgaaaaatagtgaaaaagtaatgtacatgaagatacgggatttagcaaatgaagcacatatgtcaacaactacagtattaaggttttgtagaaaattaaactgtgatggattttcggaatttaaattgaaattcaagatgtatatggatagtaaagaggatagaaaaataaatgaggacacatcttttataatagataattttaaaagattagctagtgatgagttcaaagataaaataaacggattatgtcaacttatcaaagaacatgataatatagtatttttaggtggaggtttatctggtatagttggaaaatacgggtcaagatatattacttcaataggaaagttcagtatatatatagatgatttgtattatccaatgaattgtgaaaactttaaaagaggccttgttatagctttatctgaatcaggagaaacagtagagataattggtgccataaatagattcaaaaaagaaaaatgtactatagcaagtataactaacagtgagaatactacaatagcaaggatgtcagattttaatatatcgtattatatcccagaagaaagaataggtaccattgacattacaagtcatttaccaccaatgtacattttggaaacagtaggcagaaaattatataatgaaaaaataagaagtaaaaaataatgtatgattgcagtgtttgtataataaagattacaaatgctgcatttttatttctatctaaaatagtataatattttcttaattaaaacttatagaaatttatttattaaataattaagaaaaaacaaaaagattcttttagagttataaattaagaaattatatgtattttttagatttaaattttaaaagcaggatgactgcaagattagatgtaaaaaaacatattgttacttttttgtgaaaaggaacaatgcgctgaaacctgttattttagccaatgaaaatgattacttaaataaattgatgttgtataattagttcataaactaaatacgtatttgttttataatttattttactaaaactaaagggggaacttatatgtcatcatttttaaatgaaaaagtagtacctgccataatgaagtttgtaaatttaaaggcggttgtagcattaaaagacggtatcatttttactttaccactaacattaataggatcagttttcttactattagctcaaattccatataagccattagctgattttatttcatcaaaaggatgggatgctccattgttccaagcaaatggggcaacaatgggaattatggcgatgattgcatgtgttggtatagcatatacatatgccaagaatgaaggttatgaacctttatcagctggagttgttgcattttcaatattttgtttaactactaattcatacgttataacagaagacggtacaaaagtaggaagcgtaattcctatggattggactggcggaaaaggtatggttactgctattattatcggacttattgtaggtgcagtttattcttggtttatgaagagagatataagaattaagatgccagcaggtgttccacaaggtgttgcagattcattctcagcattaataccagcagcaattcttattacaggtggtacaatcttatattctgtatttaaaatatttgatacaacattcattgagtttatttataaagttcttcaaactccattacaaggtatgactgattcattaggtggagttgtagtaatgggattaataattcctttcttatggttctttggtgttcatggggcaacaattattggaggaataatgggtcctatattaacatcaaatacacttgaaaatggtgcaatcgttacagcagggaaagaacttacacttgcaaacggagcacatatagtaacacaacagttcctagatcagtttatgactgtaacaggttcaggtatgacaattggtttagtattatgtatgttattcttaggaaaatcagctcaatttaagcaactaggaaaactagctatagtaccagcagtattcaatataaatgaaccagtattattcggtactccaatagtaatgaatccattaatggcagttccatttatagcaatgccagttatatcaggattaatattatatttctcaatttactttggtattgttccaccatttggaggagtattagtaccttggacaactccaccaataatttcaggattattagtaggtggtgttagaacagctctattacaaacagcaatattagttttatcattctttgtttatctaccattctttaagaagtgcgataacatgagttatgaagcagaacaagctgcagaagcatcatcaaattaaatgtagatttaaaaatataattataaaaattaattaaaaacgggaattagattttatataataagtaatttcttaataatatttcttaataatatagataagaaattgtaatatagaatctaattcctaaaaaataagtattaagcaaataaaatggaggatttaaattaaatggaacaattagaaatgcaaataatgaatataataatcaacgcaggagattgtaagaatcatgcatatatggcattaagtaaagttaatgaaggtcaatatgaagaggcagaaaaagaaatggttcttgcaaatgacgcattagctaaagctcatgattcacaaactgaaatgttacaaaaagaagcagcaggagaaaaagtagatttttctattttatttgtacatgcacaggatcatttaatgactgcaatttcagaaaagaatctaattgaacaaattatagaattaagaaaagttgtgaatatgttaataaataaatagaatttttaaattacatcaataaatcaatatgtttaaaaagtttggaggaatttattatgataacaataagattattttgtgcagcaggaatgtcaacaagtttattagttaataaaatgaaggaaagtgcatctaaaagaggcttagaagttgatatagcagcattcccagaaggacaaatggataagcatttagatggtgtagatgttgcattacttggaccacaagttggatacagactaacaaatgcaaaagcagtatgtggtcctaagaaagttcctatagatgttatacctatggttgattatggaatgatgaatggagaaaaggtactagattttgcactaaaactatctggtaaatagataaaagataattttaaatttactttgaaattaagttagaatttatgaaacaagtttgagttaaatcagagaggattatgttatgagatataatttgggaattgatattggtggaacttttataaaatatgcattagtcgatgataaatatgaaataagagataaatggaaagttgaaactatcaaatttgaaactaaagataatttttatgattatatatgttcaaatataaaatccttagatttagttgataagataggaatcagtgctccaggacttattgatgaaaactctaatgttagatcttatgcagcagaaaatgtagtgataatgtatggaactaatataaatgaagaaataagtaaaaggacaaatagaacaacatcagcaataaatgatgcaaaatcagctggattatgtgagtttaaaattggcaacgcaaaaggtagtaaattgtctgcattttttattattggaactggcacaggtggatgcatttgtgatgaaaaaggtgttgtgtatgggaaagattcatttgcaggagagtttcatcatattcctcatataaatttagatactggaaaaattgatagactaggtgatttttcatcaatgacaggccttataaatatatataatcaaaaagtggatgattttaacaagttaagatatggacatgaaatatgcaataaatatttaaatgatgatattgttgcaaaagaagcatttgaagaatggataagaaacatatgtgtccaccttattacaataagcgtgttttataatcctgatgtcatatgtattggcggaggaatttctgaagaagcttggttcataaatttaataaaaaataaatttaaacatatgtctagagaatatatttttaacaaagatgtaataacaacaagaatagaaaaatgtagatacaataatgatgctaacattctgggagcagtaataaatgtagaaaatttatagtaataaatcgaagtatacggaggtattttataatggcatttaacgaaaaatttttatggggtggagcagtggctgcacatcaattagaaggtggatggaatgaagggggaaaaggcccgagtacagcagatgttatgacagcaggagcacatggagttccaagagaaataacagatggtgttattgaaggacttaattacccgaatcatgaagcaatagatttttatcacagatataaggaagatatagcattatttgctgagatgggatttaagtgctttagaacttcaattgcatggtcaagaatatttccaaacggagatgaacttgaaccaaatgaagaaggtttaaagttttatgatgatatgtttgatgaattattgaagtataatattgaaccagtaattacattatcacactttgaaataccatatggaatatgtaaaaaatatggtggatggagaaatcgtaaagtaattgacatgtttgtaaggtttgcaacaacggttatggaacgatacaaagataaagttaagtactggatgacatttaatgaaataaataatcaagcagaaactgaatatgacttatttgcatggacttgctcaggagttagatttgaagatggtgaaaatagagtagaagtaacttatcaggcagttcatcatgaactagttgcaagtgcactagttgttaaaaagggacatgaaattaatccacattttaaaataggatgtatgcttgcttatgttccagtatatccatactcatgtaatccacaagatatgatgctttcagtagaagctatgcatgaacgttatctatatggtgatgttcactgtagaggatattatccaagctatgctcttaataaatggaaaagagatggaattaatataaagatggaagatggagatgctgaaattttaaaggaaggatgcgttgattatataggatttagttattatatgtcagcatcagttaaaagtgatatagcaactgatgaaggtgacggtatgtctggatattctagagctgtgaaaaatccttatgttgaagcaagtgactggggatggcagattgatcctgttggtcttagatatgcattgaattctttatatgaaagatatcaaaagccattatttatagttgaaaatggatttggggctgttgatgttaaagaagaagatggaacatgcaatgatgattatagaatagattatcttgctaaacatatagtacaaatgaaaaaggccgttgaacttgacggcgttgatttaatgggatacactccatggggatgcatcgatttagtatcatttggaactggtgaaatgaagaaacgttatggatttatctatgttgataaagataatgatggtaatggtacgttaaatagaagtaagaagaaatcttttgattggtacaaaaacgttattgctactaatggagaagaattataaacttaaattgtattaacaaaaataatttaaatattttgattaagtaaaattatgtttaatatatacaggaatgctgtgctaatttttagtatggcatttttgtttttattatagttaaattttggtgttataatttatgttataagaaagtataaagaactagcatcggcataggtgtaattcttattaaccttcctttaaaaatatgtgtatatcttttaatgaactttcaacatttatataaggtatgtgggtaaactttatttacttagtaaatgaagattattaattaaaagatatatcaatggatattatacacagataaatttataataaaagtagtttgagataattctaataaaatattaatgctagagggaaatatattaacatatttttaatatcaaattatttaaagaggactttataatttacaggaggaagatttccatgaagatatatgaaaggattttagaagatataaaaaaatatataattgatgaaaaggttccacaaggatttaagcttccatcaattaattatatgtgtgaaaaatacaactgtagcaagggaaccgtaattaaagcatatgattctttatgtagtgaacatataatttatgctacaccacaaaaggggttttttgttgctgataatcttgttaggtataataatgataattctggaagttatgatttatccactggaaatcctgtagtaagcagtattcctgtaaaagatattcaacattgtttaaattcagcagtagagctttatagtgatatttctcttgcaatgacttcaaaaggaatacctagtgttttaaaaatacttccggaaattcttaataaaagtgatatttattgtaaaaataaaaatatatatttatctcaaggggtacttcaagttttaacattactgtcaaaaatgccatttcctaatggtaatgatactatattaattgaagaaccatcatatgtttattatatagattttttaatacatgaaaatttagaggttaaaacaataaaaagagatgagaatggaattaatattaaggaacttgaagaaatatttaaaaatgaaaaaataaaatttttctacacaattcctagaaatcataatccgttagggacatattactcagtaaggcaaagaaagtctatcatagaacttgcacacaaatataatgtttatgttgttgaggatgattatttttcagatgtatacagtcttccaaattattcacctatatattattattcagactttaaaaactgtatatatttaaaaagctattctaagacaataccctatataaggattggagcagcagtgattcctgatgatttaatagatagatatgaggaatggattaaatactcatactattcttcatattatatgccgtctttagtttcacaggctacttttgaatcatatataaaaagcaatatttatgaaaagcatataaagattattgataaacatttaaaagaactattgtctatatttagatcggtaacagcaaaatgggattctaatatagttaaagttatagggggaaagtcagggtattattcaactatgatattaaatagtaaaataagcagtaaagagttaattgatagattaaagaaaaggaatatatatgcatcatctaataaaagggcttattataataaagaaaattatgataatagtataagaattagtcttgcaagacttaataaaaatgaagtaaaggttgtgttggaaattatatatgaagaaattctaacacttatgtagatatacatgtttatattataaaaaatagatgatgcagtaaattattaatgcatcatcttattttgtgtttaatacgaaggatgaacttaatttaaaataaatgttggtatattgatatatgttagtaattaggaccacattagctaataatttttaattaaattgaggaagatattctttatgagcttctaataactcatctaaaagaacttttgccattttctctgaaggaattaatggatttattgttaatgcaagcagtgctttattataatcaccttcaacagcagcatcaactacaagtttttcgaaagattttattgtttgaaccaaaccatttacggcaactggtaatttcccaattgaaagtggtttaggaccatcttttgttataatacatgaaacctcaacagcagagttatcatcaattccttctattgcaccgttatttctaacatcaacaggttgaatgtcttttttgtcattataaatagaattaataagtctgcatgcagcatcagaataatatgctccaccacgtttttctaattgaggtggttttatgtctagagtttcatctttatataattcaaataagtctttttcaagtttttgaacaatttcagctcttgtttcacccttagagaactcttttaattcatcttcaagcatttcagaagtctgataatagtatttatgatatggacatggcatcatatttagtgcttttataaaatgtggactccattcaaaatcttttatatttttaactattgagcccatttttccttcagcaatagaattaattactttatcagttacgttttcaccatcaagataaatttctttaccaaaaaccatatgatttaatccagcaaaagtcattgtaatgcgattagaatcaacatctaacattccagcaactgctttttccattccaataggaacattacaaagaccaatgacttttttatttattccatatttaagaagagcttctgtaaccatacctgctggattggagaagtttataagccatgcattagggcataattgtgacatatctttatctatatctaaaattacaggaatagttctaaatgctttaaacatacctcctgcaccatttgtttcttgaccaataaccccgtgacttaaaggaattctttcatctttgttccttgcatctaactgaccaactctgatttgagtagttacaaagtctgcatctttcaatgcttctcttcggtctaacgttaaatgtatatcaataggaacaccagcttttttaaccattctttttgctaaattacctacaatttctaatttttcttttccactttcaatatctacaagccatatttctcctacaggaagttcatgatatctttttataaatccttcaattaattctggagtataacttgaacctccaccaattgttacaattttaatttttttattcatatgcaatacctcctaacctcttgtctatatgttaactttattaggagtatcaatcaatcatatgaaaagctaactgtactagtacagttttgagtgctattagagaaattatatattaaaatttataaatgaaaatagaagtataaattttaatctggattttaaattttaattgtaaattaatagtttaaaagaaagattatataagcatattatggggttaattggataaaaataaataaaagttaataaaatgtaaaatttccttgaattttgtatgaatatgtacgattatagtattataaatgttaatgtgaatcaggggtcaaattaaatttgtacaagcagcgacactgtaaaaaattaagggagtgatttttatcataaagctgagcaactacatgaaatatgatataagcgatggaatgccataaaattttaaaaagagattaactaaatttatagggatatattaaggtttgtatttaacaataattattttaaatgaatttagtacttaattgaccaaatttgggggtatttttataattcataattacttgaagtagtgattcacagcattaaaaatatttactgaatactgggaggagaaaaaattgaacaaactaaaaaatataagaatagtacatttaataataactttaggtttgatatctatagttggtgcaatgattattggaattaaaggattgaattctatatcaaaaatgaatgaatctaccaatattatgtatgaaaaacaactattaaatgttgctaaaatgggtaagctcaatgcagatttgggattactaagacaaggtgtaagtaagcttattgataggaaatatgatgaaagcgtaatttctgtaattgattcaaatattaagaatataaatgatattataacagaatatgagaaagaaaatttaaatgatgaattaaagtcatatttagaaaattttaagtcagaatataataagtatttatctaaggtagatgaagtaaagaaattaagaaaagaaaatatagaagtttcagcagatgatgtaaatgaatttaatataataggaactaatatgagtaaatatgctgatgaaacagttatatataatgaaaaagcagcaagtgatcttaatgatttaaataagaaagaatacaataatacaagaacagcatttatttttataattgctatcatcttattaataacaattttaataatgatagctatagtatcattagtgaaatcatcaataactaatcttactagagatctaaaacaaatagcagaaggagacttctctgtaaaaatggatactgaaggaaataatgaattttctataattaataaagcaatatctaaaacagttgattcaatatcagatatattaaaaactgttaagaataatgctgataacatgaacgaacaatcaatttcattactagcagtatcagaagaagttacagcatcaactaaagaagtttccacagcaataaatggtgttgcagaaggatcaacatctcaagcagaagagttaattgatattgtaagtatagtaacaagttttggagaaactatccaaaatatagtatcaataactaatgacgtaaataaaaatacaaatgaaattagtgtaaaagcagaaggaaataatgaacaattaggagaagttgttcaatctgttaataatataagtaattcatttgatgatataagcaataagattactaatttaggaagtaaaataaatcaaattaatgaaataacaacaataataaacggtatagctgagcaaactaaccttcttgcattgaatgctgcaattgaagcagctagagctggagacatgggaaaaggatttgccgtagttgctgaagaaataagaaagttagcagaacaaagtaaagaatcttcagaagaaataaacaagttaatatcaattatttcatcagaaacaaataacgttataagcacaacatcaaatgttaatgatgaattgtcatcacaggtaagtataattgataattcaattaaagcttttagaactataatagtagatattggtgatatattaccaatgataaataacgttaataatagtattgaagatataagtaaagataaagatgttattattggaaagattgaaacagcttctgcagtatcagaagaaaattcagcatcttcagaggaaattttagcttcttctcaacagatgactgtatcagcagaagatttatctatgagtgcacaagtactttcagatatagcattaaacatgaataacaatgtaaataaatttatattaagggattaattttaaagtgcagcaaggtattatcttgttgcacttttttgagttgttaatgatatattttggaagaatatgataaaatatatataaaagttaagtattgtgtatgaataggaggaattttatgaagatgagaaaaataagtacaaaaatgttatgcgtgttagtaactattaatatattaattatgacattaatactttctataagttatgaaacaagcagaggaattttagaaagtcaaatacagaagaatatggattcagaacttgtagttgatactaacctaataaaaggtcaaatggaccaagtggaaaaaatggcagagcaattggcaaggaatgttgaatctacatacaaaactacgaatatagatcaatatgaacaatacataggaaaagttatttttcaaagtgatttagttattggaagtggaatatggtttgaaccttatgtttatagtggaaatgaagaatttatgggcccatatatttataaggataatggagcaccagttttaacatatgaatatagtaatgcagaatataattattttaattatgattggtataaggaaggaaagaataataaagaaaccagtgcgcattttacagaattgtatcatgatgaagtatcaaatcaaataatgtctacatgtgcagtaccaatgtatgacaatggtaagtttataggtgtaatatctgttgatataggtatttcatcaattcaaaatttagtaaatgagattaaggtaggggaaagtggcgcagcacaattaatagatccaaatggaaaatatattactcataatgattctgataaaattatgaagacaagcattaaagatgatagtgatactaatatggctgaacttggaaagaatatgttcaagggagaaggtcaaggtcatgagaaagtaaaattgaatggagaaaattttaatgtttattataaaacaatagatgaattaggatggaaattattattaaaggttccagagtcagaaattaataggccagtgagaaatttattgtttaagttaggatttatatgtgtagtagcaataatattatcaataattgcaattataaaaactataagttatgtgactaagaatattaaaaaagtaaactcatttgccttaagccttgcagaaggtgattttactacggaagaaatagatattaaaacagaagatgaacttggacaaatgggtgataatttaaataaaatgcttagagaaaataagcagattatccaaagtgttgcagatagttctagagaaatatcatcagaaagtgaaagtttacatactacaactatagagttatctgaaaactataataaagtagaggatgcaataaaaacaataaatgaagaggttatgactaccagtgcagctatagaagagttaaatgcatcagtagaagaagtaaatgcagctcttgatgtattggttgatgaagcagataatagttataaaatatcaagtgatataaaatatagagtaaaaaaaatagaaactaatacactagaatcgtataacaaagctgtgaatttatctaaagttcatgaggataatttaaacaaaagcatagaaaatgctaaggtagttgcaatgattggaactatggcagaagctatctcatcaatagcagaacaggtaaaccttctttcattaaatgcatcaatagaagcagcaagggcaggagaacaagggagaggatttgctgtagttgcttcagaaataggaagtttagcaaatgaaacaagtgatacagtaaaacaaattatagagacaacgcagaaggttgagggtgcattcagtaagttaactaatgattcaaaagagatgttattatttataaatgaaaatgttactccagattatcagacctttgttaatgcatcaaagcaatatggtaatgatgctgataatatagaagaattgtctaacaaacttgctgaaatgtctgctaatataaaaaatatattacaagaagtaggaaaaacagtagtaagtattgcagaatcatcacaaaatacatctgagaatagtggagagattatagataatattgataaagtttcagacatacttaacaatatatcaaaattagttgttaatgagaagaatgtttcagattctttaagtgaagttatacagaagtttaaattgtaataaattaaatagagatctttaaaaacgaaaaagtgcagcaagaataatgtcttgctgcactttttatttattaaattcatcagaattttcatcaactttattatggagtgacctagctattgtttcaattatatataaaacaggaacttgagtcgttatatcagatataccaagcttctcttggtttatataatatgaaatatttaaatcagatatttttgatatagtacaattttcactgttagtaatgcttacaataggacaattttctctcttgaaattgttaataagattaataacagtaggagtttcaccagaaacagataaaattataattacacagttctcatatgttttatagtttgtaggaaaatatgggtcgtcaatatatgttgcaaattttccaagtgaagaaaaatatcttgctgcatatttgcataatattcctgatgtacctgaacctaaaaatacaagattagctgaatctgttatcaagtcgcagactgcttcaattttctcatcaagttcttctgtattgagttttttaaagaaatcaataattatgctttgatcgtttcgtacattatttatgtttgaaccttcaaggtatatttttagtttaactttaaattcagaatagccattacagtcaaactttttacagaatcttaaaatagtagttgttgatacatgagcttcatctgcaagttctcttattctcatatatattactttttcagtatttttcattatatatctataaagcataagctctaaatcatttaagcctttaataatttcactgttaaacataaaaaacctctttcaaaataaatttaggcatatgagagaaaattacaagttcaaatatgctggaattgacttgttattttttgataatgccttaataatgagaattctatctactattatatcatctagattattgtatgtctttatttgtagataaatgtttaactaggtaacatatttcatcatcagacaaattagtaagattatattttatttttaagggattaagggtttccttaattatattatacatagaaaaattatcttttataaatatatctttattaggatacaagacagtattttcattattttttaatcttccaattaaaaaggatagatgtagagtaagtccaaccaaactatcaggagtaaattgtttatttattctattttcaagttcagttaatacattttgtatatcattagtaagctctgctcctgatatattaggaatattttcatttaaaattttaggaatatttagtaatgttgttttttcatctattaatctttgcatctgcattagtactgaaccactaagggcttcatacatagaaaattgatttgtatttagagaatcaatatgaaatgaagatacaacaaataaaacttgatttttggtttcaagatttaaaatcatttccttgtaactctctttattgcaatagcttagacatactatttcaaataaatctggatcaaactttaaattaacagataagaaatcctttattgcagcagaaccaccttctccagtcaagcatgcagttattattaaagttttgttagtatcaattgtcttattatttaagtttttatgaacttgtaaataagaatttatcattataacatcattatatatttcatctaatgataatcctaataatgcttttcttgcagcttcaagtacatgaagtgtagacacaagcgaaataacttgaagatctacatctaattcttgttttacagtatcagcaaaagcgagaagagatcccatatcaactaataacaaataaccagcagaagttggattttcacttataataagtcgtaagtggtctagcacttttgatggttcaacatcaattggagcatttataggaagtacatagtcttcacctaataatttacttgcaacatcactcattgaagttgccgttgattctccatgagcaataagaattacttttactttatcttttggctgtgtatttagtgttgtgtcaggtattaaaaataatgttatatagccagcttcgtctattggaatagaagagtaaagatactcagataaaatttctttgacttctaatgctatagaaaattcttttggatatagattttgtatttttctaagattaggattttttattatctttttactgtgtattctatcaacaagtgtattaatatgaagagcaaaagcagtgtaaaggttattatcaaattgtatagggagtctttctgttatatgatttataatcttatcaaaacattctaaaacacttggttctataattgatagtagattttttttgctaaattccttagatatattagaaaaattatgtttaaagtgcttggcaatatctttttcaagaatattttcaatatctatatcagagatttctagtgattttagtttctttaatttattttctaagaaatcataaatactgttatcactgttttcaaatatatcaagagaattatcacttgatccattaaatctgaaaaattctatttcatcgctcattaaattattccacaatattctatgttctttttctttataaagtccttctttaatgtatggtgtaaggtttccactgtggattctaacatcacctcttacatttgttaagaattcagaatatgcttttgcgcaaagcatctgaacatcactttttaattgtcctatattgtttggacagtcatatgataagagtgctctgagtgagtttaaagaaacatatatatctttacttaatcttatactttcatatttaaagaagctttttataagatatagtcgttcctcaagagttctttctttcaatgaaggaatagttataacaataggtattctccttctaaaagtgttaagaagtgcagagtcaggattttcagtagttgctgagattattaaaacatcagattttcttgattcagagtcacctacacgtctaaaagtacctgtatcgaggaatacaaaaagagtttcctgaccttctggaggaagtctatgtacttcatctagaaataaaattccgccatcagcttgttcgattaatccagttttatcacattcagctcctgtataagcacctttttttacaccaaataattgagaggtcagtaattgaggattattactataatcagcacagttaaaaactataaaaggagaatcttcactttttacattcattgttaaggcgtaattatgcattaatgaagcaaacatggatttaccaacaccggtacttcctaaaattaaacagttcattccttttggaggatataaaatcgctgctttagcttgttcgatagaactttttaatgaaatattattttcagctaataaatcaagctgagattttacttcttttttcttccagtcagctagataaaataaaactggtcttccggttgatttatttaattttccttctttacataattcatttaattcatggcttaaattagctctggacatatttactaatgaagctaatgttttagtatctattccttcagaacagttcaactgtcttagtttttgtaaaattaactcttttttagtcattaattatcctcctaatttatattgaccagaaaataggtatatatctggtacaaattttggattaacttcataatatttatgaaatatttaagaaattagtgtttaaagtatgtaaagtaaaaataagttttttatatcaagtaagctgtaaacactaatatcacttgcttttaataagcaaatgatatgttctttacatgaaaatgatatcataaatatatggctatggtcaaatatgggattaaatagtgtttatataataaatgtatatataaaacagtgaataaaaagattaaaacactaaaaaaattttatcaaacactgttttttacatataaaaaatagaaaaatataaaaaaaaatcaagaaatgaaaacttaggcagatagtaatttaagctagtgtttatcagtgtaaatactaataattatatttttttgtttagtgtttggtatacgaattgctttatatattggtgtaagaaataaaacagaaggtggggaacaataaatggaacaattagaaatgcagataatgaacataataatcaatgctggtgattgtaaaaaccacgcttacatggcgttaaacaaagtaaatgaaggagaatatgaagaagctgaacaagaaatgcagttagcaaatgatgctttagcaaaagctcatgatgcacaaactgaaatgttacaaaaagaagcaggtggagaaaaagttgatttttcaatcttatttgtacatgctcaggatcatttaatgacagctatttcagaaaagaacttaatagaacaaattattgaattaagaaaagtagtaaatactttaattaaatagttaataataagattctagttaaatacttatattcaaaaaatataattaaataaatataaaataaaaagttaatttaagggggaatttatcatgattacaatcaaattattctgtgcatcaggaatgtctacaagtgttttagtaaacaaaatgaaggatgcagcaaaagctaaaggagtagaggctgatattgcagcatttccagaatctcaaatggacaaacatttagaatcaatggatgttgcattacttggaccacaagttggatacagattagcaaatgcaaaagctctttgcggtccaaaaggaattccagtagaagttataccaatggttgattatggaatgatgaatggtgctaaggttttagatttagcattaggattagttaaataaattattttgattatttaaagatatcttaggattatttaatagtcctaagatatctaagtaagattatgttaattactaaaaatagttttggtgatgtggatttaatagttgataatgaagttttggacataccaagaattaagttcattgaagctcatttgaaggaaattaagaaagtcataactgaaaagcatatcaatatttagagaaataatagcaaatctttatttgtaattattcatattattaaatttataagggggaaatattatgtcactaaatcaaaccttaaacgaaaaagtagttcctgtagtaatgaaattcgttaatttaaaaggtgttcaggcattaaaagatggtatgttatatactctaccattaaatattattggatcaatgttcttacttgtagcagcatttccattaaaatcatttactgatttttgtgcaaatacatttggaccaaattggaatgatccattatacaaggttcaaaatggtacaatgagcataatggctttagtagctgttatgggtatggcatatgtttatgctaaaaatgaaggggttgagcctttctcatcagcagtattgtcattaagtacattcttaattataactaatgactgggtagaatttacaccagaaggagcaacagaagcttttaaagtaggttctgtaattccaagagactggatgggtggtaaaggtatgattaccgctatattagtaagtttacttgttgcatgggcttattcattaatgattaagaaagatatgagaattaaaatgccagaaggtgttccagaaggcgttgtaaatggattctcagctttaattccagcagctgtaatctttatagtagcagatattgtttatgcagtatttaaatttggatttaattcttcacttgttgaagtaatttataaaattgttcaacaaccattacaaatggcttcagactcaccatttggtgcagttattatagcattcttcgttccattcttatggttcttcggaatccatggtggtgtaactgttggtggtatggtaggaagtttattaactcctaatacagctgataatgcacttttacaggcagcaggaactcttgatcttgctcatggcgctcatattgttactcaacaattttatgataatttcataaacttagctggtagtggtcaaacacttggattaacaatggcaatgttattcttagctaaatctgctcaatataagcagttaggaaaacttgcaatcacaccaaatttatttaatataaatgaaccaatattatttggtactccaatagtgttaaacccaatcatgggtgtaccatttattatagtaccagtagtaaatgcactattgttgtactttgcaattgcaactgagattctacctccaatgggtggacaattaccaccttggacagtaccaccagttctttcaggtttaatcattggtggatggaaatatgcagtaatgcaatttgttgtaatagtaattggaggattgatttacttaccattcttcaagaaaatcgatgctatggcttatgcagatgaaattgcagctaaaaatgcacatgcagatgctggagttcaagcttaataagcacatactttaataagcccttttattaacaaattaaaaatatatttaaaccacaacttttatgaaagaagttcagatatttattatatagatatctggactttttttgtgtatgcatatattatttttggaaaaatttacttgaacatattgtgttgaacgatgaacgctgttattataaagatgttcaaaaaatgaactataaagtagttgattttaggattagaaaattaatatttaaaatattatgttgcaattgatacctgataaatttgaatgttgaaatcactatatgatttctagattataattctaaagttcatagtgcaatatatattatttgcatttagcaaattgcaataaatgttttaacttataggatatttaaagggggataaaaatgaacaagtttattaaaaaaatttgtgtcgcaggtttaatatctgtaatgacaggaagtatgatggcatgtggcacaaaaacagaaaacaaagtggcagaagcaacaaaaacttctgatggaaaaattcaaattgaatattggtatggacttggaggaaagcttgacgagaatatgcagaaaatagtacgtgactttaatagttcacaagataaatatgaagttaggcctatagcccaagatgattatgatacaacatataaaaatcttcaagctgcaatatcagctaaaaaaacaccagctcttgcacttttagaaccagataagcaatatacattaggatcaaaggatttactaacagatataaatgaaattgcaagtaaggattctgaatataatgcagataattacttaagtgcttttatagagccaggaaagcaggagggtaaacaatatgccttcccaatatacggaacaactcagcttttatattataatactaaagcatttaaagatgcaggaataagtgaagattcattaaagacttggagtggactagctgatgcagcttcaaagcttgttaaaaaagatggtgacgaagtttcattttatggatgggaaccaatgaaaggaccagacaacttagttgatgcagctttaagtaatggtgggcaagttttaagtgatgataaaacaaaagtaatgattaatagtgatgaatgggttgaagcttgggatagttttagaaaatggatacatgaagataaaattatgagaattcactctggtggacaaggctggcagtattggaatgatacagttgctgatgctatggaacaaaagacagcaggatatacaggatcagcaggagatcagggagatttagattttaatatattatcagcatatgaacagccagcatttaaagaaggtaaagaatcaaaacctgttgcagaagcaagatttttagtaatacctaagaatgtaagtgatgaagaaaagcaaggtgcttatgaatttataaaatatttcacaagtccaaaagttaatgcagagtggtcaatagcatcaggatatatcgcagttaataaagaaagtcctaatgatccagcatttaaagaatatgtaagtgataagccatatgcattagttccaacattacaggcagcacatgcatcacaagcatttattgatccaacaggtggaaagataagtgatgctcttaagattgcagctgataaagtagaaatagaaaatgttccagctaaagaagctttagatgaagctcaaaagacagcacaaaaggcacttgattcagtaaagaaataattggcaatacaattagcagttaacagttaataattatagttaactgttttgtggggaaattcctatggaatttaattttcaattttaagtatagatgttagctgatttatattaattaaaagaggagtagtaatggtgattatagatagaagaaaaacaattaataaaagaaaaattaaaaatttaatgagagttttaatgtttatattaccagcactaattccacttggagtattctggctgtttccaatgggtgaagcaatatttatgagctttacagactgggattacatgagttctgcatataacattgtaggttttgaaaattatagaaatatattttcagatagtatgttttatgatgcacttaaaaatactttaatatttacattgggaaccctagtacctactatagcattggggcttttagcagcagttatactaagaaagaaaataactggatcagcaatatacaaagctataattttttctccatgggttactcctacagttgtcatttcaatagtatggagctggatatttgagccacaatatggacttgcaaattatattttacaattgcttaatatgcctaaaagtcaatggcttcaaagttcagatacagcaatgacagccgtaattttagtgactgtgtggaagggttttggatgggcaatgatattttatcttactgcattagagagggttccaaaggaattatatgaagcagcagcagttgatggagcaggttcatggcagaagtttaaaaaaataacattacctttaatatcacctactacttttttcttaactataattacaacaattaattctatacaagcatacgatcagattcaggttcttactcaaggagggccatctggaagtacaagaactatactttatttatattatcagactgcatttgaaaattttaatataggtgaagcaacagctatagcagttattatattacttatcataggatgtcttgctggaattcaatttattgcatcaaagaaatgggttcattattaatataaaaaggagaaggatgtttatgaacatagatattaacaataatattgaggaattgaatatatcagaattattagatacagataaaaaaatttatattcctaaaaagacattaaaagaaagaattggcacattttcaagacatatattattaatatttataagcatagctacattctttccttttatatggatggttacaagcgcattgaaatcaagacaggaaatatttacatttcctcctaatataatcccagcaaatccaaactggcatatatttagtgatgtttttaaagaagctccatttggaacttatatgtttaacagtctttccgttgcaacaattgaagtaatatttcaaataataagtgcagcaatgattgcttatgctttaacacagtttaaatttgcaggaagaaaagtattatttggaatagtaatgtgtacatatatgcttccatcagcagtaacttatgtgccatgttacattattcttggaaaacttaatttactagatactcttacaggacttacaataagtaatcttgtaaatgtacttggaatatttcttattagacaggcatttatacaggtggataaaagttttatagaagctgcaagagttgatggtgcatctcacataaaaattttgtggaagataatgtttccgttaactaagccaacctttataacttttggtttaataagctttgttacttattataatgaatatatgtatccatcattgataacaaaaagtccagagaaatttttgatttcagctggaataagacagttttttattcaagatggtgcatatggaacaaagtggccagaaataatggctgcaagtacaataacagtattaccactacttatattattcttgattgctcagaaatggtttatggatggtgtggggggagtcaccgtagataaatagattaaaatgaaaatttagaaggaaactatccaattagcagattttaaatctactaattggatagttttttgtttataggtaaaaaaaatattttcttgtgaaactatttttataaattagcagtctaattagcataaaagaaaatttttaggaggacttaaatgaaaaaaatatttttattattaatggggattttaactatgatgtctttgtctgggtgtgttaacactaaaagtagttcagaaaaagaaactacagttaaggtaagtgtcaatgaagaaaaacaagcagagagtatactaggttcattaactgaaatagtagggaaaagtgacgaatatgtagtgaaaaagttaggtgaaggaaaagaagaaaatgggattgtttttagtagagaatataatatagatgttttaaaaggaaatgcccttgtaactattggttataatgagaataaagtagtagattcagtaaatatattgcctaatgatactgattatgatggaaatattgaattattgaataaagcttttggaaaatattcagaaagaaatgatgattctaaagaaagtgaagtagaggatagaaaatattgtatttggaatttagatgattgtacattaactttaatgcatgcatacggaagcttgtctgtagaaataagaaaaaatatataataaattaatttagaaaatatttaattatagtgaagaaggtgatgttctgaaatttttaagtaaaataaattcacaaaaaagatttagtgagattttagaaaagagtagagataaattatatagatttgcatattgttatgtaaaaaacgaagatgatgccttggacattctatcagaagcagtttataaaggatacatatcttttcacaaattaagggatgaaaaatattttgaaacatggatgataagaataataattaattgtgcaaatgatttttttaagaaaacaaataaatatgtctatttagatgaacacaatatagaaaatattaaagatataaatacatcattatcaatggaagatagaatggatttatacgaccttatggatagattacctgatgatgaaaagacaattataatattgaaatattttcaagaacttaattttagagaaatatcagaagtattgtctatacctgaaaatactataaaaagtaagttatataggacaataaaaaagctaaataaatatttgaaagaagatgaggtgaagtttaatgactaatagaaataaatatgaagacatcagtataccagaaaatatttcggaaattattaataaggctgaaaaaagaggaaaaagatataagcgatttcaaacagctaagaaatgttcagcaattgtatttgtatgtctagcgtttacaattacagttaatgttccagctgtttcagcagcattaaaggatatgccggtaataggaaaacttgtagacgtatttcaaattaataaaggcggaagcataactgatggagtattaatttcaacagagagtaaggaagatattattaagattaactttaatttatcagaaaatcaattaacaactgctcctagttatacagttaataaaaaggttggacctaatagaattgtttttgatttctcaggtgttagaaattttgattataataaactacaagaagatattcttagtagctcttatataaaagatgtatatagaaatattgtattagatgattcagctatttcatttgtagtagagcttaaagaaaatgtagactattctatatcagaatataaggaaccaggatatatggaacttaagttatttaataagaataaagaagaacctaaaaatgtttattttatacgatcaaaaccaatggaaaatggagaacctttagctatgatagcagagatgtattttgatgaagatgctactgttgtaaagactaaaaatggactttattcagttagcattggagagtattcttcaaaagaggaagctgataaggctctagaaacattaaaaaatagagaagactataatgaagaattatatgtagatagttgtatgagtaatgaaaatcctaattaagtaattttgtaataatgtgaaaaccatagagtaatataatctctatggttttatttttaatatttaaatatttatccctagaataatagcattttctgtgaaaaataatgcaaacatattattttttatatgcaataataagttcacaaggggagtttttaaatgatgattccgtagaagaatctaaagatgaatctgtaattacatagttaactttatcaattccacatatattaataggtacatctcttcctaactttgagctatcagcggctacaaaaacctcatttgatatttcaagaattttttttcgtgtaattgcttcatccatattgtagtcagaaatacctttatctaaagtaatacctcctgcacatatgaagctttttgaaatatttaaagttttaaagttaaataggtaatcataagctacaattgaactttcattatgtctaagttttcctcctataattataacttctacgtcactatttataagttcatttacaataggaattgaatttgttataactataagattttttatgttttttatattttttgcaatatgatatgtagttgagccgctgtctaaaaatatacagtcaccttcaattacaaattcgctgcatttctttccgataatttcttttatttcaagcttattttccattctgttttgcataagtggctcaccagaataagtttcagctaattttattccaccataaattttttggattttcccttgcttttctaatacagataaatcacgtcttaatgtttcaatggaaatattgaatttatctgtaagatcttttaattttaaaacatcattaacttttgctaattcaaagatttcaagctgacgttctataggatacatatctaacacctcacataagttgataataatattatatatcctatttagctattaaataggaataatttagactatttaaaaaagaatgtaataatacaataaaaatattatcacatatataaaaaacattgtcaaaagttattaaagagtatgcaaaaacattgtcatgttttacctgcaattaacaattgtataatacaaactttacaaagagttgatatatttattcttgtaaggtttggaggtggcttaagtgctagaattaaaaaatataaccaaaaaatttaatgacaagacagttttagataacatcagtcttaatattgaaaatggagaaatagtttcattattaggtcaaagtggaagtggaaaaacaacattattaaatataatcttaggtcttacgaatatggatgaaggaaacttaatttttaacggtgatgatatcactaatgtacatatgaaaaaacgtggatttaatatagtatttcaggattatgcattatttcctaatttaagtgcttatgaaaatataatttacggattaaagaataataagggaatatcaacaaagaaagaagttgatgaaataatttctattttaggattacagcagcatttagaaaaaaatataagccaattatcaggaggacaaaaacagagagttgctcttgcaagaactcttgtgactaaaccaaaggtattgcttttagatgaacctttaagtgctttagatggggttataaaagaatcaataaaagataaaattaaatccatagtaaagcagtttaaacttacaactatagttgttacacatgatccagaagaagcattaactttgtctgacaaggtattaataataaatgatggtaagatagctcaatttgggacacctaatgaggttataagtagtccaagctgtgaatttgtagaagagtttatattaaagcagctacatataaaaaagaacaatatatataatttgtttggagagtgcttagcatgaatagaacaaagatagaagtaaaaacaatatttacaataataacacttttctttataggatttttagtactgccattaggaatacttttctttaaatcaattcagatagatggtggaattggatttgaaaattataaagaaacaataagtaatccagaacttttaagagcagtaaaaaatagtacaattgtatctttatgtgcagcagtaataacaacaataataagttttatactttcatatgttttgaactgcacaagaatttttactcccataaaaaagtgtataagacttggagttatacttccaatgcttctaccaacaataacttatggatttgcaataatatattcatttggtaaacaaggattattaacaaagatttttggaagagaacttttgaacatatatgggtttaatggtttgttaataggttatgttatttatactcttccatcatcatttttactcataaacaattcttttaaatatattgataagaaatttatcatagtatctaatcttatgggtgataatagagcaaaacagcttataaatacaatactacgcccacttatgggtagtataggtggagcatttgtatcagctttcatattatcatttacagacttcggtataccagcagcagtaggtggtacatataatgttgtttcaactcatttgtatcaggttatgcttggagcaattcctaattttaatggtggggcagttatagctattttaatgcttatgccagcaattttaggagttttattactcaattatcttgaaagattcaattttcattatgacaaagtaacagatatagagcttggaaaaaataaatttagagatgtagtgttaggatctattgggagtttaataataatatccattctttcaatatttattgtaatgttcataacaccattcatggttgatttcccttacaatatgagctttacattagaatactttaaaaatactgtaacttcaaataatatacttactgtttataaaaactcaatattcgtagcagttttatgtgggatattcggtacaatggtaacttatcttggagcattaataaatacacgtacaagccttcatagaaaattcagaaaaagcttagattgtttttctatgattacaaatacagtaccaggtatggttttaggtttagcttatttaatgttatttaataagacagatttaaaaggtacatttttaataataataatttgtaacatggttcatttctttacaacaccatatcttatggctaagaattctctttctaaaatgaatccatcatgggagacaacaggtgaacttttaggagattcatggtttaagacattagttagagttgtaataccaaattcattttctacaataatagaaatgttcagttatttatttataaattcaatggtaacaataagtgcaataattttccttgttggaacagctacagctgttatgacaactaaaattaaagaactacagcattatgctaagttcaaagaaatatttgttttatcaatattgatatttttaactaatctgtttgtgagattaatatgtgattatcttaataagaaactattggataaaaataaaactagcaataaaaagataagtaataaagttttaaaaaataaaaagaaaaacaagggagagaagtttgaaatggggaaaatactaaaattaataacggctggaactatggcattaacattatctattggaatgttaggatgtggggcaaaatcatcggataaggttgtaatatacacaaatgctgatgaagaggctatagaaataatgcagaatacattaaatgaaaagggatatgaagataaatatgttcttcaatcatttggtacatcagagttaggcggaaagctaattgcagaaggagataaaattgaagctgatattgtaacgatgagttcatattttattgaaagtgctcaagaaaaaaataacatgtttactgatttaacatttgatataaaacctttaagtgagagtacaaaatatagtgcacctattttagggaataccggttcattatttgtaaatccaatagtaatagaagaaaaaaatcttagcatgccagaatctataaaggatttaacaaaaccagaatttaaagatttagtttcaattcctaatataaatgattcatctacagcatggcttctagtacaagctataatttcagaatatggagaagaagaaggtacaaaaatcactaaggatttagttgccaatgcaggtcctcacattgaaagttcaggttcaggtccaattaaaaaagtaagagcaggagaagtagcagttggatttggattacgtcatcaagcagtagcagatagtgcagaaggaaagcctatagaaagtatagatccaacagaaggaaatttcactttaacagaatctatagcagttgttaataaaaaagatgagaaaaaacgtaaacttgctatggaaattgcagaagttatagttaaagattcaagagaagagttaattaaatattatccagtcgcattatatgaaggtgaaactgtaagtgaaaaaaataaacccaaatattctaaacaatttgaagaaaagttaagtgttgatttattagaacagcatcaacaattttttaataatgctaagtaattgagaaaataaatatataaataaaaagatggagtgatatgcaatgaaaaattataaacttttaacaccaggaccattaactacaacagaagcagtaaaaaaagaaatgttattcgatagatgtacatgggatgatgaatataaatctataactcaaaaaataagaaaagaattattagatataggaaatgttcatgaagaagattatacggctgtattaatgcaaggaagcggaacctttgcagtagaatctgttattacaagcacagtgggagaaaaggataagctattaataattgcaaatggagcatatggtgaaagaattggacaaatagcagaacatatatcattaaatcatgttatatataataatggatatgatgaacatccaaatatggataaagttaaagaaatattagataaagatacggaaataactcatatagcaatggttcattgtgaaacaacaacaggtatattaaatccaatagaagatttatcagtaatagcaaaagaatataataaaacattaataatagatgcaatgagtagttttggaggaattccaatagatataaaagcattaggaatagattatttaataagtagtgcaaataagtgtatacaaggagttcctggctttggatttgttattgcaaagaaagaaaaattagaaaaatgcaaaggaatttcaagaagtttatctttagatttatatgatcaatataaaggaatggagaaggatggtaagtggagattcacatcaccaactcatgtagttgcagcattctcaaaagctttagatgaacttaaagaagaaggcggagttgaaggaagatataatcgttacaaaaataataacttggttttaagaaaaaaacttaaggaaataggaattgaatcttatattgaagaggaaaaacaatcaccaataataactacatttgcttttccaacagatgctttcagcttcaatgaattctatagcttcataaaagaaagaggatttgttatttatccaggaaagcttacagatattgatacattcagaattggtaatattggtgaaatatatgaagaagatataaataaactttgtaaaataatagaagagtacgtaaaggggatgaaataatcatgaaaaagattgaaggaataatttttgactgggctggaacagcagtagattttgggtgttttgcaccagtgaatgtttttatagaaatatttaaacaagctggaatagatgtaacaatggaagaagcaagaattccaatgggaatgcttaaaagagatcatataaaaacaatgatggaaatgaacagaatatcagatttatggaaagaaaagtacggaagattacataatgaagaagatattgataatttatatgctaagtttgagccaatgttaatgaagtctctttcaaactatacaactccaattgaaggcgttattgaaacaattgaaaatttaagaaataaaggcttaaagattggatcaacaacaggatacacagattctatgatggatgttgtaacaaaaggtgcaaaagaaaaaggctatgctccagatttctatgtgacaccagattcaacaaattcaaatggaagaccatatccatatatgatttatagaaatatggaagcattaaaattagttgatacttcaacagtagtaaaagttggtgatactaattcagatataaaagaaggtcttgcagcaggagtatggagtgttggtgttattgttggaagttcaaatatgggactaagtgaggatgaatataataaattatcacaaactgaaaaagataatttaatagagaaaacaaaggctggttttatggaagcaggagctcatttcactataaatacaataaaagaacttccagagcttatagaaaaaattaatgaagttattaaagaaggaaaaagaccatatgcaatcaatgaaaagcttgcttagagaaggtgatgcaaatttcactcataatagaaaactatggaatgacaatttagatgaaaatacagttgatattataggacaagatgaaagggtatttttaagacagtctatgtctacgccttgtatgaatgctgtttcagatgtagaaggatgttatattatcgatacaagaggaaaaagatatcttgattttcatggaaatagtgttcatcaagtaggtcataaaaataaatatgttatagaaaaaataaaaaatcagcttgatgaacttccttttataccaagaagatatacatcagatatagcagtcaaggcagcagatgcattgataaataagacaacatcaaagaattttaaagttttatttactccatctggaagtgcagcagtaggacttgctcttaaagtagcaagaaaggtaactggaaggcataaggttatatctatgtgggaatcatttcatggggcaggtcttgatacaatatcagtaggtggcgaatatgtatttaaaaaagatattggaccattaataccaggtgctataaaatcaataccttacaatggatatagaaatttaataaatagtgatgataacataaaagtttcagatttctgtttagattatttggaatatataatagaaaatgaaggtgaaattggagcaatacttcttgaaccaataagagcaacagatacacatgttccgcctaaggaatatttcaaaagactaaggaaaatatgtgatgaaaataaaatacttctcatttttgatgaaattccaacttgtcttggaagaagcggagaattttatgtacatcagaattttggaattgagccagatatattagtgttaggaaaaggattgggtggaggaattgtaccacaggcagctgtcttagtaaataaaagatatgatgttgcagaagacatatctttaggacattatacccatgagaagcctgcaattggatgtgcagcaatatgtgcggcaatagaatatattgatgaaaataaccttatggagaattgcagagacttatcgcagtttgcaatgtctagaggaaaagaattgatgaataagtataactgtataggtgatttcagaatacagggacttcttatatcctttgagtttgtcaaagatagaataactaaagaaaaagatactgatttatcagaaagaatattatactcatctttggaagaaggtttatcttttaaagtatcatcaggaaattgtattacgtggcatccaccacttgtattaagtaaggaagaattagagtttgcatttgatatatttgaaaaagccataattaaaaaccaaagttaaaataaaaaatcatgttctataacgtacattttatagaacatgattttttttatggtttaaattataaatttaaaactatcaattataaattataagctgtaagcatggtgcagctattttttattctaatttacttaattataattaaatgttgttatagatgttatagattatatattttaaattataacttatatatatcaacaacatttaatttaaaaaaggttatgatcatcttttcaactatatggttgtaattaaaaattatattaccaacatttagttttaaaaaagttataggcataatttatagatatataagagggtgggaataaaaaatccgagaagtataaaaaaattaaagaaagccttcggttttccctataaacagctaaccgttaacttaattcataaactcttacataatctacatacattttagctggaaaattagtagaatcatcaggatcttttggccagtttcctccaacagccatgttaagtaatatgaaaaatggttgatggaatgcatcattattttttatatttctttcaagattagggatgattatatctgatatgtcagcagcacagaataattgatcatccacataccatttaatataattttttgtccattcaagagcataaacatgataatcatctagattatcaacagtaacgctttgcccaaaagtttgaggtccgttattatcccagtgaagagcaccagatactacaggctctttatttacatgttccataatatcaatttcaccacagtaaggccatttgtcatctccagtaaaactgcttccaagcatccagaatgcaggccataatccttggtctagtggaagctttatacgtgcttcaattctgccatatgtaaattctttaagttcttttgattttaaacgggctgaagtgtaatctgatccattataattttctttatgtgcttcaatgacaagatttccatcttcaattctagaattatcgcttctatcagtatagtattgaagttcattatttccccagccattgttacttccgttattaccttttcctatatcataagtccagttgtctttgtttatttcactttcatcaaattcatcgctccaaacaagcttcattttttcataaggctttgagtaaaaggtttcagcacatgcatttaatggtgatagaaatacagaagtaaataaaagtaaagatgataatttaaataatattctttttttattcacaggttgaatcctccttttggttatatttagaattataacatatttcaagtagtcagtgggatatgcttaaggagaatattgttaagaaataaattatagagtttaaagttttttatatacaatttggaataaagtcttttttatactcatgaacctcattatcaattgataattaataatgtagaaaaactatggacaaaaagggtataaaacgcatataatattatcaaatgataattggagggaatttatgggttataatttaggtggtttaaatagtgaagaagttgaaaaacttcagagaaaatatggaatgaatgaattaataattcaagagaaaccaaatatgttaaagaaatttctgggtgtattcaaagaacctatgtttttacttttattaattgcagccacggtatattttttattaggagctcctaaagatggtgcaataatgttagtatttgtaggttttgtagcctcaatcacttttatacaggaatggaaaacagaaaaaacaatgaatgcattaaaagatttgacatcaccaaaggttaatacattaagggatggaaaaaatatattaataaaaagtacagagcttgttcctggagatgtagtatttctttccgagggggagagaataccagctgattgtattgttttagagccttcaaatttttcagtagatgaatctatattaactggtgaaagtgaatatgtaatgaaagtttcaactactcaaagtgaaaaaagcactgattattggaaaaaagatatattatatgcaggcactttatgtgtgtttggaaaatgcacagcaatagtaaaatttacaggaattaatactgagtatggaaaaataggaaaagctattagtgaagcaaaagatgagcctacaccacttcaaaaaaaggtgagtatattagttaaaaatatagctatagctggagttatattgtgtattagtgtaatggtagcatcttatttttacagttttaatatattaaacagtatactttcaggaataagtttagcaatggctataattccagaagaatttccagttgtattgacagtatttttatctatgggagcttacaggttggcaaaaaataatactttgatgagaaagatatcagctgttgaaactttggggtctgcaactgtattatgcgttgataaaactgggacaataactcaaaataaaatgaaagttaagagtatatatagtgatggaataattttcaataatgaagatttaaaaaatcaagaattaagtgatttgatggtgttatcttgtgagaaagatccatatgacccaatggagaaagcaatattggaagctgctaatttatctaagttggaaactttatataaatatgatttatctaaaaaaatagcttttgattcaaaaacaaagagaatggctaacatatatataaaagataataagtattatgttgcagttaagggatcggcagaaaccgtattaggactttgtaatttagataaacaaaccatggatgaaataaatattgaaatagataagatggcatcaaatggattgagagttttagctttagcggattgtactagtgaaaaagtttatgatgatctagaatgttatgagttaacttttaaagcattggttggattacaagatccacctaaagaaggtgtagaagaagcaataaagctttgcaagaaagctggaataagagttgtaatgataactggtgattattccaaaactgctatggcaataggtgaagaaataggattaaaatttactgataaagttatcgttggtaatgagatagattcattaagtgaaaatgaattatgtgaagttgtaaagagttgtgatgtattttcaagagttataccagagcagaagatgaagattgttaaagctcttaagaaaaatggagaaatagttgcaatgactggagatggcgttaatgatgcaccagcattaaaaagtgctgatataggaattgcaatgggacaaagaggaacagaagttgctaaagaagcagctcatatgattttaatggatgataatttcacaaccattgtaaagtcagttaaggatggaagaagagtatatgataatataagaaaagctatggtatatattttaataattcatattccaatagctgcaatggcaatgtttgcaccattgttcaatttgccaccgttacttttgccaatgcatattatgttgttagaacttatcattgatccaacatgctctattgtatttgaaggagagccagcagaagcgaatataatggagaatcctccaagatctccacaagagccattacttacaagaaatttaacaataaaagtagtgcttcaagggataattatgtttttagcagcatttatgccatttcattatatgattgatttaggaatatcatcagaatatgccagaagtttttccttaataacttttatagtagctaatgttacattggttttggttaatagatcaaatacggaattactatatcatcttataaaagaaaaaggtagtaaggtaagattaattgtaaacagcatggcattgattatggtttttgctattgtgtatatacctattctgaatggtttctttagaacagaaaaaataggagtttatcctttaatatttgctatagtattaggatttatatccacaggatggtgggagattgttaagattactaggaagataataagaaaaggaatttattaaataaaagtaaaaatcataatgttaataaaaactggatatataaaaaagtttgatactaggcgataaaaaagaggttgtataaaaataatttgatactagttgttgaaaaaagagaattcataaatttgaattctcttttttgcgcataatattactatgaaaaaaattataaataaatgtaatattaaacctattcatcaaataggtttcctaatttgatacagtcaatttaatttataatagtaagtaagtataataattctatattttaggtaaaattatataatatagaaattaatattaaaaaaggaataataattattgaataataattattattggtataaaatataataaatgaagaggcggagggatatattatggaaagatcaaagattgaagaaataatggaaagatattcaggaactactattaataatgaagttggaaagccatggagtggaattaaagagctaatattagttgacaaaataaaagaaactgaggatattacatcattctactttaaagcaaaagatggaagtaaacttataaagcataaagcaggacaatttttaccttttacaataaaaactgatgacgagaaatatagatatgtaacaagaacatatagcttatcaatgaagcctaatgaagatatttatagaataagtgtaaagagagttcaaaatggcctaataagtaactatctccatgataatttaaatataggagattcaatagaagcaatgatgccttgtggaatttttacattggaaaatcataagaaggataaacctacagtattcatatcggcagggataggaataacaccattattatcaatgttttatgatagtgcagataaaataaataatattacatttattcaagcagttcaaaattcaaaaatgcagccatttaaaaatgacattaaagctttatgcgaaatgagtaaaaacaaagtatatgtcttctttagtgatcctaaagaagatgaaatactagggaaagactatgattttaaaggatttgtaacaaaggattggataaaagataacctggatttaaattcacaattttatttctgtggaccaccaccatttatgaaagcattaaataatgcacttttagaacttggcgtaagtgaagaatacattaattatgaattttttggagagcagcaaaaattataaaatttaatacaatatataaaagaactaactaggttggatagtttgattaattctataatcagaaatagtgagagtacaaatagaacttaggatttatgaaaatattaaatagtattaggaaaggtgatgttgcactaaaaaacagtgtaacatcacctttttgatactgtaatatatatattaatgttttttaaaatatgtttaataaacattaaatgtaattgtgaagtatctctaattgcattgtttaattaactatatttattttatatattcgttgctaactaagctatctgataaaatttctgttggtatgacaaattcaactacccccatatatccaggagcgacttcatatttatcaaatgaaattacaagtttaccttctgaattaatataaaaattttgatcttttgaaatcttttcgaatagatccatatccacatctttctctattccttcaacccaataaaatttattttcatcggctttattttgttctatcatttgtttttttatgttttcacttatgatattaacataactatcgtttttaaataaacttggtagcgtaattaagatttcactttgcttatctatggtatcatacttcattgttgttgaagaagaaccaacagtatttacaacatatcgacctatagataataacctatcattatctgtctttacaacataaccactgcttacgcctaaatgaccatcaccgttacttttcatatcttccatatcatccatgaaatcttcatatagctttttattttcagtaagatatttatcatttaaattgttttcaaggtctttattttctaaaccttgtatagaaggaacttttatatctgcgttgtaactatcttcatttacagtatactctcggaaagttagtatttttactatactacctacaactggtacatttgataatgatgctgcaaacactggactactattaactccaacagtaaataaagctgttgcagcaacaattgaagcagctgctatttttatacctttaaaattagctttagaattggtgatttttactccattgtcttctaaagattttttgactataaaatctaattctacaggaataggaacatccatatagttcttttttaattgttgcaaatttttatctttcataataaacctcctcagaatcattcatttttatacgtaaaattttaagcgacttatataaacggctttttattgtattaatattttcattgagaatttctgcaatttcatctatctttaaatcttcaaagtatcgtaaaattattattgtacggtaatttgatggcaggttatccaatgctttttggagatcaacattttcataatcatcaattactccatggtctaaactagaaaaaatttctgaatctacaacatcaagttttcttttttttcgtaaaaaatctaaagaagcatttactacaatcctgtagaaccatgtttttatataattaggatttttcagagaatcctttgatgatagggctttatatatagattcttgaacaatatctaaagcgtcatcagcgttttttacatagctaaaggccaagcagtagatattttctttatattggataacataatctgctatttggttttccaaacaatttttgttcattggtaccaatacctccttttcattgatttagatattcttattgaatactttatattttatagacgcatatgtaacataaaaagtttttaaagattttaaaataatatatatgttgagctatgaactttaaaattataatttggaaattatatagatgaaaatattcttatatctaaagataatgttttgtgtgaagtagttaagaaagtttaaaagataacgaaatttaagaatactaaagaagaaagtaggtaggatatgaaatttcttattaagagatatggaactagtataaaaataaatatttttgataagattataattttattaacagttatatgtttttgtgcaacattaacattttcctttatatcttattatagttcatggaaaaataatgttgaatctattgaaaataacttggaggaattttctaataacacgaagcttttaatagaagagtatcttgataaaaattttaaaatactagattatatagcggggtttaaagaaatttacaaaatggattggaaagaacaatatgaatttttaatatcaaaaactaagaatttagattttaatcactatataataatggacatgttaggacaaggacactatacaaatacaggagaaataaaaaatcaaattaatgaagaattttatagggatataatatttaatgaagaatttctttctgaaccttttttacaagttaatgaaaatcgctcaattacaactttaagtgtatctatatatgataaagaaaatgaaaaggttggagcattatgtggtgttatagatttaagtaagattaataagttatttgaatataaaacaataggaaaaggaggatattgttttttaataaatagagaagggtactatgtttcacataccaatatggaatatgtacataaaagaaaaaatatattcaatgatagtgtgattgatgaaaataataatattgaatttttgaaatatgtaactaatataaataaatcgttacttggaaatgttacattgaataataatgtatattatacgagtattgatccaattgaaaatgctgattggtatgttgtatatctgtttcctaagttagagataatgaaaaatttaaacaaatttattagttttcaaattatggttgtaatatttggaatattgttaatgctattgataataagattaatttataccagtattgaaaatcataagatggcatgtacagattcattaaccaagttaaacaatcatttttcttataagttaacaatgaaaaaattagaaaataaatacaataaaaatattacaattataggttttgatttaaatggttttaaactaattaatgatacatatggacataatattggagataaggcactttgtgtattttcagaaattttattaaaggtatttaaaaataaagaatttgttgggagaataggcggcgatgaatttatagtaatttcattagaagataattatgaaaatactgaaattaagctaaaagatttagaaaagttaataagtgaatacaataaggagagtgaatataggttaggtacttcatttggatattgtactagggttaagggggataagtcgtctttagagaaaattcaacaagaagcagatatttgtatgtataaaaataaaaaactattatagatattttaatagaaagtatgtatttttcaattaaaatattattaataatattctatgtcacataaaaatatcatagatatatgtttattgaatgaagaatagtagctttctaattgtaagtgtgggctactatttttttgtggtataataaattagttgataaaactatttatatgtaatatataaggtgaaagtgaggaaaaatttatgaattatgagatcagtgtcgtagttcctgtgtataaagttagagacagaataataaggacactagaatctttaaaagctcagacatttaaagactttgaagtattatttgtagatgatgggtcaccagatgatagtagtgattttgcagataattatcttaaggattcagatgttgcttataaaataataaagaagaaaaatggtggtgtaagttcagcaagaaaccttggaatagaagaagctaaaggtgaatacataatgttcttggattctgatgattatatagataagaatatgcttaaaggattttatgataaaatattggaaggaaattttgatgttttatattgtgcatatgtctttgaagaaagtaacgaaaaagaaataacaaataatatgaaggatttaaattatggtgaagtgtctggaaaagaagcagctcttgggctaatctatgggactacttatactcacataatggcaaatttatttaaacgttcactactaataaataataatataagatttgatgaaaagagaaaatttgcagaagatatctcatttatggtaaaagcatatgcatcttctgaaagagtatattgtataaataagatttacgcccattatgtaaaatggggagaatcggcaatgaacaatataaatttaaactataaggatgtctattattctaatgttgaaactcttcagtatataaaagaaaagtttaatgataaagctttagaaaaagcaatggttacaagtagaataccagctgcaatagtaaatatatttataggatttgcaactaaaaaagaattacacgatgatatgtatgaatttattaatgatgagaaggtaagaaaagatttaagaagatataaaatgtataaattagaaaaagatagattgaagtatttaattttgagtaaagttattttacttaagcctagcatcatagaaaattattatggaaaaagaagctgatttaaattaacagttaataattcttaattgtaaatttaaaattggaacatatatattgcaattgacaattgacagttgagaagtgacaattaaggtgaaaatccttacagaatttttgaaattatatgcagaataattattgcaacatatatataacaaaaaataatttctacattataagaaaggataaaacaatggttaatgatagaactcaacataatgaaagtgattacgaggatttaagtttaagagatgctcagatgttaatggttgacatattaaaagacgttcatgcaatttgtgaaagacatggattaaaatactttttagatgctggaacacttattggagctgttaggcataaaggatttataccatgggatgatgatatggacattggaatgcttagagaagactatgaaaaatttcttgagattgcaaagaaagaattaccagatcacttatttcttcaaacatttgagactgatgataaatacgatatttatcaggttccatgtaaaataagatataatggaactattttaattgaaaagggaatagcagaaaatagtgaaatgcataatggtgtatatattgatgtattcccttacgatagtcttccaaaaagtaattttgtatacaaagttcagagagcgttaagttacaatatattaaagagctttataagaattcgtgaaaagccagaaaacttaagtttgaaaaatagacttacatttactttttataagatagtcagaggattatttcctgataaaagaagaaagaaattttttgactttttagtaaaatggaatgatgttaactctccatatatgggatatggtttagatactgtatggagtgagtatgtttataaaaaagaagactattttgaacttacaaagcttgaatttgaaggaaattatttttatggaccaaagaattaccatgctattttgacacagttatatggtgattatatgacacctccaaaagaagaagaacgtcagtggcatgcaaaggaaattaaaaagcttaaaagtatttaaaaccactttgtgaagttttgcttaagaagtattcataaatattgcatatgcaagttaatattagtataattctatggtggaagttaatttaatttaattgacaattaatgttgaaattactttgtaatttttaatattgtgtatgcaaatttaatattaaaatatatatgtattaattttattaaaaagatatataactagaattaataagatttatgtttgaaaggtttaaattaaataatgattgagtaaggagtgaataatttggtaaaagtatctataattactcctgtttataatgtagaagcttgcattgaaaaatgtgttaagtctgttatgaatcaaacctgcaaggagtttgaatttttacttatagatgatggatcaaaagacaaaagtatagatattgcaaaagaattattagaaggttctgatattaattacaaaattataacacaaaagaattcaggagtaagcactgcgagaaatgaaggtataaaaaaggctgttggagagtatattacatttttagattctgatgattacatagctccagaatttatagaattaatgactaaaaaagcagataaaacaaattgtgatgttgtattttgtgattatagcgaagttgatgctaatggaaatgtattaattgagagcagaactaaatatttaagtgattttataactggaagagaagcagcattaaagcagcttgcagatgaaattactataggtatgagaagtggtatatacaagacttcagtcattaaggataataatattttctttgatacaaagagaaaatatggagaagacatgatatttatagttaaaactttattagaagctaataaagtaatttctgttaataaggttcttgccttttatgttatctggagtaacagtgtgactcaaaatgtatcattaaagcatcttgattgttactactcttacgtggatttattggaatacataagagataagggagatttacaagaaattgataagttccttgtggaatataaaataccatattctatatcacatgtattttcaattttatcaaaagatccaaagttccatgatgacttatttgagttcttaaataaaggacaggtaaaggaatcattaaagagatataaaattcagaaaatggataaaaataatattagatattttattcaatgcgaaggtatgagaaaatgtcctaaattatttataaaaattttaaataaaataagatagaattattcaaaaggtttaaattgcttttgagcaaaaatctttccagattggaggaaagctgaagtgaaaaaatggaaaactttaataattatgataattgatatattcatggtgaatatggcatatttattttctataaatatagtcatgggagaaagatttacagaaatttcaaagatttatacccatgatgttattgctttaagccttatatatcttgtatgtttttatctattcaaaatgtatgaaagcttgtggcatttaacaggaaccgatgagtttctacttggtgttggaggaaatattctagcaggtatattatcaataggatatactagaatatttggttcaacaataccattaaatgtttcagttgtaggtatacttttaagtattttctgcgtacttggttacagaattctttatagggtatatagaagaactctgttatatataccatttaagtattctgcagatcaaagaagagtaatgatagtaggtgctggttcagcaggtactatgattattaatgaaatgatggcaagaagagaacttaaatataatcctatagttcttattgatgatgataaaagtaagcttggtaaaagaatatctggtgtaaaaattgaaggtaatagatatgatataccatatattgttggagagcaggaaattgatttaattgtaattgcaattccatctatagactctaaaaataagtcagaaattattgaaatctgtaaaaatactaactgtaagctacagataataccaggaatgtatgaaatacttagtggagatgctacagtaagcagaattaaagatgttgatttagaagatttattaggaagagatcctattcagttagataataaaggaatagaggattatataaaaggaagaactatacttgttactggcgctggtggatctattggatcagaactttgcagacagatttctatgttccaacctaaaaaattagtattgtttgatatttatgaaaataacgtttatgatattcaaaatgaattaagagaagacttccctgatatggatttgtctgttctaataggatctataagagatcgtgatagacttcatgaagttttcacaaagtataagattgatgttgtattccatgctgcagcacataaacatgtaccattgatggaggacagtcctaaagaagctgttaagaataatgtatttggaacacttaatttagcacttgaagcaagtgctgcaggtgtatcaagatttgttatgatttcaacagataaggctgttaatcctacaaacataatgggtgcaacaaagagattatgtgaaatgattgttcaagcaatggataaacagtcaaagacagaatttgtagctgtaagatttggtaatgtacttggaagtaacgggtcagttatacctttatttaagagacaaattgcccatggtggtcctgttactgttacacacaaaaagataataagatactttatgcttatacctgaagcagctcaacttgtacttcaagctggtgcatttgcaaaaggtggagaaatttttgtacttgatatgggtaaaccagttaaaatatatgatttagcatgtgatttaataagactttcaggacttgaacctaataaagatataaagattgtattttcaggacttagacctggagaaaagctttatgaagaactactaatgagtgaagaaggtttacaagatacagttcataataaaatatacgtaggaaaaccaaccttcgaagatatggataaattaactattaagcttgaacagttacgtaaactgttagagttaaatgatattgatgaaattaaacatgtgatgcagatgatagttccaacttatcattataaaaatgtggatgaagttgctgctgaaaatgcagataaggagtaattatgtctagagaagagaaatacagaaatatagctttaggattagttattattattgcttgtattatgggagtaatgaatggaagttaccttataagtgcaatgtatatagctactttagtaggagcagtatttattgcgagagatagagatatatatagtgtgctttatacaacacttttagtatctgtaatatatgattatgttttatatgtaccaggaatacagtccgtttatatgttccatattattttaggcatatttacacttatgtcattgtataagttgtttacaaataaagaagtgttcctaaagcttgataaaaaagttttaggtttgtatatggtatggtttgtatatatgtgtgcaagtgttttatgggctataaatagaaaattatcaattaaatatattgcgatatatttaatgatgtttgcatttataggttgcttaatggcttataacataaataaagaaagactaaatacgactataagattattattatatttagtttcacttattgttgtaataggattaatagaagtgcttttaggaaaacaacttcctgtaagacactacattgatggatttttaagcagtcttccacaatggcagattaatacaattcaagcaagaccaatagtattttcttataatacaaacaatcttaatgcaacacttgctatacttataccaatatgcctttttgctgtgtataagtttgaaagtgtaatagcaaaagtatggtttagcttagtttcagtgattgcatttgcactagtggtaataacaacttcaagaactggatatgtagcattcttgttctcagttggaatatttgcagtatattcattgtttaacatgcgaaatcttggaataaaacaaatggtttatccagtaattattgcattaggaatggctttagcattctattatgctcctggtatgatgaatataaaaccagttgaaggtgaacaaattcaacatacaacaacacttacaggaaaacttcattctcttgaaagcatggttgcaggagaagaaacaggtgaatactcaacacttaatagaatggcgataattaaagatgtattaggtggagtaataagtgaaaagagataccaaggttttggtgttggtaatgtagaacaatatataaaggatcagggtaatacaggaagcatatatagtcctcactgttatccaattgaaattttaggtgatttcggaatacctggagttttactatttggaatatactatttatacttactaggatataattttattttagcaatcaagaaaagaagcacaatgtgttttgcaatggtagcagcattaattgcatttgcacctgcaagctttggacctagttcgataacatatgtattctcttactggattatgattggactttctgtaagttgtattcaagtttatagaaacagcgataatgaatacagaagaacttcagatatgaaagaatataaacttgtgtaattattatttccaagggaatatttaaataaagaaaagagatttcgataataaaataattattgaaatctcttttttgtattaatacaattaactttgaagcatagtctcacgggagaacttgcatttaaaatacttatccaaaataaagaaaatatattcccaaaacaacagatccagtaacgagtattttactaattagaagctgtttttttgtgaagaaccttattcctgtaccaattactgcaatcgagcctacaacccatgcgaaaacttggggaccaataaaatttataggctgtgaagtagcgttcaaatatgcaattgacatactataagcagtcattaaaaccaatagtacatcgcttgtattatttttcttaacgacaaacaacagaactataccgacaattgctaaaatactcattcctacaaataacaaaaacaaaaaacctaatgccatattcatatcctcctttaatacaacaattcatataatgtatctttatcatataaatataataatcttaaaatctgtactttttatttataaaaatctaaagaattctgtatatcagcaaataggtaattgaatttccaaagtgaaaaaatcatctttttccaaaatagaaagtgaaccaccaatctcacagattaatttttcaacactttttaagccaatcatgtgactttcgataacctttttatttttttcaatgattttatttgtttgataaaaaataactttctgtgccttcaactgaattttgaactctacaggatactgatggtctgcatatttttgaatattagaaataatattttcaaacaaacgtgacatttttctatgatcaatcaataaatagaatacgtaattgtccaaaagtgatactatactaactttaaatccatgatcttcaagaaagctcttagcatctgacagagcatttctaaagaaaattgtcccatcaaatctttctaacatgcctgttttattcccatcaaaaacgcaactattaaaaaggctatctgacatttctttaattctatttgccttgtcataggctctttctgcatatagatgtaattgatcttcattggagtattgtccatctctaataaattgaaggtagctcattacagaggttagtggagtacgtaaatcatgggaaagcacagcaatagtctcaaatcgttcttgagttatttgttcagaacgatttagattataagacatagcttcggctaaatggtttatactaagagcaaggtcactaagctcatcttcaccttcaatgggaattctttgaaataggtttcctgattccatttcctctacaatgctactgatttgtattatataagaaaattttttttgtaataatagaataagtacaaaaacagtaataaatatcccaacaaaaatgcacatcagattaagcaagtattctgtttggagtgtaatgtccattcctgttttcagtgcataattgcttgaaataactctggcggtccataaaaaaaacaatatgcaaacccaaccgcatagtatagaaaagccaaagtacttccctaacaataacaacagttttgaagcttttttatgtttaaccaatataatatccccttccccaagctgtcttaatatatttaggctctttaggatttttctcgattttttttctcaaatttttaatgtgaaccatgattgcattgtcagaagctccgatataagaatcattccaaatactactatatatattttccatagaaaatattttttttctattcagtgccaataactcaagaatatcatattctgttgaagttagaggaattaaaacaccatcaactgaaacagttttttcatctgtatttattaccatgtctgaaacaagtaatatgggatttgattgttgtgtaggtatgctgccatattgagagtatcttcgtatcaatgcttttactctcattaaaaattcagcgttagaaaatggcttggaaagatagtcgtctccaccagcagaaaaccctatagccttgtctgactcttgtgttctagcagtaaggaacaaaattggtgccatagttttttttcttatttcggaacaggcaagaaatcctgaaagtttaggcatattaacatcaagaacaatgagagaaaaactttcatctgcaagtgatacaacttcatcaccattagatgcggttgtaatatcatatccatctccacttagtaaaatggaaagaatctctagaatttccgcatcatcatcagcaatcaaaattttttgagttttatgtataaaatccatgttttctcctttcaatcatttaatagaattagtaaaataaattttctaaagtctctttatttaaccataattatgatggcacatcttataggttaagtatatgagacaggtttttaacttagatagttttatttaactttaacatgttagtattagtataaaataagggattcattaattagaactgattaaaataatagttaatttgaattaatgtgtctaatatgggaagtagcagaagatacgaataattatctagagatgttgttgtagacctatttaagtaataaatgagcctgaagtagaatggaatttcaaagtgatattgatacaaaatttactttaataagtagtgcattaattatgaaataaatcgaataaatattttataatagaaaattttttatgctttatgttaggttgatatgtaagaggatagtagatagaataattatctactatcttctcaattttattttaagtaatcttcaattatatttgtgattaaagatgaagtatctccgttaccaaaagcagatgcaggagtaccagttggattaaagttttcaattgcatctttgattttgttagagtcacttccaacaataacattccagccattattaacagtttcaacccattctgtttcatctctcatagttatacaaggtttatttaagaagtaagcttctttttgaactccaccgctatcagttacgattttagctgagttttcttgtaatgcaagcatttctaaatatcctactggatctataattttaatattatctccaacatgtaggttatactcagagatgaacttcttagttcttggatgaagaggaaggattattttctttccacactcacttaaagctttaataatagatgttagtctttcgatgctatctgtattttcagcacgatgaattgtagaaagaatgtagctttctggagctaaatctaaatctctagttatagtagaaacttcttttgctctttctttaaataagttaacagcatcatacataacatcacctacattatgtactccttttgtcacattttcagcttttaagttatttacagctgtaagtgtaggagtaaaaagaagttcagaaatatgatctgttaatattctgttttgctcttctggcattgctttgttaaaacttctaagacctgcttctacatgagcaacaggaattagcaatttacttgcacaaagagaacctgcaagagtggagtttgtgtctccgtaaactaaaaccatatcaggtttttcttttaaatatatatcttcaagagccataagcatgcttccagtctgatgaccgtgatttgatgaaccaatgcttaaattatagtctggctttggaattcctaattcttcaaagaagatgtcagacatattattgtcgtaatgttgacctgtatgtactaatatttcagtgttgccgtttcttcttattttattggatactgttgcagctttaataaactgtggtcttgcacctataacagttaaaattttcatagagatttcctccttaattatatatgaaataattctaatgttattttatcatatataataactaacatacaatgttgctagtactaaacatcaatttttactatataaaattaaaatttataatttgttgaatttagtaaatataagatttaaatattaagaaaatatggttagtagcgataattaaggagaatattattgattaaaatagtaataaaatgaaaaatgtatatatttgaaaaaataagtataaatgatacaataaagataataatggtataaacatattaacaaagttaaagtataaggagtaaattgagatggaaaaattaaagaggagttcatttaaattaaaactattatctggtatattacctatagtaataataggaatgggaattttgagtttttatactgtatataagttcaatgagagcattgaaaacagtacaataaaaagaatgactgaaaatgtaaataatatgtctgacattataaatgaatggattgatggaaagttattagaagtaagaagtacagcaaatacacctactgctaaactaattagttcaaatatagaagcagtagatgaatttaataaaaatagaatattgaatttggaaaaggattatccaggggaatatgacaatgcagctgttataagttttaataatgatggaatatcaagagctcagtatgcaaatggaaaaactgttaatggtgatgtatcagaaaaacaatggtataaggatttaatgacagggcgttcatataatatatccaatccagtaatatcaaagggaagtggaaaaactttaattgtaattggtgcagcagttaaggatgattcagataatataattggagatatgatatcagcagttaatatttctcgtattcaagaaaaaattaatgaatttaaatttggagaaaatggatatagcatacttatttcagatgatggaacaataataacacatcctgacgaatcacttattatgaagtcaaagataactgagttagatgattctgatatggttaacttaggaaaagaaatgctaaaaagtgattcgggtgattttaagtttggtgtaggagataataaatcaattgctttctataagaaaataccattaactaattggagtgttgcaagtgttatttcagaaagggaattgtttgcagaaggcagaagtttagttactacacttgctatggtttcagtaatcataataattattatagcaggaataattatatttatggctaataagttttcaaagcctttacgaaagctatgtgatttttcaagtgaaatagcacaaggaaatttaacatgtgaattaaatattaatagaaatgatgagattggacaagtagctgacactttaaaaaatacatcttatgagcttagaaatatggtaattgatataagtacttcagctaatgaggttaataaactagctgatgatgtaaatgaagcaataaagcagtcgctccttggaactgaagaaattactaaaagtatggaacaaatctcaaggggagctataaatcaagctgaaaatgcagataaagcttcggaaattacaggtgaacttgtagatgaaattaagagtgttgttgataagtgtaactatatgaatggaattgttaatgattcaattaagatgagcactattggtactgaaagagtgcaaaatgcagtagaaaacattaaatcaattgaaaaaataaataatgaaagtatagagcagacactaaatttattagagaaatctaatgaaattggacaaatagttaatgttataagtgaaatagcagaacagacaaatcttttagctttaaatgcttctatagaagctgcaagagcaggagagcaaggaaaggggtttgcagtagttgcaagtcaagttggagagcttgcaaaacagtcaaatgaagctgctaaaaaaattgaaaatattataagaggaattcaacagcaggtacaggttattgataagcaaatgaagtttggtgcagaagaggtggcaaatggagttgaaactacaaaatctgtaagtgaaaactttactgaaatagaaaagacatttaaagaaattgaaagtgttgtattagaagtctttaatgcttcaaacataatggaagaaaaggcatatacaacatctaattctataaaggaagttgctggagtgactgaagagaattcatctgcaacagaagaagtaacagcagcaaatgaagagcagagtgcatctatgcagcaaattgcagaaacaacaagtaaattagatgaactcattgaaaatcttaatgagacgattaaaaagtttaagatttagatatttataatttatagaattttaagtaaagacaaaggttattaatctttaaataacttttgtctttttttgtattttattactcaatttcaaatatgctaaaaagcagtaactatccaataagagaagatagattttgccaaaagactatgatataattaataagttaaaaatcaagttaatatgtatttataatgggaatactattaatactataaataggcaatttatacaattgataaaccaattgttttattaaaggagaatttttcaatgaatatcttacttattaatcattatgcaggttcagactaccacggtatggagtttagaccattttacatggctagagagtggaagaataaaggtcacaatgtaactatacttggagctaacttttctcacttaagaaaaaataatccagtaatagaaaaagactttcaggaagaagttatagatggaataacatatgtatgggttaaaacaccacaatatcaaggtaatggtgtaggtagaattaagaatatttctacatttatgtggaagcttagaacgaattataagatgcttgcagataaatataagccagatgcagtaattgcttcatctacatatccattagatatttatccagcacatagaattgcaaagagatgcaatgcaaaattatgctttgaaatacatgacttgtggccattaagccctatggaaattggggggttctcagaaaagaatccagcaatagtaatacttcaaagagcagaagattttgcatttaagaattctgatgtaattgtttcgattttaccaaatgcagataaacatataagagaaagaggtttctcaacagataagtttgtttatgttccaaatggaattcttacaggtgaaaaaaatgaagcaccaatggaaaaaacaattgaaagattacaggaattaaaagaacaaggatatttcttagttggatacacaggaaatcattcaccagcaaatgttcttgatactatgattgatgctgctaagaaaacaactgatgaaaaagttaagtatgtattagttggtaagggtaatgttaaaaatcaacttatggaatatgctaaatctaataatgtaacaaatattgaattcttagatccagtattaaaggataatatggataatgtattagagcttctagatataggttatataggtttaaagaaacagaatttatttaactatggagtaagtcctaacaagctttttgattatatgatggcatcacttccagtaatatatgcagttgaagcttcaaatgaccctgttaaggatagtaactgtggtataagtgtaccagcagaaaatccagaggctgttgttgaagctgtaatgaagattaaaaatttaagtgaaaaagaaaagattaaaatgggtggaaatggtaaaaaatatgtattagataatcatatgtatgaaggattggcagataagttcttaaatgccttaaagaaataattaggagtagagaaatgaatactttaaataaatttattaaaaggatatttgacattgtttgttcaggtttaggtctaatagttttaagtccatttttactttttgttgctataaggataaaaagtggatcagatggccctgtattttttaaacagataagagtcggtgaaaagggaaaagaatttgaaattctaaagtttagaacaatggtagttgatgcagaaaaacttggaagacagattactgttggaaatgatagcagaataactaaaattggagctttcttaagaaaatataagatcgatgaacttccacagttaattaacgtttttaaaggtgatatgagtcttgttggaccaagaccagaagtgccaaggtacgttaacatgtataatgaagaacaaagaaaagttttagatgtaaagccaggtataacagatttagcatctataagatatagagatgaaaatgagcttcttggtcaggcagaaaatccagatgaattttatattaatacaataatgcctgataaattagctttaaatttagagtatataagaaaaagtaatgtgtttttagatatatatataatattcagcactatatttaaatgcatttagttaacaattcatagttaacactttaggaaagagatagcatgatgttttttagacttgattaataagattaataacagaatattacattaagttgtggataaaattgttttaagattaaaaaatgtgtataattttataaagaatatattgcaattgacatttgataatggacaattaattttaaaagctatactgaaaaagtttttatatcatatgtaggcttacggctgcaatatatatttaatcactaataatattaaagaagaaggtagagagcatatgaaaaaattaaagtttgccataattggttgtggaagaatttcttataagcatgttgaggctttagtaaataatagagaagaagcagagcttgtagctacttgtgatgtagttttagaaaaagcagaagcaaagagagatgagtacatagaaaagtctggatgtaatgcagattgcgttcatgcatacactgattataaagaaatgcttgataaggaagacatagatgttgttacaattgcaacagaaagtggatatcatgcagaaattgcaatttattctatgaaaaaaggtgcaagtgcattaatagaaaaaccaatggcaatgtctattgatgatgcaaatgaaatgattaaagttgcaaaagaaaataatgttaagctttgtgtatgtcatcaaaatagattcaataagccagtacaaaagttaagagatgctatggaagatggaaagtttggtaagttagtaaacggtactgcaagaatcctttggaacagaaacatgggatactacgatcaagcgccatggagaggtacttgggcattagatggtggtacattaatgaatcaatgtattcataatatagatttacttcaatggatgatgggtggagaaatcgaaagagtatatgcagaatgtgatactttccttagagatattgaagctgaagactttggtgctataattataagatttaaaaacggtgcaattggaatagttgaaggatcagcatgtgtttatccaaagaacttagaagaaactttaagcatttttgggcaaaatggagcagtagctataggtggtcttgctaacaatgaacttgaaacttggagatttgatggtgatgatgaagaagctatcaagaaagaagttaatgttaagatagacaatgtttatggtcaaggtcatacaccattatttaaggacctaatagatgctataaataacgacagagaacctttagtaagtggtgaagaaggcaagaaagcaatgtcaataatattagcagcatataagtcaagaaagacaggaatgccagtacaattcccatttacagaatttaaaacaacagatatggaagaacaattccaaggaagaattgaatttagaaataaataaaagtaataaaatgaaagccagtcgaaaacgactggcttttttgttttttctattctaagattgaagaaccaataggatcttttttcttagggaatagtatatatccgattattatagcagctacagttggaaggaaccatgcgaatccagcacttccaagtggtataaatgataaatctatacttgggattatacttaaaataccgaacactaatgaagtataaactccaagtcttactgctttaatattagttatgtatttatcaaataatgttgtaaagattaatgtaatagcaacaggatataatacatttaagattggtccagagatagtgacgatcttatcaactcctaatgaaccaataactatgctgattaatgatattactattgcatttaaattataagataatttacctttagatagtttttcaaagaatgaagcaccagctgaaagtaatcctattgatgtacttaaacatgcaagagccattgctaatcctataattattgaaccaatattaccaagaacacttcctgaaataaataataatacatttgattttgttagttcaccagtgaaagtgcttgtagtttgagcaccaaggaacattaatcctccataaacaaatgctaaacctaaagtagcaataaagcctgactttaatgtcattggaataacttcttcttttgagtatcctttagcgattatacttgctgaaatcatggtagcaaataataaaccacctagtgcatccatagtttgatatccttcagtaagtgatgtagcaagtacaccagtagcaccagtagatataacgtcacctataggaaacagaacacctttaattattattattgcaagaattaatagtagtagtggtgttaaataagtacctattgaatcgatgatagctgactttcttaacacgaatacaagatttatagcaaaatagataaacatccaaacaagagggcttataccaggtaaattaggctgaacagctaattcataagttgttgcagcagttctaggtattgcaagcattggacctatagcaataaataacaatgtagcaaataaaatagcaaatttaggactgattttagatgccattgtttcaaatgttccatcaccttttgtaacagcaattatagctagaagtggaagaccgacacctgtacaaataaatcctatactagctataagaaattgagaccctactgcatgccctagaaatggtggaaatattaaattaccagcaccaaaaaacatagcaaatagagcaaaacctattattaaaacgtctttagtattctttttcataacaaactctcctcaaatcaattctaatttcataaattaagaaattaaaatttaattaatgtataacttatattagcatttcattaaggatttatcaacaaaaacttacaaaacatttgtttttgtttaaaaaacaatgaaaaatttagcataaaattgtatatttgctaataaaaattaaaacaataattatcttagaattaaaataaaaaagatgatgatattttgcttaaagtagttcgaattttacaaaaaaataaatgaatgaactatcctaaatatatgtctggatagttcattcattatatgttactaaaatatttttgagtttaataaattattatttttctttctttttatctttatcaattccacatgatacccaagggtaatcaggactgtttggatcacattcctttgaagtatcaattttcttttctggttgataagtaacttcaggttcattattacaattacattttttattttcttctgccataaataaaacctccctatattttactattttccaatattatagttctcttaaaagaaaaaatcaatacaaaataataaataagatttaatataaaaatccatgcatatattaatgaaaagaaaactattaattatatatatttcatataaataataaaaataaaaacatttattgtaaaaaaactctttacaacggataattattattatataataataaacatagaagatataaaaacaaaagaaaaaacattactaaaagtaaaagaagatttgatataaaaaatgatatagataaatgtaggaggagttttattatgaaaaaatttgtgtgtacagtgtgtggatatgtttatgaaggagaaaaagcaccagaaaagtgtccagtgtgtggagtaggaccagaaaagttcatggaacaaagtggagaaatgacatgggcatctgaacatgtaattggtgtagcacaaggtgcttcagaagatataatggctgatttaagagctaactttgaaggagaatgttgtgaagtaggaatgtacttagcaatggctagagttgctcatagagaaggttacccagaagtaggaatgtactatgaaaaggcagctttcgaagaagcagaacatgcagctaaattcgctgaattattaggagaagttgttacaagctcaactaagaagaacttagaattaagagtagaagcagaaaatggagctacagctggtaagactgacttagctaagagagctaaagtagctaacttagatgctatacatgatacagttcatgaaatggctagagatgaagctagacatggtaaagcattcaaaggattattagatagatatttcgcataagatttttatagagaaaagaaagtgtggacaaaatgatgttatcattttgtccacactttcttttttgactaaaaatacagatgttaaataagttattataagaacttttagataagagtagattaaatttactcttatctgttatcaaattgtaagaaaagagaaattaatttgtaatcatgtctaaatataataaataaatgtagtatatcaagaaaatttaatgataaatataaataattaaaaaatgttatgataaaaataatttagaggtgaatatttaggagcgtgataaaagatgagtgcagttttagaattaaaaaatgtaagtaaaataatgaacggaaaagctcttgttgaagatattagttttacagttaataaaggtgagatatttggatttttaggaccaaatggagcgggaaaaactacaacgataaagatgataacaggtctttacagcataagtaaaggtgaaatatatattgatggaaatagcgttaaaaagaattttgaaaaagcactacaaggtgtaggtggaataattgaaaatccagaaatgtatggatatttaagtgggtatgataatttaaaactatatgcgagaatgcatggtctcatatcaaaagaaagaattgatgaagttgttaatcttgttaagcttggtaacagaatacatgacaaagtaagtaaatattctctcggaatgaggcaaagactaggggttgctcaagcactactacacaaaccaaagttattaatattagatgaacctactaatggcttagatcctatgggaataaaagaacttaggcaaacgcttagggaacttgcagaaaaagatggtttatccgttatggtatcaagtcatcttttgactgaaatggaactaatgtgtgatagatttggaataattgatggcggaaagatgattgatataaagactataggtgatattaaaaagaatgaatcgcaaaatataaaaacttttcttatagaaattgataataagcaaaaggctgaaaaactaattaaagaaaattacagcaagttgactgtagaaattgaagatgaaggaattaaagtaagttgtgaaaaatcacaattaccacaaattaataagttattagttaataataacattgctttatttacaacaacaataataacaaagtctcttgaagatgaatttatggaagtaactaaaggatctaaagatcaaataagataagaaggatggttatatgagagtattaagtttaacatataatgaattagtaaagcagtttaaaaaagtaagcattaatataataatagcgctgatacttatttcagctattgttttaccactagcaatgaaaaatatacagccaaatgattattataaaaatagaattgaatcagctcaatttatgattcaagatttacagcatcaaatagatagtttagaaactgataaaagtcaaaaagcagctatacaaagaaagtactatgctatagataaagaatataaccagttagttgttgataataaaatatcatttgatgattggagagagtatgaagctcaagaactaagatttgaattatataaattggcagctatagaatttgtacttgaaggatattctaaagatgtagtattagaaaatttacttagtgaggattctaaaaaaattgagaattattataatttaacattagaaaagaaaaaagaaatagaagcaggatatataaataaaataaatgaactaagagatgttattgaaaattctgattataataggcacacagaattagaaattcaaaggaaaaaagaaagtattgagttatatcaaaaaaatatagaagaatatgaaaagttagccgctaaaaatccaacagatgaagaaggtaaagctaaactagatgaacttaaaaaagaaaaagaatatgcggaaagggaaatacctaaaattgagcaagacttagcaataattcaatttagatatgataataaaatagattatgataagaataattggaaaaataattctattaaatctatagagtcagaacttcatgatttaagaattgaaatgcttgacgaaaaagcatttaatgttagtgttaataatgatagtttagttacttcatatgagcaatatgttgaaagttacaaaaaagctaatgaaaaaagagtagagataataaaagaactttggcatggattggaaaatgatataccggatttaggtagtgtgaaagatgccagaagtgcagtagattcaacttatgaaatatatgtgatattagcaatcattatggtaataataattggtggtggaatagtagccggagaatattctaatgggtctataagattattaatgataagaccagtatctagatggaaaatattactatataagttgctagcagttttaatagttggattcagtattgttatacttggagtattaatattatttattagcagcggggtaatttggggatttgaaacattaaaagtgcctgtattagaaactattaatggaaatatagtagaaacgaattatattaattatatgttgccacaattactagtatcaacgtgtagtttattattcatagcgagtttagtgtttatgatatcaacattagctagaaatacagctttagcagttgcacttgggatgttagtttattttggagcaggtcctttaagtggattgttaatcggattcaaacagacttggttaataaacactattataccatatataaatagttcttattttaaattggtaccatatttttcagagatgctgaagtcaaatggtatggattttaattacatattaggagcaaaacagttagtaattgcttcagcaattatgctaataattaccttcataacatttaagaaaaaggatattaagaattaatattaatgaaaagctatagcaatgctatggctttttcttgtaataaataaaggtatacataattataaatttgtttagtatcaatgtactattaaaaattaatgatttacaatattatataggattcttataggaatttgaggcaaaatacttattagaagttacatataattttaagaaaaactaatgtattaagaaaaaataaaaaattatttagattttaaggtggtagaatgaaaattataaaagcaataggaataaatagaacttatggaagtggtgaaaataaagttgatgcattaaaaaatattaatttagagatagaaaaaggtgaatttattgcaattgttggagcatcaggttcaggtaaatcaagccttttacatattttgggtggtatagataaacctacatgtggtgaaatttacatagatggagttagcttgaaagaattaagtgaggatgaaatatctttaattcgcttaaggaaaataggttttgtattccaattttataatttaatttccgtattaacagtagaagaaaatattgagatgccagtattattagatgatggattggttgacgaagattataagaatgaaataataagttttttagggttagaaaataaaagaaataatttaataacagatttatctggaggacagcagcaaagggtagcaattggaagagcattaataaatagaccttcaattatattagcagatgaacctacgggtaatttagattctaagaatgctagagatattataagtttgttaaaatattcaataagaaaatataatcaaacattagttttaataactcatgatgataatattgctaaaatggcagatagaattattgctattaaagatggagagattgctgttgacgaggtgaggcaataagtgaaaaaatatagtgatttagttaataggcaatttaagatcaatcttaaaaaaaatatattaattataataggaataatgacaagtgtattattacttatttcagtgacatatgtaggtaattttataaatgagtttaatattgaaagaactaaatattcacgtggggattatgaagtaatcttaaaagaccttaatatatatgaagtagaaaaagtaaaaaataatattaaggtagaaaaatgtggaatttataatgttgagaaaagtatggacattaaaattgaagatactaaaaaaaagctagaaatatactctggcgattatactataatgaatgaattatttgagtctactttgaagataattgaaggaaggatgccaaatagaaaaaatgaaattgctttaacattatcagcaaaagatgagttaaagaaaagaataggtgatacattaaatataagtgaaagtgaatatataattacgggtttttacaaggatgatgagtacaatgttaggcatactttaacaggattaatatatctagatattgatacggctattgagaaaaataatgcagttataactatgaaaaataaaaaaagcattatagaagatataaaagaaattgtagaattattggacaaagatgagaatgattgggatgtaaaagagaatattaagtataataatatgctattagaatcttatggtataagaatatctaacggtatgatggttgtaaatagtgaaaaattatatatgttttttatttatttaattatttgtatattgactatagtatttatatatggatcattaaatggttatttacaagaacgaatacatgaaatttcaatattaagatgtataggtgcaactaaaaataagattagatatttgcttataaaagaatggtctattttatcaataatttcattaattgtaggaataatattaggaaatattttagcttggttaattattaatattgtatttattaaagtaataggaattaatagctatggggtaggattcagaatttattatgatgttattttaagtacaattattttttcactttttaatatggctatagcaatgattttattaataataagaggggttgatcgagcaccgattgaaggcactaaagtaaataatctgaaaattacatatataaataaaaaaaaatcaaaagttattagatttctttttggatatgaaggtgagatagcgtatagaaatatatgtgcaaatagaagaagttttttgattataactattagtcttacgattatactgttaatgattaattcttttacagcattttatttattaaatttaaaacaatatgaatatgagctaaatagtttttatgatattcattcaacttattttagtgagacttcatacgattacttattagaagatgttttaaataaaagggataattacaaaaaagagtttgatgacttaaaaatgatagatgatatctttatgaatattaatctaaattctactattacaattgaaggtgttacaataaatcctgaacttactaaatattatgcaataaataattcaattgaaaatatagccgaagaatataaagtaaagtttaatcaagccagcattttaatttatgacaaagcttcattgaataaaattattcccaatattaattccgttacaggtaataatatagatatacaagattttaatgaaaatggctttgttgtagttaatacaggttttaacaatcctaaagcggtatttaaagaaaatccaaaagaagaagtaaaactatatctgaatgaaaacaataaatctccaatatattcaaagtttttaggatgtattaatagtgataagttaatcagtggaaatagatttggatattataatagattaactataatagttaatgatgaattttattataaaaataaagatataatggatagcttaagtagtatatccagtgacataaatacaagtataaatataaagaaaaatattaatagaaatacagctatatcaactattaaagagataataaataaaaatggaggttactatatagaagaaaaacaaacatcagaatcatataagaatactgtggacgcatcagctacattgatatatactatgttatttctagttgtatgtataggatcaattaacataataaatacacgctacataaatattatatcaagaaaaaaggagctaggaacatttttagctataggaataagaaaagataagtttagaaatatgataatattagagggaatagtgcaatggtttatttcatgtactatgggaatagtgttatcattaatagcatttaagataattagcatagcttttagctatagtgtgggacaaatttataacataccaaatctaataatactaatgggagcattaatactattattagttaacttattaagcagcttcttaccttatactaagttaaagaaactagaaataaatgaactcataagaaacaaggaataaatagaggtggaatatgaaaagaatattattggttgaagatgatagggcagtggctttagcagttatatatagtttgaaaaaagaggggttcgaagttgatcacgttactaatttaaaaagtgcaaggaatatgttaaatgatagtatagacataatattattagatgtaatgcttcctgatggagatggatatgaattgtgcgctgaaataagaaaagcaaagaatgatattccaataatatttatgacagcatgtgatgaagaaaataatgttgttataggtttagatttagggggcgatgactatgtatcaaaaccggtaaaaataagagaacttgtatcaagaataaatgctgtattaagaagaaaaggaaaaaataatgctataaataatataaaggaagtttttaaaagtgaaaatctagaattagataacggtgctcatatagtacgaaaagatggtgaagaaatttctcttacactaaatgaatataaacttatgctattacttatggaaaatgccccaaatgtattaactagagatatgatgctagagaaagtatgggatatagagggtaattttattgatgctaatgctttaagtgttaatataaaaaggcttagagaaaaaatagaagatgatataaagaatcctaaacttataataactataaggggagtgggatataagtgggctcctaaggtggtgagttaagatgtcaccattatgttataaagatgagagaattaaaatttggatgtttattataatagctttgattattgaaggtgtagtttttacgctaattcatattaattctattaatgctataaataaaaatattataaataataataattcaattataggtactatagaaagtgaaaatcctgagttagctaaagaaataataccgataattacaaagaataaattacaaaacattagcctaggagaagaaatactttctgactattcatataataataatcttaaatactataataatcctttagttaataatgtgagtaaaactgcatttattatgataggaattttaacgttaatcactatgagtgtagttatatttggagtgttagcaatattaaatccattatataaaaaattaaaatacttaacatatagagctgaaaatatagttgaaaataagtttttagataatgatataaaagttgattataaaggcagtttaagtaaatttgaacttaggtttaacgaaatggaagaaagaattaaaaataatttaaccttacttcaagatgaaaaaattaatttgaaaaatataataaatgatatttctcatcagttaaaaactccattaatggcattacagatgtataatgaaattttaaaagattataaaaatatggttgatgaagaaattgaaaattttattttgttaagcaatgagcagcttcaaagaatggaatggcttgtaaaaacactacttaaatatgcaaggcttgaaagtaatgtagttgaatatcataaagataatatttcattaaataatactataaatgaaagtattaatcctttaagagtaaaagcagaagaaaaaaatcaaaagataatttttgaaaatgaagatgaagttatattttatcatgatagaaagtggatatcggaagctataagcaacataattaaaaatgccatagagcatacaggtgaaaaaggggaaattgagattactcttgaagaaacacctataaatatagtaataattattaaagataatggagaaggaattgagaaagaacaattgaaaaaaatttttaatagatttcataaaggagagaattcaattgatccaacaagtataggaatcggcttatgtcttagtaaggctattgttaaagctcacaatggagatattacagtagaaagtaaattaggagttggaagtatcttttatataactttcattaaaacaattctttaattttataacaataattttcaggatgtgtttaaataatataaattaatcaatgaaaataataaagtttcataataaaattttacgataatatatatgtagtatgtaaaataaataattaaattgatatagagttaataatatggtcatattattattaaaacgtttaaaacttaaattgatttacacatgtaaaagtgataacatatgagtacaaagagttaaataaaatctttaatgagaggacgattaaatatgaaagtaaaaaaggcaattataccagctgcgggacttggaactcgatttttaccagctacaaaagcgcaaccaaaagaaatgcttccaatagtcgacaagccaacaattcaatatataattgaagaagcaattgcgtctggaattgaagaaatacttattataacaggaagaaataaaaaatgtatagaagatcactttgataaatctgtagaattagagcttgaattagagaaatctgggaaatcagaacttcttgaattagtaagagatatatcagatatggttgatatacactacataagacagaaggaacctaaaggattaggtcatgctatacattgtgcaaaaacatttgtaggggatgaaccatttgcagtgcttttaggtgatgatgttgtagatagtaacacaccttgtttaaaacaacttatagattgctataatgaatacaatactactatattaggagttcagacagtaccagaagaaagtgtttctaagtatggaattgtaaatggcattcatattgaagataaagtttataaagtaaaagatttagtagagaagccatctattgaggaagcaccaagtaatgtagctatactaggaagatatataataactccagaaatatttaacatattagaaaatacgaaaccaggtaaaggtggagaaatacagcttactgatgcactgaagactcttataagtcaggaagcaatgtatgcatataattttgaaggaaaaagatatgatgtaggagataagcttggatttttacaggcaacaattgagtttgcattgaagaaagaagagcttagagatgattttataaaatatcttgatgcaagaccatgggaaatttatgaagataaagaaaaataaaagtatttaaatatgtactaaggctatttaattgttttaagattaaatagccttagttttttattctttagactagtcatacaaaaaaattatattttttatataactggtctagtattttcagtatgaggaaattataatgaagtcaaatttgtggattaattttaaatgttaaagaattgtattattaaatcaagaaacctaaacaataaaagttgaagaaaattaatatttttcacctaaactataaaacttatattatcgactctcaacggtatagacatgttaatagataaaatataaagattatggtagaattatctttagtaatttcatattaattgatagattaagaaaagatttggaggactagatatgaaaatttgttatctggctgatataaacagtgctcatactcataaatggttaaattattttaaaagtaaaggatatgatattcatgtaatatctttgggaaatggtgagtatgaaggcgttactgtacattctctagatattaatgatacagttatgaaaaaatccactgacaaaaataaattgcagtattttaaaaagattaagagagtaaaagaattagtaaatgaaataaaaccagatatacttcacgcacactatgcaacaagttatgggttattaggtgcattggcaaattatcatccatacataatttcagtatggggaagtgatgtttatgatttccctattaagtctcctattcataaaatgatggttaagtataatttgaaaaaagctgattatatttactcaacaagtaatgtaatgaaggatgaaacaaagaaatatacagataaagacattgaagttacaccatttggtgttgatatcaatagatttgtaccaggaagaattgaaaaagatgaagttattattggaacgataaaaactttggaagaaaaatacggaattcaatatcttgttagagcatttaaaaatctaaaagatagaaatcctgatgttaatttaaaacttagaattggaggaaaaggaagtcaggaagattatcttaaaaatttatgtaaagaacttaatatagacagtgatgttacatttttaggttttgtaaatccagatgatgttgttaaagagtttcaaaattttgatgtggcagttttcccatcaacactagatagtgaaagttttggagttgcagcagttgaagctgaaagctgtgggacaccaatagttgtatcagatgttggtggacttatggaatctactaagccaggtgttacaagccttgttgctaaaaaagctagtgttgaagatttaacagataagatagatgtgcttataaaagataaagaattaaggaatacaatgggaatgaatgcaagaaaatttgtagaagaaaattatagtcttgcagataattttgattatgttgataaattatatcatgaaataacattgaaatagtattaaaatatagggtatacataggagataaacacatgtatactctatgttattatattaaaaaacataattaatatttataaataagaattgtattaaatccccaataatgtgaacgatttaataaaaatatggaaattgacaacttgatatagtaaaaaaaatacagtatcatataattagagtattatagaatttcatgtatgatttatagctgattaagcttaaatttatattttaatataaataaagtttatattattttaggttgataatcataattttatgattcaagggtggttgagaaatgtgattgattataaacaactttataattctttgaaatctgaatatgaaacatatcagcaattttcagaaaagcatatgcaggagttagtgaataagaatataaaattagaaaaaaacatagatgcgctatctaatattgttgaaataggtaaatatatgaatgcatatcttagtgatgataatttaatcagtatgataaatgatatgatactaggaattttaggagtaacatattcaactattttcattttagagaatggtgaattaagtataaaagcaagtaatatagatagcatgaatataaaacttacatctacagagattgctagtataagcaaagaagaagaatttataatgaatgatgaaaatataataaaacagactggtagtgctaaagtcgacatacattcaataatgggaataccaatagtattaagaagtaaatttattgggtatatattagtagaacataaaatgtttaattttatgacaacagagttgaaaatatttttgaaatctattgcaaatcaaattgcaataataatagaaaattcatttttatatagacaattagaaaatttaactcaaacagattctttaatgggaatttacaacagaaagtattttttagatttcttagaaaaatcaataaaagaaaatgaagataggaaatttgcagtagtaatggtagatattgatgattttaaaaatgtaaatgatacttatggacatcaatttggagatgaggttcttaagaatactgcaaaaatactaaaaaagtggacagaagaaaatgatttacttgctaggtatggtggagaagaattaataatgtatatttcagacattaaagatgctgagagtgtatttaataaaatagaaattattcgtaaagaattagaaaatagtaaggttaattgttacggtttaagtgatagcgttacagcaagctttgggatggctttttatccagaagagagtaaagatataaaggaactaataaaagtggctgatgaccttttatatgaatccaaaagacaaggaaagaataaggttttgtattcaaaaattttaaaaaaacaaactatatagatatttaagtagatggttaatttataattagtattatattaataagtatctactttttttgtattttattatatttacttattaaatagttttatgtagaatcaatggaggtttttatggatataaaaaaactaaggtccttaataaaaaaagaagaaggtcttaaacttgattttaaattgaaattagatttatctactgaaacaggaaaaaaagaacttgccaaggatatttgtgccatagctaattcaaatggtcaaaggggatatattatagttggaattcaggataagactaagaaaataataggaatacaaagtgaggatatgtttaaggaggaacgtattcaacagataataacatcaagatgtgaaccaccgatccccttgagggtagattttgttgatcttaacggaaagactattggtgttatttctatttatgatggtggacagaagccatatcaaattagggaaaatggtgcattctatataaggagaggttcaactacagatgttatgagaaaacaggaattagttgcccttcttgaggaaaatttaagtcttacaatagaaacatgtcctcttataaggagtaatatagatgttttaaatatggatttagtaaataaatattttaaacgtaaaggaataaattttacagatgaaaatagagattttttacttttaagttcaggaatcgcttacgatgatagaaagggtgagaagttaaagtgcacctatggagggttacttgttttttgtgatatcaattatatatatataccaaataatatgataaaaatagtaaataaactaaatgatgattatggtgagggatatataattcaaggaaatctaatagatatggtggataaggctgaaaaaaagattttagaaataatgccagaagagtatccttcagatgcaattattgagagtataaaaaatgcagttctttatagagaatattttgatttaaatagaatagttgagataacaattgataataataacattattatatcaagtccaggtgaatttatagatgaaaatataaaaggagaaaggacaaactataataagagaaatatatggctttatgaaaagcttataactatagatgagaaaaaaagatttttaaacaacggaaagggatttacaagaataagagatgcttttaagaatagaggcaaagttagatttgtaaattcaagaattgagcatagtttcaaagtaattctaccaggatgcaatagaacaaaaaattgtaaagatgatatggacaataatccaaaagagcatagctagtattagtattaatgttatgttgccaaatttatcacttgaggatatactatttatagtagtttatacttgacaatagataataggcaaaattattatatttatagtttgtaatagtagtgaatggaatttctcatatttaaatatatgttaataataaattttatcattaacttgtcacttgtcaattgtcaactgaattaagggaggtattttataatggcaaatgtattagatgagctgttagaaagaggatacataaaacaatttactcatgaagaagaaacaagaaaattattggaaaatgaaaagataactttttatattggatttgaccctacagcagatagtttacatgtaggacactttattgcaatgatgtttatggctcatatgcaaaaagctggacacagaccaatcgctttaattggtggtggaacagctatgattggtgacccaagtggtaagactgacatgagacaaatgatgacaaaagaaactattcagcacaatgttgattctataaagaagcaaatggaaagattcatagatttcagtgatgataaagcattaatagttaataatgctgactggttattaaacttaaactatgttgatttcttaagagaagtaggagttcatttctcagtaaacagaatgcttacagctgaatgtttcaaacaaagattagaaaaaggtttatcattcttagaatttaattatatgttaatgcaaggatatgatttctatgtattaaatcaacaatataactgtaagatggaacttggcggagatgatcagtggtcaaacatgattgcaggtgttgaacttgtaagaagaaaagcacaaggtcaagcaatggcaatgacttgtactttattaacaaacagtcaaggacaaaaaatgggtaaaacagttggaggagctttatggcttaatccagaaaaaacttcaccatatgatttctatcaatactggagaaacgttgatgatgcagatgtagaaaaatgtttagcattattaacattcctaccaatggatgaagtaagaagattaggtgccttagaaggtgcagaaataaataatgctaaaaaggtattagcatttgaagtaacaaagcttgtacatggagaagaagaagctaagaaggctgaagaagcagctacagcattatttgctggtggtgcagatatgtcaaatgttcctacagtatctattactaaggaagaattaggttcatctatcatagacattatggcaagcacaaaaatcttaccatctaaaaaagaaggtagaagattagttgagcaaggtggattatcattaaacggagaaaaagttactgatgtttcaagagttttaactgaagaagatttcgaagatggtatagctctaataaaaagaggtaagaaaaactacaataaaatagaaattaaataattttaatagatttaagctgtttctaaaattagaagcagctttttcttaatttatagatattacttacgataagtatattagaagtatattttaattgaaaatttatattggatttcactttttgattctgtaagcaaggaaaaataaatatgaaaaacttacaggatttatttgatttatatataaaacatttattagaatatatagatttaaatttaactacatattgaattgtgaattcagtacaaggttacgggggataataaaaataataaagtaggtgaaattaaagatgccaggaatttggaatataaataacggatataatatgaacactcgaaaggtatctagtaaattaacatttgaagtgggtgaaaaatttaccggaagaatagtagataagggtgatggtaaggatgtaacaataaagctgtcagatggttggcagtttattgcggaattagatggaaaagttaatttagatgatattaagcttgtaaaatttcaagtagatggatttgaaaatggaaagcttaaattaaaactagttaaaggtgatacatcaaataataatgttgatgaaggagatgaaaattttcaggaagtagttgaaaaagaaggcttatcaaaagaagatgtggaacttttgaaaaaaatggttaagcataatttttcattatcaaaggaaaatataaatgagataaaaacaattcttcaatttagtgaaaaaattcaatgtgatccagatgaactagatgcttttcttgaaaagtatatagccagtaaaggtgtagatataaatagtgagcaaggaaaggctatgaaggaaatactcactaaatttataagtgaatttaaaaatatgagtgaagaagatatacttacattcatagaaaataatattgattttacacaagataatatagaaagttttaataagctttttaagggagattcttcaatagaaaaaatacttttatctattaaagaaaagcttaattcatcagatatagagcttagtgcaaaagatatacagataagtgatactacaaagcaaccaatacaccaagaaaaagtagataataattctttaaatacagcagccttttcaaaggtatatgctgaacatgatccatcaaacaataaaataaatgtacttgaaatattgaaaacattagcaggtgatagtgcaattgaaggagaaaatgttttagataaatctataatggagaagttaaatgataaaaatatttctcaatctataaaggacattgtgggagatacagctttaagtgaagataaacctaaaactcaagcttcaagtcttatagagtctacaaataaagcaagagtagaagatatattaagtaaagctgaaggaaaagaggtaaagcttacagacactgaatttaaaaagataactgaaatagttcaaaataaaaccaatattgaaaaaccagatattaaggaaattgtaaaaaatgatatttttaaaggtagtgcagaagcaattacattaaagaatgacccattagtacaagaaaaatcttttgtaatgcctaaaaaagctgaaaatactaattcttttataagtaatcttataaatacagtagatgatgaaaatagagttgatagtataaaaaatgaaataaggtctaaaattgataatgttaaggatgttgtaaaggaactattagcaaatacatcaacacaagaatcagtttcaggaaagataactaacctaataaaagaaaatataaatgatataaaggtatttaattcaataagtaatgaatattattgcttaaattttgatatatcaggtcagatgaataagtatccatgtcagcttataattaaagataatagaaaagaaggaaagaaaatagatactactaatacaaagatggtattgtcgataaaaacatctaatttaggtgaagttgatggatatttaacaatgagagaaaataggatagatgtaaatttaaaatgtgatgataaatatacggttgttttagagaatcataaaaaaggacttattgatggtcttgcaactttaggagtatatgtaagcgttaaagttgatgcaaaagaacaacgtgcagatattgtgagtacaagagcgtttttcaatgatgtaacaatatcagctatagatactaaggtttaaattatatattgaggttattaaatgatagtgctgaataaatccagatagatattttaaaagtataatagtcgtaagtaaaaaatatattttgtaccatgaattttacaattataatctaaaaatgaaatagtgatttcaacataaattttcgcatgttaattgaaatatatatattagtatttgtactaaatttaattatagagtaaaattaaatcaattataatctaagattataattgtagataattgttttatatataaaatgatctagagacgtattaacttattatgaagatagcttgaagtttatataatttataattactttatgaaggggagaaaataatgaatcagaggaaaaaggcagctgcattaaaatatgaattcaatagtgatgcgccaacagtggctgcatcaggtatgggctacattgcggataaaataatagaaaaagctgaggaaaatgatgttcctatagtatataataaggaacttacggatttgttatgtaatgttgatgttggaacggagattccagaagaattatatgaagctgttgcccatgtaatagcgtttattactgatctggataagaagagataagacaaaagagaaaggtgaaaatttaatggcactttatactatttcagatttacatttaggatttaatgttgaaaaacctatggatatattcggtgataaatggaaaaatcattgtgataaaataaaagaaaattggatttctaagataactaatgatgatatggttcttatagcaggtgatatatcatggtctttaaaagaagaagatagcatatatgatctagattggattaatgaacttccaggaaagaagattataagtaaaggcaatcatgattattggtggaacagcatttcaaagttaaatgcaatgtatgaaaacacaaaatttcttcaaaataacttttatgtttatgaagattatgctatctgtggaacaagaggatggatatgtccaggtggtgataaatttacattaaaggatgagaaaatctataaaagagagcttataagacttaaattatcattagatgcggcaaggaagcaaggatttgaaaaaataatagtcatgcttcattatccaccaactaatgagaaatttcaaaaatctgattttgttaacataatagaggaatatagtgttgaaaaggtcatatatggtcatttacatggtcctgtattacaaggaaaattgttaaatggattgtggggaaatgttgaatatattttaacatcagcagattatatagattttaaccctaagagaattctttagcgaattttttacaaacaataggataccacctagctttagaggtggtatcctattgttttaaatagaaaaattaaatttctgataattcacttgaaagagcttgaatttcattacattttgaatcaattgtagatgcaatttcgctagtaagtaattcgtgctctgcataattcttttctagactatcaacacatgaaataactgtatctttagcttcataagcagtaactagattagttatacaagtattaatttcatcagctgcattttcgattgatgattttatatctgaaaaactagttttagcatcagataatgagttatgctgaatttttaatgcagagttaccagtatccatagctttagatgttctcatgatatcttctttaatttcatcaagaattttagttatgctttttactgctgattctgaattttcagcaagacgttttacttctccagcaacaacagaaaaacctttaccagcttctcccgctcttgctgcttcaatagctgcatttaaagataatagattagtttgattagctatttgactgatagaatctgtaattagattaactgattctaactttgatactaatgaattaacagtagaattggacacagtaaaagagctttcaagatcttttagagaagtatcgaggttatcaattacattcaatcctgaatcagcaatcttttctgaatctaacacttttatatgaacatttgtaatattttctgctaacccttccatacttgaactgaagccagttaatatattttttgtattagaaagttcttttgaattgttatttgtagaagttgttaacaatgaaacagaatcagatagtgtttttaatgaatcgtttatattttctgttttattttttaaaatgttaaccttatcaattgtagctgaatttagactttcatcattttgttcttgtgccatttcaatttctgtgtttagatttttttcttcaatttggttatttgttgtttttttctttttaaaaatattcattaaatatacctcctgctatgtaacaatagtagcttacttatttttaattaaatctttaattgttcgggccatttctttaaccctatgagaagcattagtgttaactatagtttttgaaagccacaataaagcttcatcttcatttccaacccttcgatttaggtctccaataagatatgttaaggaatctctttgaagtccatatatagggaatggttcattttgatatgcatttctaaatccttctaatgcttgtcttaaaaatgacatttcggaaacactatcatttaaaagcctaaacatccatgctatttttagtgaaatcatagcttttgtactgtcatgacttgaagtgagcactgcatttaaaagtgctagtttatagcgttcgatggcatttttttcatccgctattctaggatagcttctagggatccattttggtgttacgttactcataacgagttcttttctgtagtttctgatattttcaaaatcagacttcagagcagcataaccacatgaattacataaccatacatcataaaaataaggattaaccttaggactatatcgtataaagaaatctgaatccttagagtctattcgtggcgtttttgatttcacgcatgttgctttaaaagtagaattacatacaggacaagttactgtcttatcaaataaataattacgtacatcatctgtcatcataaaagttacctcaaagtaataaaaaatatatatatatttaattatatcataattaagaaaattaataatgtatattaaaaaaataaaggaatattttgattaatcattatacataatttaaactttttgctataatagtaaagaatgagatgataaaaagggtgatatcaatggctataaatgattggaagaatttcttaatgccttatgaacaagcagttgatgagttaaaggttaaattaagatcaattagaaaagaatatagaaaaaaaaatgaatactcacctatagaatttgttacagggagagtaaaagaagtttcaagtatgcttgagaaagcaaataagtttggtatacctatagatagaataagatatgaacttgaggatattgctggaataagaataatgtgtcaatttgttgatgatatagatacagtggtagaacttttaagaggccgtagagatatgcagattctttatgaaaaggattatgtaagaaatgttaaaggcagtggatatagaagttatcatatgataataaagtatcctgttaatatggcagaaggaccagtagaaatattagcagaattccagataagaacacttgcaatgaatttctgggcaacaatagaacattcattaaattataaatataagcagcatataccagaaaagcttaaagaaaagcttaaacgttcagctgatgcagcatttagattagatgaagaaatgcttgaaataaaggatgaaataaaggatgctcaaaaattatttgaagttaagtcacatttaattacaagtattatgaatgcacttttaacccttatgtccttaggcaaacatgcagaggcatcaagatatgaaaagacacttaataagcttatagaagaaggggaagtgtgggaactcaacagtttacttttttctgttaaaagagaaattgaaagatataaagattagtaagagctatgtttaagttttatcttaaacatagctttctttaattttggcgtagtagtagagagttgaaacatatatctatctataaaaacatttctgtagtaaactaagtttaataaaaaaaggaggagaattatatgaaaaaagatgaaatattattgaagttaaaaaataatccagaatatataaaagaaatagaagattgtgataatgaatttaaattgtttcttataaaaaataatggaacaaatataaagtatatagataatcctgaaaaagaccttcaaattgaagctataaaaagaagtccattagcagcaaaatatattattaatatggatgaagatgtagctgttatgtgtgtaaaaagtgcatggaactcattagaatacattaaaataaaaacacctaaagttattgaggaagcggtaagaactaagggatgggcgatacagtttattgagaatccaagtgaagaacttcagattattgcagtgagtagagactatgatgcaataaaatatatagaggatccaagtgaaaaagttcaacttaaagcaatacaaacatattatgcagcgattaaatttataaataaacctacacttaaggcaaagatagaagctgttaaatctaatggtgaagctataaattatatgaataattatgatttagatgaaattaagctgtttatagaagctaatattaatgtggtcaaatatatttatgaaagtattgatgttgatttagttgtagaagtactagtaaatatggttaaaaaagaggatataagcagggagtacataagagacttcttagaacttgaaatactagaaatggataaaattaattttattagggaatatggcagcaagaatgcaaagaaatttttagttgattataagctgtcaatatagaacgaggaaaggtgaggaaaatgaattattcagaatgtataaatgctgtcagtttagtacttgaatcaaatgaagtacccttgataattggagaaagtggtataggaaaaacttctctaattaaatatatagcaagagataatggttattatcttgttactatagatgcaaatcttctaaaagaaggtgaaataggaggacttcctattgtaaataataatactactgtttatgcaacacaccataaacttgttgaaatagataaaattttaaaagaatatgaaacagcgcaggttatattatttatagatgaattaaacagatgtgatcattcagttgcacaggaattaatgaatttaatactaaacagagaaataaacggatatgttctaaatgacagggtaaaagtaattgcagctatgaatccttcaagtagaaatgatggtttttataatagtcaatatgaagttgttgatttagaccctgcacaagaagatagatttgtatggattcaacttgattcagatattaaggaatggataagatggggaatgagcaaagaaggaaatataaatgaacatataatagaatttctttcagtatttccacagtatcttcatactccagacagtagtgaaacaattaaagctacacctcgaagttgggaaagagtatcaaaatcatatgatatttacataaataataaagataaatatccttttgaaacattgttaaatgtagttaaaggaaatgtaggctcaagtattacaaatgattttagtagttttattatgaatctaaaaaaaccattaattaaagttgatgatatatttgaaaatgatgtacttgaatttgaattaaaggaaaaaatacaaaaggaaaatcattctagattatatatattagtaaaaaatgctgttaactatttaaaagaaaataatagcgaaagaaatttaaatttattttctgaattgcttgatttatatccaagagatttaagacttggaataatgaaagagataaaacgagactatagagagagtatttatgaaaaattgcttgataatgacaagttcttagaagcattctttaatatttttaaataagagatattttaattaataattaatggtgaagttagtatataattttagtattaattataaagttcataaaatgaaatagttaattaagaaaaaggggtgatttatgtggattttaatgaagaaagagaagaacttctaaaagaagtttttctaatggatgaaaagaaaaaatgtggagatttttataacagaagattttttgatattgttgaaaaggtaatactatatcttcttcaaggacaggatgctttttttggacaatttatgcttagtataaaacgtgaaataaggtttgacattaaggttccaattgcaactattccaaaacgtgatggcttcaatatgtattttaatccttttttctttcttaactgtactaagagagagatggctgctttgttaaaacatgagatatatcatataatgaatcttcattttgagcgagaaaaacagcttaaaaatagatttagcaaagaggctgttggagtggcattagatatttcaataaatcagtacataaaggatcttcctggttatagcagaaaacttgaggctataaatatggagcataatttaaatttagcggaaaatagaagcattgaagagtatgcagaggaaatttataaatctataaaatctagaataaaaaaagataaatttaatgaaaatggaaatgaagaatttcttcttgaaatggataaagctcatgaaatatgggatgaaattgatatagatgaagaaagtataaactcattaactaaaaaaacagcaataagtgcttataataaaaatactcctgaggggcttgaaaaaataatacttgcatatgatgaaaaaccagaaatatcatgggagctagtattgaaaaatgcaataccagcaatgaagtcaggatataaaaaaactattgtaagaagaaacagaagacagcctgaacgttttgatttaagagggactttacctaaaaatgaagcagaagtagttgttgcaatagatataagtgcaagtatgaaagatgatgaaatgaaaaaaattcttatcgagatattaagtataactcatgcttcaaaaaataaagttacagtaattgaatgtgataatgaaataagaaaagtatataaacttcgtagtgagaaagatattcaaaaaagatgtagagaaaatggatctacattgttttcaccagtatttaagtatataagagataaaaacctgaaaaactgtatattagtatattttactgatggagttggtgaaaaagaattagaaattaagccttttaataaaaaaacattatgggtaatttgtggagatgatgaattatctttaaaagaatcttatggtgaagtaaaaagaatacatagagaaaaatatgaaaagcttgaagggaatataggtcttcagatggtcaatgaagttatacatgattgggcgagataagatatgcaaatgagataacatatgttaaaataaacgtgatttataaaatttatatgttgtatttagtaattgattaaaaataaatacataactttaaaaatatagtgcatacatagatttactaagtacaatatatataatttatttaggtaacattaattaataaagaaaggttgggtgtttttgaaaataaaactaaaaagcaaggattggattgttttgctttctgtagtattggttgtaagtataataactaatatttattctgcatgtaaaatatatagttacaaatataatattggccaggaatcttatgttgaaatagaagagataagacaaagaaatgaaggaattatggatatattaaatacaagtttagatagtggcagcataagaaatgaagaaattttgaaactatataagaattatgatgttattgcaagtgacgttataaaactgtgggaacagtatgcagattatactcagcgttcagtatcaatttttgcaaagaacatagagtctgataaggtaatacaaaaagatattcatggaaaaataaaagaatatatgttatcgactttaagtaaagaaatgaaaaatgagcagagtaagcttattttagaagacagagacttagattgttttaaagcaatggaggatatgtcagtgagaatatatgaatatttcaatgacttcaatggaaatatgctaaatggacatagtggagaaagtaaacaaaagaaagttataagaaatcattactggattgatatgcttaacggtatatatgacataagcaatgactatattgaagtagaatggaacatagaggcagaagatcagcttgcagctgatgtctatagctaaagattttatatgctaataattaagaaaaaatattctaattaagtttaattttatatagaagaaaaagtcatacataaataagttttatgtatgaccataactgttaatagttagcttttaaaagctaactaatggattagtggcatccgctacaagaaccaccacatccgccttcaggctggattacaggttttaggcttaagccattaccttcattttcttcagatgaaagtattataaatccaccgaattgatcaattaaagttttttcataaataaatgaaatatcatgtatcttttcaacttcatctgcatcagttgcttgagaaattgaaatattaaatattggaccgctgcacgcgaatccagcaaaatttattctaatattaaaatcagttatgttattttcttctaaaaatcctttaaactcattgtaagcttcttcgcttatagtaatgtttttcataattaacacctacttttaataaagttaatgacaaaagtcattgtaaaattagtatagcatataaaatgtaaaataaaaagacaaattaaaatatgaaattataattacttttatactacatatgacaaaaaaagtaatacatatatgatataattttttattaatagattaataaagtttgaatattgcgagaaaggatttttttatgaaaccatataacaaagaatatattcttacaattttaaaagaatataataatgctataaaagatgggaataagggtttatataaaatagatagaagaatatttaagaaaaaagatattcatggatatatgtataaaaatattgaagaatataatatagaaatagtggaacttctaaaagaggataagtgtgttatgagaattgatccaagagagatagaaagttcctatgaagctatatgctatgctcgtggaaaagttggaatagttggacttggacttggatatgttgctttggaaatggcaaagaaagaaaatgtaagtgaagttattgtttatgagacgagtcaagacataattgatttgtacagggataattttaaagaaaataaaaaaataaaaataatatgtacagatgcattcaaagcggagagagaaaagtttgactttttttacgtagatatatacaattattctttaacattaaaagtagttaaggattataagaagtttatgaagcttcatgaaattgaggagtattctttttggggaatggagcattttatgcttagttgtaaatatgaggatatattatgggtttatgtgccagaaaattgggttggcatgtgcaaagatttatatacagaacttcaatcgtcaggttatattaaaagatacaaacctttaaatgagaataaagttacaaaaatactatatgagttcaaggaaatattaaattcagatatgtaaggaatgaagaaaatgatattatcaggaaaagaaattttaaagaacataggaaaagatatattaatcgaaccttttgatgaaaacaggattaatccaaatagctataatttatcattatttaatgaactattagtttatgaaaataatgtattggatatgaagactccaaatccaactaaaaagattgttataccagaagaaggattattattagagccaggtaaactatatttaggaagaactaatgaatttacaaaaacagaaaaatttgtaccaatgcttgaaggacgttcatctacaggaagacttggattgtttattcatgttacagcaggttttggagacattggatttgcaggatactggactcttgaaatattctgtgttcaacctataagaatttatcctaatgttgacatatgtcagatttattatcatgatattcatggtgaatatgatttatacaatagtgggaaatatcaaaataattctggtatacagccaagtttaatgtataaggattttgaaaaataaatgcattatttataactgtcagattttattctggcagttttttcttttagtttatttagtaataaatcacaaaactgtttgaagttattacaaaataagttaaataatgttgacttgggtggccattaaaattaatataaattatgcataaagatatgtttaattaacctgccagtataggagttgatatttttgattaaagtatgtaatttaaccaaggaatttaagacaaataagaagtatccaggatttaaaggtgctataaaatctttattttcaacagaatacacagtaacaagtgctgtagataatatgaattttgaaattgaagaaggagaagttgttggatatataggttcaaatggtgcaggaaaatctacaacaataaaaatgatgaccggaattttaactcctacaagtggaaaagttgaagtgaatggcataattccatatgaaaatagaacagaaaatgcaatgaatataggtgtagtttttggacaaagaactcagctatggtgggacttgcctttaagtgaaaccttttctctacttcgagatatttatagtgtttcttcagaagactttaaagaaagaatgaagttttttaatgaggttctagaaatagatgaatttatgttaagaccagtaagaaccctttcattaggacaaagaatgagagcagatcttgcggcgtcactaatccataatcccaaaattctttatcttgatgagcctaccataggacttgatgttgttgtaaaagaaaaagttagaaatgcaataaagcaaataaataagaaatataatacaacagttatattaactacacatgaccttgaagatatagaagaattatgtgacaggataataataattgataaaggtgtaaagatttacgatggaagtttaagcgaaataaaagagaagtatggatatatgactaatgtatctatattaattaagaaaaacgaattagaagataagataaatattaattcttattttaatctagataataatgatttgaatctaagtgatgaggatggaaaaataaatataacattcaataagaataagatttcacaaatggagataattcaatactttatggaaaattatatacttcaagatttttctgtaaaggaaacaagtattgatgacattataaaaaaaatatatagaaaagaggtataatatatgaaaaaatcattaagcattaaatcatattttacctttaccaaaaacgtttttcaaagaaatattgcatataaggctaatacaataatgtttgtattaggagatactatgatcttggctgtcacgtattatctttggaaagctatttatagcagttcatcacaaggaactctaaatgggttctcttataatgacatgatagtatatgtactgttatcatttatcactcaaggattgatagggacagaagtaggcaatacaatatcaagggaagtgaggaatggatcaatagcatcaaatcttataaagccaataagctatgaaaaaagaatgctttttgaaggctttggaggtatgctttatggatttattttagtatttataataggatttacagcagttttaattattgctatgaaaacacaaataggacttacaattcctaatgtaattatgtattttttgagtgtagtactatcttattttataaatttttactatagctattcaatggggcttttaacattcaagataacaaatatgtggggggtaaatcagataatgcaagcggttacagcacttttttcaggtgcacttgtaccaatagcattttttcctaaagttgtacagaatatatttgatttctttcctttcaaatcaataatatatacaccttgtatgatttttgaaaacaagttaagttcttatgaaatatgcatagcatttggaagacagatattttgggttatagtcatgatgattataggaaaagttatgtataaggctctggtaaagaacttaaccatattgggaggttaatattatgatgagatatattagattatataataagttttttcagcaatacattaaagttctcatagaatatagagcaagtttagttcttggacttataggatttcttttggttcaatttacaggaataatatttattcagcttatatttaattcagttccaacattagatggatggggattttatgaaatattatttatatacggaatggctcagatacctaggggaatagaccatgtctttacagattatctgtggatttttacatggaagactattgttgaaggagagtttgacagatatcttttacgtcctcttaatccattatttcaggttatatctgaaagtgtacaacctgatggacttggtgaaataatagttggagttatgcttacggtatattcatcagcaaaattagggatacaattcggaataaaaaaattaataatattagttgtagttataatattttctacaattatatattcagcaataaagcttgcagtagcatcaatagcattctggacaaaatcatccttttcatatttatttatgacatatcagattagttcatttgcaaaatatccaattggtatatatcctaaggttattaaattcatattaataggaataataccatttgctttcactggatactatccagcagcttatttcctaggaaaagaatcatttcaagtaggagtattgcttactgtgattatttcattaatatccattacagtagcatataaaatatggacaattggaataagatcatatgaaagtgcaggtagttgatattttagaaagacgttatatgaaatgagttgaatatttataatttaaattctaaatattcaaaagcttgtgtagaaattttaaagatttttattttagcagatgatatgcttctgagggctatgaaattcttgatagccaagaatacagaatatactttaggaaattttttgaacttctcgaaaagcttaaagaaataagaaatatcttataaaaaaggatatggcagatgccatgagagtttagatagttttgtgtaattagtatttttatcaatttattattactggaaattttgatttccagtaatatttttttatatttaagaaatactaataatgttttttattaccttttttagtatttcaataaaatctaaaagtatgcatattaatcaataaaagtacaagcttctaagctaattcatcttttaattgatcttcaaatattattgatagctccgctagcgtagcaccccaatttggagtaggttgactccatttttctattatttccatcgtagctaagtaaacacacttatttaacgattcatctgtaggaaagatcactctaaccttagtaaatttacgtatttgacgattaaacccttcaagtgcattggtagtatatatcatctttcttatgcttggagagaaatcaaaaaatgttgatagattactccaattattataccaagaatcaataactatagcgtatttatcaccccacaaagattttaaattgtctagctgcgccaacgcaagttcttcagttgatgctttgtaaacttcttttaaatccttcataaatgcctttttatcctttgaagctatatatttgattgaatttctaatttggtgaacaatacatgtttgaatatttactgatggaaatactgttttaatagcttgtggtaatccttttaaaccatccatacatgcaattaatatttctttaactcctctattttttaagtcattacaaattcctaaccagaacttagcaccttctgcttcatcaacccatatacctaaaatatctttatagccatccattgtatatcctaaacaaatgtaaacagctttattaattatctttccattacttctaactttaaagtacatagcatctaaataaacgataggatatattttatccaaagctctattttgccattcggtagcgctagcaagtactttatctgttattttagataccatcgatggagatatttttattccatatagatcttcaatctctgattggatatcacttgtactcatacctttagcatataaagatataatttttttatctaactcagtacagacagtttcatatttctttataatttgaggttcgaattctgcatttctatcacgtggtacgtctaagtcgacgtcaccgaaggagcttcgtagatttttactgctatacccgtttctatagtttctattgctttgattatttgattctgtacgctcatatttatttcttccaagatgctcttccatttcgccttctaatatattttcaaggacatcttttacaagtttctgtattagcccattcttacccataacatcatcgatggttttacatttttttatttcttcattgtagtcaaagttagtatcaattttttttgtcataataattcctcctaaacttatatgttttattattccaaaactaccaactgttcatacaaaaaaacagtagatagattttgtttttacacaaatctatctactgtcccgatgccatatccttttttcatatctaagactatttaacaactatattaacaagtctacctttaataacaataacttttacgatattttttccgttagtattttctttaatagtttcattttctaatgaagctgcttttataccttcttcatctaagctagaagaaaccatgatttttgctttgattttaccattaacttgaattgctatttcaacttcatctttaattagagcagatggatcaaactctggtaatctttcattgaatacacttgaagtatttcctagttgattccattgttcttcagcaaagtgaggagcaaatggtgctaatagtttgatgtaatcagttatagtttcttttaagaattctggattcttaacattttcgtgaagatatttattaagggcatttgtaagttccataagtcttgctattgcagtattgaattgcattttatctgtatcttcagttacaccttttattgcagtgtgcttccagaagtttaattctttttctgcagaatctacagttgtttttatgttttctgtagagtttataacttctctgcatgattctaatattctttcgattctttcaatgaacttagaaacagatttaataccatcatcactccaagctccaccttctgtgtaagcaaatccaaacattaaatacattctgaatacgtcagcaccgtattcttttatatattcatcaggagaaatagtatttcctttagatttactcatctttaatccatctggtcctaagattaatccttggtgagttaaacttttaaatggttcatcaaagtttaagtagcccatgtctcttaaagctttagttatgaatcttgcatataataagtgcatacatgcatgttctggtccaccaacatatttatcaactggaagaatcttattgattaattcagaattaaatggtgcatcttcatttttgttatctggatatcttaagtagtaccaagaagaacatacaaatgtatctaatgtatcagcttctctctttgcaggtttaccacaacaaggacaagttgtatttatgaaatcttcagatttaccaagtggagatttaccatctggagtaaattctacatcatatggaagtttaactggaagatccttttctggtactggaactattccgcaatcatcacagtatattactggaattggagcaccccaatatctttgtctagatacaagccagtctcttaatctgaagttaaccttcatagcaccaagcttatctttttcaagttcttcaacgatagcctttttagcatcagcagtagttaaaccatcaaatttaccagagttaacaagtattccgtgttcgcagaatggaagttctggttcattaccagacttatcagttataactctttcaattggtaagttgaatttgcttgcaaaagcaaaatctctttcatcgtgtgcaggaacagccataacacatcctgtaccatatgtagctaatacatagtcagcaatccatattggcactactttaccgttaatagggtttatagcatatgatccagtgaatacaccagttttttctttagaagaagattgtctttcaatatcagattgtttagcagcttcttctttataattttcaacagcttctttattttcaacagttgtaagctcatcaactaatttgttttcaggagctaaaacaacataagttactccgtttaaagtatcaactcttgtagtgaatacatcgaattcaagatctgaatctttaactttgaagttaacttgagcaccatatgatcttccaatccagtgtttttgcattgacttagtcttttctggccagtctaaatcatcaatcatatcaagtaattcatctgcgtaatctgttattttaaagaaccattgagtaagatcttttttagttactaatgatccacatctttcacattcaccatcaacaacctgttcattagctaaaactgtgttacatgatggacaccagttaacaggagcattctttctgtaagctaaacctttcttatataattgaaggaataaccattgagtccatttataataatcaggaaggcaagtaacaacttcattttcccagttgaacatagcacccatagattttaattgcttttccatagtttcgatattttttaaagttgaatcatgtggatggataccagtttttattgcataattttctgctggtaatccaaatgcatcaaaccccattggctgaaatacattatatccttgcattcttttaaatctagcccatgaatccgttggaccgtagttgaaccaatgtccagcatgtaattgagcacctgatggataagagaacatttctaatgtataaagtttcttatcagtattttcaggattgaatttgtaagtttcattttcttcccagattttttgccatttttcatcgattttagtactatactttgacattctttacctccaaaatttatttagcgtgcagttaacagttatcagtttaaaaaaatcatatcaatcttaactaaagaatgattttaaaaaaactgtttgcctaataatattaaatgcatacttatatttttgtttaatttaaaataaaaaaagccttcatctcaatcaagagacgaaagcattattccgtggtaccactcttattagaagatttaataaataaatcttctcacttgaatactgtaacgggttatcccgtatctgcttctaaacagataagctcatagacaagttcacaataatataacgttattttacaccaaccaataactctctaaagatatacaaattgttactacttctactcatagcttaatatgtaattttagaatcattatatattaaaatttgtaaaaaatcaaggtgaagaaataagaaagaaagtctttattattatgtaaaaacagcgcaaattttaagaatataaaaattaattacagttctaatctgtgataaaatagtaattatatgatatattagaaacatataattactagaattgtattttaagtaattacgaaggaaggatgggaatatgcatatatattattgggtagctattgctgttgtagtgttaaacataattttttcattatctttaatatttatagagagaaaagatccgacaacaacatgggcatggttacttattttacttgttttgccaggcgttggatttgtattatatttaatgtttggtcagaatttaagcagacagaaaatttttaaggataaaattatttcagatgaaaaaaagagaatggcaagtaatcaagatgaaaagctattttctaaacatagcggtggtgataagtttagtgatcttcagagaatgaattttaataattcaggttcaaaatatacagtgaataatgctgtagatgtttatgttaatggtgaagataaatttaaacagcttatagaagatataaaaaatgctaagagttacatacatgttgagtattatatttttaaaaaggatattataggaaagagaattatagatgagttaactaaaaaggcaaaagaaggacttgaagtaagacttttagtagatgccatgggttcaaggtctcttaccaagaagacattaaaacattatatagaggctggagggaagttttctttgttcttcccaggaattttaccacatgtaaatacacgtattaattatagaaatcatagaaaaattgtagttatagacggagtatatggttatgttggtggttttaatgttggaaaagaatatataaatcaagatcctgaatttggtttttggcgcgatactcatgtaagaataaagggtgatgcggtaaatgatttaaatgaaaggtttttattggattggtgttacgcatcagaagagaatataaaagattttgataagtatatgaatgaatataaagatcaatgtggtgatgtgtccatgcagatagtaacaagtggaccggaccataaagaagaatatataaaaaatgcttacataaagataataaataatgccaaaaagaatgtttatttagaaacaccatactttgttcctgatgcaccagttttagaagcattgagaatatcagcattgtcaggagttgatgtaagaataattataccaggcaaggcagatcatttctttatgaagtgggcagccagttcatatataggtgaacttctagatgctggtgttagggtgtatagttataataatggttttattcatgctaaaacaatggtttctgatagtggcgttatgagtattggaacagcaaatatggatattagaagctttaagttaaattttgaagttaatgcatttatttatgacgatagaattgcattagatggggaagaacaatttagaaaagacatggcgttctcagaagagataacaaaggaaacatataataacagaagtttattactaagaattgaagagtcattaattagattagtgtctcctatactttaactttaaaattaattttaaaagcagttatgaattttgttagttaacaaattcataactgcttttattaatcatataaacaattcatagtgttttataaaaataaaaactaggttataataaaaatataaacaataacagaggtggaatatggataatctaaaagaaattagatggaagcagagatttgaaaattttgaaaagacttataaattattaaagaagtattcaagtcaatctatttctacagaattagaaaaagcaggaatgatacaattctttgagatggcttttgaacttgcttggaaagtattgaaggattacttagaaagtgaaggatatatggttaaaagtccaagagaaactataaaacaggcatttcagattggtttgatagataatggtcatgtatggatagatgcattatcggatagaaatttgactgcacatacatatgatcaagaattagcatctaaaatgacacatgaaataatatcaatttatcttccagagcttgaaaaaatgtatgataagttatctaaggagttatagcaatgtatgggcttttagaaagagatataagatatataaaaaaagcattagaacagtgtgaagagatagaaaaggctataatttttggaagtagagcaatggggaattataaaaatggttcggatgttgatattgcagttttgggagaactcataagcaataataccattttaaaattgaatgattatttaaatgagatttatccgttgccatatttttttgatataataaattataattcaataacaaatgaaaatcttaagaaacatatagatattgaaggtaaaataatatacacaaaatagatttttcatagagagatgaattaataaataatcatataatcgttgaaataaataaaaaaatatcaatatatattgacaaaaaatgatagtttgatataatgttaaaaagactaaaaatacaatgattggagaaaaaacatgaaaaaggatattataaaatcagttatgcaaaaactttatagctttttttactttatgttctggggcttttattttagcgctggctatttattttgcaaaaaactgaataataatatatctttaatgagtgtttaatccactatagtttattttttaaagaaaaagaaactttatattaagttattatttagagctcattaacgtgagctctattttattttataaaaatttaaaaatataacaagtaaataagataataaagcagtttataaaagagattgatacatagttagaacataatttaaaagtttaaatgataaataaattatctaatctaataattgtcaattatcaattgttaactgtccattgaattaagggggcttataaaatgatagtagtattaaaacaaaaagcaaaaaaagaacaaatagaaagattaacaaaacaaatagaagctaaagggttaaaggttaatcctgttataggaacagaaaaaagtgttttaggattagttggagatacaacacaagtagatccatcaagtattgaagcaagtgaaatagtagaaagtgtaatgcatgtacaggaaccattcaaaaaggcaaatagactgttccatccagaaaatacaattgttgatgtgaatggtgttaaaattggtggaaagaaaattgcagttatagcaggaccatgttcagttgaaagtgaagaacaaattgttgaaattgcaaaagaagttaaggaattaggtgctaatttcttaagagggggagcattcaagccaagaacatcaccttatgcattccaaggattaaaatatgaaggtcttgaactgttaaagaaagcaaaagcaaagacaggacttccaatagttacagagttaatgtcaccatatgatattgaaacatttgtagaaaatgtagatgtaattcaagttggtgcaagaaatatgcagaactttgatttattaaaggaacttggaaaaactaataaaccaatacttttaaagagaggtttatctgctacaatagaagagtggttaatgtctgctgaatatattatggctggtggaaatgagaatgttatactttgtgaaagaggtataagaacatttgaaacttacacaagaaatacattagatttaagtgcagtaccagctgttaaaaagctaagtcacttacctgtagttattgacccaagtcattcggcaggtaaatactggatggttgaaccattagctaaagcagcagtagcagttggagcagatggtcttataattgaagttcataatgatccagcaaatgcattatgcgatggaccacaatcaattaaacctgagaagtttgctaagttaatggaagaacttagagttatcgcaggagcggttggaagagaaatttaatctagtcaacaagtaacagttagtttagttaacaagtaacagttaacagttaacagttggagggagaaaattcctatggaatttttcaagttttaaagaagttatgatttctaataaaagtaaatataataatttaaaataaaactgctaactgttaactgctaactaaattaaggaggagagtagtatggaagaattaattgttgatttaggagaaagaagttatcctataataataaaaaagggatctctcaatgaagttaatattgagataaaaaaagtattcaaaggtaaaaagatatttatactaactgataaaaatgtaggttcacattatggagataaggtgaaaagtaggttaattaatgaaggttatgatgttagattgatggctttagaaccaggtgaagaaactaagtcaataagcacgcttccttttgtatataatgaattattagattttaaactaacaagaagtgatttaatcataactcttggtggcggagtaataggagatttaggtggatttgtagcatctacttttttaagaggtgttgattttgtgcaaattcctacatcaattcttgctcaagtagacagtagcgttggtggaaaggttgctgtagatcttgatagaggtaagaatttagttggaagcttctatcatccaaaacttgttttaattgatccagaagtattagaaacactagatgacagattctatagagatggtatggcggaagttatcaagtatggatgtataaaggatagagagtttttctatttccttaaaaatcttaaaacaaaagaagaagttatgaataatatagaaaaaatcatatacaactgttgttatattaagaaatgtgtcgtagaaaatgatgaaagagatacgggagaaagaatgctgttaaatttcggacatactttaggtcatgcaatagaagcttattataactttaaaaaatttagtcatggtgaagctgttgcaatagggatgtatatgataagcaaaatttcagaagataaagaaattactgaacagggtgtttcaaaagatattaaagaaatattgattcaatatggtcttccttatgaagttcacattgaagaaagttcacagattatagaaacaatatcattagataagaaaaatattgataatgttttaaaagttgtgttacttaaatcaatagggaaatcatttttagaaaaaactaatgtggaattctttaaatagagtgaggtgcaataatgggagattataaagtttatccgaagaaattaaaaggagaggttaaaatccctccatcaaaaagtatggcacacagagcagtaatatgtgcagctttgagtgatggtacttgtaaagtatcaaatatagatttttcagatgatattatagctacagttgaagctatgaaatcattaggagcagtcatagagaaaaaagatgattgtcttgaagtaataggtataaaatcaccagaaaataaacttaataacagtacaagtgatgagagaataatagattgtaatgaatcaggttcaacacttagatttttagttcctatagcggctttatttgaaggtgtaaataagtttgtaggaagaggtaatctaggaaaaagacctcttgatacatattatgagatatttgataatcaaggaattaagtattcttataaagaaggtattcttgatttaaaaactgaaggaaaactgaaatgtggtgaatttaaagttaaaggaaatataagttcacagtttataactggtttattatttacacttccgcttttagatggagattcaaaaataataataactacagaactggaatctaagggatatattgatcttactttaagtgccatgagagattttggtattgaaataataaataataattatgaggaatttgtaattaaaggaaatcaaaattataagagtatagattatagagttgaaggtgattattctcaggcagcatttttcctttgtgctgatgcagtattaaatgaagttgtggttaatgatcttaatttaaagtcacttcaaggtgataaggaagttatagatatattagaaagaatgggagttaatataaaagagaatggtgaaggaattattggaactgtagataagaagctgaaatcaacaattattgatggttctcaatgtccagatattattcctgttgtatcccttgcagcatctttatgtgatggaactacggaagtcattaatgcaggaaggcttagaataaaagaatgtgacagacttgcagcagttacatctgaacttaataagcttggagcaaaaattacagaaaaagaagatggacttattatagaaggtgtatcaaaacttaagggtggatgcacagtatggagtcacaaggatcatagaattgccatgacacttgcaattgcatcaactatatgtgaagagcccataataataaaagattatgaatgtgttacaaaatcatatcctgaattttggaatgactttataagtttaggaggtgcattagatgagtggaatgtggggaaataaattaaaggtatctatttttggtgaatcccatggagcgggaattggaattacaatcgatgggcttccatctggtattgaaattgatatggaagaagtactgaaggaaatggcaagaagagcacccggtaaaagtaagctttcaactgctagaaaagaaggggatcagcctgaaatattaagtggattctttgagggaaaaactacaggtacacctttatgcgctgtaataagaaatagtgatcagcattcaaaggattatggaaagcttaaggatttaatgagacctggtcatgcagattatcctggttttattagatataacggttttaatgactacagaggtgggggacatttttcaggaagaataacagcaccacttgtttttgcaggagctgtatgtaagcagatattaaatataaaaggcataaatgttggggcacatgttaagagtattggaacaatatatgataaaagttttgatgaagttgaactaacaaaggaacttttagataacttaaagataaatgaacttcctttattatgtagtgaaaaggaagaaattatgagaaatgctatacttgaagcgagaagtgactgtgattctgttggcggaacaatagaatgtactgtaattggaatagatgcaggtgttggaaacccgttttttgactcagttgaatcaactcttgctcacttaatgttttcagttccagcagtaaaaggaattgagtttggaaaaggatttgagatgagtgagcttagaggatctcagtgtaatgatgaatattattatgatggtgataaggttaaaacttatactaataataatggaggaattacaggtggaataacaaatggaatgccaatattgtttaaggtaggaataaagccaactccatcaatagctaaaaagcagagaactattgatattgaagaaaagaaagaatctgaactgataattgaaggaagacatgatccatgtatagttcaaagagctgttccagtcattgaagctgtaactgcaattggaatacttgatttggttttgtaggagtaagtattataaaggagagaaacttataaaatggcagatttagatagttatagagttcgaatcgatgaaattgatagagaaattacaaagttatttgaagaaagaatgaatgtagttcttaatgttgcaaaatataagatggaaaataatcttcctatatttaataggggcagggaagatgaagtaatacaaaagaatataggatatttagaaaataaagattactctggtgaacttgaagagttctataatgatttaatggaagtatcaagacatcttcaaaagagaaaaatgcaggaagaagagaaagcaaaaaatgctgaaataataaataagtcaaaagtattagataaagaaaataatgttgataaaaaaataggcttttttggagtttcaggatcatttactgaagaggcaatgcttaaatactttggaaatgttaaaaatccaaaagcttatgatgaatttgaagatgtgtttttagcagttaaaaataatgaaatagattatggtgtaatacctattgaaaattcttctacaggtgcaatagctcaagtatatgatcttttatctaaatatgaattttatattgttggggagcagtgtataagagctgaacaaaatatcataggtgttaaaggtacaaaactagatgatataaaagaagtgtattcacatccacaaccatttgctcagagtactgaatttctaaagtgtcatcctgaatggaagcttataccgtttcatagtacatcagtaagtgcaaagttagttagtgatttaaaagagaaatcaaaagtagcaatagcaagcaaaagggcagctgaaatttataagctggatataataaaggaaaatataaataatcagagccaaaatacaacaagatttataataatatcaaaaaatcttgaatctgattcagaatgtaataaggttagtgtagtattttcaatagatgataaggctggtactctatataaattaataagtcattttgcagaaaacaacattaatatgataaagatagaatcaagaccaatggaacaaggaacttggaattatttcttgtatgttgattttgatgggaacatagaaagtaaagaagtagaaactgcattaaatttaataaaacaaaatagtccttattttaagctgttaggtggttatagaaaaaatatataattaatgcttaatgtaataggatgctataaatttaagattttaaatctaattattttaaataaaaagggggattaacaatggatttttatggagttttaggagaaaagcttcctcacagtatttcaccagaaatacatgaagaaattttttcactattaaatattgatggcgcatataaaatatttgaagtagaaaaaaaagatatcagtaaattgtgtgattcattaagaattttaaaaattaaaggtactaatgtgacgataccttataagcaagaagttatgaaatatcttgattcaatttcagaagaagcagaaaagataggtgctgttaatacaatctatttaaaagatggaaagttatatggatataattctgattactttggatttggaactattataaagaaatatgatgtagaacttgaaggtaaaattactatggttttagggacaggaggagcatcaaaggctgtagttacatacctgcttgataaaggtgtaaaaaaaatatatttagtatcaagaaatcataaaaatgaatctgattataaagatgatagagtagagtatacaacttatgaagagatagaagaaattaaaggtgatgttattattaatacaactccagtaggtatgtatccaaagacaggagtaagccctgtaggagagaatattataaaaaactttgatacattgatagatataatttataatccaagagtaactgaatttttagcaattggggaaaaattaaataaaaaggtatgtggtggtcttgaaatgttagtaggtcaggcaatcaagtctgaagaagtatggcaggaaatggatatagatgatgaggtttttgataaagtattttctaaaataaatgaaaactttaaataattaggcagaaaacttaatcgttagtagtgaacaattagtttttgttattcactatcattaattttgggggtaggaaatgaaggataaagtagttattataggaatgccaggtagtggaaaaactactattggtaaaatacttggtagggaattagatttaaaattttatgatatggatgaatatattcaagaaagaacatctaaatcaatcttagaattgtttgaaaatggagaagattattttagaaatatagagacagatatgtgcagggagctttcaaaggaaaagaatgtattgatttctactggtggtggtgtagtcaagaaaaaagaaaatattgatgcattgaaaaaagatgcattaataatatttttagatagaccagttgaaaaaatactagaagatgtagatgtttcaaaacgtcctcttttaaaagatggtaaagaaagagttattaatttatataatgaaagatatgaattatataaaaaatatgctgatgaaattgtggttaatgattcagatatgatagaagtaattgaaagattaaagaatgttatagcacaaatgaattttgatgtagtaaaatagtagatatagttaatatgctttccttataataaatgatttgaaaaaatatttattataaggagggcatattttttattctttagataattgatagttgagtcaaatctattgataactttaaaaggttgaaaaattctatatcacactttattgtatttatcagttataaatttgaaaaaagatttaacagatggagttgagtatctatttttaagtgaagccatgtagatgtaacgttcataattcaaatttgatatggggataattttcacattgaaattttttagtattgatatatttggaagtattgcaataccataatttattgaaaccaatcctgcaacagcagtatcttcttcaacttcacatattatttttggagttatttgtgcctgtgaaaaaagattatcaattattggtcgtattccactttctttattaaaataaacaaaaggataatcttcagtttcttttaaatctatattgtccttacaagacaatggatgatctttagaaatgattaaaactaaatcttgcttaattacagggaaaaattctatattgggttcattttccacaaaagagcagaatgcaagatcatatttgtctgattttaacccattaattatatttgtagtattatcctgtccgaaagtaaatgtaatatttttatttgaggaatcattaagaaattcatttattgtattaggtataaattcagctccaagtgtataaataaaggctaaatcaattttgccttttgaaggatcaagaaaatcctttaattttttttctccaatttcaagaatgtttaatgactcatcaacgtatttcaagaagagtttgcctgactttgttaatttaacatttctaccttgcttttcaaatagatatgtacccaattcactttctagattagaaatagcatgacttaggctaggttgagttattgagagtattgatgcggcttgagtatagtgttcaaccttagctaagactctaaagtagtttagatgatttagattcatgtacattcaatcctttcatttagctgatcttttttataaaaatatttgtttgaataatatactaacattatctatagataaaatctatagataatgttaaaaatatgaattggattaatgaattatcacatattaaaataaatatacagcgataaatgaagaattcttgataaaaaagttaattttttatcaagaatgatagttttttatcaagaattttcaagaaatttattttatgggagagaagagcatgaaaagatacaataatatttttactccattaacagtgaaaactatgacaataaaaaacagagttgttatgccacctatgggaagcaattttggtggagcaaatggagaaataacagaagagcacataagttattatgaacaaagagcaaagggcggaactggattaataatcttagaaaatgtatgtgttgactttccacttggatctaatggaacaactcagcttagattaaatcatgactgctttattccaggtttatataaatttactgaaagattacataaatatggtacatgtgtatcagtacagattaaccattcaggggcatcggctgttccgggaagaattggaatgcaggcagcatcagcttcagatgtaccttcaaaaacaggaggagctgttccaagaccattatcaaaggaagaaatatatgaaattgcagataaatatgcagatgcagcaagaagagctcaaatggcaggatttgatgcagttgaaattcatatgggacactcgtatttaataagtcagttcttatcaccaatatttaataagagaacagatgaatttggtggaagtgctgaaaatagagcgagattcggaagattagttatagaaaaagtaagagcacaagttggacctatgttcccgataatgatcagaattagtgcagatgaattgttagaaggcggaaataaattagaagatactttagaatacttagaatatttggatgcagaagttgatatatacaatgtttcggccgcattaaatgattctctatattttcaaatagatgctaactacttagaagatggatggagagcatacatgtctaaggctgttagagataaattcaataaaccaacaataacaactggtaatataagaaacccacaagttgctgaagatattttagcagaaggtaaagcagatttagttggaatgggaagaggacttattgctgaaccaaactgggtaaataaagttcaaagtggaaaagaagaaacattaagaaaatgtatatcttgtaatattggatgtgctggacatagaattggattaaatagaccaataagatgtacaataaatccagatgttgtatttgaagatacattagaaggcagaaaagtaaataagcatactaatgttgtagttattggtgggggtactgctgggcttgaagcagcatgtacagcagctgaagctggatgtatgacgttcttatttgaaaagaaatcataccttggaggtcttgctagagaaatagctaagttaccagctaaagatagaataaatgatttcccagattacttaatcaacagagttaataatctgaaaaacttaattatatttacaggtacagaagctacagttgaagctgtaagtaacttgaaaccagatgtgattataaatgcaacaggttcaattccattacttccaccaataactggacttttagatagaattgataaagaagattcaaaagttcgttcaatttttggattaataaatgaaattgaaaactttaaagaaatgaatgttaaaggtaagaagatatctgtcgttggtggtggagcagttggattagatgttgttgaattctttactgaaaaaggtgctgatgttactataatagaaagattacctgttataggaaaagatttagatgtaattactaagattcaaaatatggcaatgcttaaggaaaaagaagtaagagctatgacgagcacgtctcttcttgaagttaaagatagtagtttcttagttgaagttgatggaaacaatgaagatatagattttgattttggatttgtatgtctaggtatgagaggcgtagcaacattattaccagaattacaagaacactttaaagatacagatgttgaaataatgaatatcggtgatagtgtaagagcaagaagaataatagaaggaactactgaaggtagaaatctaactattgaaacactagatagattgggattatttagataatactgtataagattcacataaaaaattagtttaagcttaatagtaaattttattatattggcaaaaaagcattttctatctttagaaaatgcttttttgtttttaatcatttgtgatattttcgcttgctaaaatagtcatggccttttgtaaaatattattttcattttttaatttatcaatagtatcttttaattcttgtatttcatcataagtattttttgaaacaagaacagtgctttgagtgttcatatcagaggatttagctttagaactattttttttactttttgaatgtttttctctgaattctaacggagagcagtttactctgctagtaaatatatttgagaaatggcttatatttgtatatccaactttatttgaaattgatgtaagtgattcatctgtatttaataatagaagctttgcttcacatatacgaagatcaatggcatagtttattggtgatactgtatattccttcgtaaaggcatgacttatatgtccagcgcttacatgaaatacgtcagaaagcttttttaaagttattggttcattataatgttcacttatatatacaaggatatctcttacaaaggaagactttttcttttcaattgatagattttcttctggaagaagtccatatattaatgaaactaatgaggtggcaagcatattgcatgtaaattgagatattagtgtttcatctatacataaagtacgtatttcttccattatagattttataagcaaatcatgtataccagtttttattattgcatatgtacttgaatttaaaaggctattagattctgaaaagccatttattgtataatcatcaataattatggtccaggcatctacaggtttttctgtatcagagctaatagaatggagaactcccttttccattatcaaaatatgtcctttttctaaaatgaatgtttccatatcaatagtatatgtagctttaccattagctatataaactatttctgtagaatttttatgaagatgatagttatatgtccagtcaggggtattataattatgaaaaattcttcttaatttagggtaatgtttatccttaaatatatcttgagattttttattaaaactaaaagaaaacacctttaatcctcctttaagtatagtaatgatttttatacattatttaggtagatagtaatagtataactcattgataaaataaaaagtaaataaaattttgtaaaataacaatataatttaaaaaataatctataaaatggcttaataacgttaagaaaataaaaaagatatcaatataatttgagtgtaaaacaatattgtttgtattcaaattgtttgaaaatttatataattaggttgtaaataaaactaaattaatttgttaaaaaaaacacattattataagaggagtacgaacaatatggaagaaagagtagtaaaacaaaactacaagaaattatacccgacagcatttattttatatttaagtttctttgttcatgggtttggggcagcgattttatcacaaaatacaacttcacttcaagcattatggagtacagatgcggcaggagtactttatgtaatttctgcattaggaataggtagattaataacatatcctttttcaggagcaatttcagataagtttggaagaagattgacagttataattggatgtttagtatatatatgtttctttggaggaatattaattgctccaaatgttcaagttgcattttgtatagcaatacttgcaggagtagcaaacggatttttagactcaggtgtaattccagcagttatggaaatcttagttaattcatcagggcttgctagtattttaacaaagcttgttatagcaattgcacaatatatattaccagttatggtcgttttctgggcagacaatggaatgtggtttggatggacatttgtaatgtgtataggtttattagtattaattgcattattattaattaaacttccatttgcagaaccagaagcaaagaaagaagaagttgttgaaaattcagcagaaactattaaagctaatttctggattgaaggtgtagccttaataattatgggatatactgcaacagcaacattccaagtatttttaaacataaataaagattatggaatgacattcttaaatatgtctcaatcagcagcaggtcaaataggctctaattatgcattaggatcaatatgtgcagtattactaaatgtagttttagttaaatggtttaaatcagttagattaatattaatatatccagcattatcattaggaacattactttggatgtacttagctccaagtccaacagttgctcaaattggaggattcttaattggtgcaacttgtgctggtggtgtattacaattggtagttgctacaatgtcagatttgttcccagcatctaaggcaaaagcagttagtatgataatgattgctggagcattatgcgcattcacaattacagcaatagctggtggtgttacaaaatcatttggtgttcaatatacattacttgtttcagcagtacttgcatcagtgagtatagtagctgcaatagttgtaaatataagatataacatacttatgaaaaaagataaataggattttatttattaacagtacttagtaagttaaattgagatatttataaattatacaataaataatttgtatattatgaggataaaatatgtactattagtgtggcaatgttaatcaatatatgaaatttatgtttacttaatttaagaatatatttgattagaaaatagataataggatagagaggtattaaaaatggaaaagagaattacaggacatacagagttaataggacttattgcgtatccaatacgtcatacaagttcaccaacaatgcacaatgctgcatttgcaaaattaggacttgattatgcatatcttgcatttgaagttgataataattcattagaaggagcagttcaaggtataagatctttacaattaaaaggttctaatgtatcaatgccaaataagactgttgttcataaatatttagataaaatatcaccagcagcagaaatgtgtggagctgttaatacaatagttaatgaagatggagttttaactggtcatataactgatggtactggatacatgatgtcattaaaggataatggcgttgatgttattggaaagaaaatgacaatagttggagctggtggagctgctacagcaatagaaatccaagccgctttagatggtgttgctgaactttcaatattcaatagaaaagatgatttctgggcaaatgctgaagaaacagtaagaaaaataaatgaaaaaactaattgtaaagcatcactttatgatttagatgatttagataaattaaaagaagaaatagcaactagttacttatttactaatgctacaggaatgggaatgaaaccactagaaggaaaaacttatattccagataaatcattcttaagacctgacttaatagtatctgatgtagtatacttcccaagagaaacagaacttttaagaatggcaaaagaagtaggatgcaaaacaatgaatggtcttggaatgatgttattccaaggagcagcagcatttaaattatggactggcgaagatatgccaatagaatacatgaaagaaatgctagacattaaatattaataaatatatttagggagagttgttataaagcgaaaaagttagtagttttgtagcaactcttttagacaaaagacagaatatagatttgaagtggcatttaagtaagttgtctataataacagatttatttaagatataataatgtagatatgttatctagatgtttatatagataactaaattattatagtaaggagagatattttgaaattattaaattggttagataattattttgaagaattgctgatgataatattgttgattcttatgacgcttattatgggagtgcaggtgtgttctagatacatgtttaataattccctgtcatggtcagaagaagtaacacgatatttatttatatggtctggttttatcagtattagttattgtacaaaaaagtgtatttctataaagatagagcaatttgtagaggcatttcctaagaaaggaagagccatatttaagataataaatcatacaattgaactgatatttttcttttatttaatgccgttttcaattttatatttaaagtcttcaatagaaagtggtcaggtaagtccagcatgtggtattcctatgtatttagtacaatctgcaccactaataggttttagcttagcaattataagaataattcaaagatggattatagaatttaagatatgtagggagggataattacatgacatcagttatagtatttatgatatttttcatttgtcttttaatagctattccagtgtctatatctttagggatagtttcagtattgccaggttttatctctccttcgtttaccgctagcggtcaatatattgtaaggtctatgtttggaggaattgatagttttccacttcttgcagttccaatgtttatattttcaggaattataatggctaaaggtggaatatcaaaaagattatttgatatatttgcttattttttagggcgttttacagcaggaatgccatgtgctgtaatcgtcacatgtttgttttatggagcaatttcaggttcagcacctgcaacagtggctgctgttggaagtatgacaatacctattttaaatgaacttggatatgataaaaaattctcaacagcaatagttgctgttgcaggagggctaggtgttattattccaccaagtataccatttataatgtttggaacaacatcaggtgaatcagtgagcgacttatttatagctggaattattccaggaataattatagcttttttattgatggggtatgctatagcttattgtaaaaagaatggtgaagatagagagagaatagaaaatgtaataggtcaattgaagaaaaaaggtttagttaacatattaaaagaaagtttctttgcattattatctccggtaataattttaggttgcatttattcaggagttgcatcaccaacagaagcagcagtattgtctgtattttatgcattaataataagcgtttttgtatataaaactattgatgcaaaagttcttttaaatgtatgtattgaaacagttagaacctatgcacctattttatttattcttgcggcatctgttgctttttcaagagtattaacattgatgcaggtaccacaacttgtaagtgaatggatttcggttaactttacgaataaaataatactattattagtgattaatttagtgttattagtagtaggaatggtaatggataccacacctgcaatattgatattaacgcctattttaattccaatagtacatagtataggaattaatcctatacattttggagttattatgattgttaatctagcaataggattcataactccaccaataggtgtgaatttatttgttgcaagttctcttactgatataccagtaatggatattactaaaaaagcactgcctatgataatatgcttcattatagcattgctattgattacatttataccagagataagtttgttattgttaggcagttaggtggtgtaatatgagagttaaaaaagaaacattaagttatcttatattgggaattataattactatttcttcattattaataggatgtaacaaaaatgtattagaagaagaaaaacaagtttatgcatggcctatagcaacggctagtccagaagatactgttacacaaatttttgcagaaaagtttgctgaagaagttgaaaagatgagtgatggcaagatgatcattcaagtatattctaacagtgtattgggtggagatagagaacttttagaaagttgtaaggatggagatattccttttgtagtgcagaatacagcgccacaagtatcttttattaaagaagcatcaatcttcgatcttccatgtgtgtttacagatattgaagatgtaagacaaacggttgataatgaagaatttttatcagtaatgaaagatgcatacaaaaagtctggatataagttaatgggatactcagaccaaggctttcgtgtaatgtcaacaaataaaatggtaaaagaatttaatgactacaagggtcaaaaaataagaattatggaaaatccttatcacttacaattttggagaagtatcaatgcaagcccaacaccaatgtcatttagtgaagtatacataggtcttcaacaaaagactatagatgcacaagaaaatccatatgaagtaatagtatcaaataggctttatgaacagcagaaatatattattgaaacaaatcatttaccacatttgatttcatttatagttagtgaaaaattttatgaaaaattatcaccagaagatcaagatataatcaataaggctgctcaagttgcaattgattattcaagaaaagtatcagatgaacgagttgaagaaaaaatggatattattaaatcaacaggtactgaaattattcccatatcagaaaatctgagagacgaaatgatagaagcctctcaaagtgtctataacaatataagggatgttgtcggaaatgatcttatcaatttatatacaaatcataagtaaaaattagaaaatcataagaaataataaagaggcgtttcgaatttattttatcttatgaaaaacataataaagtgataataatttattattatatatagatatattttaggagggcgtacaatgtcaaatatagtagaagttagaaatgtaaaaataggtgaaggaataccaaagatcacagtaccagtagttggaactaacaacgttgagttaattgaagaagtaaaaggtttaaaaggaattaagcttgatatagttgaatggagagttgatttctatgaaaatgttgaagatatagaaaaagtaaaagaaatattaggagaaataagaaaagtattagttgatactccaatattattcactttcagaactaaaaaagaaggtggagaaagagaagtacctgttgaatattatgtaaaattaaattgtgaaatagctaaaactaaacaagtagatttagtagatgttgaattattcacaggtgataactatgtatcagaagtagttgaaactgcacatgcaaatggtgttaaagtggttatgtctaatcatgatttctttaaaacaccagcaaaagaagaaatagtttcaagattaactaaaatgacagaattaaaggcagatcttcctaagatagcagtaatgccacaaagtgaagctgatgtattaactttattatgtgctacaaatgaaatgaaacaaaaatatgcagatcagcctataataacaatgtctatggctggaatgggagtaataagcagattagctggagaatgtttcggttctgtattaacatttggtgcagctaaaaaagcatcagctccaggacaaatagctgtagaagatttaaatacagttcttcaaatattacataaaagtatatagattttttaaagagatggattcagtatgatgaatccatcttttttaatttctatgctatatatcaaaaaaatgtcaattgttaagtaaaatcaattgaaagatttatataaatggggtatattataaaatgtaggataataagcacagtagggcaaattaaaaaaaataatgtagtataggaggatgactaatgataattgttatgaagtcaaatgctaaagaagaggaagtaaaaaaggtaaaggacataattgaatctaaaggtcttataactaatatttcaaagggagaaacaaactatattgtaggtatcataggtgatacttcaatgattgatcctaagaaaatgcaagtgttaaaaggtgtagataaggttatgaaagttcaggagccttttaaaaaagcaaatagattatttaagccagaagatactgttgtaagtgttagtaactctattattggagggggaagattaggtgtaattgcaggtccgtgttcagtagaaagtgaagaacagatagtagagatagcaagaagagtaaaaaaagcaggagcaaactttttaagaggtggagcatttaaacctagaacttcaccatacagctttcaagggcttgaacttgaaggacttaagttgttaaaaactgcaaaacaggagactggacttccaatagtaacagaaataatgtctacagattacattgataattttgtagaagatgttgatgttattcaaataggtgcaagaaatatgcagaactttgatctgttaaagcagataggtaagacaagaaaacctattttattaaagagaggattaagttcaactatagaagaatggcttatgtcagctgaatacataatggccggtggtaatgaacaggtcattttatgtgaaagaggtataagaacatttgaaactattacaagaaatactcttgatttacaagcagtacctgttgtaaagagattatctcatttaccaataattattgatccaagccatgcaggaggattttcatacttagttgaaccaatggcaaaaagtgcagttgtttgtggagctgatggacttatgatagaagttcataatgatcctgaaaatgcattgagtgatggtcaacaaagtttaacaccagatgaatttgatatattaatgaaaaaagtaaaagcagtagcagaattagaagataaacaaatttaatcatttgataagtaaaaaaataattcacagtaattgtcaactgtcaattttcaattgtcaattgacaaagggggcagaaatatgaaaattgtagttgtaggacttggggtaattggtggttcttttaccatggcattaaaaaaagcgggttataatgacgtatatggaattgatataaatgaagaatctttagaaaaagcaaaaagacaaggttttattaaagatggttttacttctggaagcgaaatagtaaaagatgctgatcttataataatttctttatatcctagattagttaagaagtttatattagataataaggaaaattttaaagatggagcaataataactgatgcgacaggaatcaaaaaactatttgttgaagatgtaattaatatactaccttctaatatagattttgtttttggacatcctatggccggaagagaaaaaaagggtatagattttgctagtgcagaagtttttaacggagctaattatataattactccagttgaaagaaataaacctgaaaatcttgatttaatagagaatttagtttataagctaggttttaaaagagtaaggagaattactcctgaatatcatgatgaaatgataggatacacaagccagcttcctcatactcttgcagttgcacttgttaatagtgatatagaaggaagagaaacgggaagtttcataggagatagttatagggatttaacgagaattgctaacataaatgaagacttatggagtgaattatttcttgggaataaggacaatcttcttgaatcaatagagagttttgaagcagagcttgataaaattaagaatgcaataaaagatgatgataaagacacattgaagcaactgtttataaaatctactttaagacgtgaaagactttaggattagatacggtgaaccatatcataaatcagtgataaatttactgaaatcagataaaactttatattatttgtttatagaaactattaatcatattttaaatataaatatggttaatagtttttttcctatataaaataattagatttttgtgaaaatctatatgtatgtattaagttcagtataaccagctatagtgacaataatggttaaaagtgatagtattaagtaaaacttaacaatactatttcatatataaataatattatgaataaaattgttttcagaatataggattgggaggggagtaaaacaatgagatatatagccattataaaatcttgttatccatcattaagtaaaacagaaaaaaaggttgctgactatattttaaaagaaagaggcaagataatatatcagacattattagaaatatcacaaaatatagaagttggcgaggcaactattattagatttgtaagaaaaataggatttagtggatttcaagatttgaaatttgaaatagcaaaagaaaataataatgatattgaaagtaatagtaatagtttagataataattacgatagctatatagatgaaaatgccgaaagaattgcccaaacaattataaatactaaatcgactttagacaaagataatttaaagttagctattaaaatgattactgattcaaagagggtatttttctatggagtaggctcatcagggtttacagctaatgaggctcaaactagattcatgagactgggagttataggaaacgctattatagatcctcattttcaatcaatgtactcatcaataagcaacagtcaagatgtaattattgtttttagtatatcaggatatactaaagatattattgaagcagtaaaaattgcaaagcaagaaaatactaaaattatagcaattacaagttacatactatctccaattgcacaacttgctgattgtgtattacttacatcagcaaaagaaaatccactagagggtggatcatttacaggtaagatatcacaactttatataatagatttactttgttcagaatatttagtacaaaataaaaaaagtgcattattgcaaaaacaaaaaacagcagaagcagttgtatcaaaagctgtggattaacataaaagggtacgtatcattaaatttaatgttttatggtatgtattttttttcattttattagtctttaactagtattttaaagactgattattcaataaaattatataaataaaaccaatcataattatgtcgagaatatagtatatatctcgatttttttatataaaaagaaaatagtgacaatgaagaatgacgtagtaatcacatcttcattgtctttttttattattttagaaaatcataatgcagtgaaatatgttggcaacttttaaatattagaaatgaaagattaagtttaaaaattagtaaaaaaattataaatttcacacgtttgtacttaattttactaaaaaaacatcaaaattgataaaatgtaaaaatatacttaaaaaacgtttacaagagaaataaatggtgatatacttagagcaaatgaagtaatacttcttaattcaaagaaaaaaaggagtgaaattttacaaggtttttattaaaagaaatggaggaggaaaaaatgaaaatgaaaaaaatgatggctatagctttagttggcgtgatgtcattatcattgattggatgtggatctgcaaacaagacttctggtggagatgcagaaacaaagattatgtattcaaatggaggaccaattgaattctttgaaacaccttggttaaaccctggtacctttacttactcaaaggtattgtatgatcacttaatagttgctgatgagaatcttcaacctaaagaagggcaattagcaaaagattattctttaagtgaagatggtaaagaattgatatttaatttaagagatgatatttactggcatgatggagaaaagattactccaaaagatgttaaatggagtatagaatattctttaaaaaccgctgtattaaaccaagtatttattaatacattcaaagccataaaaggtgcagatgcttacttagcaggaactgctaaatctattgatggtatagtgattgatggtaacaaaataactattacgtttgataaagtagcaccagatgcattattaactttcacacaatttgctccattacctgaaaaatactttactgatgtagatccattaaaattccaacaagcagagtatttccaaaaacctattggatctggtccatttaaagtagaagaagtaaagatgaatgactatactactttagcaccatttgataagtattacaacggagaacctaaatatgacattttattaactccaagtcctggagacagtgattctaacttagttaataatgcaaaatcaggtatgttagattttggatatacaaagactgtttctgatattaaaggacttaaagatgctgaaggaattacattaaataaggttgatgttagatatactcgtctactttatgcaaataaattcgataaagcagatggaacaaaatcaccacttgctaatgtaaaagtaagacaagctattagatatggtattgatatgaagactatatgtgaaaatttatatgatggaacagcaattccagcaaatagcttaactccaaatggaagtgacaaagttgaaggattggaaacttatgattacaatccagaaaaagctaaaaaattattagctgaagcaggctgggatcctaattatacattagatgttgtttactattatacagatcaattaactgttgaccttatgacaacaattcaatctcaattaaaagagatcggtattaacatgaaatttagattagttgaaggtgatttagcttcacttctatggaaagcacctaatgatcagaaagttggaccaactgctgtagattgggatatggcttatggagctattgcagcattatcaatgcatgaatattatgatagattcagagaaggctcagcatcaaattctcatactccagcagatgataaattaaatgcattaattgatgcaacaaattcttctatggatacagaagttcaaaagaaggcattctatgaattacagaagtatgaaaatgagacattatttgatataccactatattatcaaccaatttacgtagttcaaagtaataaagtagatactggaattgagaaatatggtaaccctcaatttaattacaactggaatattcaaaattggaaaattaaataagtataaatataataaaataaaggttgcatcgatttgattcggtgcaacccaaaatataataaaaggaggaaaatatgttaaagttcattataaaaagattacttggattaattccaatggtatttataattacatttattatatattttgcacttgagctaacaccaggagatgctgtatcacatatgattagtccagaaatgttagcaaatgttgatgcttcaaagcttgatgaaattcgttcagcttatggtttaaatgatccatttataattcgttattttaaatggttaggacaaatcctagtagggaattttggatatagtatgacaagtggagttcctatagctgatgaattaaagaaattagtacctgctactttagagttatcaatagcagcattattaatttctacaatacttggtagtgcattaggtttattcagtgcaattcgtcgtggtactctttcagaaggaatattaactgtagcaggaatgattggtgtatctattccagagttcttctttggtatggtaatgatattaatttttgcattaaatttagattggcttccagtaggtggacgtatgatgccaggtaaaacagccttttttgatcgaattcaatatttagtaatgccagcccttgttttaggtatatctttaacagccggagttatgagatatgctcgttcaagtatgttagatactatgaataaagaatatatacgtacggcaagaagtaaaggtttaccagaatggcgtgtaaatttagttcatggatttagagtagctttaacaccagtaatagttttagttgggtttagattgcctactttaattggagggtcagttgttattgagacaatttttagatggccaggtgttggtagtgcatttgctacagcaatacgtgctcaaaactacccattagttatgattatcgcattattttcagtagttgcagttttacttgcaagtttgattgttgacgttgcaacagctgtacttgatccacgtgttaagttagattaggaggtagtattatggctgaagtaaatgttagaaaaaatagatttaatcaaaaacttgataaaattaaacaattagaagagtcaggtgaattaaaacaaaaaaatgttaatcgtacattgagaaaatttcttaataataaactagctattgtaggagcaggaatatttatagttattttgttagcttcaatattggcaccacttttaacttcatatgatccacttaaagctgaaatgggtagtgtgttacaagcaccatctttagagcatatttttggtactgataaagttggaagagacgtatttgcaagagttttatatggtggaagaatttcaatattaataggtttaggtagttcacttggatgtgcaattataggtgtactacttggctgttatgggggatataaaggcggatggtttgataaaatagttctacatatttcagaagtttttatgtcattcccacaattagttcttgtattattacttgtaacaatacttggacaaagtttaacaaacttaattgtaatatttattttaactggatggggtagtgtataccgtatggctcgttcacaaatattaacaattcgtgaagaagaatatgtacaatcacttaatgcatttggcttaaatgattttataatatgctataagcatatgttaccaaatgcaattggaccaatagtagttaatataacattaagtacagcaatgtttattttacaggaagcatctttaagtttcttaggactaggagttcctttagaaatagcaacctggggaaatattttaaacgctgcacaagatatgtatacattacaaaataactggtggttatggttacctgttggtatagtaatttcatcatttgttatgggtataaactttcttggtgatggtcttcgtgatactacagatccaacacaacaaggttaggaggaaaagatatggaagatagacctattattacagtaaaaaatttaaaaacctacttttatactaatcaaagatgcaataaagcaatcaatggagtgtctttccaagttaagaaaggtaaaactttatgtgttgtaggtgaatctggttgtggtaagagtgttacagcatcatcaattatgcaactattaccaaagctttctcgtattgaagaaggcgaaatcatatatcatggtgaaaatggtgatataagaatagatcagttagagagaaatgggaaagaaatgcgtaatttaagaggaaaggatattgcaatgatattccaagatccaatgaccgcattaaatcctgtatatacaataggatatcaaataatggaaaatatattaggtcatgaaaaggtatccaagaaagaagcatatgatagaacacttaatttattaataggaatgggaattcctttcccagaacaaagaataaatgagtatccacatcagttctcaggtggtatgcgtcaaagagcaatgatagcaatggctatgagttgtaatccaaaggtattgatagcagatgaacctacaacagcccttgatgttacaattcaagctcaaatatttgaacttatggaaaagctaaagagagattatgaaacagcaatacttctaatcactcatgatatgggtgttgttgctgaattagctgatgaagtagctgtaatgtatatgggaaatataattgagtctggggacgtaagagaagtattaaaaacacctgctcatccatatacagaagctttattaaagtcaattccgattctaggaaagggacgagaacaagagttacatccaataaaaggttcaactccagatccttttgatagacctataggatgtcaatttgccccaagatgtaattatgcttgtgaaaaatgtaatacaatgcctagtgaggagattataagtaaaacacatatggtacgttgttggaaacataaagaggtgataaataatggaagtaagtaaaaaagaagctttattagaacttaaagatcttaaaactttattcccagttaaaacaggtttttttaataaagtatctaattatgtaaaagccgtaaatggtattgatttaactatatatagaggagaaacccttggacttgtaggggaatctggatgtggtaagactacccttggaaaatcaattcttcaattagtaaagcctacacatggagaaatgatttatgattttaaacaatatggtggtaaaaaagatttaagaaagttaagtcctaaggaaatggatttagctcgtaaaaagatgcaaatagtatttcaagatccccaatcttcattaaatccatcttttactatatatcaatcattatcagacccattaaagaaatttggtgtaaaagaaaaagaagatagacgtatgcttattggagacattttagaagctgtaaatatgcgtcgtgaatatatggatagatatccacatgagttttctggtggtcaaagacaaagaattggtattgctagagcactttgcataaacccagaattaatagtgtgtgatgaatcagtttcagcactagacgtatcaattcaggctcaagtattaaacctattaatgaaaataaagagtgaaagagatttaacatatatatttataactcatgatttaagtgttgttgaatatataagtgatcgtatagcagtaatgtatttaggtaaaattgtagaactttcagaaacatcgcaaatatttaataatacattacatccatatacagaagccctattgtcagccattccaatagctgatttagataaaaaaacagaacgtatcattttgaaaggtgatgtgcctagtccggtaaatccaccatcaggatgtcattttcatccacgttgtagaaaatgtatggacatatgcaaaaaagaagtaccagaattaaagaaatatgttatagatggtgaagatcactttgttgcatgccatttagtagaacaaagcatgagtaagaaggagaataacaatgagtaaatttgatattaaggcatttaaaggggtaattccagctgtattaacagtgtttgataaggaagaaaacattgatgaagtgggaatgcgacaattagtttcatttttaatagacaaaggagtaaatggattatatttaacaggttcaactggagaaggttttacaatgacttcagaagaaagaaaaaaagttgttgaaatagttattgatgaaacagcaggtagagtaccagttgtagttcatgtaggtgctattggaacaaagatttcaattgatcttgcaaaacatgctgaaagtgttggagcagatggtatttcaagtgtaccacctttctactggaaatttaatgagaatcaaataattaagtattatgaggatattgcaagttcatgtagtattcccatgatagtatataatgtacctcttgtaggacttcttggaatgaatgctataaaacgtctagctaaaattgaaaatgttaagggaattaaatatactgcattatctcaatatgaaataacacaaataaaagatgaagtgggagaagagttcttagtttattctggtgctgatgaaatggctatgtcaggattaatcgcaggtgctgatggaatagttggatctttttataacataatgccagaattatttataaatatatatgatgcagttaaaaataaagatttagatgaagcacaaaggctacaaaaacaagctgttgaagtaataatgtatgcattacaattaccatcattctatgctggaatgaaagtgattttaaaatggatgggtataaatgcaggttattgccgtagaccatttgaaaatttaactgaagaagatgaagttaaattcaaagaaggctttaagaaattaaaagaaacttatgacttaaaaggaattgattttatagatgctatctaaaattaaattaaagaagtcatgtgaatgtgatgtctttgtgataggagcagggattgctggtgttatggcagcaatccaagcatcacaaagaggagcatcagtaattatagcaagtagtgcaaatattttatcaggttctagcttttatcctggtacatggggactaggtcttataggtccagaaaataaagaagatgagaaggatttagcaagaaccattaaagaagtaggttgtgatgtagttgatgaaaatctagttcaaacttttgtaagcaacataccaaaaggaatacagttaattaaatcaatgaacataaaactaaaagaagcagataacaagggccagaaagaatttattccttgttttgatcataaagcaaggaattggaacggaatcttgtttgatagtgcaaaagaagtatttagtaataaacttaaagtagaaaatataaaaacattgccattttctgaagtaatagaaattataaaagatggtgaaaaagttattggagttgtattaattaatgagtataaaaaattagaattcattaagtgtaaagcaattgtaatagcaactggtggaattggtggattatttaagtatcgactaaatacaaatgatattactggcatgggacaagcactggcattaaaaagtggatgtaaattagttaatatagaatttatgcaaatgatgcctggatatataaatccatgtccaaaaacaatatttaatgaaaaaacatttaaatatgtagatattttaaataaagatgggaaagacatctttgaaggaatggaaaataagctagaaaaattagaagaacgttcaacccatggaccttttacttctagattaaattcaagagaaatcgattatagaattttcagtgagtttatgaaggatagtaatggagttacagttaggtataaaaagaaataaaggatcaacaatctgagtttattaaagtatattttgactggttaaaagaaaataaaaatttaacagttgatgatgaaataaaattaggaatttattttcatgctgccaatggcggtattagaattgatgaaaaggctcaaactggagtaaatggtctatttgctgcaggggaagtaactggaggaatgcatggagctgacaggattggaggtctatcaactgcaaatggattagtatttggaacaatagcaggcgagtctgctagtatatatagttcaaataatatgatgagcaacatagacgaaatagaatttcaaccttatggcattgaaaatgtagacgagtttcttgatgatttacaggaaattatgtttaagtcagcaatgattgaaaaaaatgaagcttcagttcaagatgctattagaaaaattgataatataaaaaataaattagtatataagtcagattttaatatggagaatataaataaatcttatagattaaaatctaatttgttattggctaaatgtattttaatggcaattgatctgcgtaaagaaagcagaggatcacattatcgtagtgattataaggaagctaatgttaatatgaataagaagataattgtagaaattaatgatgatatagatgtttatttcgaataggagggaaatgtatgccagtagtagatatgcctttggaagaattaaaaaagtatactgggacaaatccgatacctactgattttgatttgttttgggatgaaaggcttaaagaagtaaacaactgtaaactaaattacaaaatagaaccaagtgaaatacagggatatgaatcatgtgattattatgatttatggtttgaaggtattgatggaggaaaagtatacgctaagtatattcatcctaagtcagatgaaaaactccccttaatattacagtttcatggatatccaggagctagcagaggatggtttgagcaatcatcatttgcaggaatgggatgtgcaattattgcaatggattgtccaggacaaggtggtaagagtgaagatgttggcggtaaaaggggaacaacagtatctggacatatagtagctggtttagatgatgaacctgagaatatgtattatgttcgtttatttcaaaatacatcaatattatgtagaatagttcaagaattaaaaggaatcgatattgataggatttatgcaaatggtgctagccagggagctggaattgcacttgcatgtgcatctttaaataaagtaataaaaaggtgtgccgcattatacccatttctttctgattataaaagagtttgggaaatggatctagatatgattgcttatgaggggctgcgttattattcaaggtggtttgaccctatgcagaatagagaagatgaagtatttactaaattaggatatatagatgttcataattttgctcatagattagaatcagaagttttatttggaaccggtttagtagataatatttgtcccccatcaacacagtttgctgtatacaataatataaattctaaaaaacagcatgtaatatttcctgactatactcatgaagagatttcagcatttgatgatatgttaattgatttcttcttaaaggaggttgattaatatgccagtactagatatgccaataaaggagcttgaaaaatattttggatctggaataaaacctaaagattttgatgaattttgggataagcaaataaaaaaagcagatatgctggatttagaatatgttgctacacaaaaagaatttaaaaataaaaaggcaaaatattatgaaataatatttaaaggtatagacggagctaatatatatgctaagtatatatgtccaaatcatgaaggtaaggtacctgtagtattagaatttcatgattataagcaatcaagtagaggatggcatcatcttactagatatattgcacttgattacgcagtactcgatatggattgcagaggtcaaggtggaaagagtgaagatctaggtggtgtaaaaggatcaacggtgtgcggtcatttaataagtggaatcgatgatgaagtagatcaaatgtattatactaagacatatttagatggatatatattatctaaaatagctgaaaagctatcaaatgtagataaaaacaggatgattacttttggtaaagggcaaggtggtgccatatctcttatggtttcagcctttaataaaaatataaaaaaatgctcaattcaatatccatttttaagtgattttaaacgtgtatgggatatggatctagacatagaagcatatgaaggaattcgttactatttcagatggtttgatccaatgcatttgaaagaaaaagagatatttgaaaagcttgggtatatagatgctgtgaattttgcatcaaaacttagatgtaatttattagttggcactggattacttgataatatttgtccacctagcactcaatatgccatatttaataatgcaaaatgtgaaaagaaacatattgtttttcataaatatggacatgaattaaataatttttttgaaaatgagaatttaaagtttattaaattttaatttatataaattatatttcaagtcagctcgtcaaattcaatttaaaatcaaatctaatctaataataaatctacaaattagctggatgttattttaatttatataataggataggaagggtattatggataaagaaaaattattaaaagaaataaaaggaaagttaattgtatcttgtcaagcattagaaggagaacctttatatattgaaaacagttctattatgcctcttatggctagagcagcaaaacaagcaggagccgctgctattcgtacaaatggagttcgtgatgttataggtataaaggaagaaactaatttacctataataggaataataaaaaagggttatgaaggttatgaacaatatattacagtaacaatggacgagatagatcaattagtacaagcaggagcagatattattgctatggattgtactttaagagagagagtagatggcaggtcagttagtgagtttattcaagctattaaggagaaatatccacaaataattcttatggcagatatatcaaatttagaagagggtataaatgcatggaaagcaggaattgatatggttggaacaactcttagcggctatactgaatatactttaaaattagaagaaccagattttaagttaatagaagatttagcaaaaaacattgatattcctataatagcagaaggaagaattcatagaccagaacaagcaacgaaagccttagatttaggagcccatgctgtagttgttggtggtgcaattactagaccattagaaatagcaacaagatttgttgacgcaatatctaagaggtagcttatgaagtatttaggtattgatattggtggaacagctgtaaaaatggggatagttactgaaaagggtgaaatacttaataaatgtagctatgatgtagcatttgatagttatgaaactccaatatttgaaacagtaaaaaaagttataggaatatttttaaaggattctaatctttcatcacatgatttaagtggaataggagtttcagctacaggacaaatagatagtaatattggaagtgttgttggtgtaggtggaaacattaaaaattggtgtggaacagaaataaaaagagaattggaagcaatttataatgtgaaaacaactgttgtaaatgatgctaattgtatggtaattggagaacaatggcttggaggagcaagaggatataaaaatgttataggcattactattggaaccggtgttgggggaggaattattgtagattctaaaatccttttaggttcaattggtatagcaggtgaaataggacatttttctatagatacaaatggaagaaaatgtacatgcgggaatgtaggatgttatgaaagatatgcatctatgacagccttaattaatgatgtgaaagagaactatgagaagttaggtaaggtttcatttgcaaaagaagaagtaaatggactaacaatatttagtgaactagaaaaaaataaagaattacagaagatagtagatgaatggattcaaaacataagtaaaggattaataagtttaactcatatatttaacccagagataattttaattggtggaggggtaagcaagcaagaaaaattatttattaagccattacgagaaataatattaaataaagtgatgaagaaattctcacaagatttaaaggtggaagcagctatgttaggtaatgatgcaggtcttataggagctgtatattataatattgtatgtgaaaaataaagctaatatagcagatatgttgcaataattgaactagactaaatataaagtctagttacaatatataaaaataaaacttttagaattctaaataatatttatgggaggttaaatcttatgaaaaaaattctttcattattaattgcatcatcaattattgcggtgggtataacaagtagcagtttacaagcatcagcatcaatgaaaaatgttactagaataacttgggagcatgctggtgacttagaagcacaaaatgggtttgataaaaatataggagttgccggtgtactatcaggaatactggataataaatatgtagtagttggaggcggtgctaattttccatatgatactgtcttaaatggaggccagaaaaaaacttattctgatttgtatttactagaaaaaaataatggaaaattagtagtaaaagaacatactaatcttccaaatgaaatagcatatggatcttctgttacaactaataaaggaatttactatataggtggaagtaccaataaagatgctgcaaatgatataacactaataactcttgatgaatctaataaattgaaatatgaaaaagttggtgatcttccttttacattaagtaatggaattgcggcagaatataatggtaagttatatattggtttaggtagtcaaaatggaaaagatagcactaagttatatgagtatgatcttaaaacaaatgagataaaagagcttgcatcattaactgaaaaaagttcaatgaatcaatgtgtagcacaaatattaaatggaaatttatatgtatttagtggaggaggatcaattgctaatactgatggatataaatacgatataagttcaaatacttggtcaaaggtttctaatgtaaagttaggtgataaagaaatatcgttgtatggagcaaattctgttaaattaaatgaagatgaaatgttagtaattggagggtttgataaggctgtttacgataatgctgtttataatctaggatcattaaaaggtgatgaattagcaaagtttagacaaaattactttggcgctgatccttatgaatttaattggaacaaagaaatattagtctataattgtaagagtgattcatggacttcgttaggacaagttccttttgatgctccttgtggtgaaggcttagttttgctagatgaaaatatattctctataaatggtgaaattaaaccaggaataagaacaaatagaatgtattctggaaatttgcttaataaataaaaatagttggtttaacttttgctcagtagatattattctactgggcttattttacttataaaaatagttgagtatgattctatttttataattttgtttaaatagatattaaatttggatatcataaagaaatatagaaagttctgaagaatagtttataaatagtagattgtgcaaattaataataaatactatcatgatataatttatttgtttaagtaaacgtatgcacatttgcgtatatatttattaaactagaattaaatagtagaggtgtattatgaagaataaaaatcctgcttatgataagccatttaatacctttataagattatatgatggaaattataaaaagttattattatcattcatatttttcgttataaagcattcacctgtctggattatgccaattgttttatcaaatttaattaatattataagcaatactcaggatcttaaggtaaatgaactaataattaatctgggattaatggcaatcctcgtaataacaaatgttcctgcgaccttgatacatactcgttttatgagtcttgcaataagagatgtagaaagttctgtaagaataaagcttgtaaagaaactgcaagttttatctataccatatcataagcatttatcaggagggaaacttcaatctaaggtactacgagatgtggaacttataacgaatttatctaatgtaatatgcattacagtagttccaataatattaaatgttatcgtagcattttcagtcacaacaactagaaatgtttatgtatcattattctttttagctacaattcctatagcagtattttttataggaaaatttaatggaagtatacaaagttcaaataaaatattaagaaaaaatattgaggatatgtcaacagcagtttcacagatggttgaaatggttcctataactagagcacatgcattagaaaatctagagatagataaagttgataatgaagtatctaaagttaaaagtagcggatataaagtggatatgcttaatgcactgtttggtgcagggggatgggcaacatttcagcttatgcagataatatgtcttgtgtttacaagttttttagctgttaagggatatataaaagtaggcgatattgtcctttatcaaacttatttttcttctataatgggtgatcttacaaatgcaataaatgtatatccccagattgtaaaaggttttgattctataaactctgtatccgaaatacttgcagcagaagatattgaagaaaattgtggcaagtttgttatgaaagaagttgaaggtgatttccaatttaataatgttacatttagatatgaagatggaaaggaagatgttcttaaagattttaatcttcatgttaaaaaaggcgaaagtattgcatttgtaggagaatcaggaggaggaaaatcaacattgcttcagcttgtagttggtttcttaaaagctacagatggtcagattcttgttgatggccatgacattaatgatattaatttaagaagttatagaactcatattgcaatggttcctcaaaatacggttttattttcaggttcaataaaagataacattacttatggcatggatgttagtaatgaaaaattagatgaaataatagatgcagcttgtttgaaagaagtaattgaaagacttccagatggaattaatacaaatgttggagaacatggtgatatgttatcaggaggacaaaaacagcgtatttcaattgcaagggcgcttataagaaatcctaaggttattattttggatgaagcgacttcagcattagataataaatctgaaattcatgttcaaaaggcaatgaagaatcttatgaaaaatagaacaacgtttatggttgcacataggttatcaacaataaaagatgcacaaaagattgtacttattaatggtggaaatataagagaacaaggaacttatgaagagcttattagtaaaaagggtgaattttataatcttgccagcaataaggatgatggaagtaaataatagtgaattaaaaaagagttaatattataaaaacatgaatatgtaaagtgcgttctatacaaataatcagaaattaatacaaatttaaattatgttcatatattaaattgaaaaaatatagaaataataatattgttaaataaaatattgctatttatgaaaataagaattaagaaattaagataacaattaagttattagaatacaaaacctaggaggttattatgggaattaaatactttgaagaacataaagtttttaaacttgatggaaaaaatacatcgtatattatggcagttatagatgaagaagaatttttgggacatgtatattttggtaagaaaataatagatgaaaatgcaaattatttattgagaacagaagaagctccatttgtgccatctaaaaataatagagatagagtatctttttatgacagttttccaacagaatattcaacacatggaataggggattttagacagactgcactttctgtaaaggattttaaaggaaatacggcatgcaaacttcaatatgtttcacatgaaatttatagaggtaaaagtaaacttgaaagtcttccagctacatttggagaagaaaatgaatgtacaagcttagaaattacatgtatagataaggatttaaacttaaaagtagtgttaatgtacacagtttttgaagatttagatgcaataacaagaagtgtaaaaataatcaatgaaggaaaagagaaaatatatctaacaaaagcattatcaatgtgtatagactttgatggaatggattacgatatgatttcacttcatggatcatgggcaagggaaagacatattgatagaagaaaagtaagccatggaacacagacagtatcatctgtaagaggtgaaacaagccatcaggatgcaccttttattgcacttatggattcaaaagcaacagatgattatggaaatgtatatggatttaattttgtttattcaggaaactttttagcacaagttgaaggatgtcaatttgatacaacaagagtgcttatgggaattaatccaacagactttgaatggagactagattcaggagaagaatttacagcaccagaagttgttatggtttattcagattgtggaataggaaaaatgacaagaactttccatgatttatatagaaatcatttaataagaggaaaatataaagataaaaaacgccctatattaataaataactgggaagcaacttactttgattttgatacagaaaaacttcttgcaatagcaaaagaagcatcaaaagtaggaatagaaatgcttgttatggatgatggatggtttggacatcgtaatagtgataactcatcccttggagattggattgttaatgaaaataaaattaaaggcggacttaagtatttagtagatgaagttaataagatgggattggaatttggaatatggtttgaaccagaaatgatttctccagattcagaattatataaatcgcatccagactggtgtattcatattgaaggacgtacaccggcactatgtcgtgaacaatatgtacttgatcttacaagaaaagaagtagttgattatgtttacgatagcttaaagaaaatactttcaagcgcaaacataacatatgtaaagtgggatatgaacaggcagattacagaccttggaagtagctttattaatccagaacaacacggagaaatattccatagatatgtacttgctgtttatgatttaatgaacagacttactaaagattttcctgatttattacttgaaaactgctcaggtggaggagcaagatttgatccgggaatgctttattacagcccacaaatatggtgttcagatgatactgatgcaattgaaagacttaaaattcaagaaggtacagcaatggtatatccattaagtactataggagcacatgtaagtgactgtccaaatcatacagtaggaagaacaacaccatttgaaacaagaggttatgtagccttaagcggaacttttggatatgaactagatataactaaaatatcagaagaagatagaaatatgataccaaaacagatagaaatgtatcataaatataatgacttggtaagaagaggagattactacagaattgaaaattattctgaaaataatggttttgactgttggtctgtagttgcaaaggataagaacgaagtattagtaacatgtattcaggttttaggaagacctaattatcatagcagaagaataaaacttaaaggtctagatgaagattcaatgtataaaaatgaggaaacaaatgaagtatattcaggcggagcacttatgaatgcaggaattaatgttactgacttatacggagattattctggaaagctgattcatttattaagactatagtatgtatcgttaaaaagtatctagagcacggctttaggtactttttttaatgtataaactgtaactataaattatcaactaaaaaagcatgtgaagaaaatttttatgtgtattaagtacattagttttgtagacgtatttacaatacattgacataaaaaaatgtttgaactataattttaaaaaagtaataacattaataaacaaaagatatgatttattatgagggggataaaaatgaagagtaaaaattttttttctagtatgagtaataagataatgttacaaattattcttttagtagtgataatttgtacactgatctcatatgtatcgttcagtagaactaaagaagatattattaaaacaacatatgaaacgctaacagacagaactaatgatagtgctagagctataagtcgtgaatttgaaattagcatgaaaaatttggagtatgttgcttcattgccagaagttaaaagtatggattacaatgtttggaaggaagttgtaatacagcaatgttcaacttggggatttgaagctatatacatatttgataataacggacaagcatattatacaaatgatgaaataaaggattattctaatgattcgtattttgaacagataaaagaaaataagaaattcataatggacactccatgggccgatattgataataatagatcggtagcgacaataatagtaccaataatgaatgacagtcaggatatattgggatatatgtgtggaactttagatttagcaagggttaattcaattgtgcagaatattcaaataggtgaaaatggatatgcatttttgatgactcagcatggattaattgcagctcataagaatatggatctagtatttaattataagaatatagcagacttaggagaagaaaatgctgataaaagtgaaatagaaaactttattttagaggctggtttaggtaagagtaatataactgatatgaatttagatggagaagaagtatacatttcttataagaatccagaaggtacaccatgggtccttggagttgtagcaccatcaaaagaagtattacataatataaataagatatctataattcaaactatattagccataattgcaataattattagtattcttatttcattaatcataagaaaaaatataaataaagaattgaaaagaataataaaatattcagaagaattatcaaattacaatttgtcatataaagataattcaaatattagaaatagtgaatttaaaaaagcgatttattctttaaattcaagtgtagatgctttaaatgaaactgttacagaagtgaaaacaagtagttatgatatatcatcaagtagtttagaaatagataatatgataacagacatatcgtcagaattggatcagtcagtagcagctgttgaagagatatctgcaagtatggatggttgttttgaatctgtgaataaagttaatgatttagtacaaaaagtggataatagtgtaacagtatctgttaatatatcttcaaaagtaatggatctttcggataaaataaagagtcaatctaataatcttcataaggatgcaataagttcaatgaataccttagatgagatttattctaaatgtaagggggagctggaagaagccttaaagaaagtatcagtagttaaaaatatttcaactatgtcagatagcattatgtcaatatcagagcagacaaaccttctatctcttaatgcagcaatagaagctgcacgagctggagagcatggccaaggatttgcagttgtagcaaatgaagttaaaaaattagcagaacagtcaactgaaactgtaggaaatattaagaatcaggtaacagaagcattagatgctgtaaattctttatccttaacatcaaaaagacttcttgatatagtagaaaaagatgttatgaataattataacaaaataatagatgcaacggttgattatcaggatgcaggagtaagtgtaaaacaaatatcagaagattttagtagtatatcgcgagaaataagaaattccatgaataatatgactaataatattgatgggctaatggaatcaataaaagaggtaagaagctcaactaatattatagtagataatatgtcacatattagttctaaaaatgaagaaatagttgataaagcacataataatagagataaatcagataatttgataaatttagttgataaatttactatatagaaaattaaaaatatagatatgattttataaaatcatatctatgttttttatattaagaagaattatttttaattgattatataaggaattgtaagtaccatagaggttcccttaccgagtatacttgttatttcaagaccatattcttctccataattaagttttaaacgtttgtttatatttcttaaagcaattccattaaaaagttcatttttatcattaatataatcatttaaagattcaagtgttttatcatcgattccaattccattatcagagacagtaattattaaattatcattggattttaaagcttgaataattatcttaccatttccatcacattcgcttaatccgtggtatattgaattttcaattaaaggttgaattatcatttttattatttcacaattaagaacatcatcagtaacaagattttcaattgtgaataaagaatcaaagcgaattctttgaagatagatgtagttatttattatttcaatttcatcttttaatttaactgtattaatacgcctattcatactatatctaattatagttccaaaatattctgccattgttgaagtttcaggatcatcatttatttcagccatcatgtgtatagattctaatgtattatatatgaaatgaggattaatttgattttgtagttgttttaactctaattctttttgttctatttgatttttataatttatagtaattaaagtgtttattctagttttcatatcattataagaattaattagtatccctatttcatcatttttattataagcaaagttgtaattcaagttagtttcaactttacttcccatattttcaataagtgattttattggattaaatattctatttaagaaaaatagataaattacaataaataatattaagcaaaaaattaaattgcttaaaaagaaaagtaaatataatacatcaatatgataagcatcgtcttttggaattgtatttatgattgtccaatcggatgattgcaaattattatagcatactatatgtttttcattatctttagaataaactagttcaggaatagtactgctttgattaatatattcagagtaattatattggtgttcagcatcatctgtaccaattattaaattattttcagaatcatacagataaacagcttcattattaaaaggaatatctgaagtcagtaatgacagtagttcatctgtagaaaatgtaagtagtaaaattccagtagtcttttgtgattttatatcaattatttttcgtgttatagcaattaagctttcatcatctttagttgtatccctaaaaacattagttgcgttaaagtttgagaaaatctcaacctgatttgaagaatttacagcagtattaaaccacttttcatgaaatggattttttaataaatcattattattatttcgagcagtatatactccatttccatttaaattaaatatgtaagctccatttatagtcttattttgaataagcatcatatcacataaatatagtagataattatattgttctatatcataagtattattattagatagtgtagtgttaagcttttctatatcaggtattattaatggatattttgagacgtcaattatattgtcaagtttttgagtaatttgagtacttaaatttaaattaaagttttttattaacttttctgttttattaaattcatacctagaataagagtataagtttacagctgtaactattaaaaatatgatatatattgataaaaatataagtaaggttagtttttttattgataaatctctattaattttcataaatccacctttaaactaaaaaatgtattttaaatatttaaattttaacttataatttaaatatatattagaatatacaattattcaataatgataagacatgttcataaaaatggtatacgttttcttatattttctatgtaaaggattttactaacttgaaatatgtacactaggaggaaaaatgaaaattatagtagttgatgatgataatataattagaatgggattaactaaaatgattgagaaaattgatgaaagttatgaggtgatttcaagttttcaaaatggcgcattaactttagaatatttaaaaaatcatagtaaagaagttgatcttgtaataactgacataaagatgcctgtaatgacaggtatagagttaatcgaaaattcaataaaagaattagacaagtctccgctatttttagttttaagtgggtatgatgaatttaattatgtgcgagatactatgaaaatgggagcttttaattatttattaaaacctataaaaagagatgaattaaaaaaaatattgaaagaagctgatgagagaattaatgaaataaaaagcaatgataaaatcatagataaatctattgaaattttgaaaaaggacttttttaagaatatattattttcaagtaaggaacttaacaataaagttgaaaatccattgttagaaaatcttcagctaaatgaaaactaccaatataaaatgatagtattaaacaaaaaggttgatagcagtatattatatgattttataaagggaattatggatgtccataaagatattgaatattcatcatttggatataatgattctgtttacattattttttatataaatacaaaaacaaataataattataatgatatttttgaatttatagttaataaatctgattgctttattgagttgaatataagtgtatacatattagatgatacagataaaatatggaaattaagagatcagtctaaacttgttaagaaaatgaaagaaaatgcagatgaatctttgaatgtaaaaaaatattatttaacacaagatgaaagattaaaagaaatattaaatagtgatttgaatgatgttaataacaatataactgtaattaagcttgcaaaagattatattataaataattataataagaacatatccttaaaagatgtagcagatgaggtttatttaagtcaaaattatttatcggaattatttaaaaaagaaataggagaaggattttatgatttcctttcaaaatatagaataaaaaaagcaaaagaagttttattaactacaaatttaaaagtatatgaaatagctcaaatggttgggtataatgattcaataacttttggaagagcatttaaaaaaataacaggaacaacaccaaataattttagaaataatagagagaattaattcacattgtttatgaatgaaaggtgaagtgattaaagtgttgaaaaatataaaaagagtctggattataattttattagcaatgattggttttgctatacagattgtagcattaagcaaaagcttaaattatgacaaagacgacagaacgcaaaattttcttcatggaaatatagattttgtgagcaacaggacagataagagtgatgaactgaatgaacttattgatgaattcgaaaaaatgtatcctaacgtgcatgtaaatttagaactaataggtgatgtagaagaaatccttgaaagaaaagcggctgttggagatttagcagacgttacacttgttccagcaagtatagataaaagagaattttctaattattttttaccaatagatgatttggggtttaatggtgataatatttatgattatatatcaggacttggaagcgataacttactatatactctgcaaacatcatctttatggatgggagtaatttacaataaagaaatatttaataatctagatatagatacatatcccaaaacagaagacgaattttttaatatatgcagtaagataaaaaataatggaatagttcccattgcgttaaattatagacaatcatggattatgaatacatggatagataccataccgtatttatataatgttcatatggaagataaattaattggagaatctaaagatgttttttcaagtgatggagagatatataaatcattaaattttgtaaaaaaaatatatacattaggatattgtgaaagtgatatggtgaattatgactgggcacaatgcaaagaagatattattaatggaaagacttctatgataatttggaattcagattttataaatcagttggttgatttgggtatggacaaaaatgatttaggtatgtttccaataccagaaacaaatgttataaagatgagtggagactatagaatggggattagtaaaaatactaagtatccagatgcttcaaagacatttttaaaatttttatttgaagaagacagatatgcaaatgctgtaaacataatgtcaagtttacgaggaagtcaagataatttaaaaatgatagatgaattaaataaatttaatcttccagtaatttttcaagaaagtatagctactaaaaatgatgaagagagtatacttcatgataaatatacttatttaagaaaaagtataggacttgattatacatttatacagaattatataacatcagaagatactaaaaaaatagaaaaagaagctaatgataaatggagattatatagagataaataataatatgatttaagaattacttatttttaggtaattctttttttgtttttagatagaaattagaagctttaaattgaaagaataaacaaattttactgtatataaactaaaattattgcaagtactgatttacgtttacatgaagagtggttaaaaatataattaagacatcaagtaaagcaagtaagtaaaaataagaccttacacaagattttattaaggaggctaattatggctggtatatcactaagacatattgttaaaacatatccgggcaatgtaaccgttgttcctgatttaaatttagaaattgaagataaagaatttgtggttttagtaggaccatctggatgtggaaaatcaacaacactccgaatgattgcaggactcgaagatatttcaggtggggagatgtatattggagaaaggcttgtaaatgaaattgcacctaaggaaagagatatttccatggtatttcagaattatgcattatatcctcatatgacagtatataaaaatttagcgtttggattagaattagctaaagaagataaaaaagttatagatcaaaaaattagaaaggtagctaaagatttagatattgaatatttattaaatcgtaaacctaaggcactttcaggtggacaaaggcagcgtgtagcagtaggaagatcaatggttcgtaatccttcagtatttttattcgatgaaccactttcaaatttagatgcaaaacttcgtggagaaatgagagctgtaataaaacaacttcatgaaaaattacaaacgacatttgtgtatgtaacacatgatcaggttgaagcaatgacaatggcagatagaattgttgttatgaaggatggttatatacaacaaaatgatattccacaaaagttatttgattgtccttgtaataagtttgttgctggttttataggaatgcctcagatgaacttctttgattgcgaacttaaaaagaaagacgatgagttttatttgaaatttgcaaattataaaattctacttccagagagtaagaaccaaaatggatgccttgatgggtatgtaggaaaaactatttcagctggaataagacctaatgatttatctattgtagataaagaatataccataaatggtgaagttgaattaaaggaattaatgggagctgaatcttatatatacgtaaattcaaatgatgttagatttacagtgcgaacagttggaagttataaatgtgaaattggacaaggcgtttctgttaaatttgatacagaaaaaattcatttgtttgataaagaaactacaaaaacaataacaaattaaaacataaaaatatggagtgatagaaatgtttagatttttgttccctaactatgcaaaagctggagcaggaatagatagaaatgctcctaaaaaacggggggttcctctaataatagagacattaactcgtgaatttagtaatttaataaaactaaattgtatatgtttaatattttgtattccaatagttacaatagggccagccattggagcacttacaagtgtgactataaaaatggttaaagatgagcctgtagattggttttatgattttaaggaatcatttaaaaagaattggaagcaatcattaatattaggaatattacagtctattgttgcaattgtaataggatgtgcatttctttactattttcaattaacaggaatagcatgctactgcatgatgttcataatttcagtaatttcagcaatagtgttaatgtcttttatatatttatacccaatgactatattagttgatttgaaaataaaagatatagtaaaaaattcatatcttttatcaatgataaacattaaatattcaattataacacttgcagtatgcttattagtatttgcagcaggtattatgcttagatttgtaactataccaataatatttttattttttagtatttccttcagttgttttatatgcagcttctgtgcctgtggaccaatagaaaggaacataatcaaataaaagtaaacaattacagaggtattaattctaaattttattaaatacaaaaatttaggatatatataaataaaaaattataaataaaaattataaattatatgaatagctataaaatttagaagaaacggggtatgtaaaatgaaatttacaaaatgtatggctttagctattgctggagcaatgacaatgacttctatgattggttgtggaagtagcacatctagtggaggaagctcatcttcaaaggggaagacattaacagttttaacacatagaactgatatggatgaaacttttaaaacatatgctgaggaatttgaaaaaacacatgaaggtgttactgtaaaatttgaaaatttaaatgattatcaaaatacaatttctacaagaatgggaacaaatgattacggggatgttcttatgattcctgctaatataacaaaaaatcaatatccagatttctttgaaccattaggtacttatgatgaattatcaaaaaaatatgattatttaagtgatgtaaacgttgatggtactatttatggattagctacaggagcaaatgcaaatggatttgtttataacaaagaagtatttgataaagctggagtaacagaacttccaaaaacaccagaagaatatgttaatgcattaaaacaaataaaagaaaaatgtccagatgtaattccttactatacaaattataaggattcttggacattaacaaacttctcaaatggaattgaaacttcaatggctggagatacagattacttaaataaaatgttctatgataagaacgaattcttaccaggttctgtaacatatacatcattaaaattattatatgatgcagttgcaaatcaatgtgttgaacaagatccaatgacttctgattgggaatattctaagcaagcaatggctgatggaaagattggagtaatgtgcttaggttcttgggcaattggacaaattaaagctaaatcacaaaatccagataacataaaattcatggcagcaccatctactgtaaatggaaaacaaaatattcaagttgcagcagattatagaatgggtgtaaacaaaaacagtgaaaataaagaagtagcaaaagattttgttaagttctttgttgaaagatatccacaagattcaaacatgctttcatcattaaaaggaactgaattacctgatttcttaaagacaggtggtaatgttgaattaatacaacaaaaagcaggtacaacagagcaagcaaaagattttgatgcagtacaaaaagaatcattaatcaatttaagtgatccaacatggattaagacagttattgaaattggacttggaaatggaaaacaaagctttgatgattatatgaaatcattaaatgaaagctgggttaaaggaatagattcaatagggaaataattagaaatctaattgttaaagtaaagaaaaggcgatatttcatatgtgcatagatatcgcctttcactaagaaagtagagaggtgctatttatgacaacagatttagaaaaagttgatgttaagccagattttccaagcaagcaaaagcgaaaattaggattttcatcattaccatataaaaaacagaaaattataatttcaatattatttttaatggttccagtagtattacttgcagtattcacctatttaccagcaatatcaatggcaggatacagctttacagactgggatggtataagtaaggttaaaaactttgtaggtttaaaaaattatcaaacaattttaagcgacccaaaatattttcaacctttatttgttagtatttactatttgattgcatcttttattcaaatagctttaggtgttggagtagcatacttagtttcttttggatgtaaagcttcaaatttatttaaaagtgtatatttctttccatcattaataaatagtgttgcaataggatttatttttatattctttttacaaccaggaagtactttagatacagtattaagtttcttacatttagatggattaataaactactggttacaagatcctaagtttataaatgtatctatggcaggtgtttctgtatggagatatgttggatataacattgtaatgtttgcagcagcaatggcatcaatatcaccagatatattagaagcagcaagagttgatggagctagcagatggcaacagcttagacatataattattccaggaatatcaacaattttaggattacaattattcttagcattaactggtgcattatcagcatttgaaacaccatatataatgactggtggtggtaatggaagtatgacattcattattcaaactgttaattatgcattccaaaatcatagagtaggacttgcatcagcaatggcaatgatattattaatactttgtatactaataataagcattcaaaaattagtatttagaaataaggaggtttagggaatgagcatgaaaaaattaacaccaagtgaactgatatacaatatatgcaaatatgcatttttaatattgttagttatagtgtttatattaccaatattaacagtactttttgcatcatttaaaactggtacagaatatgcatcaacaagtgtattaacattacctgaatctttttttaacttcgataattttatagaagcatttacaaaaggtaatatgcttaatggttttaaaaatacagttatcatattgatattttcattagctggagcagtacttactggatcaatggcagcttatgtattttcaagatttaaatctaagttcaccaaatttgtaaatggaatgtttttagttgcagttatgattccagcaatagcaacacaggttgcaacattccagataatatcagctttaggattattcaatactagactagcacctattattctttatataggtacagatataatgacgatttatatattcttacaattcttagataatatttctgtttcattagatgaatcagcaattatagatggagcaaattattttcaaatattctttaagataatacttccattgctttcaccagcagtaattacagtacttataactaaaggagtaggtttatataatgatttctatactccgttcctttatacaccaagtgcagacttattaacattatcaacaactttatttaagtttaaagggccttttggtgcacactgggaagtaatttctgcaggaattatagtagtaatgattccaacacttattgtattcttaacactacaaaaacaaatttacagtggattggtttcaggatcagtaaaagaataagatagattagtaattagtattttgaaaattgaaggaaaagaatttttaaaaaacttaaccttttaattataattaataaattaatcaataatttaatgaataaaaaagaacataatatatagataaaaggagatatgaaaatgactagaattttaggagataatttaccaaacatgccatggcaagaaaagccagaaggatttaacggaccaatatggagacatacagaaaatcctataatcggaagaaatccagtagaaggagtagcaagaattttcaatagtgcagtcgtaccttataatggagaatttattggagtattcagaggagaaacaataaatggaagaccacatatttacttaggtcatagtaaagatgctattaactgggaattcgataaagaaagaataaattttgtagatgaagatggtaagccatatcaaccactttatgcatatgatccaagacttgttaaggtggaagatgagtattttgtaatatggtgtggagattttgatggagcagcaataggaattgcaaagacaacagattttaaaacatttgtaagacttgaaaatccattccttccatttaatcgtaacggtgtattattccctaggaagatagatggtaagtatataatgttatcaagaccaagtgataatggacatactccatttggagatatcttcttaacaaaaagtccagatttaaaatactggggagaacatagaatagtaatgcaaaaaggcggaaatggatggtggcagtcaataaaaataggttgtggtccagcgccaatagaaacagatgaaggatggttaatattctaccatggagttacgggaacttgtaatgggctagtttattcaatgagcgcagcaatattagataagaaatgtccatcaaaagtgttatatagagctggaagcataatgcttacaccagaagaatggtatgaagaaagaggatttgtagcaaatgttatattcccatgtgcaacattaactgatgctgaaagcggaaaaatagcaatttattatggagcagcagatacttatgtaggacttgcttacactacagttgaagaaactgttaaatttataaaagaacataatgaattaatcggattagatgctacagacggaagaatgtaatattgctatttgataaatatattagaaaagcggtagatgttttaacatttactgcttttcttgaatggaggaactgatatgaaaattggcttaaagaacttaagattacgtatgaaaaattttgaggctaaaataatcagcaaagagaaatttaacaatatatcaataaggaaaaagttattgatatattttatttctatttcgataattggaaatatatcaggtgtattagggttaatttttctccatcatataggaaataaatataattatgcaatagttaactatggacttattcaaggggatatagggaaattagggattgaacttgaaaaaagcaattctgctgtaagagattttttattttcagatggtgatgaaagagataaggcaaaagttgaactaaatggatatttggataatatagataaatcattagattctatatcaggttatattgtttcagatgaagaaatggatgcaataaagaatataaagctaaacttagccaaatataaacaagtaagaaataatgtttccataagtgtaattggagatagacaggatgaaggattaaaattatttagaagtgaaggggctcctataatggaggaaataagtacggaaatttcatcattactgcaaagaaaaattgatcagtgtaatgaacttattagtaagattgaaataattaaaatgactaatacaatattagctattataacaattacatgttcaataattataagtattttcatatcaagaagactaagtggcagattaggaataacaataaataagataaaagatgcagtagagagtatggcagaaggtaatttagacataaatattgatgttgagtcaaaagatgaacttggaattcttgcagagtcattttctaatatgataaaaacattaaaatcttatataaatgaaatatcatttattttaggcaatatttcagaaggaaatctaatgactaatactagagaagaatacaagggaaattttttagagataaaaaaatcactagataatattacaaaatcactaacagaggttatatcaggaataaaggaaagtagtagtaacgtaaataataattctcaaaaattatctgatacagcacatatattatcaaaacgttcaagtgaacaagcatattctgttgataaattaacaaattatattgataaaataaatgaacaggtaaagaataatgcagaaaatgcagaaaatacaaatattattacttcaaagttattgatagaaatagaagaaagtaatagaaaaatgcaggacatgctattatctatggataatattgaaaatgcatcaaaagatatagaaaaaatcattgaagcaataaatgaaatagcatctcagacagatctacttgcgttaaatgcagctattgaagcagcaagagcaggtgaatttgggaaaggctttgcggtggttgcagatgaagtcagaaatttatcaggtcaaagttcaaatgcagtaagcgaaagtatttgtcttataaaaaattgtattgaggcagtaaatagtgggaaaatattagctaataatactgatagtacattaaggcaacttgttaataatatagaaaaagcaacggatttagtttcaaaaataaatgatgcatcatctaaacaggcagaagcaatagatagagttcacaatgatatattgaagatttcaaatgttatacaggaaaattccacaacagctcaggaaagtgcagcagcaagtgcagagcttagtgttcaatctgaatcattaaataaaatgatagaaaagtttagaattgaataaaaaatataaatcattgtattaaggagaaggtttagtatgagtattaaattgaataaggaattaatagaaaagtcactagtaaataagggtgatatttcaagaatactaaaattatatgaaaaggcagaaaaaggtgaagatataacaatagcatttttgggaggatcaataactcaaggatgtaactcaacagtatatgaaaagtgttatgtagagcttgtatctaaatggtttgaaaataaatttaaattagtaaatgttaagcatataaatgcaggtgtaggtgcaacaggttcacttataggtgttcacagagcagaaaaacaagttttaagtaaagatccagatataattttcgttgatgcagcagttaatgataatgattcagattattgcaaaatatcttatgaaagcgaaataagaaaattattaagcagtaaaaataaaccagcagttgtagaagtgtttatgaccatggtagatggtgttaattatcaagatgcacaaataaaaattggatttaattataatgttcctatgataagttttagaaacactgctaatgaattagttgaaaaatataatttaaaatggagtgatttactgactgatgaggttcatcctaatgatgatggtcatgaaataataagtgaattattagtgaattttttagaagacatatatatgaataactacaataaaggggaaagtattgaagttaaggataatacattagaaaaaaaatgtgtatatggtgatagatatataaatggaagaatacttaataataaggagttaagaccaaaagagattattggatttcataaatatgaagaaggctttcaggtttttcataatggatggagatttattggcaaagctaatgaaggtggaaaattaatgatagagactgaatgtaacaatatcattttattatacaagaaaacaatttctgaaaatagtgggaagtttaaggtacgagtaaatggagtagaaaaggcgttaattgatactcattttaaagatggatggggagattgcactgtaactgaaattttagaggagtgtgattataaaaaaacatatgaaattgaaattgaagtaattagtgaagaaaaggatagagaagttacaattcttggagtaatggtttcttaattaatatttttaacaattttcacaatagtctttagaccttttaatgaaattaattatacttttattaaaaggttttgctttttgttatagtaatagtaaacatattttattataaataaacaatatttatgaagttttagagtaaatgttttcaaaaataggtgttgtaaatataataaaattaacattatcatgattttaatatgaaatgaggttactaattatgaataattatatggtttttgatattggtggaagttcggtaaaatggtctgttatagagggtgaagggaaaatacttcaaagtggaagtattaaaatagcaagtaatatttcagatttttttaatggattagcagaaataacaaataatatgaaaaaagagtttgatgttaaaggtattgctataagtgctccaggtgcagttgatagtgaaactggagttataggtggagtaagtgcaattccatatattcatggaccaaactttaaagaagaattgaataagcttacaggaattgaagtggaaattgaaaatgatgcaaattgtgcagcacttggagaatgttggcttggagctggaaaagataataaagatttggcatttatagtatgtggtacaggtattggcggttcaatagtaaaggataaaaaagtacatgttggtatacataaacatggaggagaatttggttactgttcatttgattatgagattgatgaggaaggtattcctaaatttaaagcatggagtcagacaggatctacagctggtttagctaataatattgcaagacttaaaggattagaaaaaggaagtataaatggagttgaagtttttgaaatgtgcaaaaatggagatgaaattgctgttcaagaagtaaataaatattattacaatatggctataggaatttataatattcaatatatttatgatccagaagtaatagttcttgggggagctattagcgaaagagaagattatataaacgaaattaataaaagacttgattatatgatgggtactgaatgtggtcttgaaggaactataaaacctttggtaaaaagatgtgtttatggaaatgatgccaataagttaggtgcattatataattatctacaaaagcattctaaataaaatatatattgcgatttatatttaacatatgcaatattatagttaaatataagtacgcatatggtaagaggatatatgaagaaaaaatggattataatatgggtactagtatttttggtaatatgtagttttgctttaagaattattggatataatcatgaagaaaaaaagcaagttgtttttttgaataattttataaatatatctgataaattagaggaatatgaaaaatcttttgaaaaattacatccagatattgatattaagattgaatcagtaggagatcagtatgaaaacatcagtatcgtaaggctaaatgctaataaggcaggagatgttatggttattccatcttacatgaatttatcagattatccagattattatgagccattatatagtgttggtgaggctttaaataaatatagattcagtgatattaaagctatagatgataaagtttatagtatccctttatctatgacagtttcaggtggaatattgtatgatatgaagattttaaatgatgctggtattacaaagatgccacaatcattagatgacctcaaagaggcattaagagcggttaaaactagaactaatgcagttccattgtattctaatgcaagaggtgaagaacagcttatatcatggaatggattaatatattcgattgaaggcagcaatgattatatgactagcatggtcaatgaaaataatattttttcatctgacagcagatattacgaagtatataaatttttatatgaatgtgtaagtgaaaatctaattgagtctccgtttactagttcaaaatgggatggtggattagagcttattaagaaggggaatttagcttctgcagtagtaaattttcatatgtatgaagaggcaaaacaatatgcattaaattctgattctattgaatattttccgttgaagagtgctggtggtgattactatctatatggagaaccgtcatatggcattggaataaataaagaaagcaagaataaagaagaagctaaaatgtggatggagtatcttttagatgaaacagattttctaaattatgctggagatgcaggaatgctggttaagaatgataaaccagaatatgaaaagatggcacagactaatggtttaaatattatttatccagacagagttactgaagagaatataggaaaatttgaaaagattgataatgaagcatgcttaggcatatatggaggaagttttgcttttaatttaataaattctgcagctgagggaaaaaataattatgatgagctttgtattgattggaataatagatggaactctgctagcaaagaaattaataaaaaataaattgtatattaattaagtgctgaatattctatttttataaagattattcagcattgttttataggtttgatattgtttaaataaagctacttatagaatatataagtaatatgaatacgtttaatgaaaaaactagaactaagaaaatatattgtataacggaggaatgtattgtgagtggaaatttaaaagattataaaattagtgctatagaaaatataaaaatttatgggagaaatgcttttaacgaagattctatagcgcttttttggactggaagtggctttgaggcaaacgtcagaggttctgaattatggatggatattgaaacagattatgatatttatgagcaatggataagtattgagataaatggtgaacttgttagtagacaaatgttatcaaagggacattctttagtatgcatttttagaggtatgaataatgaacttataaaaaatgtaagagtatataaggatgttcaacctatggatatggatgataaatgtatatttttaattcatgaattaaaaactgatggaatatttgaaaaagtgccagagaaaaaaatgaagattgaattcataggagatagtatatcatctggagagggaacaataggagcaaaattagaagatgactggatatctatgtggtttagtacaacaaataattatgcagttataacatcgaaaaaacttgatgctgattttagaatattatctcaaagtggatggggagttctttgtggatgggataataatcctaatcatgcactacctaggtattatgaacaagtgtgtggtgtagttaatggaaaaataaatgaagaactaggtgcttttaattacaatgattttgaatcatggcagccagatgttattgtagtgaatttaggaactaatgatggaggtgcatttacatctccagaatggatagatgaaactacaaaagaatcttttaaacaacatatagatgacgatggaaattataataaaaatgatattaaaagatttgaaaatgctattataaaatttttatgtaaaataagaaaaaataatagaaaggcaaagattgtatgggcttatggaatgcttggaactcctatgatgaaatatatttataggagcatagaaaaatatcaaaatgagtttaatgatgataaggtgtttataactcagcttcctaatacaacagaggaaactgttggtgcaagaaagcatcctggcaaacttaatcatgaaattgctgctaatcagctttgggattttataagaaatttatagttatatatatgttaatattaatcttaattctcctaattagaatgatgttacataatatttttaataaaaaggtatgctttttttacaaaaagacatatcttttgttgactatgaggaaaatagcaattataatgataatataaacatttacaaaataattaaagagtttatatgtgaaaataagtaaagaatatctatattatgtgaacgcttaaaattattatttaaatattaaaaatacggacaagttttaggaggttttttatgactttaaaatgtaaattccctgataagttttggtgggggtctgcaacttcaggcccacaaagtgaaggtagatttaataagaaacatgatagtgtttttgatcactggtttgatatagaaccagaagcattctttaatggtgtaggtccaaatgtagcatctaatttttataatagttacaaagaggatataaagttagtaaaagaaattggtttaaacagttttagaacatcaatacaatggactagacttattaaagatttcgaaactggtgaagtagatgaagatgctgtaagattttataatgatgtaattgatgaattaatagctaatgatatcattccagttatgaatttgcatcactttgatttaccagttgaattatatgataaatatggtggatgggaatcaaaaaaagttgttgatttatttatagtttttgcagaaaaatgttttaagctttttggtgatagagttaaatattgggctacatttaatgaaccgatggttgttgttgaaggtgaatacttatatcaattccattatcctaaaatagttgatggtaaaaaagctgttcaagtactatataacataaatttagcttcagcaaaagctataaaagcttttaaagaatctgaatgtagcaaaacagatggtaagataggtattattcttaaccttactccatcttatccaagatcgcaagatgaagctgatgttaaagctgcacagtttgcagaggactttttcaacaattcatttttagatcccgctataaaaggtgaatttactgaaagactagttgaagtattaaaagaagacaatgttctttgggaatcaacaagtgaagaattagaaatcataaaaaataacactatagatttccttggtgttaattattatcaaccaagaagagctaaagctaaggaagagccatttgacgaatcaaatggatggatgcctgataaatactttgataattatgaaatgccaggaagaagaatgaatccatacagagggtgggaaatatatccacaatgtatgtatgacatagctataaatattagagataattataacaatattccttggtacatttctgaaaatggaatgggtgttgaaggggaagaaaaatacatcaacaaagatggaataattgaagatgattatagaattgagttttatgaagaacatttagaatatcttcataagggtatagaagaaggttcaaattgttttggctatcatacatggactccaatagactgttggtcatggtctaatgcatacaaaaacagatatggatttattgcagttgatttagctagacaaataaagactataaaaaaatctggaagatggattaaggatgttgttgaaaataaaggattttaaattatagtattaaagttattcttgaaaaaattagttatgagaccttttgataaaaactttaatttgtttgagttaaaaggtcttaattttttatgcaaataaaatatgtaaatgaattttatatttatgttaaaatagagttagtaaaataatcttttagatgttgttatggagggaataagatgtatccaattaagtttgaaaacctatattatgaaagaatatggggaggaaaagatttagaaaaattcagaaataatgttccagaaggagtaattggtgaaagctgggatatagcgtgtcataaaaatggaactggaaaagttgctaatggtgaattaaaaggtaaaggttttgatgaagtcattaaagaatatgggaataaacttttaggaaattctataagcacagatgaagattttcctttacttattaaattaataacagctaaagataagctgtcagttcaggttcatcctaatgatgaatatgcaaagagagtagagaatgatttaggaaaaactgaagcatggtatgttgttgatgcagaagaaggagcatcattaatagttggaacaaaagattgtgataaggaaacatttaaaaaagcaatagaagatggaaatttagataaatatttaaataagataccagttaaaaaaggtgactttttctatgttcaaagtggtttggttcatgcaatttgtgaaggaattcttattgctgaaatacaacaaagtagtgatacaacttatagagtatatgattataacagaggaagagaaatacatgttgaaaaagctttagatgttattgatttttctcttaaaggtgaaaatactcaaggaataacaataaagaatgatggatatgacaaaacatatctttgtcttggagaatatttcacaattcagaaatatgaagttaatacttctgttaaagaagctagtgatgaagatagattttatttattcacatgtgttgatggggaaggaactataaaatataatggtggagaagaaaagatatcaatgggcgatagtatatttatacctgcatcattaggagaatatgaactgtgtggtaaatttacattattaaaaagttatgttccagatgttaaaatagaagaagagaacataataaaagttgtactaaaataattaatataaaaaataagtaaaattgggggaaaaggtaatacctccaattttatttaatttaaagaactattaattgtaatgttaactatttttaaacgtgttataattaggttaagacatgaataaaagggagtgcatatggatgtcaaagtataaagaaattgcagaagacattaggaagggtatacttgatggaagatacaacccaaatgaacagctgccgctagaaaaagaaatgtgtgaatattatgatgtaagcagaataacaataaagaaagctgttgatgaacttgtttcagagggcctagtagtgaagagaagaggtgctggaacatttgtaaaagcatttgataattcagatgtagagggattcagtatgtcaaagcaattttgtggattcactgaaagctataaggataaaaaagttgaatctaagataattaaatttgaagtagtacatcctacagaagagattgctactaaattaaaaatgacatgtgatgattttgtatattacataataagagtaagatacgcagatggtgaacctcatgtggtggaatatacacatatgcctataggtgttataccaggaataaagaatgatatattacataaatcagtttatagctatattgaaaatgaattaagccttaaaataaagagtgctcataagacaatacgggcaatagaaccatctgattctgaaaaggaatatttagagatagattctaagatgcctattttagaagttgaacaggtaggttttttagataatggtcagccatttgaatattcaattgcacatcatagaggtgataagacagagtttagaagtgtgagttttaaataacaaattcttttaaatatataaatttaaaaagataatttcctatagtatattaagttgattaacagggaaaataagctagaacattttaattctagcttatttttagttatattaattcattgataagcccttttctatatgcgtcaagaagtaattttaaatcattaatctgatttttaagatctttaccaatatcagtatcaccaactttttttctatctaacttttctacaattctcatagaagaatgaatatccgtttctttactgaaagcatcttcaatagatttaaatgattcatggcaaatgagctgaagtccatatgaattataaattagagtgtatccagagattcctgtttcttttctataagcttttgcaaatccaccatctataactataagttttccgttacattttacaggactttctccaaaccgatcttttacaggaacatgtccattaatgattcttgattcggatggatttaagttaaattctttgaaaatcatgttgcacatttcttcagaatccctaaattcataataaggattcttcttttctatatgtgtttcttcattttttataaagtatctttcgaaagtagccatatcctttttcccaaataatgaagagcattcaccagtccagagataccaaagtatgtccatgccatattgcttttctaagctatttcgtttactaaaatatccttctcttgcaaggcagtcaaatgtatctaaaagagctttgcctttataagattctccatttaaaatcatacttttaaaagtcatgtccttatttaaaggaatacatccatgaaacaaaagatttgaattataagttaaataaatacttcctttattgaaaagaaatagaacatgtttttgaagtttatcactatttaagaatgatatctgaagtttatcaattaatttcctttcttcaggagtcagttcaaaaggtttttcaggatttattgtaggaaaaagcttatcactaagttcataagtctggttatttaaagaaatagttccttcgttataattaattttatctagtagaagtcgatgatctaatttaaattcaggtcttctttttataatttcatattcaagtttaaattgaatgattgtaatagctttatgcatttttgcgactaattggatttcagaagttccataatttttatcattattttttgggatgaaagaagtacaaggatcatctctatactgttctaatgcaaatgtagcaaggggaagaatatttattccgtatatatcttcaattatatccaggttagaatatcttgtagctattcgtaaaacgtttgctatagaagtagtatttccacaggcagctcccatccataaaatatcatgattaccccattgaatatcaacagaatgataatctataagagtatcaatgataatatctggtcttggtcccctatcaaagatatcacctataatatgaagcctgtcaattacaaatctttgaattagatgacataaagctgttataaattctttggcacgttcaatttcaattattgtattaattattccatcatagtatccatgtttatttttgctatcagaatcctcatgaagaagttcttctagtatataactgaaatctttcggcagggcctttctgacttttgaccttgtgtattttgaagaaacatatctacataactcgataagcctgtacaaatttattctataccaatcactaatgttatcttcttgttttaaaacgatttctagtttttgttcaggatagtagacaagagtagcaagacttctcttttcagaatcaagcaaagaattattatatagttcatctatttttcgtcttattgcgccagaaccatttctcaacacatgaacaaattgttctgattcaccatgaatatctgctaaaaaatgttcagtgcctttaggaagatttaatatggcttcaagatttattatttctgttgaagccgatgcaatagagggatattgtttagaaagtagttttaaatatttaagattttcatttttagtatccatagaacctcctgtattagtaaaaaatataataactagaaatatttaacaagtatacctttaaaaaatgcttattacaatagtaacataaaaatatgttcatgtgttcaattgcgaaatattcagaaaatacatatattgaaattaacatgtgaaaattaatctagaaataactatgtcatttctagattaattttaaagtttatagttaaacatttatattaaaaacagcgaaaagattatattagtaattttttcactgttttataagtaactaaagtcctttactatttttaggagatagatttctttcttttaatatatcataaatagttgctgatgttgtatcttctaatgtatatcctaaaatagttactattttttctagttcttcctcggaagaagtctctatttctaaataaggaaatggacaaaaacttttatcgttaatatcaatttcaattaatgaattaaataatctataactttctctatatttttttattgattccttttttataagacctaaagatttaaaaatcccttcccccatagttttatcatctataatagtttcattttcttccataatcttaaaacgttcctgtgagatcatttttttagttgtcataaaaactatggttttgtttagaagtagatcgttaactgttcttattcttgcatatcctttttgtgctaacaatcttccatcttcaaagtcatatatatcattaatctgatcttcacttttaactttttgtgcgttgttttctaaaagtatttttcttatattatcaacatcaatatcaataattcttgtttctaattcatgcatagcaatacctcacttactaattattttttattaggatataaaattatggaatctatagttttataaattcaggttgcattttgttaaatctgcatatatatctgtatccaagatcaattaacacatcatttatatattcaaatttaaatgcaatctgagatggattatgagaatcagatcccattgttattatttcgcctccaagatctttatacatttttaaaatatttcttgatggtgtaaggtcaggtagattatatctaaaacatgaagtgtttatttcaataccttttccatcagcaattatttttttgagaatttcttctatatagttagaaaaaatactatcatccagaacattattaaaattaccataacgtttaattaagtcaagatgacctaaaactgaaaactcatgaaaagttttcaccatatctaataatctatcatagtatccttcatatgcttcatgttgtgtttttcctttatgatagtcaccagtgtaaagctcgtttctatctattgtatgtatagatgcaattacaaagtcaaaatcatgtttttttatgtcttttgagcatttttctaatagatgattctggaatcccatttcaatacctttttttatagatatcttgcttgagtattctttagaataagaatctaagtctttaaagtatttatcatagtccacatagacatttggattgccaattatatcgtaatctacatggtctgtaaaacatatttctttaagaccaagttctattgatttctcaatcatgtctttcattggagttgttgagtctgcagaatagctgcaatgcatatggtaatcataaaacattctatataacctcgctaaaatatatattatttttctaaaagaacttttatttataacttgattatatcgcacactagtaattaagtgaaataagtatattcataaataagggttttttttaaatgtatataagattataatatctaagtaattaatttaagtggatggtgaaaaagatggaatacataaatgatattaatataaatgaggcagtaatacatattttagatagtaatgctgaggaacctgttttaaatgaatatagcattgatcttgatgaagatatatataaatttctttacaaacatatagagaagtgctttaaagatgatgaactcaaatatggaaagtttaatccagaaagaaatattgtaaaagaagtagttcaggattatttaaatggcatagataatgatttaataactttatctaaggaacttgcaagtcagcttttcataattatgaagggaaatattaacataccagcgggtgatttaattgtggtatcattaataacagatcaaggtcctatgattggaattttaaaaatggattatgtaaaaaacttcactcatgaagttcagtttgttaataataagattggtataggaatagttccacaaagtgcaggacttcctggaagtggacagaagatacaaaaagctgcttttattaaacctataagggaagatgatagatataacttaatggttttggataaacaaaaaagtagtaaagatgaagagtatggagcaaactattttataagtaattttttaggtgcatctattataacaaatgaaagggatatgacgaaaacatttgtaaaggcagctgaaaattggactagaaaaaatattacagaggatgctggaaaggcagaagagataagaactgctataaaaactaaattaaaagaagaagatacgattaacattgatgaattttcaaaggaattgtttgagaaggataatcaggccaaagaagattttagaaattatataaaagaacagggattaagctcagaggtttcagttgataaaacatgggttgaaaagaaattaaagagagtaagactcaacatagataaagaaatagatttgtacataaatgaagaaacttatcatgattctagcaaatttgaggttatacgaaatggtgacggaagtataaatttagtagttaaaaatgttattaattatatagaaaaatagaattgagaaacagataaaaattacagtggtaattttttatctgtttcatatttcgtaataactatttagatataataattgtgttataacttaattcgacaatattaatatacatatgtattttgttatggtaaaattagttataatttcaaaaacaaacaaataagaatattcattaacatataaaattaggagtaatagagttatgaatagaaaaaagattattgcgttaattactgtatttactattgtaggtagtattggaatattaacttatacaagttgtataaagttaaataaatcaaaagaaaatacggtaattaataatgacgacaaggatatggagtttaataatgaaataaaggtattggatacagataaaaaagcgcaagttattcgtaatgttactacatcagcaaaaattctttctatatcttttgaaggaatagatgataataatacgatgactaacgtattagaactacttgataaatataaggttaaagcaacatttatagtatctggtatagattcagctgaaaatcctgatatattaaatcaaataaaagatgaaggtcatgaaatagggaatgcatcacttaactataaaaataatgtagatgataaatcaaaagaagaattaatatatgatttttcaaaatctaacaaaataatagaagacataataaatgataaggtaaatcttctaaaatgtaagtctgaaacgtatagtgatgaacttcttgaagcagcatatgcgtgtggtaacgaatatgtacttgatagtgatagttatttgaattatcaaagttttaaaaattatgaagaggcttatggatatgcaaataggttgaaaaatggaagcattctatctataaaattaaatggagtactggatgaaacagagtacgccaataaaacaaataatgaaaaacccgctattgatgaggaatcaggaataaaagaaaaggatgttgaaaaaaagcatcaagtaacaacatttgaaatgcttgaatggttattaagagcaataagtcaaaataagaaggcagttgttaaagttacggatttagctaatatagttccagataataatacaatatttaatacttatacttctacattgaattataactatagggatatcaatacaaataaatcaaagcataatggcataggagaagataagaataactcaaataatgctgtaaataatgaaataacagatgaaaaagctgaaaaaccaaacagtaaatatgaagttgatttaaatagtgtagattttaaaaatttaattgatattaatgataaaagagttgttgatataaattcagagatttatactactaaaaattcgttaacgtatacatttaagggattaagtaatgagaacacattagattatgttcttgaaagtttaaaacaaataaatggccatggtactttttttgttactaaagatgaaatagaaaaatatcctgaaagaattaataaaataatagaatacggaaatgaaataggaaatggtggagtaacaaataatactaaattactatctaaatcaacagaagatatagcaaaagaaatatacgaagtaggaataatgcttaaaaatagagggattaaaacaaatgcttatatgccgggatatggatatgtcaatgaaaatgtcagagaagcgctttcttcattgaaatctcttgaagagtttaaaaattatgaactattcacatatactaaatcaccagttataactaaatatagaagatggaaatctgatgagataataaatgattattttaatattaatacgtatttatctttaagaaaaggtgaaattgtatattttagactggattcagatttgtttgatgattatatgacagtagggaatatgattacgaatcttacagaaaattatgttgaaaatggatatattcatagatttgactcaaaaactaatttatatgttccaataaagaaaaaattaggttattctgttgtaactctaaatgaattgcaggaaatagatgctataaattctaaaagatattcactaaaaaaagacttaagcgctctaccacagagaacagtaaaagaagcagatgctatacttcaaaaaaattatattggaaatatttatgtagatttacatggatttaatgaagaagagcaggcaaagatggatacagaaggttttgttaatactaatggagaaagtgctgttttctttacttttgatgattggggaagtgatgttgttataaatgacatactagatgttttagataaacataatgtaaaagggacattttttgcattaggtaaatatgtggatattgaaagtaatatttctaatgccaatcctaatttattgagaacaattgcattaagagggcatgatataggaagtcacacatatgatcatgacaaacttgatactgacccagaagaactaaaaatttctcttaataaatcacatatggtaatggatagagttattggggatttaggaagtcttaagccatatttaagaccacctacattatatataaacaaatcaggacttgaaactgcttttcaatgtggttttgattatgttattaatggtaatatatcaactcatgattatgaagctgcttctggagaagaacttttagaggggctagagagcgaacttgttaagaaaaaaggaaatatagtagttatgcacatgaataatcaagcatcttatacagcagaggcattagaccaatttttaactaaaaatgaacaaggaatatatggtgaaagatatagaattgcaaaattaagtgattatttaaattaattaattttgttgataagaagataactaactttaaggtgaatataggaggttaattatgaataagatcaaagatattctcttaaaacaaaataaggatagacgtttactatcaaatgttccagataaacaggccataagaaagaatacagatcgtagaggtaatggctcattagatgactacaaagatgatcctatgggatttattatgagcaaaaatgcaggtatacgctatgagatgaaatgtaaagtaaatataaaagggaaaataaaaaaagaaatagtatcaatagaaggaatgtcacaagatatttcaacaactggaatattaattgaacttaatagtaaagaagatctagaaatacttaataaatgtgatgaattaaaattacagtttaatatattacctggttcaatgccagagggatatgaaatgaatgttaaaattaaaggaaaaaaagtaagagatactattgatagagacggaaaaataatatgtggtatagtatttgaaccatccttatcagaatataaaaataagaaaaaaggaaaatatatgcttgtaatatgggacagtagatagatttgtgtaaaaacaaaatctatctactgtttttttgtatgaacagttggtagttttggaataataaaacatataagtttaggaggaattattatgacaaaaaaaattgatactaactttgactacaatgaagaaataaaaaaatgtaaaaccatcgatgatgttatgggtaagaatgggctaatacagaaacttgtaaaagatgtccttgaaaatatattagaaggcgaaatggaagagcatcttggaagaaataaatatgagcgtacagaatcaaataatcaaagcaatagaaactatagaaacgggtatagcagtaaaaatctacgaagctccttcggtgacgttgacttagacgtaccacgtgatagaaatgcagaattcgaacctcaaattataaagaaatatgaaactgtctgtactgagttagataaaaaaattatatctttatatgctaaaggtatgagtacaagtgatatccaatcagagattgaagatctatatggaataaaaatatctccatcgatggtatctaaaataacagataaagtacttgctagcgctaccgaatggcaaaatagagctttggataaaatatatcctatcgtttatttagatgctatgtactttaaagttagaagtaatggaaagataattaataaagctgtttacatttgtttaggatatacaatggatggctataaagatattttaggtatatgggttgatgaagcagaaggtgctaagttctggttaggaatttgtaatgacttaaaaaatagaggagttaaagaaatattaattgcatgtatggatggtttaaaaggattaccacaagctattaaaacagtatttccatcagtaaatattcaaacatgtattgttcaccaaattagaaattcaatcaaatatatagcttcaaaggataaaaaggcatttatgaaggatttaaaagaagtttacaaagcatcaactgaagaacttgcgttggcgcagctagacaatttaaaatctttctggggtgataaatacgctatagttattgattcttggtataataattggagtaatctatcaacattttttgatttctctccaagcataagaaagatgatatatactaccaatgcacttgaagggtttaatcgtcaaatacgtaaatttactaaggttagagtgatctttcctacagatgaatcgttaaataagtgtgtttacttagctacgatggaaataatagaaaaatggagtcaacctactccaaattggggtgctacgctagcggagctatcaataatatttgaagatcaattaaaagatgaattagcttagaagcttgtacttttattgattaatatgcatacttttagattttattgaaatactaaaaaaggtaataaaaaacattattagtatttcttaaatataaaaaaatattactggaaatcaaaatttccagtaataataaattgataaaaatactaattacacaaaactatctaaactctctgtaatatcaagtatgttactatttttcattacattttttatagtattaatgagagcagaaagtgtaatatattttagatttaacaaaatattatatttatacagtattattgcggcagtttttttattaagcagatatttctttggtatgctgtataagccatttccaattgatatggattttacaccaagtgtaacaataattattccatgttttaatgaggaagagtggatagatagaactattttaagttgtataaaccaagattatccagtagataaattagaggtaattgttgttgatgatcattcaagtgataactcagttgaaaggataaagacaacaatagatactctttataatgaagctgagagatttgaaacgaaaaagagattaaaatattttgttcaagaagataataaaggaaaaagagaagctcttgcaagaggcgtaaaagaagctaaaaatgagcttgtagtatttgttgactcagatagttttttagatccatttgcaataagaaatttagttcaaccctttaaagatcccaagatgggaggagtgtcaggaagaacagatgtagcaaacacatatacaaacacacttactaaaatgcagtcggtaagatattatatagctttcagagttatgaaggcagcagaggctttctttgattctgttacatgcctttcagggcctttatcatgttatagaaaaagtatagtacttgaaaatttagattcttggttaaatcagaaatttttaggtcagaaagcaacttttggtgatgatagagcaatgactaattttgtactaaaaaattatcgtactagttatcaagatacggcagtttgttcaacaatagttcctaataaatataaagtcttcataaagcaacagatgagatggaagcgatcatggcttagggaatcaataatggctggtgggttcatatgtaaaaaagaaccgtttatgatgttgtttttttatattggtcttttagtacccgtgttagcgccagtagtggtagtttacaatcttatttatgttccaatagtatatggcgtttttccaacaacatttcttgtgggactcttaatgatgtcacttttgatgagctttgcccagatgcttttaaggaaaagtacaacatggatatttggaatgatattttgtttatactatgaagcggtacttttatggcagatgccaattgcagttttgactttctggaaatctacatggggaacaagaatgacaagtaaagatgcagaagtagaagcacgaaaagcacagaaagctaagaagaggaaagagaaaaaggaagtgactgctcaatgaaaagtaatgttttttcaccacaacgtaaagataaaataaaacttattagaagtgtatgtgaagggattattttaatttccttattggtaattattataagatcattattgtcattttcagaatatgaaccatatgatcaaaatattataagcaatactacagatacaggatttatagctgtttcttactttggagttgatagaaatggcactgatgcattaataagtacagatagattaaacaaacatttaaaagcattaagagataatgggtatgttacaataacgcaacaagatattttagattattatgaaaaaggaaaaaaacttccggagaaatctttatttttaatgtttgaagatggaagaacagacacagctattttttcacagaagattacggaagaatataattataaatcaaccattcttacttatgcagataaatttgaaaaagaagactcaaaatttttaaaaccaaatgatttaaaggatttagaaaaaagtacgtactgggaacttggaactaatggatatagacttgaatatataaatgtttttgataaggatatgaattttttaggaagaatgaattcgctacaattttctgaagctgcacctaatattcgcaggaattataaccattatttaatggattttattagagatgaagataatgttccaatagaatcatatgaagaaatgaaagcacgtatagattatgattatgaaacaagtacacgtatatatgaagaagaacttggaaagaaactagatttatatacacttatgcattcaaatacaggacaatttggtactaacaatagagtaagtaaaataaatgaaaaatggattaaagatctttataaaatgaactttaacagagaaggttattcctttaatacaactgaaaactctatatatgatttaactagaatacagcctcaggcctattggccaacaaatcatttgcttatgagagtcgcctatgatatcggtaaagaaaaagaaataaattttgttgtgggggatgaaagtatagcagctaattttaaagagttatctggaaaagctgaatacaacaataatttaataactcttacatgtgtaccaaatggaaaaggagtgttaaaattattaaatagtgatgattttaaggatattaatttaaaagttgaattaaaaggaaatattttgggttcacagtcaatagttttaagagcaaatgaggataatagtagtagtgtcaggtttcaattaacaaacaatgttgttagtatagttcaaaagttaaatggaaatgaagagatacttttcaaaaaagaacttgatagtgttaaaaaagaatttgatataaaagatgaaggtgatagatatataaatattgatgttaatggggacaaaattcttttatatgtagatgatgagcttatggcaaatgacataaaatttgataattcactaaatagacctggtgctgtgtatttagaatcatcatgggatgaatatggatatagtcaaagaaatattgctgatgatgtatatgatggtatatttaaaaatctgataataacagattctaatggtagagaactctatagtaatgaattaaaaggaataaaaaaattgaaatatgttactaaaacttgctttgataatattataaattggtttgtgaaaaatttataaattagatattataaatattgcaaaaaagttgttaatatgaggattccaatgaatgtgattacaggagtaaaattatgaaaaacaaacaaaagtatatgttaatgtttagtctaatagcatcaatttttatttttttaggatgtacagctaataaggatgtcaataatgaaacaataagtgaaaatagaaataatatttttgatgaaagtattggcaaaatatcagcatgggcggcatattggaatctagatgttgatgaagaggtaagtacacttgggagtcagttaggcagtgtttcatattttgaagcatattttgataataaatatgaaattattattccagatgaattgcttaaatattttaatgaaacaaaatctgagaattatgaaaagtatataacttttgttaatgatgtaaagaaagatgataataagttttctctgaaagatataaatttattaaaagaaatattatctgattctgaattacagaataaatatgttaatgatataacgagtattgccattaataatggatttgatggtatagaaattgattttgaaggaataaaaaataatattgaattatgggataaatatatagagtttataaataagttatattattactgtgaaaaatctaatttgaaattaagaattatactagagcctaatacacctatagaagatattaattttggtgaagggccagtttatgtgatgatgtgctataatcttcatggaagttcaactaaaccaggtgaaaaagctaatcctgaatttataaataatttgattgataagatggaaaaagttccaggtacaaaagagtttgcagttgcaagtggtggatttgattgggacgaaaatggaaaaacaacatctgtagatgaaaaaaaagcagaggaacttttagaaaagtataactctgagaaaaaaagggattctactagtggatgtatatattttgaatatatagatgaaagcaatattaaacatgaagtatggtatgcagataaagatactctaaataaatggatgaaggtaatcagtgaaagaggtcatatagtaagtttgtggagacttggtggaaataaattttgattggtaaatataaattaaaaggaataatttaattggttaaaagattaagaaaagctattgttaacttagaataaaataaagttgacaatagcttttcttagtattatactaatcttatgaaattattggaaaaaattatatatgatgagtgggaggataaataatgaataatatgaaaactaaaaacatggttacaatagctttaatgacagctataacatgtattgttgcgccatttacgattccattaccatttactccagtaccaatttcattagcaaatcttgttatctatatttcgtgctgtgtactaggatgtaaaaagggtactataagtttcttgttatatttattattaggagctattggtttacctgtatttggtggtttttcggccggattatcggttgttgcaggaccaacaggtggataccttataggatttatattttgtgctatatttacaggaatatttgttgaaaagtttgaagacaaaatgtatatgtatccagtaggaatgattataggaacaataatatgctatgcatttggaacagcatggttagcatttcaattaaaattgggatttgtagaagctatgtttatgggggttataccttatttaattggagatggattgaagatagcagtatctactgttttagggtatacattgagaagtagacttgcatcaatgaatctaataaatgcataaatttaaatatttaataagtaaattttgtttccacatattaaattaaaataaaaaaataacatgaattgttttatagcagttcatgttattttttatcgatccatataagctcagaatagctttgaaatatagtctgtttagtatatggtttaataattggtttattatttcattaattttacaaggacagccttttgtgcatgtaatctattttcagattcatcaaagatttcttcagcatgtgcttcaagaacttcacttgttatttcttcatctctatggcaaggaaggcagtgaagtactaagacatcatcatttgcattttttaaaagttcattattaacttgaaatccttcaaaatgcttaattcttttttgtgcttcttcttcatgccccatacttgtccaaacatcagttattactacatctgcacctttaacggcttctataggagaagtagtaatggtaaactcaacattttctgtttcagcaatttcttttgcacgagataaatatttttcagaagcactatatatttttggagatgcaattgaaaaattcataccaactttaaggcagccaatcataagtgaatttgccatgttattaccgtcgccgacaaaagctacctttaatccttcaagaatatttttattttctcttattgtcataagatcagctaatacctgacatggatgctcatcatcagttaaaccatttataattggaattgaagagtatttagctagagtttcagcttctttttgtgaaaaagttcgaatcattataccttgtataaatcttgaaagaactcttgcagtatcttcaataggttcacctctgcctatttgtaattctttatcacttaaaaataaagcatttccacctaattgatacattccaacttcaaaagacactcttgttcttgtagaagctttttcaaaaatcatacctaagctttttccttttaaaagaggatgttctataccatgtttttgttcatattttaattgatcagctaaatttaatatatctaaaatttcttcttttgataaatcgtccatttttaataagtcttttttcacaaaaatacccccatattttaattgtaagttgttatgttatttattttatttctgatagaacatcaagtagaatatctataccattttttaattctgctttacttataactagtggaggaagaagtcttactacatctttgccagctgttaatacaaatagtccttttttaatacattctttttgaactagagaaggagagcattttactttaattccaagcattaaccccattcctctaacatcaactacttgaggattattgttttcttcaataagttcctttacatatgcacctttttcagaaatttcattgtatgatttttcattacacagctcatcaagaacaactaaagcacctgcacatacaacaggattagcaccaaaagttgagccgtgatcaccaggctgtaatacatcttgaactttttcaccacataagaatccgccaataggaagtccagcacctaaaccttttgcaacagtaacaacatcaggtctaacatcaaaattttcatatccaaataattgaccagttcttgcaataccacattgaacttcatcaaatattacaagtacatctttttcattacacattttaacgacttcttgaacgaaatccttatctagaggtataacgcctccttcaccttgaatagcttcaagcattatggcacatacatcaggtgtaagtttttctttaaaatcatttaagtcatttgcttttacataattgaaaccttcagtaaaagggtagaagtactggtgaaatttttcctgaccagttgcttttaaagttgttatagttcttccatggaaagattgagttaaggttagaattgtatttcgtccttgtccgtatttatcaaagctatattttctagctattttaatcgcaccttcattagcttcagcaccagagtttccaaagaagattttcttcatttttgatttttcagttaactcttttgcaagtttaacacttggctctgttaaaaatatatttgaagcatgaactaaagttcctagttgagaagaagtagcttcaacccattttttatggccatagccaagggaacttacaccaataccacttgtaaaatctaaatatttattgttatcttgatcataaagataaacgccatggcctttaactattactggatccaaacggccataactgtttactaaatgttcttttgcttcattaaaatcatatgtcatgtttaatacccccaattttttagttagcagttgtcagttaacagttagcagatcttaattaaatcattccactgttaactgttacttgttaactgataactgatttaatatatcattgttccaacaccttctggtgtgaataattcaagaagaatagagtgaggaatacgtccgtccaaaataattgctctttcaacacccattcttactgcttcaacgcagcagtctattttaggaatcataccaccttttattacaccttcaaggcacaattttggaatttgatgaagtcttaatgtacttagaagagaagaagcatcactagggtctttcataacaccaggaacatctgtaagaagcattaattcttcagcttttaatgcagaagctatctttgaagcacatgtatcagcatttatgttataaggtttgttatcatcttcacctaaagcaacacttcctattacaggaatatatcctgagttcatagctgtttttaaaatatctgtgttaacttcagttacttcaccaacatatcctaaatcactttcttctatttttttagcctttattaaagagccatccatcccacataaccctagagctttaccaccaaatttttcaattaaagaaaccaagtctttatttacttttcctccaagaaccatttggacgacttctatggtcacatcatcagtgtatcttaatccatttataaattcacttttatgatttaatctatttagtaaatctgaaattgcaggtccaccaccatgaactacaactggttcgatacctacacatttcattaatataatatcgttaataactgtttcttttagttcatcatttatcattgcatttccgccatattttataacgatggtttttccacgatatttttgaatatatggaagtgcatgaactaatatctcagctctttctgaatgattcaaatttaatacccccaattattatagtttacagttatcagttaacagttagcagttaaggtggatattcctacggaatatctttactgttacttgttaactgaattctagcttctatagtctccgttaatttttacatattcataacttaagtcgcagccccatacatatgcagtgcattcaccttgagataagtttattttaattattatttctttctgatctaagactttctttgctttatcttcatcaaaagcaacagaacttccatttttacatacttcaatttctccagcacagctttcaaatgaaacatccactttttcagggtcaaaatctacattagcatatccaagtgcacatagaattcttccccagtttgcatcactaccaaacatagcagttttaacaaggcttgaatttatgacacttttaccaaataagacagcatctttttcatttgtagccccaataacttgacattctaataattttgttgcaccttcaccatctttagcaatattttttgccattattgtgttaatttcttttagtacatttacaaaagtatagtagttttcatctttttctgtaatggtaggattattagcttgtccgttagctaaaataaaaatagaatcgttagtacttgtatcaccgtcaacacttactctgttataagtaatagtaacagttgattttaaagcttcatctaataattgaggtgaaatagaaatatctgttgtaataaatgaaagcatagtacccatatttggttctatcattccagaacctttagccattgttcctagagttacctttgtatctccaatatagaattcagcagcaagttctttcataaatgtatcagtagtcataatagcagaagcagcatcttgatttccgctttttgataatttttcagtaagtagaggaataccatctttaattgcatcaatatttaaaggaaccccaataactcctgtagatgcaactaaaacatcatcagcttttaagtttaaagctttagcctgaagagcagtcatcttttttgctttacttaatccatcatctccagtacaagtattagcattaccactatttatgattattgcttgagcttttttgttagataagtgatctttgcagatataaataggagctcctttaactttattttttgtaaacattccagaagcctttgctggaacttcagaataaattaaagctaaatccttttttactgaaccttgtttaataccgcaatatatgcctgatgcaaggaatccttttggagcagtaactccaccgtctatatatttaatttccattaataaaacccccttaaattagttaacagttatcagttaactgtttttagttaaatattttttgattacttattagctttggttgtttgtacgatagatattaatattttacataattctatagatttttctaatattgattgccccatttttacatctaaataattactttgtattaatagttgtatccaatattctgtttcttcagcttctttcaaagctatactcatttttgacaggaaatcttttctagactgtccttttagtgcttctttaatattagcacctatacttgttcctgaacgtagtaattgcttagataatataaactcctttttggttatagttaaatatttatatatgtctatgatttctaatgcaaaattgaaagatttatctttaataatactactagacacatgaacaccacttttgttaattatttataatataaataattaacaaaacaatgataaaatattcaatttatactaattaacaactgttaactgttacttgttaactgttaactactaaaaagctggtgctataagatttataccttcagtttcatcaaatcctaaaattatattcatattttgaatagcctgaccagcagccccttttatcatattatctatcgtgcttacaattattatttgatcttttctatgatttagatgtagagaaacatagcagtcatttgaaaatcttacgttctttatagaagcagtttcgccaagaggaagtacatgaacaaaaggcatatctttataacagttttcataaagtttatgtatttcgtcaagatttactttttcttttggagtacaataaattgttgaaactattcctctgttaattggaagtagatgaggtgtgaatgttacagttactttttcatctgctatagtagataaaatttcttcgatttctggtgtatgtctatgtccaccaattttgtatggagcaaatgtttcattttcatctgggaagtgtgttgtttgagaaagacctctgcctgaacctgttgttccagatttagaatcacaaacaatattttttgtttcaattaatgaatgttttaataatggcattaatcctagatttatagtagtagggtagcatccaggattagcaattaatttacattctttgattttatctttgtttaactctggaagtccataaatgcaatttttatgtaattctggttgagtgaatttttttccataccatatttcatattcttcttcatttgataatctgaaatcagcccccatatcgatacagattttattattttctatggctgtctttgcaatatcttcacttaatccatgaggtagagcagtgaagattacatcggctttttccacaacatcatttgcactttcacatattaaatcagttttatttagaaagttcacataaacattgcttatttcctgtccttcaaatgaaactgagcttaatgctacaacttcaactttaggatgtgataataataatcttaaaagttcaacgcctacatatcctgtggcaccaattattcctactttaatcattttatatagccctccgattttaggtaatagctaagttaccttaaccattaaatatttttaaagaagaatttctaaataatattaaaaattcttctttaagtttatataattatctgtttatttagttttgttctattgtgtgtttattaataaatgtttctaatgcattaatttgatatttaactgactctgtagaaggtccacccataactttacgttcttcaacgcatgtaataagatcaattgcatggtatatatcttcttcaaatattggagaaaattcttttaattcatcaagagtaagttcttcgatcatcttattcttgttaatacattcaagaacaatttctcctacaacaccatgagcatttctaaatgccattccttttttaacaaggtaatcagcaacatcagtagcattagtgaaaccaaggccagcaccttttctcatattttctttttttactttcatagttttaatcattccacagaaagtcttaagtgaaaggcttgcagtatccaaaccatcaaaaacagcttctttatcttcttgcatatctttgttgtaagcaagaggaatacctttcattacagtaagaagagtcataagatctccataaactcttcctgttttacctcttacaagttcagcaacatcaggattttttttctgaggcataatactgcttccagtactatatccatcatcaagttcaatgaaactgaattcatttgtgcaccaaagaataatttcttcagagaatcgtgaaagatgcatcattatcattgaaagagaagataatgtttcaatggcatagtctctgtcagaaactgaatcaaggctgtttaatgtaacctttgaaaaacctaaatcacgtgcaacagcatctctatcaattggataagttgaagttgcaagtgcacctgctccaagtggcatttcatcaagtctcttataacagtctgtaagtcttccataatctctcttgaacatttcagcataagcaagaatatgatgagcaaatgtaataggttgtgccttttgaaggtgagtataaccaggcataatcgtatcaatattttcatttgccttttctaaaagaacttcttctaaagcgatgacatcttcctttaaatctgttattgcattttttaaatacaatctaaaatctaaagttacttggtcatttcggcttcttccagtatgaagcatcttaccataatctccaatataataagttaatgtactttctatgaagctgtggatgtcttcagatgtatcatctacattaataacaccattttcaatgcgttttagtatttcaagaagaccagaagtgattctatcactggcttcttgaggtatgatgttttgttttccaagcatggaagcatgagcaaggctgccttgtatatcttccttgtacattcgtgagtcaatgcgtatagatgaattaaaatcatttactaatttgtcagtaccttttttaaaacgtccgccccaaagtttcatattatttaacctctttcttaaggtttgcctgcatttttgctctaactactgatggtagtccataaaggttaataaatccagcagcatctttttgatcataaacaccatcttccccaaatgttgcatattcttcactatataaagagtatggagaagtcataccagcattaatgatgtttcctttatataactttaatttaatttcaccagtaacagtttcttgagttttatttacaaattcagttaaagcttctctaagtggtgtgaaccattgaccgttatatactaaatcagcaaattttaaagctatttgttctttatagtgagaagtttccttgtctaagcatatttcttcaagatctttgtgagcagaataaagaatagttccgcctggagtttcgtaaacacctcttgatttcataccgacaagtctattttcaaccatatcagtaataccgatagcattttcgccaccaactttattaagttcatctaataattcaacactattcattttcttaccatttaaagcaacggcaatacctttttcaaatgttaaagttatataagttgcttcatctggtgccgcttctaaagttttagaaagttctaagatttcagcgtattttggttcattttctgggaattctaagtctaatccttcgtgacttaagtgccagatatttttatctttactatagttagtttcacgatttatttttaaaggaatattttttgattctgcatattctatttcttcttctctagattttatatcccatattctccaaggagctataataggcatttctggagcaaatgcttttacagcaagttcaaatctaacttggtcattccccttaccagtacatccatgacatattgcatcagcaccttctttttgtgcaatttcaactaatctttttccaattaaaggtcttgcaaaagaagttccaagtaagtattttccttcatatacagcgcctgcttgtatagtagggaagatataatcatcaacaaattcttgtgttaaatcttctatatataattttgatgctcctgtttttattgctttttcttctaatccatctagctcatctttttgcccaacattaccacatacagctataacttcacatccgtaagtttctttaagccatggaataatgattgatgtatctaatccccctgaataagctaaaactactttattatattttatcattttaaaagccccctcttataatacattgtaaatatgtaaataaatattaaatttactaaaataaatctgttttttataattatacatttatagtgaataaaaatcaatagatttacgcaaaaatattcattattttttgagtaatatgcataaaacataataatatacacagaaaacgttataattatgcacttaaagtggtgaaatatgcatgttctttaagtgcataattgaattgaaatatacatggattagtttggatttatacattcaaattttaattattaaacttatacaccaaaataaaatataaaacattaggcaatatattttagaatatattgcctaatgttactgactgaagatgcttaattgtctgagcactgtattttataaaatgtaaagaagaataggcctctccaatatcgtttttagaaatgtataagcacaatcgtacagcttcatgccttaaagcatcaaaatcttgatgatttgtatatatagaagcgataaaatcattttcttgtaaataagatagtagttctacagctttatcataagcttcgtcataatcttgatttagtagtataacttccatatcatctgttttatattttattgaatcacataaatcaattacagagttatttaaaaagaaaatgccaattaataatccgaaaaaaataattactgatattattgcatttttcattgcttacaacactccttttcataatcatcataatactgaactgaaaactttccttgagtatcatacattgccacaagtatgttatcaattgagttgatgtcatgatcttttagtactttcattatccattcttcgcttttgttcatagatgttatagaacgtttattaatttttccatcagctataagaattttaggcagtacaactttttgtgtagaagtattatcagattttccactagaggaatctgatgatccagaagaactattataattcttaggaagaatagacatttgtccgctattttctaagattgcatattgaatttcatctagattgtagcacttagcaagtctaagttcttcaaataattcatctaaattcagctgttgtttttttaaggcatcataattaatttttccgttatatattaagatacaaggtgaaccatctaagatattacgtgcaggttgtaattttagttctaattgtgttattaaagtttttaaaaacaacaatgttattataggaacaataccttgaagcagtggatatctctgatcttgcataggtaatgaagctaaatccgaaatcatgattgttattacaaactcatatggttgaagttcgccaatttgtcttttccccattaatctcatagtgagtactacaagagaataaagtaatattgttctaatgcatactataatcatttttaacacctcaaaaataatatttgcagaaatataattaatataccaatggaaatatttttagccaaaaatgattgattgtatataatatagtagataactatttacagaatgtagaaaaaaataatagaataaataaagatggatatttccttaatttattggagaaaaataatataatacatctgatttgctggaaactgtagaaggttatcagttatgacttatacaatgtaagattaatagaaatgggaggaaattaaatgctaaaagaaaaagttaatattgcagaaaataagtttaaagcaaaaaaaggtatgactttctataacttaattgctgaaaatgatgagaagatagttaaagatattgctatatgcaagcttaatggacgaaattatgaattaaatgaagttatagaagaagaaggggaaatttctctcattggatttgatagtgaacttggaatgaaaatatatacaagaactcttcaatttatattcattaaggcaactttagatttatttaaagatgctaaaataacattagaacattctataagtaaagctatttatggagagatatataaagaaaatccattgactgaaaatgagttaaaaaatataaaaagtagaatgcaggaaataatcgaaaaagatattcctataaaaagaataaaagtatcaaaagaaaaagcaatagagatattttcaaattataatatggaagataaggttaagcttttacaaacatgtaaaatggaagagtttcaactttgtgaacttgatggaagatacgattatttttatgaatgcatgggatattctacaggcgtaattaaattatttgatttacaaaagtatgaatctggatttattttaagaagaccagagagaaataattttgttactttagaaccatttaaagaacagaaaagtttaacaaagatatttaaagaaactaaaaaatggttaaacatacttgggattggtgaagttggaacattaaatgaaaaggtatgtaataatggattgaaaaatgtaattatggtatcagaagctcttcatgagaagaagatagccaatattgcagatgaaattaacaaaagagaagatgtaaaaataattcttattgcaggaccatcatcttcaggaaaaacaacatttgcaaacaggcttagtatacagcttagggtaaatggacttattcctataccaatttctttagataattatttcgtagatcgtgaaaaaacaccattagatgaaaatggagaatatgattatgaatctatttatgcattagatttaaaactgcttaataaagatcttgaagaacttatgactggaacagaagtagaattgccagaatataatttcaaaacaggtaagagggaatggaatggatataaagttaaaatgccacaaaatggagttttaatattagaaggaattcatggattaaatcctaaattaatatatgatgatttaagaaagaatgtatttaaaatttatatatcagcattaacacaattaaatatagataatcataataggatttcaactactgattcacgtaaggttagaagaatagttagagattctctttcaagaggctatggtgctgaagatacgctaaagatgtggtcatctataaaaagaggggaaaaaagaaatatttttgtataccaagaggaagctgatgcaacgttcaattctacactagtatatgaactaggtgtattaaaaccatatgctcttaaagaacttgaaaaagtgccacaggaaagtgaagtttatgcagaagcaagaagattaaaagcatttttaagtttttttgaagaaataaacttagatgaagttccaaagaattcacttttaagagaatttattggtggatcatgtttttacgaatattaatttaaaaaatagtcaaatcacttttattcagtgatttgactatttttataaggtattatataagtttaaaagaaatagaataaaaacaaaaactaaataatggaaaatgttacaaaaataaaaacaatattgtaatttaataattttgttagtaatatagggataagataatatacataataagtttatcgattaaaaatataattatattgtaatatagctaaaaatgtcctgatatattaaggatttatttttaatactgatgaaaatagggggagagtttatgcctattattgttaatgacggaatagtaatacaagcttataacaataatacagtttgtattaaaatgcttggaaaagagaaaattttattttctaaaggaatcggttttggaaaaaaattcggtgataaaattcctaagggaacaaaagtagagaaaattttcattatggaaaatgcagaaaatcttaaaaattttaaacagataattgaaaaggtagacaaagatttctttgatttatgcgaaaagataataacagagatatctagagacttaaatgaaaagttaaatgaaagaatttatattggattaatagatcacttaaatttttcaataaaaagaattaaaaataaagagataattgataatccatttcttgatgaaatcaaagtattatataaaacagaatatatgttagcacaaaaagcagccagaattataaaggagagtattaatgtaactataccagatggagaagccggacttatagctttacatattcattcaaatagaaattccggtaacttaaaagatacaattaaaagtactaatataagtagtatggtagttgatttcatagaaaaaggattgaatatgaaaatacctaaggattctttaaattatgcaagatttgtaacacatataaaatttgctataaaaagaataatgtctaattcagaattggaaaacgattttattgaggaaatacaaactaaatataaaatttcatataaagtagctaaagatgcagcgcaaatattagaaaaatatttaaataaaaaagtatgcgaagatgaaatagcatacttagcaatgcatgtagaaagatttagaatttataactaaaaattctaaaaaagtattgcatattaatttttattatgataatattaaagcataaaatatatggtttaatattgtgcgtgtaatcgattaaattcgagcattagctgaaaagagtaagatttcttattcttttcagcttttttgcgttcaaaaaaatcaaatttaataaaatataagggggacttatttattatgatgaagtatttacaaaaattagggaaatcattaatgcttccagtagcatgcctaccggtagcaagtatactaatgggaataggttattggatggacccaactggttggggagctaatagtgtagccgcagcttttctaataaaagctggtagttcattaatcgataacatgggaattttatttgcaataggtgtaggtgttggaatgtcagacgataatgatggtacttcaggacttgcaggacttgtttcatggcttatgattacaacactattgtcagtaaaagttgtagccatgttcaaaggtattgatgaagcagcagtatcaccagcatttggaaaaattcaaaatcaatttataggaattttatcaggtgtaattggagctacttgctataacaaatttaaaaatactagattaccagatttcttaggattctttagtggtaaaagatgtgttgctatagtaacagcctttgcatcaattatagcagcgttggttttattcttcgcatggcctcttatctatggagcattagtaaactttggtaaagcaatagtatctacaggatctattggtgccggtatatatgcattctttaatagattattgataccagttggtttacatcatgcacttaactcagtattctggtttgatgttgcaggaatcaatgaaattgctaatttctggtcagcaaatggaactaaaggtgttacaggtatgtatttaactggattcttcccagtaatgatgtttggtttaccagcaggtgcattagctatgtatcatacagctaaagatagcaagaaaaaagccgtttacggtttattattggcagcagcaatatcttcatttttcactggagttacagaaccattagaatttgcatttatgttcttagcaccaggattatatttagtacatgcagtattaacaggtatttctgtagcagtttgtgcagcattaccagtaagagcaggatttaactttagtgcaggtttcgtagattggttcttaagctttaaagcaccaatggctatgaatggattaatgataattccaattggtatagcagtagcaatagtttactatgttgtattccgatttgtaattacaaaatttaatttaaagacaccaggtagagaagatgatgacgatacaagtagtgaaatgaatgtaacacttgcaaataacgatttcacaaaagtcgcatctagaattttagaaggtgttggaggaaaagaaaatataacatctattgataactgtgtaactagattacgtttagaaataaaagatcaagcaaaggttaatgaaaaaattattaaatcagctggagtttctggtgtaataagaccaggtaagaacagtttacaagttatagttggaacacaagtgcaattcgtagcagatgaatttaaagaattatgtaaataataaatagacaaatcatttaaaaaaatctcatataaataacacaataagaaaaagatgccacaatttattttgtggtatttttttgatttttagtagtttatgagtagatatttaataaagtgataaaataattataaacctataagctttgctagatagttattataaattgtggtttaataaatattagaaaaacaataagatgaaaataagttacactaaataaatttaaactgaggagagatacttatgaaaggtataggaatttttgatatattaggtcctattatgatcggaccttcaagttcacatactgcaggagcagcaagacttggtaaaattgcaagaagtatagcaggtggagatattgcagaagtaacatttttactacatggttcttttgcaaagacatataaagggcatggtactgatagggcattagtagcaggaatattaggaatggaacctagtgatgaaagacttagaaattctatggatattgccaaagaaaaaggaatgaaatttttatttaaagaagcagatttaggtgatgtacatccaaacactgttaaatttgtaatgaggacaattgataataaatattgtgaagtcatgggttcatcaattggtggaggaaacattaaaatttgtgaagtaaatgataatgaagtagattttactggaatgtatgaaaccttaatagttcaacataaggatgtgcctggggttatacatagtattacacatatattatatagcgaaaatataaatgtagcatttatgagggttttcagagacagaaaaggtgaagatgctactatgatttttgaaatggacaataaggtgagtatagagactagaaagaaaattgaaagtcttgaacttgtatataaggttatttcaattagcccagcaaaagaagatgaataggaaggatgatgtgaggatgcttgcaaagacaggagaagaattattagaaatatgtgaaaaatataatatttcattaagtgaatatgcaataagatgtgaagtagaagaaaagggacttacaagagaagaagtaatagaaaaaatgagaagaaatctaaatgtaatgatttcagcggcaaatgaaggtagagaaaaccaagtatattcagtaagtggccttatcggtggagatggatttaagattaataattatgttaataaaggaaagacattgactggaacggcaacaaaccttgcaatggcaatggcattatcatcatctgaagttaatgcttctatgggaaaaatagtagcatgcccaacagctggatcatgtggaatactaccagcagttattttatcagcaggagcacaattagaattagatgaagaaggattgataaaaggtcttcttgcagcagcagcagttggtatgataataggaatgaatgcaactttatcaggggcagaaggtggatgtcaggcagaatgtgggtcagcatcggctatgggagcagcagcagtagttgagatgatgggtggaacgcctaaaatgagtcttgatgctggatcaataatacttcagaatgtacttggtcttgtatgtgatccagtagctggtcttgttgaaattccatgtgcaaagagaaatgcacaaggtgcaattactgcattatgtacagcagacatggttatggcgggagtagaagcaaaaattccatttgatgatgcagtaagtgccatgtataaggtaggaaaaagtttgccatcatcattaagagagactgcacttggtggagttgcagttacaccagcaggcttaaggcttaaagagcaggtttttggtaaggaacctcaatgttaaataagtagtgtaaacaccattaaattgattaaagaatattatgtatttataatgaaattatattttatatataaccgaaaggagtgttatggaaattttccataacattctttttttatatgagaaaaaaactgatgattattaaaaaaaatattaatacaatgtaatcttgcatagtataaattttttgatataatgatataataagattaagttgataagacattattattaaataatgttaaaaaatataatataaatattattattaaaaaggaaaaagttatgattaaagtcaagcaatatataaatcggtattttaatataaatataaaaaaattattaataaattaaagaggtataatctgtacattgttaaatggtaggttatacctcttttgattttataaattactgattacaagggaaggtaggcgtatgaaaaataaaatagtatctaatgtaattaaaggtatatgtgttggtggatccatgttaatacctggtgttagtggaggatcaatggctatgatattgggcatatacaataaattaatatcagctgtaagttcgttttttaagcataaaagggagagtattgaacttcttggaacttttgcgttaggtgggttaataggaattttattatttgctaaaccattattatatttaacagataaatatacatttcctatgatgtatttttttataggagcagttttaggatctatacctatgatatataagcaggctgaaataaaaaaaatatctatacgttctgttatatatatattattgggattgctaataatattattaatttcacttatacctaaagagttatttgatgttgatttaagtaatgggataatggattatttattacttattattgcaggaatagtttcggctatagcattggtgcttccaggcattagtgtatcatatatgcttttagttttaggtatgtatgaagagactataagagcaattgatgaattttatcttccatatttaattccattgggaataggcctgcttattggaataatgcttacaacaaaaatcttagaaaaagctatgaattcttatagagaaggttcatatttaataattcttggttttgttgttggttcagtagtacaagtatttccaggaataccaagtggaataaacatagtgataagtttgtttactttatttattggctattatttgataagaaaattatcagatatggcttaaagagtttattaaattatacatatttataataatgtgaattttgttttaaatttacaaatctagagagggataaaaatgaacaaattaaaacatataagtccaggaagacttatagtattaggcttttttatggtgataatgattggtgcatttcttttgatgagtcctttttcaagaaggagtggtgtagatgtatcgtttgtagatgctttgtttacttctactagtgcagtgtgtgttacaggactaattgcaattgatacggcagatacatttaatttatttggaaaaactgtagttgctatgcttatacaaatcggaggtcttggagttacatcgattggcgttggattaatattattaattggaagaaatgttggtataaagcagagaatgcttgtaaaagaggctctaaatttaacttctatgaaaggaatagttaagcttataaaagcagttatcattatgacaatttcttttgaaatagtaggtgcaattttaagttatatagtattttcaaaagattataagccattggatgctgttggaataagtatatttcattcaattgctgcatttaataattcaggatttgatgtccttggaaattttcaaaatttaagttcgtatagagataatattcttttgaatcttgttacatgtgggctgataatatttggcggtttaggatttttaacaattaaggaaataatagaaaagcattcttttgagaagttttcattacatactaaaatagttattacaatgacaggttcattgttaatagttggaactgttttattgaagtttacagagaatataagctggctcacagcatttttttatagtacttcagcaagaacagcaggatttagcacagctcctttaagtggttttactagtgctggattatttactattgttattttaatgtttattggagcatcaccgggatctacaggtggtggtattaaaactactacattttttgcaattataaagaatgtatatagtgcatctactaataagcattgtgtagcatttaaacgtgaactatctaaaaatacaatagcaaaagcatctattatagctacattgtcactaacactggtagtagtagatacatttattttatcaataatagagccggaatttagttttatgcaaatattatttgaggttacaagtgcatttggaacagtaggattatctacaggaataactccaagccttagtgatttgagcaagttgattattacattaactatgtttataggaagacttggaccgttaactatggcaacaatatggacatttaaaccaacatcacatgtacattatttagaagaagatataactataggttaattttaggaggtaaaattcatgaatcataaatcgacaatagaatttggtataataggaatgggcagatttggatctgccttggcaaaaacccttttagaagcaggaagagatgtactagtaatagataataatgaaagtaatatgaagcaaattagaaacttaacagaaaatgcttttatattagaagaatttgataaagattctttagaggaaactggaatccaaaattgtgaaacagtaattgtatgcatcagctcaaagattgaagcaagtatattaacaactctaaatttaattaatatgggagttcctaaggttatagcaaaagctgggagttttgaacaaggatgtgtactagagaaaattggtgcagaagttgtatatcctgaaaaagatatgggagttcgacttggaaatagacttatgtattctaatttactagattttattcagcttagagatgatattacaatatctaaattgaaagctacagaaaaaataagtggacacactatatcagatttgaatatacgtcaaaaatttggtttaaacattattgcaatagaaagaaagaatacaacagttgttgaggttacacctgattgtattatagaagaaaatgaaattattgttgtaataggttcaaaaaagaatatacacaagtttgaaaggtttttaatatagtttgttaactatattttcaagtaaagaaagaaaaatatactagctaatcatttaatggttttgctagtatatttttttattaataaaaagataattgataaaataaaaaagatatatttttattaaaagaaaataaaataataaaaaaatttaaaattattgcaacaattaattatgcttaattgtattataagtagaataacataagaattaaaaaaataaatagaaaatgaggagatgattttattatgaatattaagagaattgttacaggtatgatggcaggagcggcagtattttcactagttccaagtaatgtatatgctgaaaataaggatgttgaagttataagtgaagctgcatatcaacaagactatagcagattatggggacaagtttctgaatttgatgagcttggaagaattagaattactaattctagtgatgtaaataatgatgttatattaaatataaatgaagatactataattgttgatgcagcaacaggaactcctgtattaaaagaaaatataaagcttgatgaaaacatttatgtttatgctggaagagctatgacattaagtttacctcctataacaaatgcaaaagttataatagttaatattccacaagattttgcagttccaagttatgttaaggttgattctgtaaagaaaaatgataatggaactacaacaatagttactgaaggtggaaacaaagaaataacattcaataatgaaactaatgtatttccatataaaacaagaaatattgtaacagttgatgatattaaagcaggatctaagttattaatatgggaagaatttaatgctaatggagtacaaacactagaattaccagtaaaggctaaagcttcaaagtgtatgataatgccaatggatgcaagtgaaactacagaagcaattagaaaaagcggatggagtaatgaaaatagtaaatggtactacataaaagaagatggtcaaatgcagactggttggttaaaagataataataaatggtattacttaaatgcagatggttcgatgaaaacaggatggctattagataacaatcaatattattatttaaaagacaatggagaaatggctcaaaatgaatacattgatggatattatttaggagcaaatggatcttggggaaaataattagaatataatttaatataaattttaaagcttgggaaagaatactttgggaaatgtataagggcatcatatatatagattataatctattgtatgatgcccttactctttaaagtattaaatacttatataatactttaatttgaaaatttttataattgtgaaagaaatttttttaagatagaaacggagttgttaaaagatgcagattcttctttgtttaatcttaactcaacaatttcagatatcccagttttattaattattgcaggaacaccgatataaacatcatcaattccatattcgccttctagaagtgcagaaacaggaattatttttccttcattgtttagaatagattttattatatctacagtagttgcagctattccataattagttgtaccttttacatctgcaattttccatcctgctttttttatttcttcaagtgtaagatctttatcgaaagacttgagtctgtctttattatctattaatatatcttcaaagttttttccaccaacacttacagtactccaaggaataaattgagaatcgccatgttctccaattgtatatgcctgaacgctatttgcttcaattccgattaaatcagcaagaaatacctttaatcttgcagaatctagggcggtaccagttcctattactttattttttggaagtccagataatttatatacataatagcttataatatcaacaggatttgtcactattataaaataaccattaaatccactctccataattggatcaataatagattttgttattttttttgcagtttcaaacatatctaatcttgactgaccttttataagtggagcagcagcagttataacgattatgtccatatcagtacattcggaatattctcctgcttttatttttattgaagaatttgaatatgcagtacaatgttttagatctaaaacttcactttcagctttaggcttatttatatctatcattagtaattcattgcatattccttgaataatgagatcaaaggctattgatgttcctacagcacctgctccgattactgctactttatttgctttcataatttttcacctcgacttaaaatttagacaaatttttggaattataagaaaagaaaatctatctaattttaataataactcaaaaaaattaataatggaatagacaaataattttatcgagattctttattttagtttgtgaaaaatattgtacccatacatttgaaaagaagacaaactacttttataatataaaaaaagaaattaatagttagtaatttgaactgtatgggggaatggtacatgaacaacagattaagtacaaaagaattagttttaatggggcttatggtagcattagtatggcttgctggaagtgtaataaagattccatctgtaggtggatttgttcatttaggtgattgtatggtgtttttgtcagtagtagttttaggtaagaaaaaaggttctgtggcaagtgctatgggaatgatgcttgttgacgttcttggtggatactacttatgggctccattcacattcgttattaagggagcaatggcttatattgcaggaagtatattagaaaaattagaagtaaagcatggaaaatcatttagttatgttatatcatttttaataagtggagtatttatggtagtagcgtattttggagcaggaataataatggctgcttttttaacagaaaaagcaggtttgattcaaggaattgtttattctgcaaaagatatagtaggtaacataatacaagttggaacgggtatagttattgcattaccggttagtgctgtagtgttaaaagcaaaatctgaagcatttttagcataataattttataaataatttgaaatcagtaaaaatactttgtaaacagatgagttatatatcatttgattatgaggtattttatcatttaaagttaaatttcatataaataatgtgaataaatcaaagagtaaagagtgaatgttgttctaagcttgattgtgaaatttaaataaaatatataactttaattataagtaaagttgagaaatgtatgtaaatatttttaattaaaagaaataaattcaaaataaaggcgattatgtgataaaataattatgtgcacaatactattaaaattaaaggatcctaatataaatctatttaaatttaagttattgcaagaaaagaatatactaaaaaatggagatgaatatgtagaatgaataaatatttaagttcaaagatcaagatcgtatcatttatcacaataattgcagtagttttcgcgcatgcttataattgggcagataattatttacagccaatgactacaattactgaaggattaaattattcagcagatatagaatattttataagtaatggtttagttagattttcagttcctgtattttttctgatttctggttatttatttttttatacttttaaattatcgattacaggatatatctataaattaaaaagtagatttaaatctcttgtaattccttattttgcttggagtattttgagtattatattttgtgatttattaataaaccttccaattaaaattattatggattggaagtatgagaaagaaacaggaaacattttaaactttttaatatcaccgcctccatttcaattttggtttatagtagatttatttaagtttgttattatagcgccactaatatacttagtaataaaaaaattaaaattatatgttgctataccaatatttttaatatgggtaattaattttaaggtacctggtattagtaataacacaatagaggggttattatttttctatttgggttcttatttatccatatggaagagagaagatattgttagtagaaagtttaacaaaaaaactgttgctattgtgagtagcatttggattattttgttgatatttaaaacagtatatgctggaattatggggatgaatcaacaattaataagcattgagaatactttgattctgataatagtttataagctttctgtattaataggaatattttctgtttggtatggatttgatattatattcaacaatgaaagcagattttctaagatattaaatttatcagaacatacattttttatttatgcatttcatgtaccaatattaaatataatttttcaatatatattatttaagactggatataacaatgaatttaatttattagtttactttggatcggttatacttgtaatattgacagccatagctttaagtttaatgttattgagatattttccagtatttcatatgattttatctgggggaagaggcgcgcgcatattctcaaagaatcattccgataattcagaaaatgagttgataactaggggataaaaatagtatgtgggttaattttatctatatttaatatgtaactagactatatagaagtatgtataaaaagatttgagatgtgattattaatactatttatagataaaatgactattataacaaatattatcaaacttatattaataatttaaaagtaaattattataaagaagagatgataatttattttataaaatataataaattcatttaatttacttgtaatattagaataaaaggctggctgtttaaaacagctagtctttttatgcacttgtaaatactataaagatttaatatctttagaaatctcattaaggcaatcttcagcttgagggtaaattccacacttatcaataaaggcatgatccatccctctgtatcgtatgatttttgtatccacattggcattgattagttttttgccaaaggcttcaccctgtactcttaagaaatcatattccgctgttataattaacgtctttggtaaattgcttaagtcttttgataataatggtgatatatattgattatctggttttacagtatcttcaacatataactgcttaatcatatcaataaaatctaatgaagaatttatattctgatttattttattattgctaacaatatactcattagtactccatttatattcttcaactgatttcttatctaaagtaacaactggataaatcaatgcttgatattttatcatattggtttttaaatctctatcttttaaagagcaagcaactgctaagtttccacctgcgctatcaccggaaatacatattttatctttttctatttttaatttagttgagttactatagacccatttaataacttcaaaacaatctataagacctttggggaattgattttctggcgctaatctgtaatcaatagatattattacagcatttgctttatctgaaagagctttacatggattttctactacatctacatttccgccaatgaaaccacctccatgaataaatatcatacaaggtgcattatcttttagattttttggtgtatattttcttactttgattggcccattcttaccaatgactgttagatgttctgtaagaatttcttttgtggttatatctctattatcccatcccatacttgatcttaattcacttatattgataccatggtaaataaattcattatctgatttatatttttttgttagaggggaggcatttataatcttgtaaactctcggatctaattcaccatctatatttaaatcgggtatgagtttttctattatttgtactccgctataattattaatctttgttttatgttctagtatttttactaaatttaagtaattagtatctaccaaaagtttcaccttccttaatttaatattatgaatttaaaaacttttaaaaaatttaaggttgttgaacttattttactttggcaattcaacaaccttaactttatcctatttaggtgcattttgaattgtttctaagaaatcctttttagctttgcttcccatatcagatgacacaaatgtggaaaatgcaggcccgattttttctactgcaaaaccttgtggaagcattgttacaggccatggaattgtttttccagatttgttaaatttatttactgctttatttaatacgttattactttcaactgtaaagtttgtaaaggcaggaattacattcatttcgttaactaatgcttcttgagcaattgtactttcactaagccaatttaaaaattctttagcttctgtattaacttttgaatctttgttaactacccaatacattggtactccaacgggaatagatccattaattttaaaatcattattaatgcataaaggaacaaatcccatgtcaaaatcagcacctaaagaattcaaatctgaagcaatccaatttccttgctgaataaatgcagtttttcctaatgcgaaatttccaacttgagtactataatctattgtttctaaattctggcctccaccatatttacaaagtaattcaactagcttcatccaatcattgaaaatgttattatttactatatcaactttaccgtccatataatttttaataaattctgttggtttttcttgaagggctaatggaatattaaatgtatctataccactgacccaagtttcttttgttgtatatgatactacattatcaattccaagttctgattttttattatctaaaatttcaaaggctgattttaatttatcaaatgtatctattgaatcaggatcaattcctgctttatctaaaatttctttattatatattaacccatatccttcagtagctgcaggcattccatatacttttttatctactgtaacagcatcaagtgttcctttaacagcattatttatccatggctctgaagttaaatcatcaattttatgtttccaaatttcatagtctccagttccttgaattacaaaaatatctggttcagttcccttttgaaattcagcttttagggctgcaccataatcagctccacctcctacagagtttatttcaaattttacacctgtttcttcttcatattttttagctagtttttgaagtgggtcattgatttcaactttcatttgatatactttaattaatttaccatttccgtttgaatttgttaggtttccatcagtgtttgatataccacagcctgaaattgtttcgcaagttaaagcgaaaattgaaaatattgatatgaacttttttattttcataaaatatgcaccccttaataattatttgtagtgtaaatgttttcctaactacaataataattataaatggatttgtgtataatatatttcatgttattagcgtaagtattattaatttgtgatattttttatgttatatcgatacttattaggcgtttgtccataaactgctttgaatttgcttataaatgaagcaacgttaggaaatccattatctaaccctatttgagttattgaataatctgtagtaacaagttgcctgtatgcattatatagtcgtatactatttaaataatctgaaaaagtaattcccatatattttttaaaagatcgtgctaaatgctctctagataatccgtaataatttgcaacatctgcaaggattaaattttctttgtaattctgttctatatattgggtgatttttttaaatctatcaatatatttttggctttttatagtaatattaatatctttatttactttaaagtaagttaataatatgaatagtatttcatatataatagatttaacttttaaatagtaaaatccgcataattgatctttagaaattaggttaaaatctaaagttgtttgttctattttgtttttatacatattaagaagatcacaaagtagcttttttaaggattctttcataagttcattattatttataataaattcaatgttatctataccattataattatgtttcaaaaaagcataggaaatcataattgttatccctgatgaagagtcttcagcttttatgttaattccgtgaatatcaccactatttataattattaaatcattcttacatatattattacactttccatttatataacatgaaaaatttccatccgttaaataagttaattctaaagccttatgccagtgagttggtatatttccaccaaatttattatgaattattatttttgcaggtatgttttcattcatttctacgatttcatgtaaatatctcaatacttatcctccttaaaatgatgattagctatataaatagaaatatatctatttattacaattatgacctaaaataatctaataaacaaattttagttttcattgagataggtttttgatatagaatatatgataaatgtaatggaattaaaagtagaaagcatgaaaaagaaagagtgagatagttttagattatttgacagaaattaaaaaaagagttatcataaaagtaaattttaggaaaggagaatgatttattatgtgtataagaaattttttagctattgcaatagctccaaacaatgtaaaagtaagatgcattgcaaggagcgtaatcataaatcattcttcttttgaagtgtaaaaatctgattttatttaattgttattataagtttattttttatagacttatggtttgatttttgtacagatttttatttgatttatgattgaattttaaggagctgaaagcaatgaatctgctttcagctttaattttatacatttgtataaaaaacagaaggctgaaataattaagtcttctgtttttttattataaaattacattgaaagctattcattgtatcagctagattatggaggctgaaaaatgagtttattagaagtaaagaatttaacacatggttttggagaaaaggaattatacaaaaatataggattcgaattgtataagggagagcacatgggaattgtaggggttaatggagcaggaaaaagtactctcttaaaaatattaagtggtgaggttatacctgatgaaggtgaaataaagtggcagtcaggaataaaaataggtgttcttgatcaatatgcagagattattgaagattattcagtatttgaatatttaaaaacgtcatttaatgatttgtatgaaattgaagaaaaattaaatgtattgtatgaagaaatggcatttaaccagagtaatgctgttatgaaaaaagctgatgtttatcaggagatacttgaaaacagggatttttacagcattgatagtacaatacgaaaagtatcagctggtttaggaataaatgtaataggttttgataaaatattaaagaatctcagcggagggcagagggcaaaggtaatactggcaaaacttctccttgaacagcctgatttacttattcttgatgaaccaacaaattttctagacaaagaacatgttgattggctttcagaatatttagcagattttaagggagcgtttataatagtttcacatgataataattttctagatagaatatgtggatgtatatgcgatattgagtttaaagatgtaagaaaatataatgcaggatattctgaatatttaaagcagaaagaaaatcttaaagaagattatttaagacggtattcagagcagcagagaacaattgaaaaattagaaaactatattgcaaagaataaagttagagcatcaactgcaaaaatggcaaaaggaagacagaagcagcttgataaaattgatagaattgaagctcctacaatagcaagtgtaaaaccatccattacttttaaatattcagaaacattgacaaggacagttcttgatgtaaagggattaaaagtgggatataaaaattatgctattctacctgatatgaatttttcaataaataatggagaaaaggtagtcataacaggttttaatggaataggaaaatcaacattattaaaaacaattataggacaattaaatagtatcgatggagaaatatattttggacacaatgtaaagtatgcttattatgagcaggatctaaattgggaagatgatgaaaaaacaccgattcagattatttctgattactacccaaacttttcacaaaaggaagtaagaagtcatctttcaaaatgtggagtaagaaagaaaacacagatgcaaaagataaaaacattaagtggaggagagcagtctaaggtgaaactttgtattattacacttaaagaatgcaatcttttgattttggatgaaataactaatcatatggatgagcttacaaaagaagcattaaaagagtctttagtatcatttaatggaactgtagtccttgtatcccatgaagaaatgttctataaagactttgcagatagaattataaatatttcttaggatataaattatactagaattatattataaatatttatgtatagtaacttgaaaaacctgacagatagatgtcaggttttattagttataatgtaaatataataacaaattaaaatatataagtgaaagggtgtaatgtttatggaaagattaatatgtcaaagctgtggtatgccaatggaatcaaaagaggtggtagctactaataaagatggaagttttaatgaggaatactgtatttattgttataaaaatggggaatttactacacctaatgttactatggaagaagaaattgaaatatgtgtaccttttatgaaggaacatggaatgaatgaagatgaagctagaaaattacttaaagaaacatttcctaatcttaagagatggaaaaagtaataagaaagataattttataaataaagggagatatgttatggcatatatattaaatgaagttacaattagaactgataattcagaaaaaggaattcaggctattaatgaattgtggcaggatatatccattggaaagattcctattttatttgatagtgaacatgaatttcaaacagggatatctccaatatcaaaatacagtaattatgaaggtgatgaaagtggaaaatatgatctcactgtaatggctgtaaaatcagaattttttaagcatatggaagataaaattcatgaaagaaaatatgtgaaatatgaagaaaaagatgaaaatggtgatatttcagtatgtgcaaagaaagcttgggagagagtgtggaatgatcagaaaagtggttctatagatagaagttttacagaagattttgaaagtactgtccctaaggaatatacaaaagatggagcagcacattgttatttatatatagcagttaaataagtaaatttataaatattttcatatgaatttataagattaagctactggtgaaaattaaaaatacagtatagaaacaaggtaataaagagaacatttattactctatattaatataataatttcagaacatattatattaagaggatgatgaattatgccaggaagaggcaaaaaaactgtatttgttgatagaagtattaaaaagaaaaaagaaactattttgattgaagtagcaaaagatgctgaaataggagaatatgtagatggttttgaagtgataaaaccagtaaaaagatttggaaaatattatgtgaaagttaaaaataaataattatatgaagaaaaagaattgataagttttatatttattgattcttttttgtaaatataagttatacagaaggtgtatgagattaatatttacatattgatgctataatgaaagtaagtaattaagtttattaatatattagtataatgtatcattataaaagaaataaggagtagtagtctttattatgaaaacaaatgaaattgtaaacatggcaataacatatataatgaagcatattgatgaaaatattacaattggagatgtagcagagcattgccatttttcaaaatactattttagcaggatttttaaaaatgaaactggcgaaagtatatatggatttattaaaagattgaagcttgaacaaagtgcattccgtttaaaagtagaacgcgagagaacaattactgatattggatttgattatggatattgtccttcaaattatagtcaggtttttaaaaaacatcataatgaatcacccattgaatttcgtaataatatttttcaacattcagttaatcatccattttatccacatgctcaagtgaacatagagtcatttgaagaatgtagcagaaaaatttcaatagaaacaataaaagatcaatttgtaatttatgaaagacgaattggcaattataatgaacttatagaaaaatgggcagaattcactgataaatataagaaatatatagatgaaaaaacagtatttcttgaacgtacatttgatgatccttcaattacaagtgctgataaatgtatttatgatatatgtatgaccgttgataagaactgttatgtagaaaatacatgtgtaataccaggaggtaaatttgcagtgtatcattataaaggtttcccagagcagatttatactgcttatcagaatatgtttcaagtatggtttcctgtagtaaaaaaaagaatagacaatcgatatggttttgacatatataataagattgattgtgattccatgtatatggaacttgatatctgcatttcaataaaataagcaaaaattttcattttagtatttattaagcaagaattcataagtttatatttaaactcttttctataattgaatctgtaagatatttgtctgaatgtacaaatatcttacagattcaaatagaggggagttatttttatggatttagaaagtataagaaaaaataaagagggtatgattctgcaattttcaattccagcaattatagcaatggttttaacttcattaattactgtaactgatggattttttacaggaaattatgttggaaaggaaggaattgcagcaattaatataggacttcctattgtatatctgtatcttggattaggcttaatgatatcggtaggaggatcagttattgcaggaatgatgcttggtgcttctgaaaagaaaaagtgcaattctgtttttaatcaaacaattgctacaacagtaattataagtgttctattaagcttaataatttggattttatttgagccaatgatgaaaatgttcaatgttgatggattagtatcagaatattttaaagactattatatgattatgctactagaacttccgattatggtaattaacaatagttttggtatgtttataagaggtgaaggcaatccacgatttttcatgaaaattactatatttaatgttttaagcaacattgttttggattattcatgtattaaattttttgatttaggggttaaaggaattgcattagcatctcttatatcaacaggtatatgttttttgtggagtatatattattttgttagaaagtcaacagtatataagtttggaaaaatctcatttgatggagaaattctcaagagaacaatattcaatggcagttctgagtttattggagaaatgtcaatgagtatcactatgtatgcatacaatattgtaatacttaaaaatattggtgttgatggagtatctgcatttacgattgtaggatatgcagcttatttatttagcatgatacttattggatttggtcaaggtgtaagtcctctgattagttttacccatggagctgaggataaaaaaacagaaagagagcttaggaaaattactaatatgtttgtttttgtaactggaatagcagttattttagtaatgtttattacatcaggctggtacagtactgcttttgttaaaaatcaagaggtacaaaatatggttagatctggtgtgaaaatatttattgtatcatttttattttctggaattaatactatttcatcattttattttacatccattggaaaggcaaaggaatcagtaattatatcttctttaagagggctaattatattattaatattaatttttatattgcccaagatattaaaaatgaatggggtatggcttgttgctccaataacagaatttttaacattgcttgtaactatttattttataaagaaaaatgataaaacttatagttgtatttaaggggaaaggagttatggttacaatatcatgtactcaggatttatgcattgatatgagaaattagacagtattttttactgcctgatttgaacttaaggctaatgtaatagtaaattattatctgcatttctagtctgtacaaattttataatacttttttaggatgagtaaaagaatatataagattagtatttactgttttgaatttatagaaatattatcatataaatacagcttgaccttttttatacaatggtatactctaataatagaataaaatttatagataactaggggagcttttgctgagattggaataaattcctaaacccttatgacctgatttggttaagaccaacgtagggaagtgcagaattaattagttgattttaatatgtcaattttggtgcagtccttagggctgcacttttttgtattataaattagttgtaatcagtaattctatggaggagaagtattatggaaaaaagtaaggctcagaaaattgctttgagtggagttcttattggactggctgttatctttggaacattttcaattccaattggagtagctaaaatatctccaattcagcattttgttaatgtggtaggtgcaataactcttggacctgtctatgcactagccaatgcatttgtagcatcactcataagaaatattttgggaacaggaagtttgctagcttttccaggaagtatgtgtggagcacttatagctggaattctgtataagaagattaataagatttttgcagcagtaattggagaagttataggaacaggtttattaggagcattgatagcttatccaatagctaagttgtttatgggaaaagaaggtgccatattcatgttcgtgagtccatttataatgagttgcaccgttggtgcaattatagggtactttttcttaaagatacctatcatacaaaaaactttaattaataatgaagaaatacatagggaaagtataggaaaagtatgataattggcttttaatatattgttagttagaaagttttattatatattgataaataagaaaggacgatttttatgtttagagcattgacaattgcaggatcagacagttgtggaggagcaggtattcaagcagatttaaaatcatttcaggctaatggagtttatggaatgagtgttataacagctgtgacggttcaaaatactatgggggtttttggaatacaggatattaccccggaaataattgaaggacagataaatgtaatatttgaagatataagagtggatgcagttaaaattggaatggtatctaaaattgaatcaattaaagccatagcaaaagcattaaggaatgttgaaaatttacctaaggttgttttagatccagtaatgatatctaagagtggatttaacttattatcaagagatgctaaggatacattagttaaggaactatttcctcttgcagaattaattacacctaatctaccagaagcagaggaaatattgggtgttgagattaaaactgtagatgagatgaaagaagcagcaataaaacttatggaacttggacctaaagcagttcttgtgaaaggtgggcatttagaagatgatgctacagatttgttgtttgatggaaaaaactttatattattgcctcaagaaagattaaatacaactcatactcatggaacaggctgtactttatcatctgcaatagctgcaaatttagcgaaaggtatgactgttgaagaagctgttaaagcagggaaaaaatatataacatgtgcaattgaacatggttttgaattaggtaagggggttggtcctactaatcatttctatgaattatataaagagtcaggaagatatgaagaaatcacaggggaaaaggacaagtagtaattttaaataattaatattaaaaatgaaaaacaataagttcaaagtattactttatagattgacatcagaatttatttttattaataaaaaatattaattacagctagcatatgattttgataactaaaaagaaagaataaaaatctttaagtgttaattttatattctaaactgtaattgaataagtggaggaataaaaatgaattataaaacacagatggaagcagctaaaaaaggtattgtaacaaaggaaatgcaagtagtagcagaaaaggaaagcatgagtgtagaagaattaatgaaattaatggctcaaggtaaggttgttataccagcaaatgtaaatcataagtcaataagtccagaaggaataggagatgggcttaagactaagataaacgttaaccttggaatttcaggagattcagttgattactgcagagaaatggaaaaagttaaattagcaattgagtatggtgcagaagccattatggatttaagtaattatggtaagacacaggaatttagagaaaagcttatagaatattctaaagcgatgataggaactgtaccaatgtatgatgctataggatatcttgaaaaagaccttttagaaataaaagcagaagattttcttgaggttgtaagagctcatgctaaacaaggtgttgattttgttacaattcatgcaggtatcaatagaagaactgttcagttatttaaggaagataaaagaacaatgaatatagtatcaagaggtggatcattattatttgcatggatggagatgacaggcaatgaaaatccgttttatgaatattacgatgaattacttgatatattaagagaatatgatgtgactataagtcttggagatgctatgagacctggatgtattgatgattctacagatgcaggacaggttactgaacttattgaattaggacttttaacaaaaagagcatgggaaaaagatgtgcaagttatgattgaaggaccaggacatatggcaatgaatgaaatcgcagcaaatatgagactagaaaagagattatgtcatggagcacctttttatgttcttgggcctcttgtaacagatattgcaccaggatatgatcatattacatctgcaataggaggagcaattgcagcaacaaatggtgctaatttcctttgttatgtaacaccagcagaacatttgaggttacctgatataaatgatgttaaggaaggtataattgcctcaaagatagcagctcatgcagcagatatatcaaatggaataaaaggcgcaagagatagagataatgctatggccaaagcacgtcagaacctggattgggatgaaatgtttaaggtagctattgattctaaaaaagcaaaagaatattttgaaagtattcctccagaagaaaagcatagttgttctatgtgtggaaagatgtgtgctgtaagaactactaatatgattctaaatggagaaaaggtagaattaaagtaaataataataaaaggatgataaattatgaatatagatatagcacagaaggtagtagagctattaaatagattaaaaaataaaaaaccattgattcataacataactaattatgttacagtaaatgattgtgctaatatacttcttgcaataggtgcatcaccaataatggcagatgatttaaaagaatcagcagatattacatcaattgcttcagcacttgtaataaatattggtactttaaatgaaagaactatagaatcaatgattgcgtcagggaaaaaggctaatgaattgaatattccagtcgtactagatcctgttggagctggtgcatcatcatttagaaatgagacaactaaaagaattcttgaagaaataaaaatcagtgttttacgtggaaatatgtcagaaataaaatttattgctggattagagtctgaaacaaagggtgtggatgcatcagagtcagatttaaaaagtgatagtgatgaaggcataagagtagctaaatctttagcgaagagatttaattgtacagtagctataactggagtatgtgatatagtttctgatggagaaaaatctgttaccatagaaaatggaacaaaaatgctttctaatgttacagggactggatgtatgaccacagctttagttggtgggtatttaggagcttgcgaaacaaaagaagatttatttatagctgctgtttcaggaatagtatctatgggaatctgtggagaaattgcagaagaaagagctggaagtataggtcttggaagttttcatatggcaataatagatgcagtaagtaatttagatgaagaagatttgctaaaaagaagtaaaattaaataataaattgtttataaaaagtaagataattgtatatataatttgataggagtatgtaatatgaaacctaaaattgattatagtatttatttagtaacagatagagatttaatgagtacagaaacattagaggaagcagtagaagaagctataaaaggtggatgtacccttgtacagctacgagagaaggattgttcttctttagatttttataatactgcaataaatttaaagagaataacggataaatataatgtgccgttattaattaatgacagacttgatattgccttagcagtagatgctgccggagtacatattgggcaaagtgatcttccttgttctgttgtaagaaaagtaattggtgaagataaaattataggtgtttcagcaggaacgttagaaaatgcaattaaggctgaaaatgacggagcagattatattggtgttggtgctatgtatgaaactggaacaaagaaagatgcaaagcatacaagtatggatgaacttaaaaagataagagaaaatatatcaattcctatagttgttattggtgggataaataaagaaagaataactgatttcaatggcactgatattgatggacttgcaatagtttcagctataatatcacaaaaggatatatataaagccacaagtgaactaaaagacttattttttaaactaaaataaatctataaaaattctctatgattatatttttcatagggagttttttattgggtttcatgttgataattaatattatataatagtattaattattaacaatagttgtaatttatcatactttcaatgaaaaatactaaaaagaaatttgcaggaggtgaaaaatacggtaaaaacaagaaaaaaatatagaaaaatgtaaaaaatactagtataatcaaacaggaagttaaaactaagtcaatggggaggaagaaatggtaagcaataaaaaaagaagaacaatatttgttaaaatggcattaacaaatgtagttatattacttttatcactattttttgttggatatatttctcataaaaaatctaaaaatgcaatggaaaataatttggaaataacaagtttacaaattcttaaacaagcagataagggattttcagaatatttaaataaaatgacacaagaattaactatattaaataaaaatgtagatataaaagatttagaagatcctgctcaagattataaaaaaacacagcagtatgtacagtatgctttaaaatcaatcaaagaaagcttgagtggaattgataatgtatattattcagcagagcatggagctgtgattatagatagtgaaataacagatgagagtaaattatcctttagagataaagattggtataaaaaagctaaagaaaatactgataaattcatatatagtgaaccatatgtagatgcagtaacaggtaataatgtactaactatatctaaagcagttacaggatataatggagaatttattggtgttgttggaatagatattaacttaagtgaaattgaaacatatattcatgatgtatcattgttagattatggatatattgttattgctgataataatggtaatattgtaattaataatgaaaaaaataaaacatttggcgaaaatttaagtggatttgaattttgggatgctttaaagaacagtaatcaagaaaatacaaaatggactaataatggagaattaacatttgtattgcagactatagatgaaaaaactgggtggagaatagttggatttgttgaagaaaaggaaataacagagcatctttcttctataaaaaatacaatatttattgctgtagcagtattttttactcttggaattattgcatctttgattttgactaaaacaataacagagcaaattaaaaagataaatataggtgttagaaaaattgctactggtaatttaagagagagaatacaggtttcatcgaaggatgaaattcaagaactagcagaaaatttaaatacagcattagatagtatttcaggattattaaaggaaattgactctacaagtgaagaaatgtatgattcagcatctggaattgcatctatgtcggaagaaactcatgctgcagtttcagaagtggcaaatgctataaatgaagtatcaaatggatcaacagatcaagcaacagcaattagtaatgtaactaatactgttgatggattatcaaatagaattgatgatgtggataaaaatataaacaacatattaaatttatcagaagtaacagataagttaagtgatgatggattaaaagttttaaatttacttatagaaaaatctgtggtaactaaacaaaatactcaagaatctagcagtaatgtgaaagaaatgactgacagcataaagaatattaatcaaatatctgatgttatttcaggtataactgaacagacaaatcttcttgcacttaatgcatccatagaagcagcaagagctggtgagctaggaaaaggatttgcagttgttgcagaagaaattagaaaacttgcagaagaatctaaggattcaacagataaaataaaaagtataataaaggaagtaaatcagaaatccatacgatttgttgatagtatggaagaaacggttaatattttaaatgaacaagatgaatctatcaacaatacgaaaaatatttttatcgaaatagctgaatctatagagcctttagtagaagcaattagatatataagtaatttaacagataaaatgaataacgataaggaaaatgttaaaaaagaaatagataatatttctgttatatctcaagatgtagcatcagtatcagaagaagtaacagcatcagcagaagaagttactgcaacaatggatgaacttacagaatatgctgacaagcttgatggaattgcagaaaatctaaaggaaaaattaaataagtttgaattatagaaaaattcattagagattttataaatttaaatatataaataaagcagaactattgtagtattattagttctgttttgtttttatataaacttatatattaaggataattttgtgattaaatattgtttaataaattatttttatatagtaaatatatggcttaagtgtttaagaacctaaaaagttggtatatactatataatagaaaattatatacataaataatgaaatgtaaatttactagatattaaatagaatccatattataagagtataaaataggaaaggtaaagagcattgaataatagagaaaaaattttttatgcactaaaaaaatattatggttttgatactttaagaggtggacagtatgaaattattacaagtattttaagtggtcgagatactttctgtttaatgccaacaggtggaggaaaatcactatgctatcagattcctgcaatactattttcaggtattacaattgtaatatcaccattaatatcattaatgaaagaccaagttgataacttaataggttcaggaattaaaggagcttatataaatagtactcagaatttggaaacaataaaaaaaatactttttgaagcatctataggagaatataagataatatatgtttcaccggaaagactagaatctaaaatgttttttgatatgattaaagatattaatatttctcaaatcgctatagatgaggctcattgtgtatcacaatggggacatgactttagaaagagttatataggaatttcaaaattttgtgatatattaaagagcaagccagttatttctgcattcactgccactgctactcaggaagttcttgaggattctataaatttattaggattaagaaatccttatacatataagggtgatataaatagagaaaatttaagacttgctgttttaaaagaagtagataaacttgaagaactaaaagatataataagagagaatgaagaaaaatcaggaataatatattgctcatcaagaaaagaagtggatatgcttcaccattatctaaaggatttgggatataatgttggaaaatatcatggtggcttaagtgatgatataaaagaagaaaatcaggaagattttttatatgaaagaatagatataatagtagcgacaaatgcttttggaatgggtatagataaatctaatataagatatatagtacattttactattccacagaatatagaatcttattatcaggaaattggtagaggtggtagagatggagaactgtgcaaatgctatttattttattcagaaagtgatataagcagggtagaatacataataaataaaagttcagcaatgaacagaagagaagttcaacttagaaaatttcaatctatgattgattactgtaatcttaatgattgttacagaaaatttatattaaactattttgggaatgaacgaaaattaaattattgcaataattgtgggaattgtttaaatgattcagaactaaaagattttacaaaagaaactcagatgatattgtctactgtatttagaactcgtgaaaaatttgggatttcagtgttaattgatgttctaagaggatttaaaggtcctaaaataatacaaaataaattagatacagttactacttatggaataatgaaagagtatggtagtggatttattaaaaatttaataaaaagtcttttagaagaaggatatgttggacttaaagaaggaacttattctatgcttaaactcaacgcaagatcaatgaatgtattaaaaggaaaagaaaatgttatgtttaaaattattgatgaagatgagccggttttaaatgaggaattatttgataaattaaaacagtggagaaaaatgaaagcttataaagagaatataagaccatacataattttttcagatgcaactttgactgcaatatgcaatactaagcctaaaagtattcaagaattaatggaaatacgtggtgttggcgaaaagaaaataaaagcttatggagatgaaatattattattaataaattagtagtactgtaaggaagttgttaagttaatggtttaatagtatgtttaaattactacacagcacattttatttgtgttatgtagtaatttttttatagatgagaaagttctgctcttgttaaaaaatctaatatttcagaactatttaagtatacatcacctataattccatgagctctatgtttttcgttaaatatatgaaaatccgagccggctgtataaaatagatttttttcttttgcaatatttataaaaaagcgtgtgtctttttcagtgttagaaaaatattttgcttcaatgccatcaaaaccaagttttattatttctttaaagtcatctgttggtaacaatacaggatgagctaaaacaacattagcaccaaaaaatcttagtatttcaatgccgttttcaacacatatgttatcacgtctataatacgttttaatatatccatgtagacatttttttatttcacctatcttatgactttttacacactttaaaatatgaataagaagatcatcgttatagctttcatctttaaagtaacctaaaatgtgaaccctcgtattattgtatcgagttgataattctacaccgggaataacttttatacctatattattaccatatgatattgcctcgtttaatccctgtgttgtattatgatcagtcaaagatattatatcaacatttcttttttttgctatatttacaacctccttaggggtgcaattgccatctgatgcagttgaatgtatgtggaagtctccttttttgtacattataaaaactcctgaaaatgttctgcattttagtatatgaaaaaaattatcatctagggacaaattagatgataatggttatgaaaggattatatatagtaatagaatttatagtctaaataaatttaaggagtaagaattaaaattcagtatttaaaaataaatatgcatatatagaattataaatatataaaaataaatggaatataaaggataatgaagaaatgaagagggtttgactagtctaaaatatcaatgttttagaaaaaatattgtagggggtaccccttactattagaaggattggacaatatcatataggaattacacggattgtatagttatacagagttatttatagataatctaaacttataaaattatataaagattattaagtgttgaaaagtgtcgaatacatgttactatattacacatagctacttcaaaaaacttcaataaatgaaaattaattaaataaaaaggagtaaatgaaagtaaaagctaaaaagacgcaaaaaggagaaaaactaatgaaaaagacatttttgaaaaagatgataagtgcaggtattatagcggcaacaatgtgtactatggcaccattaggagtatcggcacttgaaaaagaagtatcttcaaattggaaacaatcatcagattccacatggagctactgtataggaaacactccagttaagggttggaaaaatatatcaaatatctggtattactttgataataacggaaaaatgaaaacaggttggataaatgatgctggaaagtggtattatgctgataatacgggagcaatgcagactggcatattaaagatttcaggaaatgtttattgtctaaataaatcaggagtaatgcaaacaggtagtgttaagataggaaataaaaattatcaatgtaatataaatggtcaagtttcaggtggtgaaacacctaaagttgataagggatttgactcaaacaataatttgataaaacctaatgaaaattcaaataaaactgaatcaactggcaacagtggaagtacgaacaaacctactgctactgaaactgataaaggttcgtcaacaaatagtaattcaactgtaaacaattcaacatcaaataatgtatcatctggtgacaatagtgtaacagttagtggattacctcaattatcagaaaaatatagtgttacagtacaaagcaatgcagaaagcaaaatacttgagcttatgaatgcaaaaagaacagaagcaggtttaaaaccattatcaatagattatacattgcaaagtgttgcaagatataaaagtaatcatatgatacagaatggttacttcaatcatgtgaatccagatggaactaaatggactaactggcttaacacaataggatataaatataattctacagcagaaaatatagcatacaatacaaatgatccagtagaactatttaaccaatggtggaattcagcaggacatagagaaaatatgatgaatccttcatatactaaagttggtataggtgtacttttaggtaatggaaaatatatgggtacacaaacatttgcaggttaattagaaataaatagagtacatcccgaattattaaagattcgggatgtatttttataagttttagataagtatattagtataatttcaattcagataataataaattattttttgaatattgtgcatataattatatctgatccatcataagtattatctgattttaattttatttcaggcagtatatcttgatttgatatatttatacacaataaatccccttgttctatgtgaaatttttgtgagtctatttcgcatagaatatgttcttttaaagaatgtatacagattgaaataagagtactattttcaggatgactatagttaatattaataatattattattgattagatttatatgtgtcaatgttccatcatagtttttttgagtcattaagttaagaacagaacatcgtccttcagttgatgtgtcccaatctcccataaaaaaatcttgatcaaaagtttttaataatttagaatacttttctttgtgagttaatatcatttctccatctgttaccataaggtgtctttttatggatggaagattactgaagatcgaagtatcaatatctattttggcacatcctattctccataaaaaatctctatttgcaaatgaagaatctattggatatgtaataagttcagatgccattcctccagaccagtatgttggtgtgtagtctatatttttgattaagtttatattgtatgtcaaaatatttaccccctcaaatatgatagtttcatatattatatcactagtgcataaagttaacattaactatatacactaattctgataatataaatgaaaatatgataaaatagtaaagagaagatttaataaaatattacatataataaacagaggagtggatttcatttgattaaacttattgcatcagatatggacggaacattattaaatagcaagcatgaaattgcaaaagagagtgtagaagctataagaaatgctgaaaattcagggattatatttgcaatttctactgggagagagtatgacaatgtagagccatttctaaaaaaacataatataagatgtcagtgtgtacttatgaatggagctgagtatagagatgaagatggaaatattgttgaggtaataaatatagacatagaaatagcatctaaaattatagagatacttaataaaaataaagtatctgctagaatatttacagataaaggtgtttatacgagtgatacaaaagaagaagcattaaaagaaatgacatatagaacaatgtcttttaatcctaatatgacattagatgaggcaacagaggaagctaaaaaacagccatattttattcagcttaaatacatagataacattgaagagtttttaaatagtggaatagaaataagaaagtttgttgcttttcatagtgatattgaattgataaatgaaatgaagagtcaaataggaaaacttacaggaattgctgtttcatcatcatttgttgataatattgaagtgactcatatgacagcacaaaaaggtataattttagcaaaagttgcacaaaaaatgggcattgataaaagtgaagttatggttcttggagatagctttaatgattactctatgtttgaagtttttgaggaaagtgtagctatggaaaatgcggtcccagaaataaagaaaatagctaaatatataacagatacaaatgataatctaggtgtagcaaaagctataaatagagctgttgaggataataaaaaatgtaaataaattaataaaaaattctgagatttattttttaaacctcggaattttttattgatttataaattagaaaatttataaatagttgtatgttcatatttttacctatatcagtaccatcagggaaattgccactataaaattgaactccaggctgtgtagtatacatatcaataactattcctgtatcttcagaaagtgcttgagcagctatttgatttaatatattgccagattcatgtccagataaattaaaataaaaattgttggtaaggttgattatagtatctgaatcgcttacagatgaataatgaatttctaaagaattataatttcctaatgtatattccactttaatatttaaatttcatggataaccttcttcaccatcattactgaagtatgataattttaaacaattatgattttttatttcatcattccagattactttatcatagccatgtccaccatgaagatgattagtcccatcattaattggaagtgagtattctttattattgagattaaactttccgtgtttaattttattaccaaaacgtcatattaatgcactccagttaagtagctgttcagattgtcgtaaccaagtaaaacatctattaaatttccacttttatcaggaaccatacatgaaactattgtcccatcataatttgaatttttaatatgaattttagttgagttttctaaagtgtagatatatattttttcattattatttattgtatcaaataactttttacttattgacattaataatacctcctaaatttatatattgaatagattatgaacgagtattataatgcaataatattgtacgtacaataaataattagagagaaaaacaagcaaaagaaaactatttctgataaaatataataagtaatatattgtaaaaaattcaatttaaagggtgttgtgtgataattatttgtttaataaagcgtattaataaaagtaggagtgagaaaggttatgtggaagttaattattgcagatgatgaacctaaaatacgaagaggattaagaaaaattcttgaatggaacaagtttcatattgaaatagcaggagaagcggaagatggggaaacggctttagagttagtaatagaaaaagaacctgatattattctgttggatattaatatgccatttttaaatgggctaaatatgttagaaaaattaaaagatttaaataaaaactttattataataattattagtggatatgatgacttttcatatgcacaaaaggctttaaaattaaatgtatttgattatattttaaaaccagtaagtaaagaaaatatggaaagtataataactaaagcagtattaaagttaagaattaatgatgaagaaaataaatatggacagtgggtaaagaaacagcttcatgaaaacatggatcaattaaagcgaaatttttttgttgaatggtttcaaaataagatcgatgatgatgaaatgataaaacaaatgaaatattttaatattaagttcggtaatagcgtagggattattataatacaaataattgataaattaaatattaatattatgaataataagtggaatacagaattaattgaatatgctataggaaatatgcttaaagaaatttttaaagaatcagaatcaattattgtatttagtgatgataataagaacatcatacttctcataaataagatagatataaaatattggattaaaactaagaatgaaatagaatcaaaaataaagacatatttaaagtgtgatgtgataattgaacaggataatacagaggatgggattttaaaagcaaaagatttacattttaaacttaaaaataagataaaaaataaaaatgaattttcatctctggtcttatcagcagtaaattatattcaaggaaattattattataatgatttaaacataaatgatatatcagataaattagaagttacatcttcctatttaagtaagatattaaaaaaagaaactggattatcatttatagattatttgacaaatacgagaatagaaaaagcaatgaatatcatgaaggacccaagtataaaaatttatgacgtagcagaattagttggatatagtaatcaacactatttttgcagagcatttaaaaaaataacaggtatttctccaacagaatataagaaagggaaatagttatgaaaataaaagaaagaataatatatattttttttataataatctttatactttctatagttactttcagtgtatatgtcaataaaattcaagttggtaaaaataaaaaaattctaataggaatgtctcaggcaaatttatatgaaccttggagagtttatatgaatagtgaaattgaagaggaatcaaaaaaacatggtgatgttcaagtaatatataaagatgcaggaggagatacggaaaaacaaaaacgagatataaatgatttaattgattttggggtggatttattaatagtgtctataaatgattctactgaattgactccaaaagtaaaagaagcctataagactatacctgtaatagttttagatagagctgttgaaggctatgattatactctttatataggttcacatataaagtcaataggtgaacaagcaggagcgttagtagctgacttagcagataataaaaagttaaaggtagtagaaatacaaggtttacttaattctagtccagatagagaaatgacagaggggtttaaagaggtacttaaaaagcatgataatatttcaatagatagaacaatagtagctaattggcaaaaaaatgagtcacaagataagcttcaggaaatattacagcaggatcaaaatatagatgtgatttttgcacatagtgattatatggcattaggagcttattatgcattaaagagtatgaataaaaatgatgtaaaaataataggggtagatggtcttcaaggtgaagaaggcggaatagaacttgttaaaaatggaatattagaaggcacatttacatgcaaaacaggagggaaagaagctatccagtatgcaataaagatattgaataaagaacaggacattcctaaaaagatactattagaatgtaataagataactaaagactctttaaaataaatataattactaaaaatcagaaaagtatacaaaagtgctgatttgtataaatacaaaatatgacctaggatatataataaactcatgaaaacgaaatcattaacatttattattttaaagggggaaattaaaatgagatttaaaaaggtgttatcattagtagcaagtacagttttgtgtatagggatgctttcagggtgtggtggagcagcaagtactagttcaggatcagctagtggaagtggaagcgcagatgcaggtggaaagaaagtaattggttttgcacaagttggtgctgaaagtggatggagaactgctgaaacagattctattaaatctattcctacattagattcaaattttgatttgaaattctcagatggacaacaaaaacaagaaaatcagataaaagcaattagatcatttatagctcaaaaagtagacttaatagcattagatccagttgttgaaacaggatgggatacagtattacaagaagcaaaagatgcagatattccagttgttattgtagatagaagtgtacaagtttcagatgaatcactttataaatgcttcttaggttcagacatggaagaagaaggtagaaaggcagctcaaatagtaatagatcaatttggtgcagatgctacattaaacattgcagaacttcaaggaacagtaggatcaacagctatggttggaagacaaaaaggatttaatgctgtaattgaagaaaaagctccaaactataagattataaaatcacaaacaggagactttactcgtgcaaaaggtaaagaagttatggaagcattcttaaaatcagatggagcaaatattaatgtattatggtctcataatgatgatatggcagtaggtgctattcaagctattgaagaatatggattacaaccaggtaaagatatatacattatttcatgtgatggtattaaagatatgtttgaattaatggctgaaggcaagtctaatgcaattgttgaatgtaacccattattaggacctcaattattagaagttgctcaaaagatattaaaaggtgaagaagttgaaagaaatattaagtctaatgaaagcacattcttacaaaaggatgcagcaactgaattaccaaatagacaatattaatatttaaagaaacataagagcagaagattatgaatctatgctcttatgtttacagttaattagtacgtacaagttgataaagggagtgatattaatgagtaattcagatatagttttagaaatgaaaggaataagtaagttttttccaggagttaaagctttattaaatgttgattttacacttagaaaaggtgaaattcatacactcatgggtgagaatggagcaggaaaatctacactaataaaggtacttacaggagtatatgaaatagatgaaggaacaatagcattaaagggaaaacaaataaagatatcatgtacgcaagaagctcaaaactatggaataagtacagtttatcaagaagttaatttatgtcctaatttaacagttgctgaaaatatatttataggtcgtgaacctatgaagaatggatgtataaactggaaaaagatgaatgaggattcaagtaaattattaaaagaaagactaaatttagaaatagacgtaaaaaaacaattaagcaattattcagtagcaatacagcagatggttgcaattgcccgtgcagtagatatttctaaaggaattttaatacttgatgaacctacatcaagtttagatgatcatgaagtaaaacagttatttaaaataatgaagaaatttagggaagaaggaatgtcaataatatttgttactcattttttggatcaagtatatgaggtttcagataaacttacagttttaagaaatggagaacttgttggaacatatgatgcagataagctttcaagaattgaattagtttctaaaatgataggaaaagattatggtgaaattcaaaaaactacaagaataaaaaaagaagaaaataaaaatttgactgaagaaatagtgagtacagataattttggaagattaggttcaataaatccttttaaggtgataattaaaaaaggtgaagttataggatttgcaggtctgcttggatcaggaagaagtgaatgtgctaaagttatatttggagtagataaagctacaagcggaacaataaagattaatggaaaatcatattcttatatttatccaaagaaagcaattcaagaaggatttggattctgtccggaggatagaaaaattgaaggaattataggagatttaactataagggaaaacattatcttagcattacaaggtaataaagggatatttaaatatatacctatgaaaaagcagcaagaaattgcacaaaaatatattgatttacttaaaattaaaactccaagtatggaacaaaaaataagtaatttaagtggtgggaatcagcagaaggtaatacttgcaagatggcttgcaacagaaccaaagttcttaatattagatgaaccaacaagaggaatagatattggagctaaaaatgaaataacagaattaatattagctttagctaagcaaggtatgactatattatttatttcgtctgaattacctgaaatagtaaaatgctgtgatagagtaattgtattacgagatagaaatgtaataggagagctggttggtgaagaaatagaagaagctaatattatgaagactatagcaggggaggcagtttaaatgagtgaagctaaaaaagaaaatatatttataaagttctatagttctaaaattttctggccgttaatcagtttgttagtattacttttatttaatttcattatgacaccaagctttttgagtataagtattaaagatggacatttattcggaaacacaatagatatattaaatcgtgcagctcctcttattttagtatcattaggaatgactcttgtaattgcgacacaaggtattgatatttcagtaggatctattatagcaataagtgcagcgctgtctgcaacagttatagttgctggtggttcagtaccaacagcagtaatagtgggtattgcagcaggtcttttatgtggtgtatggaatggatttttagtatcatatataggagttcagccaatggtaggaacattaatcctatatattgtaggaagaggtattgcacaattaattactggtggacaaatattaacttttacaaataagagttttatatttttaggaacaggatatatagttcttccagttgctatatttattgtagctataatttcaatagggatgtatttactaattagaaaaactgcattaggattatttattgaatctataggtgtaaatagtaactcatgtaaatatgcaggactacaatcgaaaagagtagtgttatcattatatattatatgtggaatcctagcaggaatagcagggataattctttgtgctaatataaaaagtgcagatgctaataatgtaggattatggttagaattagatgctatacttgcaacagttataggtggaacatcaatggcaggaggtagattctacttaggtggtactatagttggggcactgtttattcaaactctaacaacaacaatttatagcttaggtgtgccacctgaaataacacaagttgttaaagctattgttgttatagcagtatgtataattcaatcagcagaatttaggaaaatgcttaatatgaaaaaatcctctaaatcaaaggtagaggaaagaaaggtggctgaagcatgaatactgcaataaagaaagaaaagaagtttaagttaaataaagattatatagcaatttatgcgactataggattatttgcattactatttataatagggtcagttttatatagaggcttttgtacaactcaggtctttgctaatttatttattgataatgcttatttgattgtagtagcgattggtgaagctgtagcaattttaactggaggaattgatctttcagttggtgcaatgattgcatttgtgagtatgattacagctagtttattacaaaagggtgtaaatcctgtattagtaataggtatagttcttttagtaggaatagtatttggtacagttcaaggatttttaatagaaaagtttaagttacatccatggatagtgactcttgcaggaatgttttttgctagaggttcaagttacattataagtatagatacaataatcatagataatccgctattttgtaaaatttcatctatgagaataccaatattaccaaaaacatttatatcagtaaatgttgttataagcttgattgtgttattagcagcaatatacatgttaaagtatactaagtttggtagagctgtatatgcaattggtggaaatgaaaactcagctaaattaatgggattatcggtttcaaagactaaagttcttgtttatactttcagtggattctgttcagcattaggtggattattattcactatatatacactttcaggatatggattacactgcaatggtatggaaatggatgcaatagcagcttgtgtaattggaggtatattattaactggaggtagtggaaatattataggaccattatttggtgtattaacaacagggattattcaaagtcttataatgtttgatggaacattaaattcttggtggactaagattgctgttggtatgttactattcatattcatagtattacaaagagtaatagtaatatatgatgaaaaaggcaaaactagtatagcctgatagttagagtgtgtttattagaaaataaggtgtagaattttactataaaaattctacaccttattttaatagataagagcagatttatataagttgaattaaattaaataaaatagtagaatttagtaataatagaagaaagtacaatttaatatagtacttaataattgggagggagaatgttaaaagagttaaaaacatatttttttaataagagtataggtattaaacttataatatattttttaggtattattttactgctaactataacaataacagcatggggaaatatgtcttatagaaaatctattaatagttcacaaaatgaaaatacgaatcaaataattactcaaataaataataatatcgatttttatgtgaaagatactgaaaagatgattaactatttatcaaaggatccacgtattttagaatttcttgaagataataaattagataatgacgatttagaagattgcgcatatgacgccttatataattgtacaagtcttaatcaagagattgcaggaataatgatagtaaatagaattggtggatatataagtgatgttatgaacaaagtatcaagagattcattattaaatgagaagtggtataagaattcctgtggtgatccagagaaaacgtatattcaaataaaaccagtaggaagaaatataaataatatatttaagtatcctgctgatgaggttttttccatgtctaaagcaatagtagataataaaagtaaagaaattataggggttatacttgttgatgtaaagttagatgtaataaggaatgtaattgagaatgcaaaacctggtactgcaggatttatatatattatggatgatgaagataatgtggtgtatactccagtaaataaaattgtatatagaatagataatgaatggttaaaagatatagataataatataataataaaaaagattgaaggagaaaattaccagcttactaaagtagtatcagattatagtggatggcagactataggagtatttccagaaaaggaaagtcttcatgtgataaaggatatacaaattcagtctttatgtgtgggtatattaggaatggttatatccataattttagctataatgtttactagaacaatagttgagccgattcagaagctaaagaaacttatgagaacagcacaagaaggagatttaacagtttattttaagactaagtataatgatgaaattggagagttaggcaattcatttaatacaatggttaaagaaattgataatcttatgaatcttgttcaaatagaagaaaagaaaaaaagaatagctgaaatgaatgtacttcaagcacagataaaaccacattttatgtataatacactggatactataagatggatggcggaggataatgatgaaaaagaaatagtagaaataatagaagcatttacaaatttacttagaataagtcttagtaaaggaaaagaaataataacagttagagaagagatgaatcatatacttagctacctgacaatacaaaaaatacgttacgaagataaactagattatgaagttaactttgaagaggaaattttagattataaagtaataaaattaatattgcagcctcttgttgaaaatgctatttatcatggaataaaagaaaaacgtggaaatggtaaaatagtagtacaaggaaaaataaaagatggatgcttggtatttttagtagaggatgatgggaaaggtatagagtcagaattattagaaaaaataaataacaatctaataaaccacaaaatcgaggataataaaattgggtatggaatatttaatgttaatgaaagaataaaacttagatatggcgatgaatatgggcttgaatataagagcatttatggtgaagctacaattgtagaagtaaagcatccaataattgaatgagaaaacagctgtaatcattgggtgattacagctgttttatttgtaaggagtttatatataaattaatttaaggggtatataaattaattcattatagcttattttgttggtatattatttccaagcaacgcttgaaaattttaattcatttttaaatgttgataatttagtatcattgttgattacaacacattcaattcctaccatgtcagcccagtctactaactgttcttcagtaagtgcaaatgagaaacttgtatgatgagctcctccagccataatccaagctttagctccttcttttaatgaaggttgtggtttccaaagtacacttgcaactggtaaattaggcatgtcctcagtcatttcaacggcatcaacactattaacaattaatctgaaacggttacccatatcgattaatgaagctgcaacagctggaccagaagctcctttaaatacaagtcttgcaggatcttctttatctccgattcctagtggatgaacttcaataacaggtttagttcctgcaagtgttggacatacttcaagcatatgtgctccaagaattaatccgttgtcagaatcaaggttataagtgtaatcttccattaaaccagtagcttttccttcagccataattttcatagctctaagtaaagcagcagttttccaatctccttcagcaccaaaaccatatccttcagccattaaatgctgagcagctagtccaggtaattgttttaatccatgaagtgcctggaagtttgttgtgaaagcagtgtatccgcctttatctaagaatgttctaagaccaatttcaattttagcttgttcacgaattgaatttacatcagcttttggatctatatcataaagatcagagtaaattgccataagttcatcaatttgatcttcagttactttttccattgaattaactaaatcaccaacactatagtaatctattgtccagccgaattttatttcagcttcaattctatcaccatcagtaacagcaacatctctcatattatctccaaaacgagcaactttaatactacgtccttcagtgacagcaacagcaggagccatccacttagaaatgtcttcagctacataatcgtcactccaatgacctacaactattttacgaggtatatcaagtcttgcaccaatgtatccgaattctctgtcaccatgtgcagcttgatttaaattcataaagtccatatcgattgtgccccaaggaatctctttattaaattgtgtatgaagatgaagtagaggttttctaagttcagttaggccatgaatccacattttggctggtgaaaaagtgtgcatccaagttataataccagcacaattctcattcatatttgcttcattacatacttcttgaattgattttgagtctgttacaacttttttgaatacaattttataaggtagtttttttgaatttaatccttcaacaaccttttttgaattatctgatacttggtcgattacttctgggccatataaaggttgacttcctgtaacaaaccaaaactcgtaattttttaactttaacattatacattcctcctattgctttctcatatttataaaaagtatacatttacatttaattaaaaattattcatgtatgtacaagtaagattatagtacaagtttattgtgcatacaagtgttatttttggaaataattattttttcaaaaaatagttaaattttcatcggaaattctttggcgataagtatagataatatcttggtttaagatatattggttaatataaatataaattttatataattaatatcttataaaaaactattgatttggtaatattttagatatataatcaaatcatcaagtgcatacaactttggaatttatattaaagttgagtacactttattatgatggaagtagttgattatagtgaaacaagttgaaacaaagcatgaaattatagaaaactactatataaaccttatagaaagcaataaggtttcagccggagaacaattaccatctgaaaatgaaatagcatcattatttaatgtaagcaggcacactgtaagacaggcgttgaactatttatcacaggagggatggatatataaggaaaggggtaagggaagtttcttttcaaatagaaaagaaaaaaagagaaatgtagctgtccttacaacatatatatctgattatatattcccaagaataatatcgggtatagaagaggagcttagaaaaaaaggctataatctattattgtttagtagtaataatgatatggaaaatgaaaagagttgccttgaaagtatagttaatcaagatatttcaggtttaatacttgaaccatcgcaaagtagtattaataatctgtcatatgaaagtatagataagcttaaacaaaacaatataaaatatattgaaataaatgcaaattgtgatgaagaagaatctgcttatataatagttgatgatgaacaaggtgggtataaattaacgcattatttattagaacttggacatagaaatatagctgcattattaaaagtagatgatttgcagggagaaagacgtagaaaaggctatataaatgcattagatgaatataatataaagtttaataagtcaatagttggtgaatacataactgacaatagagacatgtatgttgatcaatttgtaagaaatatattgaaattggaaaaaagaccaacagcaattgtttgttataatgatcagattgctcttagagtaattaataatttaagaaaagaaggcattacagttccacaagatatatcaatagtgagttttgatgattcatctttagcagtatcatcggatgttaaacttacaactataaaacatcctaaaaaggatatgggaagacaggcagctaaatgtattattgatatgattgaaggtagaattgaaaagccacaatatatatatccggcagaattaatagttagagattcatgtaaaagattgtaaaaaagtacatatgataatgcatagttaggggatatgagcaaataaaattgtatatgtttttaattgtgcattaatgtattttaaatatattaatatttaaataatttttattacgagaacttgtacgtacataatatcgacaagttatgtgatttctggattttcatctttggaatagagaataataatgaaagtaataattatccatcagtattgtggtatcactaagcaaatatataatgcttgtgtaaccgtatactgatatggagttatatataaattgaagaggggaatgctatatgttagaagaattaaagaaaaaagtatatgaagctaatatggagcttcaaagaaaaggtcttgtaatttatacttggggaaatgtgagtggcattgacagagaaaaaggattagttgtaataaaaccaagcggtgttgactatgatactatgaaagctgaagatatggttatattagatttagagggaaatattattgaaggaaaatataagccatcaacagatacacccactcatcttgttctgtataatacctatcccaatataggtggagttgtgcatacacattctgaatgggcaactacatttgcacaggcagggatttcaataccggcatttggtactacacatgcagattatttttatggagatattccatgtacaagagatttaactgaaaacgaaataaatggggaatacgaaaaagaaactggaaatgtaattattgaaacaataggagaaaaaaatcctcttgaaattccagcaataattgttaaaaatcatggaccatttacttgggggaaggacccagacaatgcagtttataatgcagtagtattagataaagtggcagaaatggcttataaaacaatgactttaaatagaagtattgaaagtgttaatcagattcttttggacaaacactatcttagaaaacatggtgtaaatgcttattatggtcaaaattaaaaataattaaatataaatttaaatataaatttaaatataaatttaaagataggagaacagtaaaatgagattttttttagatacagcaaatgtagattatattagagaagcaaatgaaatgggggttatatgtggagtaacaacaaatccatctttggttgcaaaagaaggaagagattttaatgaagttattaaagaaataacagaaattgttgatggtccaataagtggtgaagtagtaagtgaagatgcagaaggaatgataaaagaaggaagagaaattgcggctattcataaaaatatgatagtaaaaattccaatgacagcagaaggtcttaaagctacaaaagttttatcaaaagaaggaataaaaacaaatgtaacattaatattctcagcaactcaggcattgcttgcagcaaatgcaggagcaacttatgtaagtccgttccttggaagagtagatgatatatcaatgataggtatggatttagtaagggacattgcagaaatattctcagttcatggaataaaaacagaaataatagcagcaagtgtaagaaatccaattcatgttatagaagcagcgaaagcaggtgcagatatagcaacagttccttttaatttagtagagcagatgatcaaacatccattgactgatcaaggattagaaaaatttaaagcagactgggcagcagcattcgggaaataatctcaaagaaaaatttttaccataatcttaaaatcataattgaaaaatatttatataaataaaaaataagttaagaaatgaggaagaaaatgagtagagaattagatcagttatctataaatgcaataagagtactttcagcagatgcaattgaaaaatcaaaatcagggcatccaggacttccacttggttcagcatcaatggcttttacactatggagtaaaatgaaccataatggaaagaatccaaattggcaaaacagagatagattcatattatcagcaggccatggttcaatgcttgaatattcattattacacttatttggatatggactaacaattgaagatataaagaacttcagacagttaggaagtcttacaccagggcatcctgaatatggacatactaagggagttgaaattacaacaggtccacttggacagggaatatgcaatgcagtaggtatggcaatggccgagagctatcttgctaataaattcaataaagataattataatgttgttgaccatcacacttatgctatagtaggtgacggatgtcttatggaaggtatttcaggagaagcatcatcacttgcaggaacactagaacttggaaaattaatagttctttatgattctaacaatatttcaattgaaggaaatactgatattgcatttagagaagatgttgcaaagagatatgaagcttatggatggcaggtacttaaagtatccgatggaaatgatattgatgccatttcaaaagcaatagatgaagcaaaagctgaagttgttaagcctacattaatcatggttaaaaatgttataggatttggatgtccttcaaaacaaggaaaagcttcagcacacggcgaaccgttaggtgcagataatataagagcaatgaaagaaaacctggggtggaaacctgaaccagatttttatgttccagatgaagtatacagcaatatggatgaatatataaaagaaggacaggctaaggaagaaagctggaatgatttatttaaagaatacaacaatgcatatccagaattagcatcacaatatgaagaatggatgagtggaaaggttaatgttgaagctttagaaagtgaagaattctggagttttgataagtcaatagcaacaaggcagtcttctggaatgttgataaacagacttgcagaaataattcctaatcttattggaggatcagcagatttagcaccttctaataagactaatatggacagcaggggagatttttcagcagaagacagaagtggttcaaatcttcactttggagtaagagaacatgctatggcagcaattacaaatggaatccaagctcatggaggattacagacatattgttcaacattctttgtatttagtgattacatgaaaggtgcaatgagattatcagcacttatgaatcttccagtaacatatgttttaacacatgatagtattggtgttggcgaagatggtcctactcatgagccaattgagcaattagcagcccttagaagtatgcctaatatgactgttttcagaccagcagattctaaggaaacagcagctgcatggtattatgcagtaacaaatggaaaaactccaacatcgttagtattaacaagacagaaccttcctttatacaaagaaagcggaaaagaagctttaaaaggtggatatatattaagagacggcactaaggaaactccagatgtaatacttatggcatcaggttcagaagttgaattaatatataaagctgcagatgaattagaaggaaaagggataagtacaagagttgtaagtgttccatcatttgaattgtttgatgctcaagatgaagattataaagaaagtgtaatgccaaaatgtgttagatcaagagttgcagtagaagcattaagttcatttggatggcataaatatacaggacttgatggagaagttatttcacttgatacgtttggtgcatcaggacctgctgataagttatttgaacagtttggatttactgttgaaaatgttgtaaatacagcattaaaagtagctggaaaataatatagatataaaaaatatgaaaatctaaatttatgataaaagttagatatacttatattgagtaaagtaataaagagatataggaagaacagaaaaagatatatttgaagcaggtctgcatctaataaaactatttatttgcatgacttgctttcactaaaataaacagttatatagtggaggtaatgttatgagtttagaaataaatgatataagaaattcaataattaatggtaaaacagcacttgggattgaatttggatcaactagaataaaatcagttttgattaatgaaaataatgaacctatagcttcaggaagtcatgactgggaaaatagatatataaataatatctggacttatacattggatgatatttggacaggtcttcagaacagttataaaaatatggctgatgaagtaaatgaaaaatacggagtagttattgaaaaaattggtgcaataggtataagtgcaatgatgcatggatatatggtttttaataaagaaaatgagcttctagttccatttagaacatggcgtaatacaattactgaaaaggcatcagaagaattaacaaggatttttaactatcatattcctcaaagatggagtattgcccatctttatcaagctattttaaataatgaatctcatgtagacgatatcaattttcaaacaacattagaaggatacatacattggaagcttactggtcaaaaagttataggaattggtgaagcatctggaatgtttcctatagatatagaaacaaaaaattataatgaaagaatgattcaaaagttcgatgaaattattgcttcaaaaaatttatcatggaagcttagtgatatattacctaaggtgttacttgcaggggaaagtgctggagttcttacagaagaaggagcaaaacttttagatgttacaggaaatctaaaatggggaattccactttgtcctccagaaggtgatgctgggactggtatggttgcaactaatagcattactaagcgtactggaaatgtatcagcaggtacttcagtttttgcaatgattgtactagaaaaagaattatctaaagtatacgaagaaatagatttagttacaacacctacaggtaatttagtagctatggtacattgtaataattgtacatcagatcttaatgcatgggttgggttattcaaagaatatacagaagcacttggtattgaagttgacatgaacaaattattttcgattttatataataaagcacttgaaggtgatgcagactgtggtggattattagcctataactacttttcaggagaacatataactggatttgaagaaggccgtccactatttgtaagatctccagaaagtaaatttaatttagctaattttatgagagttaatttatttacgtcattaggtgcgctaaaaacaggattagatattcttcttaagaaagaagatgtaagacttgataagatcttgggacatggaggattatttaagacaaaaaatgtagggcaaaaaatcatggcagcagctatagatgcaccagtatctgttatggatactgcaggagaaggtggtgcatggggaatcgcattattagcagcttatatgctcaataagttggaaaatgaaaaattagatgattatctagctaaaaaggtatttacagacaagataggtacaacaataaatccagattctaaggatgttgaaggatttaacaactttattaaacgttattctgaaggactagctattgaaagagcagcaatagagaattttaaattataaagctaattaaaagtatatattttgctatataaaagatgaattatcacagaatttattctgtgataattttttactttaaaacaaaagtaacacacgataaagagtgcaaataagtagtaataagaaggtaaaagtatatgaaatttcttaaaaaagtgcagtattaaaagtgtgaagattttcgatactttctaaaagaattttgtatagagtataatccgtaaaccctctataattaataatgtaatcgatatcttaaatgaaaaaagaaagagagttggttgatatgactgagaagaatataacattttgtaataaaattctttattatttaatagcacctgcattattagtatatttcttttttattgatacaggaattattaaatgtagtttatcagtattaatgatatttttaataataataataggaactatttcaatccatatggtctataagaagaaaaataacaaatataagtttgaggtaagttcatcttatggaaaaataatgatggtattagtattttttgaactatgttttaatttttataaataattttatctgataatatcatttcattttatgtttttcttgaaaactattaaatgaaatgtaatataaatttattaaagctggaggagaagggtatgaaaaagaagttaatggcaatgttattatcaatgacacttttaggggcactaggaggatgtggtgttacaacagcaccaaatactgattcaaattctggaacagcatcatcatctagtggaggttcaacagatggaaagacaataggaatattaatgccaacaaaatcttcagaaagatggattaatgacggtaatgatatggtaagtaaacttaaggaattaggttacaacacagatcttcaatatgcagaagatgttattgaaacacaagtatcacaagcagaaaatttgattacaaaaggtgttgactgtttggttatagcaaatattgatggtgaatcattaacagatgtatgtcaaaaagctaaggactcaaatattcctgttatagcttatgatcgtttaataaaaaatactgaaaatgttgattattatatatcatttgataatactcttgtaggagtacaaataggtgaatatatagaaaaaactttagatcttaaaaatgcaagtggaaaatcatataatatagaattatttgctggatctccagatgacaataatgcacatatgttatatgacggtgcaatgagtgtattacagcaatacatcgataaaggcagcttaaaagtagtttctggacaaactgattttgatacagtatgtacattaagatgggatggtgcattagcacaatcaagaatggaaaatattttaactgcaaactattcaaatggtgaaaaagttgatgctgtattctcttcttttgatggattaagtagaggaatagttgaagctttaagaagtgttggatatggttcagcagatcttccttggccagtaattacaggacaagatgctgaaactgcatcagttaaatcaataatcgctggagaacagactcagacaatatttaaagatactagagaattagcagcacaagcagtaaaaactgtagatgcagttcttaaaggtcaagaagttgaagtaaatgatacaaaaacatataacaatggcgtaaaagttgttccttcttatctttgtacaccaatatctgttgacataaataactataaagaagtgttagttgattctggatatattaaagaacaagatcttaaataataattagaattgaaagcacatagcctaagaaattggactatgtgctggaaagggggtagaaaaacattatggtaaaagacaacaatgacattattcttgaaatgaagaatataacaaaaactttccctggagttaaggctttagacaatgttaatttaagagtaagaagaggtgaaatacattcactttgtggtgaaaatggtgcaggaaaatcaacacttatgaaggttttaagtgggatatatcctcatggggattatgacggagaaatactttataatggcaagacttgtacgtacaaaaatataaaggatagtgaacgtgatggaatagtaataattcatcaggagttagcattaagtccttacttaagcattggtgaaaatatatttataggaaatgaaatttcaaaacatggaataatagattggaataaagttaaaatcagaacaaaggaattattaaataaagtaggactagatgaagatccagatactatagtaagtactcttggtgtaggtaaacagcaattaatagaaatagctaaggcattatcaaaggatgttaaattattaatattagatgaacctacagcatcattaaatgaagatgatagtgagaatttattaaaattaatgcttgaactaaaacaacaaggtattacatctattttgatttctcataagttaaatgaagtatcaaaagtatgtgattcaattactgtactacgtgatggtgctacaattgaaactttagatgcatcaggtggaaaaatttctgaagatagaattgtaaaaggaatggtagggcgtgaacttacagatcgttatccgaaaaggatttcaaaggttggagacatattatttgaaataaaagattggaatgtttatcatccagattattcagacagaaaaatggttgataatgttaatataaatgttcgaaaaggtgaagtattaggtattgcaggtcttatgggtgcaggaagaacagaacttgctatgagtatttttggaaaaacgtatggtcaaaaaatatctggaaaaataattaagaatggaaaagagattcatataaagaatgtacaagatgcaattgatgctggaatagcttatgtaacagaagatagaaaggaagcgggattaaatttaatagatgatattcgtcataatatcacaattgcttcattgggaaagatatctaagaacggaattataaatgagcaggaagaaattatagcagctcaagactttagactttctatgcagataaaaacaccaagtatactacagcttgcaggaaacttaagtggaggaaatcagcagaaggttgtactttctaggtgggtatatgcagacccggatttattaatattagatgaacctacaagaggtattgatgtaggggcaaaatatgaaatttatacaataataaatgatcttgttaagaatggaaaatcagttattgtaatttcctcagaattaccagaagtattgggattaagcgatcgtatatatgtaatgaatgaaggaaaaatgatttgtgaattagatggaaaagaagctactcaggaaattattatgagtaaaatagttgcagctaaataaggaggcgtgtaatatgggtgaagtaaaaattgaaaataataaaatggataccgcaaaaaataaaaaagggatgaatctttcggcaaataaatttataaaagaaaacggtatgttaatagctttattagcagtagtacttatatttcaaattttaactaaaggtataatgctaaaacctcttaatataacaaatcttattcaacagaatggatatgtattaatacttgcagttgggatgcttttggtagttattattgggactgtagatcttgcagttggttctgtaagtgcatttataggggctgttgctggagttgtaatggttaacaaggggattaatcctgtattatcaatattaatttccataggaataggtatggctgttggagctatacaggggtattggattgcatataaagaaattcctggatttgttgtaaccttagctggtcagctaatatttagaggattcacaatgataatccttaatggtaaaacaatagctccattcccaacatcatttgctaacttaggatcaggttttattccaccactattctattttcaagcaggttcacaatattttgttgggtcatcgataattataggtattatactatctgttgtagtagtagcgaagaattactttggaagaaagaaacttgaaaagtataaatttaatactgaatcaaagggattatatattgcaaagacaataatttcagtaatagttataaatgcagctacaattgttcttgcatcatataagggaatacctaatatcttggtgattgcaggtgttataataatcatttacacattcataacaactaaaactgtgtttggaagacaggtatatgcagttggtggtaacaaaaaagcagcagcattatccggggtaaaagttgctaaaactcaattcttagtatttgttaatatgggattgatggcagctttagctggactagcttatgcagctcgtgttaattcagcacaacccaaggcaggagttaactttgaacttgatgctttagcagcatgttatattggtggtgcttcaacaagcggtggtacaggaagagttatgggagctgttgttggtggacttgtaatgggtgttcttaataatggtatgtcattacttggagtagataataactggcagcaagcaataaaaggtttcgtattactattcgcagttgtatttgatttatattctaagaaaaagaaatagtcaattatgggatatgtgttataaatgcatatcctataattaaattgtaattttggaggtgtttttgtgggaaataaaaaaagaaaagtatatataatttctaataagagtaccagactaaagatgatactatcatgttttttagtggttttatcaatgacattagttagctgctatgtattatataaaaataatttatacaatttgaaatataagatgcttatagaaaacacctgcaaagaaggaaaaatcaaagattatgcagtacttatgcttgaaaatgtaaatgatgctattaataataacagtataaaatcagaagaagagtttaaaaataattttgaagagttgttaagtttgtttgaagacttagataatacaataatccatgaaaaaagtattgaaagttatagtaaattaaaaacattaataaacagcttaaatggtgattgtaacaatgcattatattataacaaagatataaataaaaagaagcagtgtatcagttattatgaatctgctgaaaaaaagattcaagcaatagaagctgctaatggtgttctacttagcaatgaggtaaattacataaaaacaattcaagagaaaattgataaatcatttgaaaatagtaaaaggattttatttattatcataactctattagcaataataagtattttatactttattattttttcaaataaaattgaaaaaaaattatctaaattaaataaattagcacatagaatatccaatggagatttgatatatgatgagaatgaagaaatattgaattctcatacagaaaatgaatttgatatattagaaaatacattttatagtatgaaaaaatcattaaatatattgatattcaatgtgagaaaaaatgtagagacagtaaaggaagcagcaaatgaaatagtcataaatatgaatcaaagcaaaaatgcaaatgatttatccgtatcatcaataaattcagtaaatgaagtagctaatattcaagtagaattgattaaagatatatttaaggaatttaatactacagatagctatttaaatgaaacaataaataatgtaaatatacttaagaataatgtcagtattggtgataaaagtattaatattggaaaagaaactttaaattcaatgataaatcagataaataatataaatgcattaatagaatcatttagaaaagaaacggaacttttaaatgataatactgcacaaataaataatattattaacatggtggaagaaatttcagatcagactaacttattagcattgaatgcatcaattgaatcagttagagctggagaggctggaaaggggtttgcggttgtatctgaagaaataaaaaaattagcagatcaaagcaagatggctacatcggatatttctaatataattagagagctaagaaaaggtattaatagaataaacgatgaggtagagataggaacaagtcaaataaatgaaaataatgaacttgcagaaaaagttgtacaggtttttgaaaatatatatgattccaatgataatatacattgtataacaagtgaggtaaataaaaaaataaatcatgtgtgggaaaagattgtatttgttaaggagaagatgaataaattaaatattcatgctgaaattttatcaaaggaaatggaaaactcatcatcagtagcagaagaacagtttgcactgatttatgaagtaaatattcaagctgaagaatttaaaaaaatagcagaggatttaggaagtgctgttgaaaagtttaaagtataattaaagataacactataaatttaaaattgagtttatggtgttatttgcattgtattaaataaggtataagttgatattaattataaaattagtatgtttattctaattttataattgataatgatttgaattttttaacgttaaattcatatattggtttatatattatgttataataatataaaatgagcttcttataagaataattatggaggtcaaaaaatgtgtttatataaagtattaatagtagatgatgaagaagagatacgtcttggaataataaagaaaattaagtgggaggaacttggattcatagttataggagatgctgaaaatggacaagatgccattgaaaaggcagaaagactacaaccagatgtaataatgacagatataaaaatgccttatatggatggacttgaattagctaaaaatttaagagaatttatgcctgccacaaaagtaattatattttcaggatgtgatgatttcgaatacgcaaaacaagcaattacattcaatgtaatcgactacgtacttaagcctattaattcaatagaaattattgaattacttaaaaagttaaaaataaatatggataaagaaattaatgaaaaaagaaatttagaaacattaaacagatattatattgagagtcttcctttgataagggaacaatttttagttggagccattgaaggacgagttttaatgagtgattggaaagttaacacagaaaaactcaatataagcttttatgaaaattacttttgtgttgctgttattaaattggattatgatgtgttaaatgatagtgaatattcaaataaagatgaacttatgtttatttcaataaagaattttgtagaagaaattttaactgatagctgcaatcatgttagctttttatatttgaaagaagtcgttgtaattggaaacttatctgaaataaatgaagttacaatttttattaataagttaaatgaagtatctaaaagttttaaaagaataatgggattaagtacatcaataggtgttggaaatattgtggattcaccacataaaatatcaatgtcatataattttgcacaaagtgcattggattatagagttatacttggaaatgaaaaggttatatatatacaagatgtagaaaaaaatattgagtataatcttcaattcaataatgaagatgaaagaatgtttttaaattctattaaggttgcatcagagaatgaaattaaagaagtaatacagcaaatttttgttaatatagagaaatcattattgccctttaataaatacagaatatatcttatggagattatgacttctatgtttaaattattatatagttataactgtaatattgatgaaatatttggtgaagattttaattgctatgattatctatcaaaatttaattcattaagtgatattaaaagttggtttttagaaaaatcattaaaaataaataaatttataaaaagtgaaagagtacattcatccatgatactagtagaggaagctaaagaatatataagaaataattatatggatagtgatatatcagtagaaaaattatgttcaaagcttcatattagtcctgcctatttttccacaatatttaaaaaagaaacagatatgagttttgtaaactatcttacagaggtaagattggaggaagcaataaaactgctaaatacaactgatagtaaaacatacattattgctgaaaaggttggatatcctgaagcaaattattttagttatgtttttaaaaagaaatttaaagtatcaccatctaaatatagaaagagttgactagggaatgggaagattacttaagtctaaaattaatagtattatctcaagatattcaaacacaagcatacaaactataatagcaacaacatttactattatatgtgttattggaatgcttggagttggtggtgcaatttatgcaagatttataaaatctacagaagaaattgtttataaaaataatatgtttatagcagaacaagttaattctgaattagaaagttatcttaggaatatgatgagaatttcaactggaacttattatagtgttattaaaaagaataatttttcagaatcaaatgtaaacagtaaactagatttattatatgagacaaacaaggatttattggtaagtatttgcattttcacagaagatgggaaggttgtttcttcatcaccagttgcccaagttaaagacttagtagatccatcagattttgattggttcataaaagcaaggaataaaagtgaaaataggcatttctcaacgcctcatattcagaatttatttatagatcatgataatcaatacaagtgggttgtatctttaagcagagcagtagagattacttatgatggacaagttaccactggagttcttttagtagacatgaattttagtggaatagagcaaatttttagaaatattgatatgggtaagaatggatatatatatttaattgatggagatggggaaataatatatcatcctagacaacaattgctttattcagatttaatacaagaaaataatttagcagcggctcaatataatgatggaaacgtaaaagaagagtttcaaggtgaaagtagattaattacagttaagacagttggatatactggatggaaggttgtatgtgtaagtccaatgcgagatattacatcaaattatagacatgttagtatatttgttatatttacattattatttttaatttttattttttcatatctaaataaaattgtttcagcacgattaacaaatccaattattgaattagaagaatcagtgaaaagatttgagggtggagataattgtgtaccaatttctataagtggttcatatgaaattcaacatctaggaaaggcaattcaatctatggttaatcagatgcagactcttatggaaaacataatttatgagcaggatgaaaaacgaaaaagtgaattaaatgcacttcaggctcaaataaatccacattttctttataacactttagattcaataatatggatgatagaaaatgaaaattatgatggttctataatcatggtaactgctttagcaagactatttagaataagcttaaataaaggaaaaaatataattcctgtaagaaatgagatagaacatgttaaaaattatttgactatccagaatataagatataaaaataaatttacttataatatacaagctgatgagaatacattagatttgagtactatgaaacttataatacagccattagtagaaaatgcaatatatcatagcatggattttatggatggtgatggagagatattaataaagtcatatattgatgatgataagttgtatatagaagttatagataatggacttggaatgacagaagaagaagcagagggacttttaaaaagtaataaaagaaatagtaaaataaagggttctggaattggactgaaaaatgtagacgatagaataaagttatattttggacaaaattatggagtgagcatatatagtgaacctgatgagggtacaatggtaagaatcattatgccgtgtattgaatatgatcagaatagaagtgaagaggatttgaagtaatgttaaaaatcaaaaaaaagtcattttttatattgtctatattagttattatttcatttatttttattttaaatgagcttttaaatattgaaaaggagaagaagtcatataatattacaattataacagacgatgaaataaatgagggttcaatcacaatgaaatcaggagcagacaaagcggcagaggaaatgaatgtagatataagatttgtttctttgtcaaaagatgacttcttagaagaacaaaaagaattgttgatgggtgaaaacaatggcgaaacagatgcaattttaattgaacccataaggtatgagtatttaaaggatacaatagaaaaagtaaataaatttgtacctgtaatttctttgcagtcttattctgaaaaaaattataaaataaatagtgttgtatttgataattttaatatgggggttgatataggcaatgaaattctaaagtcagtatcaggagaaaagaatctagtaatagtaaaggatgatctaaagtcagatgtatcagaagaacgatgtaaggggttaattagtgcattacaaggaaatattcaatataagacagtagaatttaaaaactctaaacatatgacttattatgaaactgcaaaacatctaattgagagtgataatgcagatataatagtaacatttaatacaaagatattagagagtgtttcacaggcaaaaagtgaccttttaggggtaaagtcagatgttagtaatattaaagtttatggtactggaaatacaagaaaagtaatatcgtttttagatcagaatataatcaacggaattgcattggaaaatgaatttaatattggatatttaggtgtgaaaaatgctttaaatctcattaaagataatgaatttaaaagtgatattatttcatctaaaataataaccagggataatatgtattcagtagaaaatcagaggttactatttttatttattcgatagggggatgtaataatgcttttttatattaaaaaaatatcatctgtttttttaactgtatttatattcaacttttatatcggatgcagctttgttaataacaaaattaataaaagtgattcaaaaacaataaaaataggtgtaacgttatttgatcaaaatgatccatttatttcatcattagcaaagcaaattgaaaatgtttcaagagaaaaagaaggagctagtgaatataaaataaatgtcaatgttgttgatagtactaaaagtgtaatgaaacagtatgaacaagtagataattttatagatagaaattatgatgttatatgtgtaagcatggttgatagaactacagcatcatctattatagataggtgtaaaaaggctgagataccattgattttttttaatagtgagcctgttgaggaagatatgaatttgtggaataaagtatattatgttggaggaaagtcagaagaagcaggaaagatgcagggtgagattattaaggacttttatgaaaagtatccagaaaaagtagataaaaataatgatggaaagctacaatatgtaatgcttgaaggagatcctgaacatcaagacacgttaataaggactgaaaactgtgttaaaagtatgagaaataacggtatagaggttgagaaaattggagattatattgcaaactggcagagctctcaagcttatgaaataatgacaagatggataaatgaatacgataacaaaatagaggtggttttttgcaataatgatgcgatggcattaggtgcaataaaagcattagaaaatgcaaaagttaatcaagatgatatgccggttattgttgggactgatggtatttcagattttcttccatacattaaaaataacaatatgattgcaactgtattcaataattataagttacaaggtaaatatatttttgatattgcgtatgaacttgcaactaataagagcattaataatatagaagaacttaaatataaaaaaaatataaaggtatcatataaaaaaattactgcagataatgttgatgattttatttttaatgataatatttatgattaatattttttcaatataaattcaatttaacttattattgctaaaaatatgaattagagtacaaaatatatgattcaaactaattttattggcttttttagacatatagtctaagaatttatcataatataagaattttcagtaaaatgttattaaattaatagaaataataattgtgctaactataatatatagtgtaaaattaagtgacaataataaatgaacaaagtgttaatatgataaaaattgcatgtaaatatatttataaggtgattgaaagaactaatgaaaaatatatttattaagtggagggttattaatgaatattagaatagttacagacagctgtgttgatcataataaagacgtatttggtcatgaagaaaacatggagagagttccattcaaaatcataatagaaaatgaagaaatgatagataaaaatattgatttagaggaactcagagaaaaaatgaaggctacaaaaaataaaataacaacagcctgtccttctccacatgagttcttagaagcatttaagaaatgtaaagaaaattttgtgattactatttccgaaaaattaagtggttcacacaatagtgcggtactagcagctaatatgtttaaagaagaagttgaagatgcctttgtacatatttttgattgtaagacagcaactgctggtgcaagtcttgtagctttaaaattaaaaaccatgatagaagataaagttgaaaagaataaaataatagaggatataaataattacatagatcaaatgaagacatttttagttcctgtaaagttggacaacttagctaaaaatggaaggataagcagtaaaaaagcctttgttggatcattacttcaagtaacaccaattatgtgtgataacggggatggagaaattatacttaaagaacaagtaagaggaagaaagaaagcatttaatagattattagaaattataggtgaagaatgtgaaaattttgaagaaagaattcttgcaatctctcatgttaactctgaagatagagcattgaaattaaaagaagaaattttaagcagatataattttaaaaaggtattaatatttgagggtggcggattaactacaatttatgcagatgatggtggacttgtagtaagctattaaataatgttttagtaactaagaatcgatttatagatatttatatttataaatcgatttattatttttgtaatattttacaaaaataataaattaaattgaaaaaatacatttttaggattaatatataaaatatgaaatcgtaaacaaaactactctaatttaaaaaagcttatagaagtgtggtgatttattattttaatgaaaaatggaaacgataccgataaagttttatgtatttagggggaatgtgaagtggttaaaaataagattaagaaattggttgcaattgggactgtttttttcagtttagtgagtttttcacctaatttaagtcttgtagcatatgcagataccattcaggagagtcaggttgatgaaagtacaagattgacatatgaagaagaacagggttcaatacttcatgcatgggactggtcatttaataacatagcaaataatattgaagcaatatcaaaagcaggatacaagtctattcaagtatcaccaatacaaggtaatatagacataaatggtgaaataacaagtaatgagaaatggtgggttttatatcaaccgataaattttaaaattggaaacaaacaattaggtaccgaagaagaatttaaaaaaatgtgtgaagttgctcatagcaaaggtattgacataattgttgatattattgtaaatcatactggtaataatggttctaatgcagatacaccatcagaaaatgtggatcaagaaataaaagatttaggttctgatgcatggcatagtttaaaacctgttgaaagctggaatagtcgttattgtgtaactcaagaggatattggacttccagatttaaatacggaaaatcataaaatacaggatatggcaaaggaatatttacaacaatgtcttaagagtggagcggatggctttagatttgacactgctaagcatgttggattaccaactgagagtgatgataatggaaaagtagtaaagagtgatttttggcctaatgtattagaaggattaaagactaatgatggaaacaccccatatatttatggtgaagtattacaaggtggagcggataattttaaagaatattctaagtatattaatttaacttcaagtaattatggaggaagtgtaagaagtgcagttggattaaatggaaatccagatgtttcaaagatagaagattacaactcagaaggggtatctcctaaaaggcttatatcatgggttgaatcacatgacacgtatgcaaacgattcagaagaatctacagctttaactgatgaacagataagaaatggatgggcacttatagcatcacgtgcatatgcaaatcctttgttttttaacagaccagcaggaagaggaaagttagatggatcaataggtgattgtggtgatgataactggaggaatcctgatgtagtagcagttaataaatttagaaatgctatgttaaatcaagacgaaaaattagtagaaataaataaagaaattatgatgatagagcgtggtacaagcagtgattcaaaagctaagggagttgttattgttaatcttggagaagattacacagtttcaggattagatgtaaatcttgaaaatgggacttatgataactgtggagttaacgattcaagttttactgttaacgaaggtaaaatatcaggagttattaaaaagggaattacagttttatataaagatggacaaaaagaagaaaatgttcaatcgccagttgtttcagtagataaagaaaatcaatcttttcaagataagcttgatttgacacttaaagctgaaaattcaacaaatgcaacatattctgttaatgatggagcaaaagttccatatgttaatgaaatgaaagttacaataggcagtgatattacaccaggagaaagtgttaagttgacattagaagctactaatgctgatggaacaagaactgcaaaagaaacttatacttatgttaaaaaagctgtaggaagtacagcaactgtatattttgaaaagcctgatgattgggatactcctttatatgtttatgctaagaatgaagttaatgaacaaaataaggcatggccaggagaaaaaatgaccaaaataggtgataaactttataaatatgaattaaaggattggacaaattcaaatgttataattaatgattcatatgcaggtaaacatcaaacatcatcattaaatttaaagtatgatggaatgatgaaatatagcaaggatggaaattggactgaaactcagcctattgctgaagatccaaatgttactccagacatagaaaaacaaggtacatcaaaggtatatatacaaatccctgaaagctggaaagatgaaagtggaaaatattatgatgatgtgtatgtatatatgtatggagtacaagaactagtaaaatggcctggagtaccaatggaaaaggttgaaggaaaggaaggattatatacttatactttaccggcaggcttagaaggatcaatggtacttttcaatgcaaaaggaggaactgttcaagttcctaaagatacaggttttaaggctccaaaagactcaactatgatatacgatggagaatggaaagaataccttaatggaacatcaaaagcttattttagaaaaccagcagattggaaagaacctaatatatatgtatggaaagatgattcaagcgaagtggcaaaatggcctggtatttcaatgactaaggttgaaggaacagaaacattatattcttatacattaccagaaaactatggagatgcaaatattatatttaatgatggatctaataaaactgatgatttaaagttgccttcagaaaaagcaatgatttatgataatggtgaatttagagattatactacagatgattttgaagaacctgaagttcaaaatgataaagaaggaattacaaaggtatactttaaaaatacttctggatgggaaaaagtaaaagtatatgcttataatgatggaacaagtgaaaaagttaaggactggcctggagaaagtgcaaaagatgaaggaaatgatttatatagttactcattaccaaagggatttgaaagtgctacagtaatatttaataatggttctggtggaactggaaatcaaacaggaaacttacaaacaaaaacagggaatactatgatttatgatgaggagagcgattcattaaagagtatgagtaaagtatatttcaaaaatacttatggctgggacaaagtaagagttcactattgggttgatggaggaagttctacaacatggcctggagaatcaccagtttattatggagatgacttatatggattaacattgccagaaggatttgaaaatgctaatgttatatttaataataacaataagggtgaacaaacaaaaacagtaaaagttacagatggtgaaactaaaatttttataggaaatgatgaaacaccagaaggtggacttggtggtgagtggagagactttgcaaagagtgatataccatcagggacagatacagataaaccagatgaaggaaatgatgatgacgtttcagacaagttgacaaaagcttattttgaaaacaaagatggatgggaaaatttaagagtatatttctatacagaaaaatctgatggaagtatgaataaggaattttcaaaatggccaggagtagaattgacatctgaaggaaatgatttatacagctatacattccctaaggggtataaaaattctacattaatattcaatggtacggtaacaacttcagcagcagtttctgtagatggaactgaaacaacagagaaatctgttcaaacagaaaatttaaaaataaaagctggagaattaatgatttatagcaatggagcatgggataagtatacaggtgaaaatcctgataaagatgatgatacatctaaagtaaaaaaggtttcaataaatgggactttcaaagtaggtaatactttaaaaacacaaatctttaatgcagatggaaaagaaattactcctgaagtttcttatcaatggtatagggcatcatcacaaagtggacaatttgaaaaaatagatggtgctgtaaatagtcaatataaattaacaagcagtgataagagcaaatatattaaagtattagttacagataaagatggcaatgaagtatattcacaagcaacttcaagaataagtagctcatcttcatcacatcattctcataattcatcaaattctgtatctaatgatacatcaagtaacaatgattcagtaactgaaaataaagttacaaataataatattccagagaaaactgaatctaagttagataaagaaggttggaatttaaattcagatggtacttggacttttgttgagaaaggaaataaagttacaggttggaaacaagtaaataacttgtggtattttatgaatgataatggtgttatgaatacaggatggaaacagataaataatacatggtattatatgaataattctggttcaatgatgacaggatggcagtttatcaataataaatggtactatttaaatgaaagtggagatatggcaacaggatggaaggatgtaaacggaatttggtattatctatattctgatgggtctatggcttataatacaataattgatggatataatttagatgtaagtggtgcatggatatagttaaatttttataaaagagaaatgctgagaatttatgaattttcagcattttttattatatagaaaagagaaaatatttatagatttataaaattacactaaagaaaataaaagattaataactaatgtataatttgaaaaaataagaaaaatatgttagaatcaaaatggccttacttaaagattaagctgatggaaaaggtcattataaaataaaagtcgttctgattatatgaggggattaatcccaaataacaaggcggtagttatgaatattttaatattaatatctctgcacttattttaagtatggggattatttttttgaagaattattggaaaaaatattaagtaaagtaaaatttatatgtgcaggggtgaaatgatggagactagaatcgcactaattggaattattgtagaggattcaaatgaaatagaaaaattgaatcttatcttacatgaatatagtacatacataataggaagaatggggattccatataaggaaaaggatgtgtgtgtaataagcattgttattgatgccagtaatgatgttataagttctttatctgggaaattaggtatgattaaaggtattagtgtaaagacaatgtattccaagaagtaatatttcaatattaaaaattaaaatattccgctaaaatttgagatgataatagttcaatcaggatgagttatacaaaaaatatttaaaagaaagaagtgtgcaatagtatgtataacgttatgtcaagtgtggcaactgaatttattaatgatgaagaaattttatcaactcttaaatatgcagaagaaaataaaggtaataaagaacttataaataaagtcatagaaaaggctaaaaattgtaaaggcctttcacatagagaagcagcgttacttcttgaatgtgagttagaagaagaaaatgaaaaaatatacaagcttgctagagaaataaagcagaagttttatggaaacagaatagtaatgtttgctcctttatatctttcaaattattgtgttaatggatgcgtatactgtccatatcatcataaaaacaaacacataaggagaaaaaaacttactcaggaagaaattaaaaatgaagttatagcacttcaagatatgggacataaaagattagctttggaaacaggagaagatccagtaaaaaatcctatagaatatgttcttgaaagtataaaaacaatatatggaattaaacacaaaaatggagccataagaagagttaatgtgaatattgcagctacaacagtagagaattatagaaagcttaaagaagcaggaataggaacatatatattatttcaagaaacttataacaaaaaagcttatgaagaacttcatccaacaggtccaaagcatgattatgcatatcatacagaagctatggatagagctatggatggtggaatagatgatgttggctgtggtgttttatttggattaaatttatataaatatgattttgtaggtttattgatgcatgcagaacatttagaagcagctaagggagttggaccacatacgttaagtgttccaagagtaagacctgcagatgatataaatcctgatgaatttgataatggtatatgtgatgagatatttgaaaagatagtcgcagttttaagagtagcggtaccatacacaggaataattgtatctacaagagaatctcaaaaaacaagagaaagagttcttgaacttggagtgtctcaagtaagtggaggttcttgtacaagtgtaggtggatatgttgaaaaggaaaaagaagaagataattctgcacaatttgatgtaagtgataatagaactttagatgaaatagtaaattggcttattgaattaggatacattccaagtttttgtacagcatgttatagagaaggaagaacaggagatagattcatgactctcgttaaagctggacagatatcaaactgttgtcatcctaatgcattaatgacgttaagggagtatcttgatgactatgcaagtgaagagacaaaattaaaaggaattaaacttatagaagacgagattcttaaaattccaaatgaaaaggtaagaaagattgcacaagagcatataaatgatatcgatagcggaaaacgtgattttagattttaattttatagaagagttatgctagtaaaaatttaataattcaactctaacaatatttaataatctcaattgaaatataattaacaacaaaaacagaataagtagatgattaacatgttagagttgactcattataatactgaaaaaaatcataattaaaaagaattttttacaattgtaaaaaattaaataagtatatttttcattttaatatttatgtaaaggtttaaaatagggagtgttttgtaattaattacaatattatactatttaagaaaattatgttttaagttaaaataaaaatgtagtaaatttaaggaggtaaatatatgaataaaaagaaattgaaaattatgacatttgcaatgctggtaagtacttttttggttggaggtttaatgcaagtaccagcttcagcattaactacaggacacatgggtgaggcctttgataatgctaatacatcagtttggtcaaaatcaaatggatggacaaatgatggtatgtttaattgtacatggagaagtagtaatgtcaatttcagtaatggaattatgaatttgacacttaataaggacacccaaggaggaactaagccatatgcaggtggagaatatcgttcaaatgatacttatggttatggattatatcaagtaaatatgaaaccagccaaaaatactggtattgtttcttcatttttcacatatacaggaagtccttgggatgaaattgatatagaatttttaggtaaagatactacaaaagtacaatttaattattttacaaatggtgtaggtaatcatgagtatgtttataatttaggatttgatgcagcacaaagctatcatacttatgcttttaattggcaaccaacgtatattgcatggttagtggacggaaaggaagtttatagagcaactaaagatattccatcacatccaggtaaaattatgatgaatttatggcctggaacaggtgtggattcatggctaggtgattataatggagtaaatccacttaatgcatcgtatgattgggtatcttacgatccgatgtaatgaataaaagaaattctgtaaaatatttcttttgataatataaatgtaactgcaaggataaagtcatttttaacacataaattttgtaatcacaagacatgaaataagttataatttttataagatgattaaattttagggtttaaaagcaggcttaataaatctaaggaaattggtttgcaaaactaacttccgtttatttcaattttgcataattaagttcctttgatacttatcctaaaatttgatctcttattttttgaaaagtgcaggctttagatgtacttcatctgttactatatgttttaaatagagcgcatctataacatctatctgattacatagtatgatactacaaaagttttagaggcactatatttaaatctgaaacaagctcttttaaatagagattacagtttctctttctactaaagagttatttagtatgattcttttactaaatttattatcacagtctattttttctacgagcaattgagcagcattagcaccaaggaaaaacatgttttgatccattgttgttaatttaggttctacaaatttacttaaaggaatattatcgtaaccaataattgaaatttcattaggtacttttattcctaactttttacacgcattaagaacaccaactgccataagatcattgcaagcaaatactgctgtagaagagctattatttaaaatatcaaggaagatattcatggtgttatccacagtatcacttgtattaccattaccaatgttgataatttttgaagaatcaaaatttttagccataatttctttatatattttttcttttatatcatatgagtagctgtcttttcctctgacaaagagtatatctttgtgattattatctaaaagatagtttaaagctattttagctcctgaagcttcatcatttgatacataagaaatatttgaatccatatattctgaatttataaacacaagtggaatcttatgggaaatattatcatagaatttagctttaatattttcagtgccaggtcctgctactattattcctgaaacatttcgtgatattaagttatttacacatttttgttcttcatctgaatcaccattagtacatgcaagaataatagagagggaatttgtctttagctcattctcaattccataaactagctctgtaaagaacatattgtttatactaggaacaacaacaccaatagttgttgatttttgttttgtaagttcacgtgcttgcatgtttggaatatagtttagttcttttattactttcaatacagtttcacgagtttcggctttaactggataatttccattcattactcttgaaactgtagcaactgaaacattagctttttcagctacatcctggattgttattttcataagattaccgccctttaattttgatttatttttatattgtaaaagaaaacttagttagttatcagttaacaggtaacagttaatagtcaaaggatgaaatcttctgtgaagatttctataaacattataataaataaaattctgactgttaagcacattaattgctaactgacaacttttaattaatttaaagggtagctataaatttatcaaaagcagacattcccttttcatttctcttaaatactccagcatgatttaatacttcagagaattttataccaacttctttttgtaatatgtcataagcgttctcttcagtaatagattcatatttagataaaaggtatttataccagtcactgtgtttagcaatgctttcattatttgaaatatcagtaattctgcttattaatgcatcctttaaaagtttaagttcctcttttaatcttgcaggaagaactgcaaggcccataacttcaataagacctatgttttctttctttatatgatgaacttcattgtgaggatggaatattccaagaggatattcatcactggttctattatttctaagaactaaatcaagttcatattttccatttctttttcttgcaattggagttattgtattgtgaggttcatcatttgttctgcataagatttctacagattcatcagaatattctctccaaaggtttaagatatgttcagctaaatttgttaaattttctttgctatcaccatttaatcttattacagacattggccattttactctgcctacagttatgtcttcatatccttcaatagtataagttttttcaacagttgctttttccattgcaaatgtatatcttccaccttgatagtgatcatgggaaagtattgaaccaccaacaataggtaaatcagcatttgaaccagcaaaataatgaggtaatacatcaacaaaattaagaaggtttgcaaatgcttttctgtttattttcataggtacatgttcactattaaagattatacaatgttcattataatatgtgtatggtgaatattgcataaaatatttttcacatccaagattcatagggattattctatgagtttgtcttgcaggatgattcatatgaccataaaaaccctcattttctttgcataatagacattttggataagaagtggatttaaaagactttgcttttgcaatttcttttggatctttctcaggtttagatagatttacagttatgtctaaatcaccatattcagtagtagctttccaaaccatgttcttgtcaattctgtcttttcttatataatttgaagcaatgcttaatttgtagtagtaatctgtagctttttctttagaatcatcatatagtttgttaaatgttttgattacttcagatggtctaggcattaagcaattcattatattagtgtctaataaatcacgttcagtaacagtatcttcaagcatgttctttgaaacagcataatctagtatgttttctaaaataggtgttggagtgtttaaagtttcatttatttcttcatgattaaattcatcaacttttaataagccaaggagcatatttgttgcatagattgtatcttcttcatgaataagaccttgttgtagtccaaaatttattaatctgtttatttcataattaatcataatcgtcctccattagtatgatggacaatgacaataaacaacataacaattattggttagaactttaattgtcaattgtcaattgtcaattgtcaattgaattagttttcgaatccgtttggatgagcagtgtggaatgcccatgcatctttaatgattttctttacatctgtatattgaggaacccatccaagtaattgtcttgctttatcacttgaggcgattaactgagcagggtcaccagctcttctttcaccaattacaactttgatgtcttgaccagttgcctcttcagcagctacaatcatttcttttacgctaaatccaactccattacctaagttaaatacgttacttcctttaccagattcaaggtattcaacggcttttatgtgggcatctgcaaggtcaagtacatggatgtagtcacgtaaacatgttccatctggagtagggtagtcacttccgaatacagttatggcttcacgtttacctagtggaacttgaagtataagtggaattaaatgactttcaggattgtgatcttcacctatagttccatcaccaagtgaacctgcagcattaaagtatctaagagctacatagttgattccataagctttattacaccatttcatcattttttccatagtaagttttgtttcgccataagtatttgttgggtttgtttcatcatcttctaatataggaatttttttaggttctccataaacagcagcagtagaagaaaatacgatattcttgatgtcgtgtttaaccatactttcaagcaatatttgcattccatatacattgttattgaagtaaagaagaggtttaatcatactttctccaactaatgaattagctgcaaaatgaacaattgattggattttattttcagtaaaaattttatctaatatagcagcatctctgatgtcacctttataaaacttagcctttggatgaacagcacccatatgaccgctttgtaaattatctattattacaacatcttttccttgttcgataagtttatacactgtgtgagaaccgatatatcctgcaccaccacaaactaaaattgacataataaacactcccttttatttactttattaaattaatttatagattataatttgaactttatgataactttcttgtaccatccgatatgcttacgatgtagaaacttggttcatagccgattttttcagcatacttaggtgtaattgtagaaataaagttatctacacattcttccttaacaatacttacagtacagccaccaaatcctgcacctgtcatacgtgcaccaataacaccttcacattcccatgctagagaaacaagagtatctaattctatacctgtaacttcatagtcatctcgtaaagaaacatgagatgcattcataagttgtccgaataaagctaaatcattattttctaatgcattaacagcttttaatgttctttggttttcataaacagcatgttttgctctttttacttttataggatcagaaatattagactttacagcttcaaagtcttcttcagtaagttctcctaaagagctaatattctttacagcttgaatttcttttaatgcagcttcacattcgcttcttctttcattgtattttgaatcagcaagtccacgttttttatttgtgttaccaattactattttacacccatccatgtcaagtttactataagaataatttaaagtattacaatctagtaaaattgcacaattttctttacccattccgatagcaaattgatccatgataccacaatttactccgataaacttattttctgcttcttgacacatttttacgatttcaaccatatctatattaaatccaaaagattcgttaaggatacaccccattaaaacttcaagagaagcagatgatgataatccagaaccattaggtatgttaccaaagaaaagtatgtcaaaaccatgggaagttttgaatccatgatcttcaaatgtttttataactccctttggataatttgcccaatcatgtattttgtcgtttacaagaccttttaaatcaaattcaattgttcctaaatcttcaaagtttaatgagtttacaaaacatttgttatcatctcttttagctattaatccataagtacctattgttaaagcacaaggaaaaacattacctccattataatctgtatgttctccgattaaattaactcttccaggtgaaaagaaaacattttcagagtcccttttaaaaatttccttgaattgttcttttaagttattgataatatccatatctttaaatccccctttggaataattatttatatttatactattatagtaaccgcttactataaaaaagtaaatactattatctaaaaaataaaaaaaatttttattggtatctacttaaattaaagttaaaatcattgaaaaaaatgaagaggcatagttatagagtaggtatataaagtttttttaatacaaaaaattatagtattaagaatatttacagaaagcgattactaaaataaaaataacatttatccatgttttgaatacataaaaatatttgaatatataaaaagtgattatataatcagagttaagtaaacgattttaaaccatggaaaggatgatttataatggataagataaaaaatgaaataatgttaataacatatgcagatagtttaggtgaaaatttaaaagatttaaaagatattattgatacctattattcaaaagcagttggaggagttcatatactgccgttttttccttcttctggagataggggatttgctcctatgagatacgatgtggtagatgaagcttttggagatatgaatgatgtaaaatcaataagtgaaaataagtatttgatgtatgattttatggtaaatcatatttcaagacaatcagactattttaaagattttacagagaaaaaggatgaatctgaatataaagattttttcataagatataaagacttttggaaaaatggtgaaccaacacaggaagaagtagatttaatatataagagaaagccaagagctccatattatgaagtagaatttaaagatggaagcaaagaaaaagtatggtgtacatttgcagaagaacagatagatttaaatatggattcaaaagttgcaagagattttataaaagaaacgttaattaatatgtgcaaaaatggagcaagtattatacgtttagatgcctttgcatatgcaataaagaaacctgggactagttgtttctttattgaacctgaaatgtgggaattattatatgaaattcaaggcatagttaaagcatatggagtagatatattgccagaaattcatgaacattatacaatacagcataagatagctgaaaaaggattctggatttatgattttgcattacctgttttagtattaaacgctttgtattcaggaaatggtaataatttaaaaagatggcttgacatgagtccaatgaaacaatttacaacattagatacacatgatggaattggtatagtagatgttaaggatttaatgactgatgaagaaattcatgaaacaaaagaagcgatgtttacaaaaggcgctaatgtaaaaaagatttataatacagcagcatataataatttagatatatatcaagttaattgtacttattactcagcactaggaaataatgataaggcatatcttttagcacgtgcaattcaattttttgctccaggtatacctcaagtatattatgttggaatgcttgcaggagaaaatgatattgagttaatggaatcaacaaaaaatggaagagatattaaccgtcattattatacaaaagaagaaattaaagaaaacatagaaaatagaaaagtagtgagagatataagagaacttatggaacttcgtaattcacataaggcatttggattagatggggaatgcattacagaaactcatggaagcgacctaattataacaagaaaatgtggagaatattcattaactttaaaagctgatttaaagagttatgattttactattgagtaagagtttagtatgattttaaaaagagaattcagtttttatctgaattctctttttatataaatatatattttgaattattcaataaaaacagcagatgaaaatttttctctataatttttagggctttctccttttacttttttaaaaatctttgaaaaggtaagaggatcagagtatcctatagattttgaaactgcctttacggacaaatcagaactttttaataaagcacatgctttatctattctataatttaatagaaattcctgaggtgatatatttatattttttttaaaaatatgggtaaggtaactcctatttataccaatatagtttgcaatatcattgattttaatattatcagcataattcttatctatgtattctatggatttttctaaataaatttcagtgcttctaaatgattttgtacttacttcatcttttttacaactgacaagtgatgacatgaacatatataataatccttctaattttaattcatttgaaaaatttaattgttttaattttaacatttcattaatatacgtttttaacgtatcatccttagaatattcaaaaattaaattgccttcattaagatttgcataatttaagtatgtttcagctttaactccattaaaacctatccacatataattccaaggttcttctttatcagcctcataataagttactgtatcgggtggaataagaaagccttgatttttatgaagtgtatatgttgtgttattaatagtataggaaccttttcccgatattatatagtgaagtacgtattgagaacgaactgcaggtccatatgaatatcctgctgcacaatgctcttttccacaaaaacataaaaataaatctacagattgcttttttattggttcgagatatttacatttattatcttcaaaatattttacttcaatcaaattcaaacccccttatatttttgtaaaaatgtgaaaaatgacatttctacatatgtaatttacataataccatataatttagtattatatcagattataattgattcatacaaaaataattgttatataaagtatttgtatattggttacacatatgtgaaaatgattacaaaatggaggggaattatgttaataaattttgaaaaaaatagtaaaacatttcatattaaaaataaaaatgtgagttatttaattaagatattagaaacaggccatttaacgcacctatattggggaagaaaattaaatacaaataatttggattatttaatagaaaaaaatctttggggaagttttttagctaatactgataatatagatacgtttcaattagaagcaactgcacaggaatatccgggatatggaagtactgatttaagaagtccagctatagaattacaatttgaagatggaacaagtgttacagattttagatatgatggtcataaaataataaagggaaaacctagaattgaaaatcttcctgcaacttatgttgaaaatgatgatgaagcagaaactttagaaatatatatgaaggattctctaaaaaatataaaacttgttttgagttatactatatttaatgaatttgatgcaataactaaaaatgtaaagataataaatgatagtgaagaaaaagttaacataaaaagagtattaagcgcaaatgttgattttaaggatgatgaatttgattttattcacttatcaggggcatgggcaagagaaagacatattgtaaaaactagtcttagaagtggaagtcaatcaattgaaagtagacgaggagcaagtagtcatgcacaaaatccatttatggctcttacaagaaaaaattcaacagaaagtataggggatgtttatggatttagtcttgtttatagtggtaacttcttagctaatgtagaagttgatatgtattttaaatcgagagcacaaattggtataaatccatttgactttaattggcttttagaaagtaaagaagaatttcagagtccagaagcggtattggtttattcagaaaatggattaactggtatgtcacagacttataataagttatatgaaaaacgtttatgtagaggaacatttagagataaagtaagacctattcttataaataattgggaagctacttattttgattttaatgaaactaatataaaagaaatagctaaggaagctaaaaatttgggaatagaactttttgtactagatgatggatggtttggaacaagaaataatgatgattcatctttaggagattggtttgtaaatgaagaaaaattaaaaggtggtttaggaaaacttgtttcggaaattaatgaaatgggtatggaatttggattatggtttgagccagaaatggtttcgcctataagtaaattatatgaaaaacatccagattggtgtatacacatacctggtagagttagaaatgaagctagaaaccaacttatactagatttatcaagaagagaagtttgtgattatataataaaatctgtaagtgatattttagaaagtgctaatatttcttatgttaaatgggatatgaataggaatatgagtgaaattggttctgtaggattaagttcagaaagacaaagagaacttccacatagatatatgcttggtttatacagaatattagaagagataacaagtaagttccctaatatattatttgaaagctgctcaggtggtggtggaagatttgatccgggaatgctttattatatgcctcaaacatggactagtgatgatactgatgcaatagaaagattaaaaattcaatttggaacatctttagtgtatccaagttcatctatgggatgtcatgtatcagcagttccaaatcatcaggttcatagaaatacttctattgaaacaagaggaatagttgctatggctggtaactttggatatgaacttgatattactaaattaagtaatgaagaaaaagaatcaataaaggaacaagtaactttatataagaaaataagagaaacagttcaatttggaaattcttatagattatcaagtccatttgaaggaaatgaagttgcgtggatgaatatttctaaagatagatcgcaagtagttgtaagttatgtaaagcagtttgcagaacctaatatgtggaataaaccattaaaattaaaaggattagattatgatgaaaagtatgagattgatggaacacaaatcgtgttagggggagatgaactaatgaacattggtttggttattcctgagcttaaaggtgattatgcagcaagtcaatggatattaaataaagttgaaaaatagataatataagaaaagtattgctaaaaatattagcagtactttttttaaagtaacgagttataaaaaaagtattaatattcattatatggaaatgtttccttatagaagattcgatgtgaatcacatttaaccataaaacgattacataaaaccatttcaaaaaacatgaatatataatatagttatattgtactaagaaacaaatatataactaaaatattagaaaatagaatatataaaaaagcgggggtacaattatgataaaaaatattaagaaaattattagctgtattgcaatgacaacagttattgggagtatgcttgtaggctgtggtggaactggttcctcaaagagtcaatctggtgatactactataacatatagtatttgggataaaatacaagaaccgggtatgagacaaattgcagatgaatttgaaaaagaaaatcctggaataaaagtaaatatagaagttactccttgggatcagtattggacaaaaatggaggcggctgcaacaggaggaagtcttccagatgtattttggatgcatgcaagtcaggttgaaaagtatataggtggaaatgcaataatggatttaacagataaaatctcatcaagttcattggttgatttgaataagtttccacaagacttagttgatttatataagagtgatgggaaaaattatgcaatacctaaagattatgatactgtaggactttggtacaataaaactttatttgatgaagctggaatatcatatccagatgaaacttggacatgggatacattattagaaaatgctaaaaaattaactaataaagataagggtatttatggattatcagcaccattaaacactcatgaaggtatatacgattatgtattccaaaataatggaaagattttatcagaagataaaagtaaatcggaatataattcaccagaaacaagagaagctcttcaatggtatgtagatttaagtttaaaggaaggtgtttcgccaaatcaaagtcagtttgcagaaaacccagtaataactttatttgaatcaggaaaaactgctatggcattatttggttcttggatgtcagcagaatttgcatcaaatgaatatacatcagctaattgtaatgttgcagtattaccagaaggaaaaacaagaggaactgtattcaatgggcttggaaactctgtatcagctaagacaaaaaatcctgaagctgcttggaaatttgttgaattcctaggatctgaaaaagctaataagattcaagcagaaagcggagcagcaatacctgcatatgaaggaacatcagaggcttggactaaatcaaacgataaatttaacttatcagtatttacagaaatgttggattatgcaactataaaaccatacattaaaaataattctaaatgggaaacagaagaaaataatatccttaagaaaattttcgcaggagacatgtccgttgatgaagggtgtaaacaattagaagagaagatgaattcaattataaatgagaaataattaagaaaaaatgaaaaagtatatatgtgtttatgtataagtacataaacacatatatactactataaatttaagaaaggtatgaatttatggagtttggattagataataaacaaaaaaagaaaaatagtaagctactatttggaaaatattcaaagaaagaatgtgcatgggcatattttatgatcgcaccaacacttataggattacttatacttaatataattccagtaattcaaacattcatgttaagctttcagaaagttggagcttttggagatggacagtgggtagggattagcaattatactaaaatgcttaaggatccagcagttttaggagctacttttaatacttttaaatatgctattatagtagttcctgtaactgttatactttcattgattgtagcagtccttttaaataaaaagataaaaggagtatcgctgtatagaacaatttattttttaccaatggtagcagcaccagctgcaattgcaatggtatggagatggctttacaattcagaattcggactaattaattacttattatcgataataggaattaaaggaccacagtggcttagtgatcctaaaatagcaatgatatctattgcaatagtaggaatatggagtagtgttggatacaatatggtacttttattagctggtttacaagaaattcctaaagattattatgaagcagcaagtattgatggagcaagtccaataagacaatttttcacaataacattaccattagtttcaccaactatgttctttgtagtagttacaagcataataagtgccatgcaggtatttgatgttatattcatgatgatagacaaaacaagtgtagcacttgaaggaacacaatcattagtatatttattctatcaatattcatttgtaatgaatgataaaggttacggctcagcaattgttatgttactactagtaattattatgataattacagcggtacaagttaaagtacaggaaaaatgggtaaattactagaggaagtagggtgataatcatgaaagcaaagattaaaaatagtagcttattaattcatataattttaataattggagctgttattatgatattaccatttttatggatggtattgacatcattaaaaacagtaggtgaagcagtacaagtgccacctaaaatttttcctggcagcccacaatttaataattattcagaggttttaaatatattacctttttcaaagttctatattaatactattttaatgttgataggaagagttattggatcagtatttttcagtgctatggcagcttatgcttgtgcaagattaaactttccagggaaaaatatattctttggtttagtactatttcaaatgatgattccttcgcaaatatttataataccacaattcttgtttgtacaaaaattaggattattgaatacagtatcagcattgatagttcctggaatagtaagtgcttttggaacatttcttcttagacagttctttatgggacttccaaaagatttagaagaagcagctaaactagatggatgtaacacatggcagactttttataaaataatgttacctctttcaagatcaggattagtagctttaggaatatttacagcattgtttgcattcaaagatttaatgtggcctttgattgttaatatgtcacttgataagatgactttatcagcaggacttgcatcacttcaaggccagtttacaacaaattatccacaattaatggcaggttccttacttgcaatatggccaatgcttttaatttttattgtattccaaaagaagtttatagaaggtattgcaacttcaggtggaaaattataattcatatatttagaaaatgtgaattccttagtggattcacatttttttgttgctattaattttatttgttaaaaattcaataataagtttaaatttatgcagaaaattgataattaaataaatatttaatggatatattgtgaaattaattttttttaaaatctataatattggtttatatggaaaatatagagtggttttgttatactaaaaataaataataattagtatttattcgttattattattataagaatatttttttatttattaaaacagaaaaaaagaattacaggagaggtgttttatgaaggtcttaagaaatacaaaagttaaaacgaagttgttggtatcttttattacgatatctttgttaatagcattagttggaacaattggtattgtatccttaaaatctgtagctgaaaattcaaataccatgtatgaaaataatcttcaaagtatatatcttcttgcagatattaaacaaagtctaatatctgtaaaaagtgatgtcattgaacttgttttcataaaaaatgaagatagaaaaagtgacttgaaagatgatatagagattaatgtggataagaataataaaaatgttgaacaatatgaaaatcttccaatgacccaggaagaaaaagaaataatgccaatatataaaaataaacttaaagaatttagaagctcgagagatgaggttcttaaacttattgatgagagtaaatatgatgaagcagctcaacaatatcagcagcttgtggctgtattagatgaagtaatgaataatatcaataagttaatagatataaatcttgttaattctaaacaatttaatttagataatcaggctatgtatttaaagagtaataacattatgaaaggcttaatgttgattggcttattaatagcaattggtactggctttataatatccaattatattaataaaaatttatctaaaataacagcacttgctaaaaatctggctgaatttgatttttcagtacctatggttgtaacagcaatggatgagtttggtcaaactggaactgctctcaataagtcaatagaaaatgtaagtaatctaattaaaattataatagaaaagtcacaggatatgagttcatctagtgaagaattatcggctactgtggaagaaattacatcaaaaacagaagaaatatacgaagctgtagtagatataacaaatgaaatggtcgaagcaagttcttcttcagaagaaataactgcatctattgaagaagtagatacaacagtaaatgaactttcagaaaaagctatggaaggtagcaataatgcaaatgaatttaaagagagagctcttatagtccaaaagcaaggtgaaaaagctatagaagaggctgataatttatattcagagaagaagagtaaaatgttaaaagccattgaggatgggaaagttgtaaataatataaaggttatggctgatactattgcaagtatatcagaacaaacaaatttattagctttaaatgctgctattgaggctgcacgtgcaggagaacaaggaaaaggatttgcagttgtagcagaggaagtacgaaagcttgcagaacagtcttctcaagctgttgctaatatacaggagactatagtcaatgtgcaaaatgcatttgataacttatcaaataacggaaatgagattttgttatttgtaaatgaaaatgtaaatcctaaattcaaggaatttggtaatatggggaattcatactatacagattcagatttcgtaagtaaaatgtcagaagaaatagcatcaatgtcagaagaattgactgctaccgctggacaagttactgaagcggtaagggggatgtctgaaactacacaaaaatcatctgaaaatattgaaagaataaagataagtgtagatgaaacatcaaaagctatagaacaaatagctgaaacagcacaaagccaggcagaatttgcactaaatttaaatgatatagtaaataagtttaagatataaatatacacttaatttaattagctatgactatttttattaatatagtcatagctaatattacttttattgagaaaatggtttaatagataatttcatgtgctttataatatttatatatttaagaggtttcaaagatatgcttccagtatcttttaggcatcatttgacgttgaagacgtaaatttttacgttcttctattgtagtagatttaaaataacatttccataaagatgaatattcatctttatgatccaagagctttttacaatcatcttgtagaagttcaataatttcatatgtattattatcatatataattgccttatttctagatatatcatgaataatccagtattcgttagaaaaacgcttcatgaaatgatctcctataagttccaagatattattgtcaggctctatggaacaatataaaaagttattatctattgatttaaatcttacaaaacctttaaacttatgagcctcaaaagagactcttttttttatttcatctatttgtctaactatatctatatgaaggaaggcgtgaatattttttttgtatttaaaagcaatttttagatatttaaatataaccatacctttatcttcaacattacttaaataaaccatgtaaattttttgaagacatagcaaatctattttattaattatggaattacgtactttttcaaatttatttaaatctgtttctatatttttaatttctccaaggagaagaggagcattatattgagataatccgtaaattccatcaatttcatgttttgaataaaatgcatcatatattgatgttaataaaccttcaaaagaatcatcatatattaatatactcatagctaaaactctccattaattgatgttaatttttcaggtaaagtcaaaatgttttttggaattattattcctgattttgaagtttcgtatgatgattcatcaaaagaatttgaatcaaaaaaagatatttgatccgggtttatagaattttttttaggtaaattgttttctataattttcattttaatagatacatcatcaaaagctacctgtccatagtatttacctgaacatgttatgaaatattttgatcgtttaagaactattcgaagtttttttaaatcatcaaaagttaatttatgaactcttcttatttttagaattttttttgcagatgttacacctactccaggaattcgaagcaacatttcataagaagctttatttacatctattggaaagtgatttaaattatttaaagcccattgggttttgggatcataatttaaatcaaaattgtcattgctattttttaataattcatcagctttaaatccataaaatcttataagccaatcagcctgatatagtctgtgttctcgaatcattggaggatggcttatttgagggagaaatttattattttgtattactggaacatatgcagagtaatacactctttttaagttaaatttatcatagagattttgagaaagatttattattttaaaatcactttcaggggttgcaccaacaattaactgagtactctgaccaccaggcacaaacaaaggtgtgctttttattgtttttttcatatcagaataatgtatgatattattttttattgtactcattggttttaatattttatctttacttttttgaggtgcaagtagttttaagctttcatttgatggaagctctatatttacgctcattctatctgcatatttacctgcttcagtaatgagtttttcgttagcaccaggtattgcttttagatgtatgtaaccattaaagtgttcttctagtctaagttttttaactgttttaattagaagttccatggtgtaatcaggattttttacaactgcggaacttaaaaatagtccttctatataatttcttttataaaaattaattgtgagttcacatacttcttcaggggtaaacgtaactctttcaaaatcctttgaggaaccatttatacagtaaatacagtcaaatatacaatcatttgaaaatagaatttttaatagtgatatacatctgccatctggtgtatagctgtgacatatcccacttacggatgcatctcctatacctacttttgtattttttcgtttagatcctgaagatgaacaagatacatcgtattttgcggcattagaaagaatttttaatttgttcataagatccatttgacagcacttccttaattaaaaaatcgaacatacattctataatattatacacgaatgtatgttcttgcacaagggaagatatatcatattatttttacaaaataaactttatgtaaactgtttttgagataggcgcattttacgcctatacaatcaaatttatctctttctttgagggatattttgattattattcatcattctgttgtttctcataggggtgttattcattcccatatttctgttacccataagcatactcattaaaggatttagattgcccatattcatattattgttcatcataggagcttgattattaccgggagtttgagtattcatattgttaggagccatttgtccattgttactttgtccacccataagcatacttattaatggattcatattgcccatgttcatgttattcatgttaggcatattgttcatgttaggcatattattgctttgaccacccatcatttgagttagttgattcattggatttcccatcattggattcattccaccgcccatcattgggttcatacctcctccaagaccacccataagcatgctcattaaaggatttccgcccatatttcccataccgcccataggattattcatcatacctcccattccagggaaaagtgagcctaatatcatatttaataatggattcatttaatcaccttctgtatatttctttttactacaatctattttgaaaaacatcaatttgctacagtcatttgaaaaataatagaaatagtttattcatataataaaattttaaattatgggttatagattttaaaatattaaatatacaatggaattaattttagatatattttattgtgtaattattagaataattgaatataaaataaagtgtagttaatatgaatatataaatttaaatgggtattttttattaatttgtttataataacaaactaatacctatgataaatttagtaaataataaaaataaaaaataataaaatataataacaattctgtaattgtatacaacttgtaatatggtataataattattgtaaataagataagagcttttaaagtccttaaaatcgggaacataaatgctgtatataaacaatgttaaaaatattaaaaaaattaaggtaaggggaatcacaaaaaatgaattatattggtgttgacttaggcggaacaaatattgtagtaggtttagttgatgaagaaggaaaaatgataaagtcaatcagcagaccaacagtaaaagaaagaggtgttgaacctattttcgatgatatttttgatatgtgtaatgagctaataactgagttcaatttaaacaagacaaacttaaatggaataggaataggaattcctggaacaattgatgataaaaatggaattattgtatattcaaataatattagaatagataatttcaatgtgagagaatatgctaaaggaaaaattgattttgaaataagaatggctaatgatgctgactgtgctgcattaggagaagttgctgcaggtagtgctaaaggttgttcagatgctatagtagtaactcttggaaccggtgtcggtggaggaattattattgatggaaaaatatttgcaggattctatccaggtggagctgaagttgggcatcaaattattgaagttaatggaagacaatgtagttgtggaaataagggctgttttgaagcatattcatctgcaaccgctttaattcttgcagctaaaaataaagctgaagaaaataaggattcacttttatacaaattagttgaaggtgatatggaaaaaatgaatgcaaaagtgccatttgatgcagatcaagctggagacaaagcaggacatgaagtaattgaagaatatttagattatttagctgtaggtgttgcaaaccttataaacatatttaaaccagaagctattcttttaggtggaggaatatgcaaacaaggtgaaaacttaacaactcctttaaaagcaagaatcaaggatttagcttatgctggagacttaagaacagaaattaagattgcaagtcttggtaatgatgcaggattaattggagctgcaatgcttaatagataatttagtgtaatgaattttatagtttgaataattgctcaacattaaagtatatttaatattatacatattatgattatttgtgaagtaatagtcataatactatatagtatagtgtttaacttaacgtatattttaatgttgggtttttgtatttataaaaacttttacacttagaaggtgaagtgatacaatcattataataggggaaaagtaatagcctatttggcttaatactctaagtatttctatatatgattatttaaggtaagagacaaggagaataataatgagtgatttaaaagacttaaaagaattaactaaagcaaaagaagctcaagatagacaggaaatgcaggataaaataattggtagattaagctctataaaaagagatggaatagatgaacttattaaatatcttttagaaagaactgattattttatcgcgccagcatcaacaaaatttcattctaattttgatggaggtttagcatttcactcagataatgttgttgaacttatgcttcaaaaaaacaaacaatatagtcttggactaagcaatgatacaatatatttagcaggatatttacatgatctttgtaaatgcaatctttatgaaaagacaatgagattaaaaaaggatgaaatgacaggaaagtggattggttatgcatcctatgaaataaatgaaacggttcctttaggtcatggtgaaaaaagtgtaatattgcttcaacaatttgtaaagttaactttagaagaatgccttatgattagatggcatatgggagcatatgtacctaaagatgagtatagagattacaataaagctatagaaatgtataagtctgttttagcatttagcaattcagatgcagaagcatcacatttcttagaggaaataagagaacctcaaacttatcctatagaggaatataacaaatttgtaaaagaaaaagctatgaaaacaaataaatagtttgtaaaagtagtattaagtttagtttaaactgaatttaatactacttttttacattaatttatttattttggttaataataagaaatattacaaagttttaacatgtagtcaacattttttaactgtattataaatttgctttaactgtttaggtttatattatatctgtaaggaagaaaaaaatatgtttctacaaatccgagggggtaaataaaaatgaataaaacagctaaaagaatcatgggagctatgcttgcattaactttaatatgtggtggagcttacgggatttcaactcaaattaaaccacaagaagttggtgcggcaactacttcaactgtaaaatggaatggaaagacacctaaatatattttcatgtttataggtgatggtatgagttacccacagattcaggcagctcaatattataatggtattgaaaaaaatggagcaattaatgtatcagaaggaaattatccaacacaggaaaaactatcatttatgaatttcccagtatcaggaacggtatcaacatatgattctacatctatttgtccggattcagcttcaacagctacatctctttcaaccggtgaaaaaactttaagtagtgtaattaatatggatgaaacaaagacaaagtcatatgaaacaattacagaaaaattaaaaaatcaacttggatataaagttggaattgttacatctgtaaacatagatcatgctactccaggggcatattatgctcatgtaccagcaagaagtcaatattatgatatgggacttcaacttgtagatagtgattttgattactttgcaggaggaaaatttctttcagatacttcaaaagaagttacagaacaaggaaaaacacctattgcaaagttagcagaagaaaagggatataaaatagctgatacaaatgaggaaattaaaagcttaaacagtggtgatgaaaaagtaattgcaatatgtccagaaaatgaagtagaagaagaaagcggagctttaaaatacgatttagacagaaatgaaaatgaattaacattagctgaatatactagaaaaggtatagagcttttagataatgaaaaaggattttttatgatggttgaaggtggtaaaattgactgggcaggtcatgctaacgatgcagcatcaagtatacatgatacaaatgcatttagtgatgcagtacaagaagctataaatttctataatgctcaccctgacgaaactttaatattagtaacaggagaccatgaaacaggtggactttcacttggatttgcaggaacaaattatgatacacatttacaaaatttatcaaatcaaaaagtgtcatacacagaatttgataaatctgttgctaagtatagagaaaataaaacatcatttgatgatgcaatgaaagatgttgaagcacaatttggattaaagagagctggatcagaaggtgattcaacaaagggtggtatggttcttactgaattagaagaagcaaagattaaagcagcatatgaaaagagtatgattgcaaaagaagacagaaatttagatcaaaatgaatatgttatgtatggatcatatgaaccatttacagttactcttacacatattctaaataataaatcgggtatatcatacagttcatattcacatacaggggtaccagtagctttaatggctaaaggtgtagggcaggatttatttggtggatattatgataatacagatgtatttgctaaattaaaatcaattacaaaggtacaataataaagaggagactgaaatgcttaaagatattcatagacgtaatactattcctatattaattacacttatagcaatcgttgttttaatatgtgttcctaataaatttccgcaaaagatttatgaaaatactgagagggttagtgcaagggtattaagcacagatgagagttttataataaataatggacttataaagactggtgaacagctttgtgaagtggaaatacttcaggggaaatttaaaggagaaactgttacaggaagcaatagattatcggggtctcttgaacaggataaaatatttgcagttggggataagattcttgtaacattagattatacgggtgatgaaataagggtagcaacattggttgatcattatagaataaattatgaaattctacttgttggagtatttatgatatttcttgtgggattttcaggtatagttggtataaaagctattctgtcatttatttttacaatacttgctatgtggaaattattaataccattgtttttgatgggatacaatcctattttaataggtatggtaacaactataatattagtatgtctgataataggtttagtatatggaatagatagaagatctttagcaggaattattggagctttagcaggaagcatagtaacttgttttatggcattattctttgtgagcagatttaaaattcatggagctgtaatgtcctattcagaaatgcttttatattctggttatgaaaatctgaatcttacagaaatatttattgccagcatatttatagcatcatcaggggcggttatggatgtagctgtagatataacatcagcagttgcagaagttgttgaaaaaaaaccagatataacaagaacagaagcaattaaatctggaattaatgtgggacgttcaattatgggaacaatgatgacaacacttctattagcatattcaggtggatatattggacttcttatggtgtttatggcacagggaactccaataataaatatattaaatttaaaatatgtttcatcagaaatacttcatacacttgtaggaagctttggtcttattactgtagcaccatttacagcaattgcaagtgggattttattggcagagagaaatgtatagtgggattggaaaaataaaatggtaaaaactgaaaataagtaatagtataaaatgttgtaagagtttatttgcttacaacattttttttgtaatagatgttaaaagttttaacttacataaactaaacaaaaagtttggttttaatgaacataaataaataaaaaatattgatttgacttggtggaaaaagatgtatgactaataattctggtttgtaaagagaaaaagagaaggaaaaattaaattttttaccttgaaaaatattggtctaaattaggatgtaatgttttaatttgaaataaaaattgactaaatgaaaataaaacgggttttaaattaagaaaaatatataaaaatcctgtaaaattattaaatattcaaaaaaataaaaatataaaaaaatagtagaaattttacaataaatatagtacaatgtcaaaagataagaaaaactaaactataagttaagtaatagtaaggttataaatactaaacttaaaaaatagtatatagtaatcagtatatctttaaatttaattttataaagaaaggctgtgatgttagggttggaaaacaagctgaaattatacggctttaacaacctcacaaagacacttagctttaacatctatgatgtgtgctatgcaaaaagtgagcgcgagcaaaaggactatattgcttatattgatgagcagtacaattcagaaagacttacaaaaattttatgtgatgtaacagatattattggagcacatgtcctgaatatttcaaaacaggattatgaacctcagggagcaagtgttactattcttattgctgaagaatctatgactaatagaatgaatacagaaccaattgtaactgataaacttgatattcagacgacaagagatacggttgtagcacatttggataagagtcatgtaacagttcacacatatcctgaatatcatccacataattcaatagcaacttttcgtgtagatattgatgtatcaacatgtggagaggtttcacctctgaatgcattgaactacctaataggtagctttgattcggatataataacaacagattatcgtgtaagaggatttacacgtgatgttgatggaaagaaattatatatggatcacaagataacatcaatacaagattatattgataatgaaacactacaaaaatatgacgcagtagacattaatgtttatcaagcaaatttgtttcatacaaaaatgttgataaaagatatggaattacaaaattatctttttaacagagatgtttatgaaattaagccaaagcaaaggcttgaaatagaaaataatctccgcagggaaatgattgaaatatttagcggaagtaatatatatgattaggagatgatttacatgaatgaaaaagaagacatgactataaataaagaagaaagtaatgaaaatctatctccgtataaaaaagataaagagaaacattcaaaagctcctatttatgaagctttagtgaaatataaaaatgcaagagttgttccttttgatgttcctgggcacaaacaaggaagaggaaatccaatgttaaaagagtttttaggagaaaaatgtctttctgtagatgttaattctatgaaacctttagacaatctctgtcatcctgtttctgtaattaaagaagcagaggaacttgcagcagatgcatttggagcaaaacatgcattttttatggtaaatggaacaacatcagctgtacaagctatggttatgagtgtatgtaaaaaaggtgaaaagataataatgccacgtaatgttcacagaagtgcaataaatgcgcttgttataagtggagcaataccagtttatataaatccaggagttaataaaaagcttggtatacctcttggaatgagtgtaaaagatgtggaaaaggctataaaagaaaatccagatgcaaaagctgttcttgtaaataatccaacatactatgggatatgttctgatttaaaaaaaatcacagaaatagctcataagcatggtatgtatgttttagctgatgaagcacatggtacgcatttttactttggtgataatatgcctatctctgcaatggaagcaggagctgacatggctgctgtaagtatgcataagacgggtggttctttaactcaaagttcatttttattattaaattgtgatttacatgttggatatgtacgtcagataatcaatcttacacaaacaacaagtggatcttaccttttgatgtcatctcttgatcttgcaagaagagatcttgttcttaatggaaaagagatatttaaaaaagtaacaagccttgcagaatatgcaagacaggaaattaataaaattggaggctactatgctttttccgaagaattaatagataaggatcaagtatttgattttgataagacaaagttatctgtattcacaagagacataggtcttgctggaatagaagtatatgatattttaagagatgaatatggaatacagattgaatttggagatattgcaaatattttagcaataatttctgttggagatagagagcttacattagaaagattaatatcagctttatatgaaataaagagagtacattcaaaagacaaaagtggaatgtttgatcatgaatatataaatccagaagtggtattaactccacaagaagctttttattgtaataaaaggtcagttccaatgaatgaaagtgatggatgtatatgtgctgaatttgtaatgtgctatcctccaggaattccaattcttgcaccaggggaaagaataacagaagaaatacttgattatataaattatgcaaaagaaaaaggttgtttcttaactggaactgaagactcaaagattgaaaagattaatattgtggaaggagaaattggttagttaagagttaaaggttagtagttgacggttttgtcagaattaatcattaattatttaactttcatgtagtggagctatgggaatggaactttggtatacagaacaacacacagaaaatgtacgattttcaattaaggttgaaaaacagttacatagcgagcagacagaatttcaaagaatagatatattggaatcaaaggaattcggaagattttttacacttgatggaatgatgatggttacagaaaaagatgaattcatttaccacgatatgatagtacatgttccaatggcagtaaatcctaatattaaaaatgtacttgttataggtgcaggagatggtggtactgttagagagcttgcaaagtataaatctattgaaaatatagacatggttgaaatagataaaagagttgtggaagtctgcatggaatatcttccacagacagcgtgcagattaaatgatgaaagagtaaacttattttttgaagacggattaagatttgtgagaaataaggaaaatgaatatgaccttataatagttgattcaacagatccgtttggacctggggaaggattgtttacaaaagagttttacggaaattgctataaagcgttaaaagaggatggaatattagtgaatcagcatgaaagtccatattatgaaaaatatgcaaaagctatgcaggatgctcatgaaaaaatatatggattatttaaagtgcacagagtttatcaagcacatattccaacatatccatcaggtcattggctttttggttttgcatctaaaaattatgatcctgtgaaagacttgaatgctgaaagatggaataatctcaatatagagacaaaatattataatacagaattacattcagggtgctttgcattacctaattatgtgaaaaaattactagaagtaaagaagaaataagttaaattaaaaaattatatagattatagatttagttaaaaaaatggaggaatgaaaaatgggaagagctttaataattggtgcaggtggagttgcaagtgttgcaattcataaatgttgtcaaaattcagaggtgtttgaagaaatatgtatagcaagcagaactttatcaaaatgtgatgcattaaaagaaaaattacaaggtggaaaaacaaagatacagacagctaaagttgatgctgataatgttgatgaattagtagccttaataaatgactttaaaccagatgtagtaatcaatcttgcccttccatatcaagatttaactattatggatgcatgtttagctacaaaggttcattatgttgatacagctaattatgaaccacttgatacagctaaatttgaatataaatggcagtgggaatacagagaaagattcgaaaaagctggaataacagcattgcttggaagtgggtttgatccaggtgtaacaggcgtattttctgcatatgctcaaaaacattactttgatgaaattcactatattgatatagtggatgctaatgcaggggatcatggatacccatttgcaactaactttaacccagaaataaatataagagaaataactgcaaatggaagctattgggaagatggtaagtgggttgaaacaaaacctttagaattaaaagaagtatatgacttacctcaaataggacctaaggacgtttatttattacatcatgaagaattagaatcattagggcttaatattaaaggaataaagagaataagattctggatgacattctcagaaaagtatcttactcatttaaaagttcttgaaaatgtaggaatgacttcaattgaaccaattgaatttgaaggacaaaaaatagttccattacaatttctaaaggcagtacttccagatcctgcatcattaggaccaagaactaaaggtaaaacaaacataggatgtatattccaaggtattaaggatggtgagcctaaaacttattatgtatataatgtatgtgatcatgaagaatgttataaagaagttggatcacaagctatttcatatacaacaggtgttccagctatgattggtgctagtatgatattaaaaggattatggaacaaaccaggagttcataatattgaagagtttaatccagatccatttatggaagaattaaataaatggggtcttccatgggtagaagattttaatccaactttaattaaataatagtttaaagttagagaagatatttctgagaaatatccttgaaaatataagtgtttattaataaaaaatgatgaagaattttttcttcatcatttttgatagtaaggaagattataaaatgaaagtgaggaaaaaattttgttaaaggatatagagatagataagttaccatcaccatgttatattgtggatgaaagattattaaagaaaaatcttgaagtacttgattatgttcaaaaggaaagtggagctaacattattcttgcaactaaagctttttctatgttttctacttttccgttaataggaaagtatttaaagggtgttacatcaagttcattgtttgaagctagactaggatatgaagaaatgggaaaacaagttcacattttttctccagcttatagagaagatgaatttgaagatataatgaaatactctgatcatattatttttaattcatttaatcagtggaaactatataaagatagagttaaaaattataaagataagaaaattcaatgtggcataagaataaatccagagtattcagaaatcgaaacagacatatacaatccatgttttgagaattcaagaatgggtgtcactttaaaaaactttcaagaaaatgatttagatggaatagatggattacattttcatacaatgtgtgaacaaaattcagatacattagctcgtacaattaaagttgtggatgagaagtttggaaaatatataaaaaatatgaaatggcttaactttggaggtggtcatcatattacaagagatgattatgacttaaagacattgattgaatctgtattatatatgaagaataaatataatatagagatatatcttgaaccaggtgaggctgttgctttaaatagtggatttttagtgagcacggtacttgatataacgaataatggaatggatcttgcaattcttgatacttcagcagcttgtcatatgcctgatgttcttgaaatgccatacagacctaacattataggttctggaaaaccttatgagtatgaatatacatatagatttgggggacctacatgtcttgctggagatataattggagattattcattcaaagaaccactaaaagttggagataagttaatattctgtgatatggctatttattcaatggtaaaaaataatacattcaatggaattaatcttccttcaattgttaagtatagcgaagaaaacggtgtggaaattataaaagaatttgggtatgaagattttaagggaagactatcttgatagttaacagttaacagttaagaattgatattttttatataggagagttttattatggagaagaatattgaaacatttataggctgtgataatgaatataatgaatcaaaaattgttatttttggagcaccttttgattctacaacatcgtttaggccaggaacaagatttgcaagtaaggccatgagaagtgaatcttttggtattgaaacgtatagtacatatcaagataaagatttagaagacattggagtttttgatggtggagatttagaacttagatttggaagtcctgaaagtgcattgaatgatatagaagaatttacttcaaaagtattaaaagatgataaaattccttgtatgataggtggagaacatttagttacacttggagcatttagagcagtagctaaaaagtatccagatgttcatgtgatacattttgatgctcatgctgatttaagagaagagtatttaggtcagcaactatctcatgcaacagtaatgcacagagtatgggatattataggagataataaaatttttcaatttggaataagatctggtgataggcaggaaatttactggggaagagatcatgtttttacaaataaatttaattttaatggattagaagaagtagtcgaaaaattaaaaggaaaacctgtttattttacacttgatttagatgttttagatccatcagtctttccaggaacaggaactcctgaagctggtggagttacatttatggaacttctaaatgctattttaaaaatttcagaattaaatattgttggtatggatgtaaatgaactttctcctatatatgatcaaagtggaagttctacagctttagcatgtaagattcttagagaattaatattgagtgtttataagaattaagtattataaaaacagtcagatgtttatatgaatatctgactgtttttataacgtgtacattatttttttatcgtggtaaaataaatttaaatacaaataataactgtaaatagttatttatacaaaaatgggggactgtaaaatgaaaatatctataatttatagcagtagaactggtaaaactgaaagggtggcgcaattaataaaagaaggtgttgaaagagttaaaggcattgatgtgaagcttatgaatttacaagatgagaattcaatagacaaagattttattaataattctgatgggataatatttgggactcctacttattatgcaaatattgcatgggaattgaagaaatggattgatgaatcaacagaatataaattagaaggaaagcttggagcaacatttgcaactgcaaattcaattgctggaggagcagatatagcacttcttactattgtaaatcatctaatggtaaaaggaatgatggtatattcagggggagttgcatttggaaagcctaaaactcatattggatacgttcatataaatgagatatgcgaaaatgaagctgaaaatgctagaatatttggagaaagaatcgctaataaagtgaataaaatattttaatattagattggagaaattataatatgaatgaagttttgaataatattttaacaagaagaagtattagggcatttaagaaagaacaaattaaagatgatgaacttgaaatgattttaaaagctggaatttatgcacctagtggtatgaacaagcaaagctggcagtttacagttgtgcagaataaagaaaagatagaggctcttgctaaagttgtaagagaagaacttggaagagatgaaggatacaatttttatgcccctccaacattaataatgttatctaatgaaagagataacaataatggtttagcagattgctcatgtgcattagaaaatatatttttaatggctaattcattaggtatagggtcatgttggattaatcagctaaaaactatatgtgataacaaaaaggtaagagatttattaaatgaatttgaaataccagaaaatcatatagtatggggaatggcttccattggatatcctgaaaaaccaggtgttgagcatgaaagaaaagaaggaacaataaaatacataagataattatgtttatataatgataaagtgaagagagaattcgaaaagaatttttcattagctttatcattattttttactaaaatttgacgatgttttactaatgcaataaactatatatagatataagaaaattgaggtgtaaaaataatggcaacaataaaggatatagcatcgattgcaggtgtttcaatctcaactgtttcaagagtacttaattttgatgaatcattaaatgtatcagattcaacaaggcaaaaaatattaaaaatagcagatgagttggagtacacatcatcaagtaaaaaaaagaaaagtaaaaaaaataataaaaatataggaattttatgctggtgcaactacgaagaggagttagcagatccatattatttatcaataagattggttgtagagagaatatgtagtgagcgatgtataaatttagtgaaattagatgaaaacatagatttgaaactagtaaaagagttaagtggaatacttgttataggaaattactatacagatatggttgaaaaaatgtcaaatgataatgataatatagtttatgttgattattcacctgatgaaagtaaatatgactcagttgtaattgataagaaaaaagccacatttgatttgttaaattatatatatgaaataggtcatagaagaataggattaattggtggtaaggatttaaatgaaaattatgaaaatatgatgattgatgaaagagatattgaatatcaatatttcatgaaatgtaaaggaatatacaatcctaagtacatatatactgcaagcaggtttaattttaaaagtggctatgaactaacaaaagaaatgttgaaggaaaaggaaagacctacagctgtttttgttgagaatgatacaatggctattggtgcatataaagcaatagcagaagaaggactgacaatacctgatgatataagcattgttggatttaatgatcagccaagtgctaaatatatggttccatcacttactacagtcaaattatcaactgaatatcttgcaagcgcagcgattgatcttgtattagagaatatagatggaagtagaccatataagaaaaaggttgttattcctacaaaattaaaaatacgaaagagctgtaaaaacatataactaaaaagtttactaaaataattttagtaaacttttttatttgtactaattttataaattagtacaaataaattaaaaaaatacaaataataaaaattatattttagtaaatatataaaattttttctaattaatacaaagaatataataacgtttacaaacatgaagctgatataatgtaaacaaatacaagaactgattaccttacttcaaaggtatggaaacaatttaagggggagttaattatgaaacttaaaaaaataacggcattagtcatgacagcaattgttgctttaggaatggtagggtgtggatcatcatcaggaagcagctcaggaaaatcaggaagcagcgatgataaaacaattactgtatgggcatgggatgatacattcaatattaaagctgctaatatggcaaaagaaagatatttaaaagatcatccagatgtaactattaatgtagtaagcatggcacaagatgatgtagttcaaaaattaaatacaagtttatcgtctggtacttatgacggacttcctaatgtggtacttatagaagattacaagatacaaaattacttactatcatatccaggagaaattaaagacttaagtagttatatagatccagctaaatttatggattataaattaggatttatgacagaaggagataaggtatatggagtaccatttgatagtggtgtttctgctttattctatagaactgacttaatagaacaagctggatatacaaaggaagatatgaaagatataacttgggaaaaatacattgaaattggtaaagcagttaaagaaaagactggtaaaaagatgttaactattgatccaagtgatttaaatcaattgagaattatgatgcagtcagcaggaagctggtatgtagatgctgatggtaaagtaagcatagataacaatcaagctttaagagatgctgtagaaatctataaacaaatagtagatgcagatatagctaaacaagtttcaggatgggattcatttataggtgcattccaaagtggtgatgttgcatcagttgtaaatggatgctggctttcttcttctattcaagcagcggaagatcaaaaaggtaaatgggcaatagcttctactccaagaatgggaaataatcctaagtcaataaatgcatctaatagtggtggaagtagttggtatgtattagataaagttggaaattcagatttagcagcagatttcttaaaagaaacatttgcatcaagtgatgacttaatgaatgatttagttccagctataaacttagtaagtacattaaaatctgcaagcagcagtgaaaattacaatacacaagtagaatttttcggtggacaacaaatattcaaagattttgctggatgggcagaaaagattccaagtgttaactatggacttcatacttatgctttagaaaatataatggcagagggaatgcagtcaatcatctctggtggtgatattgatgaagcacttaaaaagacacaagcacaagcagaggcatctgtaaataattaataagctcataattattcttaatatataatttattctaaatggattaacaattttaagatggagcgaaagctccatcttaaaataaaattaactttatgaaccacttgtcaaataaatgtggggttatttgacaaatggttttataaaaatgaggagttgatataaatgaagcaaaaaagaagccgtggaattgaaagtaaaactaataaatggggttggggatttgtagccctaagtatagcttgtatttcattatttgtcttttatccaaccattcaatcatttataacatcattacaatcagggatgggtaataaccttaaatttgtaggttttgctaactatacacgattaatgggtgatgctacttttaaaaaggcagttggaaatacgttcttatatcttatcgtgcaggttcctgtaatgataattttagcacttgtaatagctacaacattaaatgatccgaaattaaaatttaaaggattttttagaacttctatattcttaccttgtgtaacatcattagttgcttattcaataattatgaaaagtatatttgcttcagatggtttagttaataagttacttatgactattaatgtaatttcagtacctatagaatgggttacagatccaatttgggcaaaagttttaataattattgccataacatggagatggacaggttataacatgatattctacctatctggtttacaaaatatagaaccatcaatttatgaagcggcagatatagatggagcttcatcatttaaaaaatttacaaaaataacagttccacttctaaaaccaataattcttttcacaacgattacttcaacaataggtacattacagttatttgatgaagttatgaatattacaaagggtggacctgcaaatgcaacgacaacaatttcacactatatttataacttatgtttcacatatacaccaaactttggatatgcagcagcagtagcttatgtagtagttataatgattgtaatcttatcattaatccaatttaaggtaggaggagatagcaatgagtaagaaaaaaattgataaatcaatggttttaaaatatgtatttttaagcatcgcagcatttgtttctatatttccttttttctggatgattataagtgctactaataaatctgttgatgttacgagaggaaaactaacatttggaactcactttatagcaaatttaacaaatcttttaagttcagatttgggatttatgcgatcattaggaaattctgcagtaattgcaataataacaacatctttagcattattagtatcatcaattgcagggtatgggtttgaaatatttcgaacacctacaagggacaaagttttcacactacttcttttatcaatgatggttcctttttcagcattaatgattcctctttataaattctttggatcattaaatggaacaccattaagttttatgggattaaattcatatttagcagtaatatttccgagtatatccacagcatttttgatcttcttctttaggcagaatacaaagtcttttccaaaagatatattagaagctgcaagaattgatggattaggagaacttgcaatattctttaagatgtatatgccaaccatgaaaactacttatgcagcaggtgcaataataacattcatgagtagttggaataactatctatggccattattagtattacagtcaccagaaaaaagaactgtaccattaataatatctacattaggatcaagttattctcctgactatggattgataatggtagcaatagtaatagcaacattaccaacagcatttgtattcttcacaatgcagaaacatttcgttgcaggtatgattggatcagttaaataatattcatagaaaaaaagttaatatatgaaattaaattattaataatgaaagattaattaactaattttgcgtgagttgattaatctttcttaattacaatacaggaaaatcgatacaattagctataattcggtaggtgacagtcacctattaaaaggaggggcaatatgaaaaataaatttttttataataaagtaacggaatttttacatggtggtgattacaatccagatcagtggcttgattatccagaagttttaaaagatgatgtacgtttattaaaacttgcaaattgcaattgtgtttcaataaatatttttggctggagtgcaattgaacctgaagaaggaaagtatacatttgaatggctagataaaataatggatgatatggcagataataatattcatgttattcttgcaactccaagtggtgcaagacctgcgtggatgtcagagaagtatccagaagtcttaagagtaaatagtgatagaagtaaaaatcttcatggacagagacataatcattgctttacatctcctgtgtatagaaagaaaactaatgagataaataggattttagcagaaagatataaagatcatccagcattaataatgtggcatatttcaaatgaatatggtggagaatgccattgtgacttgtgtcaggatgcattcagaaattggctgaagaaaaaatatgataataatttagagcaattaaataaagcatggtggacaggattttggagtcataaatttactagttggtcacaaattgaaagtccatctgaacatggagaaatatttgtacatgggcataatcttgattggaagagatttgttactgatcagacaatagatttttacaagaatgaaatagaacctattagagaaataacaccggatatacctgtaacggctaattttatgggtaattatccacatatggggttattcacaggattagattattggaagtttgcaaaagaagttgatatagcatcatgggataattatcctgcatggcataataattttgaaagtactgctgaattagcttctaatgttggttttgttcatgatatatatagaagtttaaaaggtggtcagccatttttagttatggaaagtactccaagtttagtaaactggcatgatactaataagttaaaacgtccaggaatgcatatgcttggttcacttcaagggcttgcacacggtgctgattcagttttatacttccaatggagaaagggtagaggtgcatctgaaaaatttcatggagcagtagtagatcattgtggacatgagaatacaagagtctttagggaagtatcagaacttggacgtgttcttgaaaagataaaagaagtgcaaggatcaacaatgaagtcagaagtagcaataatttatgacgttgaaaacaaatgggctatagacgatttacaaggattaaaaatgaagaaaaaagaatatgaagaaacttgtcagaagagtcatagagtattttgggaaaaaggtattccgactgatgttataaatatggattgtgatttttctaaatataaacttatagttgcaccaatgttatatatggtgaagccaaacgtagcagaaaggttaaataaatttgttgaagatggtggaacattaattacaacttactggagtggagttgtagatgaaaatgacttatgttttcttggaggattcccaggtccattacgagatgtaactggaatatgggcggaagagatagattctttatatgatgaggaaaggaaccatattgaaatagtatcaaatgaattgaatataaaagagtgctatgaagtaaaagattattgtgaattaatacatgcagaaacagcagagatattaggtgaatataaagaagatttttatgctggaatgccagcacttacagttaataaatatggaaaaggaaaatgttactatatagctggaagaactgaattagagtttaatagtgatttttatggaaaaataataaatgatttaaacataaaaggcgctatagatggtaatcttccagatggggttactgctcaagaaagagttaatgatgagtttaaatatacttttgttatgaattttactgaagaaaaaaagaccgtatatttagataataaggagtatttagatatgatttcaggagaaaaagtatctgaggaaattatattagataaatatggagtaaaaatattgaaaagttctataaaatgttaaaagtattgcttacttttaagtaaatttatgttttataataacttcttagaaaggcactataaatttttatagtgcctttatgtttaaagtaatattttgatacataaaaagtgatttataaattcagcaagttaggagaagataaagatgaaaataaagaacaagctagtagtttcttttgttgcaattataagcataatatcaattagtattttttctatagtttattttaattttaataaatcagcatatagcaattttgagcagactgtaattacaacaagtaaactaggatatgcatatatggaaaaaagatattcaggtgattggaaagttagggatggaaaattatataagggtgatgcactacttaatagtaataatgatgttcctgagtttattaaaatagaaacaggaaatctatcaagtatttatttaggaaatgagataattgccacaagcataaatgataagaatggagaaaaggtaattggacttcaagcttctgatgaaattacagaaaaagtaatcaataatggagaaacttttattggaaaagtaaatataggtggagaagatatgctggggcagtatattccaataaaaaatggttttggaaaagtcattgcaatgtggtttgttggtgttgagtatagcagtatatatgattatataatacagactatatctatgattgcattaatattgttaattttgatgattttaggaatagttatatttagtaagattggttcaataattgtaaattcaattcataaattcaacgaatatctatcacatatagcaaaaggggattttagtatatccattgaagaaagattatttgctgcaaaagatgagacaggcactatgtttagaaatcttaacttaatgaagaattctgtaagtggaatgttagataacattgaaaaacagtctgcatctacatcaaaaacaagtgagattttatctgatattgtaaaagacgtaaatgaaattgttggagaggttagaatttcaactgaacagatagcagcaggtttagaagaaacagcagcatctacggaagaaataaattctagcacaagtgttatggtgcaatcggtaaatggaatatcagaaattacaaaagatgcaattcttcattcaaaagaaattaaaaagagagctgataaatttaaagatgagtcaataaaaatgaaacaagaaactgaaaaaatatatgaaaataatagtggaaagctaaaagaagctattgatagatcaaaaagagttaatgaaattacagaacttttagatgctatttctaatataagtgatcagactaatttgcttgctttaaatgctgcgattgaagctgctaggtctggtgaagcaggtaaaggttttgcagtagttgcagatgagataaagaatcttgctgaagaatcaaatgttacagcagaaaagataagagaaattacagtttatgtaattaatgcgatggaaaatttagttagcagttctaatgaagtattaaactttattgattatatgattaaaaataactatattcaattttatgagattagtgatttatatagtaaagatgcaaatgattacaacactatgtcacaaaatataggagatactctacaagaaattttaatatcaacaaaagatatttcaagtgcaattgataatgttgcagaatcttcaggtgaaggagcaggagatgcactgaatatatctgataaaataaatatattatcagattcaactgaaaaattaattgaaaatgctaaggattgtgaaaatgtttcaaaagaattggaggagactctaagaaaaataaaattataaaataaaagcatcagataatcaaaattatctgatgcaatcattggataataaaattagttggattcacaataatcagtaatagctggcaaagaaagttttacaatagttcctctttcaggttcacttgtaatattcacaccatgattatcaccatatataagtttaattctatcattaacattattaataccaatacttgtaaagttattattctttttgtgatttccagtatatatgttttttaaatcttcagaggtcatcccaattccattatcaataatttcacaaatgagattttcattatttttattaacaaaaacatgaattgatccagaatctctatctgtgaaagcatgaaaaaatgcattctctatgaatggttgaagtattaattttggaataatatagccttcgcactctggcattacaaagaaattaacattaattttatcaccataacgaacatgattgatgagaacatagtttttaagattttcaatttcatcagaaacagtaatcatttcgtttttattgcttatagtatttcttaaaagagaaataaatgcatcaattacttctgaagctttagatttattttcctgccaaacaagccattttatagatgaaagagtattgtatataaaatgaggattaatctgcatttgtaaagctgaaatttccgcttttcgtttttctttttgtatcttcattttttgatccacataactgtttaaaccatctagcatatagttaaaggcactacataattcgcgaacctcaacactgcctctcaataagatgtgattgttaaaatctccatttattattttaggcattgttctagcaagaattaggattggtcttgttgtttttcggattataaaaaagataataactataaatattagggcaattaaaagacttactaaagtaatctgccatgtatcgtatatttcatctaatactacatttttatctatggtacctataatattaaaattataggttggaagatattttgataaaacagccacatcagaagaattaagttttgtatcaagataggtaagattattatttataatgttttgtgaaatcttatataaatctaaattcacagtaccaatctgataacttaaattagaagaaactattgtgccgtcattagaaattattgaaatatcgtttccgttgcctacaaatggaagataatatttttttaagtattcctgatttacaaaagcataaacaaaaccatagatttttttagtatacttatcatgaaggaccttaattgctacccagccaccacagttttcactgctttttgtaaaaccatcatgatagtattgataaaatatttggttttcattttctagggctttttcagttatggaattagttagtagttctttgggtgtcaaaagcattgagtcattgttttgaacataactttcaccattaacacctacaacggatagagtaattccgttagagtcttgagatgataaataatttccaagtacaatatcaacattatataatgttttgaaatattcctgaggagtcaggtcatttttacttaaaagattctgaaaatctgagctgtctgctactatattcattgctgtaattatttttgaatttaaatcattaaaattttcagcaatttgacttaaaaccttgtaattggatttgctaaatgtacttgcaatagtatttttggatattctaatagtaattgcgctaattgatattgatatcaatataatggttatgagcattatactggcaacgcgaacaaataatgttgtagaatcaagtaatttttttatgttctctttcattaatataatccttccacgaaaaaatagtgttttaaacaaggttttttcggtatgaacttggcgtaaagccagtaaattttttaaataccttagaaaaataactttgatcagaatacccaaccatagaacttatagaagaaatagggatatcttgttttaaaaattcacatgctttttctattcttatcttatttaaaaattcattaaagccttcatggttatgagagctgaagtaggaagataagtaataataattaaagctaaatttctgtgaaacatctgttagtgtaagcggctctgcataattagtctgaatatagtgtataattttattgatcatgtgagaattaaaagtactctcatatttagtcattaattcattgaaattatcacaaatttctttacaaatagtaattaaatcatcagcatatatagcttgatcaatttgactaaaaaacttatgttttagtaaattaatttcaaactgatcaatatttaaattttcaagattagaaatagcattataggtacagttttgcattatgctttttagttcaaactcatttaagcttttgtgtgaaattgaaagagaaatatattccaataacatattaaaagcatcagttatatgcattgatgacataagttctgaaaataatttgaagttaaagctattttcatctggtggagttttgtagtcatctgaagagtaaaaataagttcctttattaaaaaaatattgtttacataagaataggaagttttcatcatatatattttttatatttgctaaagaatcaaagtttttgcttactactaagaaggaattggaaaatttttgataaaatttttcagagaacctttttaattcataaattaaatgagagttattttcaaatttgaaatttattaaacaaaggacaatttcattctctagtgttactgttttatatatagtttttgataaattagatgaaaagaaactatcaagttcagaagctaattggtttatgaaattgtttctatcttcataacttttaaaaatattttttgcatttattccgaaaagacagaatttatcataagtaaataaattgtttagttcattaaaatcaatatcagagttaaatcctaaaataagtcgttttaaaacagtttctgtatgctgggttttatttgaggataaagagaaattctttatttttccagcagcttttcttaaggattttagcaatgaatccagttccaatgttggttttaacaagtaatcgattgcaccattttgaaaagaagatttaacgtattcaaaatcactataactgcttaaaattattattgaaatatcaggataattattttgaatatatttgctgagttcaataccatctatttgtggcattacaatatcagaaataataatatgtggtttttccttttttatcatgtcaatagcttcttgtccattggaagcttgcccgataattttaaagccttctttttcccagtctgtcatatatttgataccctgtctcataatgaactcgtcatcgataattagaattttacaaaaatcattcaatttttaagcacctcaaattcaaaagtaaaataataaaacattattaaattatattatagattataaagcatttttaaaaggttttcaaataatatattttagtaaaaaataagtaaaaacacattgactttttactaaaataaatataaaatttaattatgaaaactattacaatatggggtgtgaggaaatggcaatattaaaagaagtttttggaaagacacaaagcaataaagatgtatatttatttacattatcaaatgaagaaggtatgaaggtaaaaataataaattatggtgcaacagttgtatcaattattgcaaaagataaaaatggaaaatacgatgatgtggttttagggtatgacaccattgaaggttatgaaaatggtgataaatattttggagccgtagttggaagatgtgctaatagaattgaaaatggaatttttaatattaatggaagagaatatagagtatgcattaatagtggacaaaatcatcttcatggtggaaaaataggttttgacaaagttgtatgggatattattgattttaatgaagcttcaaacactttagaatttgtatataacagttttgatggtgaagaaggatatccaggaaatcttataactaaggttaaatatactcttactgaagataattcattagaaatagaatataaagcagttagtgacaaagatactgttgtaaatattacaaatcattcatatttcaatttagctggacatgcttctggtgatgctcttaatcatatggttaaaataaactcagataaatttacagctaacaatagtaattcaataccaactggagaattaaggtctgtagaaggaactcctatggattttaggaattttaaaagagttggtgattatatagactgtgattatgaacagattataattggaagtggttttgaccataactgggttgtagatataaataaaggtatatctgaaaaagcagcagaaatagtagaaaagaatacaggaagaaagcttgaagtttttacaacaatgcctggaatgcagttttatagtgcaaattttttagatggaaatgatgttggaaagaataatgcaacatatattagaagaagtgctttatgttttgaaacacagtatgcaccaaatgcaatcaatactccagaatttaaatctcctctgcttaaagcaggagatgagtataaagaaaaaacaatttatagattttcaacaatataaagttgatgttaacatacagaaaatataattagaaagaaggatgcatagtgaacacaagagaatttacacttgactggcttgaaaacccagaagtatttagagttaatagattagatgctcattctgatcattggttttatgataatttagaagaaaaaatgccattaagacaatgtttaaatggcaagtggaaatttgcatatagtgaaaatccaagtttaagacttaaagatttttacaaagaagattttgatgtaagcggttttgattatattgaagtacctggacatattcaattacagggatatgataaatgtcagtatataaatacaatgtatccatgggaaggtcacgatgagcttaggccaccacatatctctaagacatataatccagtaggaagttatgttaagtattttgaagttaatgatagacttaaggataagcaaacttttatttcatttcaaggtgtagaaactgctttttatgtatggttaaatggagaatttgttggatacagtgaagatacttttactccttctgaatttgatattacagaatacttaaaagacggatctaataaacttgctgttgaagtttataagagaagtagtgcaagctggattgaggatcaggatttttggaggttttctggaatatttagagatgtatatttatatgctgttccaaaaactcatataaatgatatttttgttaaaacagaactaagcaatgattataaagatgctgaattaaaagctgaacttaaagttacaggagttattgaaggtagcatagaatcatatttagaagataatagcggaaacaaagttgcatattatgaaaatatcaatttagataaagagttaacaatatcaatgaatataaaagatattaagctttggagcgcagaagaacctaatttatatactttaaaaatattaataaaggatttggatgggaatttagttgaagctatacctcaaaaagtaggctttagacattttgaattagacgataaaataatgaaaatcaatgggaagagaattatttttaaaggtgttaatcgtcatgaatttagtgcaagacgtggtcgttctataacaaaggaagatatgatttatgatataaaatttatgaaaaagcataacattaatgcagtaagaacatcccactatccaaatcaaagtttatggtatagactttgtgatgaatatggaatttatttaatagatgagacaaatcttgaaagtcacggatcttggcagaagcttggtgcttgttctcctgaatggaatgttccaggtaatcttaaagaatggcaggactgtgtcttagatagagcagaatctatgcttgaacgtgataaaaatcatccttcagtaataatatggtcttgtggaaatgaatcatatgctggagaagatatattccaaatgtcagaatattttagaagaaaagatccatcacgtattgtacattatgaaggagttttttggaatagagaatatgataagactagtgatgtggaaagcagaatgtatgcaaaagtgaaggatattgaagaatatctagataacaatccacaaaaaccatatataagctgtgaatatatgcatgctatgggtaactcttgtggaggaatgaataaatacatagaacttgaagaaaagtatcctatgtatcaaggaggatttatctgggattatggtgatcaagcactttatagaactactgatgatggtagcgaagtattgtcatatggtggtgactttacagacagaccaagtgattataatttctcgggaaatggtttaatatttgctgatagaactgaatcaccaaaagctcaggaagttaaatatttatatcagaatataaaattaattccagatgaaaatggagttcttataaaaaatcaaaatctttttgtaaatactgataaatacactttaaaatatacaattaaaaaagaagatgagctattagaagatggggaaattaatgtatctgtagatcctggaactgaaaaatatattaatcttccaataaaagactatagcaaagagaaggaagtggtcttaactgtttctacattattaaagaaagatgaactttgggctaaagcaggatatgaagtgaactttggtcaggctgttttaaaaggaaatactaaacaagaaaaatcatcagaaactaagttgaagattgtacacggggatgttaatattggagttcatggaaaggactttaaaattatattctctaaacaggaaggtggaatagtatccttaagatattatggaaaagaatttattacaagagttccaaaaccttattactggagagcaacaactgataatgatagagggaataagcatgaattcagatgtgcacaatggttaagtgctacagttggacaaaaatatagtgatttttctatggatgaaaatgaaaagtcaattattttaagatatacttatgatcttccaacagttccatcaacaaaggttaatgtttcatattatatagaagaagatggagtcataaaagtaacagtacattataatggagtagatggacttcctgaactacctgtacttggaatgaactttagattattatcagaatttgattcatttatatggtatggaaaaggtaaagaagagaattatattgatagatgtgatggtgcaaagttaggtgtgtatagcagcactcctattaaaaatttatctaagtatttagtgccacaagaatgtggaaatagaactgatacaagatgggttgaagtaagaaatgaagagggagaaggactaagattttcttatgaagaacttccatttgaatttagcgtattaccttataactgcatagagttagaaaatgctcttcatcaagaagatttaccacctgttaatttcactaatgttaatattattggaaggcagatgggtgttggtggtgatgatagctggggggcaccagtcctaaaggaatattgtattgattcaagtaaagatattgaatatacatttaaaatttcaggaattaaatagttttaatgtattattagaaaataagaatatataaactagaaggttaaaacactgtatcaaatattataatgatacagtgttttattattaaacaaaactatgaagttatatgagaaaggtaaatctagtctaggttttcactattgctattaataaattgttctctgtattttttcggagacattcctttttgctttttaaatatttttgaaaaagcaagagaatcatcgtagcctacagaacgagatatatcacaaatagataatttgaaatttttcataagttcgcatgctttgtttactctaaaagatattatgtattgttgaggagtcacaccaatactttctttaaaaataagactgaaatattttgtatttaatcctaataaagcagcaatttctgaaattagtaattttcttgaatagttcatttctatataatttaaacatttttttatataaacatctttatagtaataatcagaagaactgtctatacttgagagttctataagttcagaaaggaatattgataatagcccttgaagtttaagttcagaggcatattttaatttagaagcttttatcatattatcaaaacattcttctaaaaacttaccattagaatattcaaatataggattttcttttgttaaacccgcacattgtaaatagtattcggcttttatacctttaaaaccaacccatttatatatccatggagtatgattgtcagcttcataataagttatgtcatctggaaaaattataaaaccttgatttttgtgtagcttatatagttttccgtttactaggaaagtgccacttccttcaataatataatgtattaaaaaatggtcacgtatagcaggaccaaatgaatgagatggtgtacattcttctcttccacattgatatactaataggtctctgctttctctattatatgttgggaaacaaagcatttccattgagtttttcatatattcctcctattaaaatctttgttaatggaattataacataataagaaaaatcattaaataatgcttgaaaatatataaaaagtaatttcttatttaataaattttaatattataattaatatagacacagtgttgacataaaaaaattatatagtaaaattaatatatttaaattatggagagagttaaaacatgggaaaaaacaaattgaaaaaatttattggaacaattatggcagcactgggaatatcttttggacttaatggatgttcagattattcaaaaaaaagcgtggatagtacgtctacaaacatagccgaagttaataatatagaaaatgctccatttgaaattacatttatgaatgttggtaaggctgacagtatttttctttcaattgatgacaaaaatattatgatagatacagggctaaacagtactaaagataatgtggtttcacaattaaaagaaaaaaatattgatagcattgattatcttatattgacacatatggataaagatcatattgggggagctgatgctatacttaatgaatttaaagtagataatgttatacaggctgattatagtaaggatagtaagcaatatgatcaatatataaaagctatagagaaaaataacataacgcctattttgattcatgataatattaatgttaaaactgataatgctcaaattaatatatatccagcattaaaaaaatcatattcacagtcaaatgattattctataattgtaagtataaactatgggaaatataagttcttatttgcaggtgatgctgaagaagaacgtctttcagaatttataaatagtaataatgaaaaatatactcttgtaaagatgccacatcatggaaaaataaattctcttagtgaaaaatttataaaatcaataagtccttcatattctataatcacatgttcagatgaagaactgcctgatgaagacactattaagttactaaataagtataatgtgaaaaactttttaactaaagatggtgaaatagtagttaaaacagatggaaataatattagtgtttctcaataagaaaccttaaaatataaaaaatggaaaaagtacaattagagtaatactatcttattgtactttttccatgaaaataaatatattatctttactaatctttcatgataatttaaaataaatcatacataatatatagactattagaaaaagaggtgaaattaatgaaaaggtttttaagagagcaggttatgaaggtggcagatatgcttgaaactataataggaatcctgcttgcggtaagtattggaatattagtagtatatttaattggtgatataaaatcaataataacgaatcattcagatttagaggtgtttaataattatttagctgctgcatttaatcttgttattggtatagaatttataaaaatgttatgtaaacatacgcctgaaactgtaatagaagtattactttttgcaattgcaagacagttaatagtggaacatacaacaactatggaaaacttagtaggtataatatctatcggaatattatttgcaacaagaaaatatttattttataattttgatgaagtcgacaaaacaatttatagaggaaatgaaagagtaaaaagaattaatttattagagcatcttgatattccttttgatgataaggatgaaacgctagaagatattgttttgagagaaattgaagcaagaaatcttgaaattggtactggagtatgtatatattatccaggttttgctctaagaatagcaaaaataaaaaataatgtaattacaagagttgaagtaatacgttctataaaaaagaaataactgaagaggttaagtaatgcagcaataaataattattgctgcattactgatataagatataatctatttactttagagactgttattgttaatatttagattagacacagattttatggtcagactaaggggaggctcgtaattatgaataatgatcagactacaaaggggctcatcgtttcagcagcatgggaacttttttataaaaagggatatgataatactacagtggatgaaataatagagcgctctcacacttctaagggagctttttatcattattttaaaggaaaggattctcttttaagttctctttcatatctatttgatgaaaaatatgagaatgtaataagtataattgatataaatatgaatagttttgataaattaatttacttaaacagagaactatttaaaatgatagaagaaagtgtttctatagagctactggcatctttatattcatcacagcttgtaacaattggagaaaagcatttacttgatgaaaatagagtttattacaagcttttaaaaaaaataataaaagaaggccaggaaagaggagagattaaaagtagtatatcatgtgatgaaataatgaaagtatatgcattatgtgaaagaggattaatatatgattggtgcataagtaaaggaagttattctctatgggaatatagtggacatcttatgcctatgtttttaagagagtataagaaaagatagattatgtgtaacaaatattgacaataaatttttatagtagtaatattaaattaagcaaaggtgccttaagggatactctttgctttttttattttacaagaaaatatttttacataattatttgactttgataaatacttacaaagtatttgtctgtataaagaatttagtatatattataaaatctaatgagttattggggagagagcaatgaataaagaagtgatttttaagttacactcattatatagagataattttcggattacaggctataaatttggaaaaggaaacaaatcagtatgtatcataggtgcaatgagaggaaatgaagtacaacaactgtatacgtgttcacaacttataaatgaattgaaaaaactagaaaagaaaggagctataacacgtaataatgaaattcttataataccatgcataaatacctatggtatgaatataggaaaaagattttgtacgactgataatgttgatataaatagaatgttttcagaaactgaatatgtaggaacatcacgcaaaatagcagaaggtatatttaaaaaagttcaaggatacacgtatggaatacaatttgcaagcttttatatgcaaggaacttttatacctcatgtaagaatgatggaaactgggtatcaaaatccaagtttagcaaatttgtttggattaaaatatgttttaataagaaagccaaccccttctgatacagcaactttaaactataactggcagatggggagtacgaatgctttttctgtatatacaaattcaacagataaaatagatgagaaatcagcaaagcatgctgttgttgctgtcttgagatttttaactagaatgggaataataaaatataattgtcataatggatatatatcgagtgttataaatgaggaaattttaaagagcgtaatatcagaaactagtggtatttatagaagattaaaaaatcctggtgatagtgttgagagaggagaaatccttggggaagtattagatccatatgaaggaaaggctatttcacaaataatttcatcaactgatggaattatattttttgcacatacatcacctttagttatggaaaatgaggttgtatataaaataataagaagaatacatgaatgatttcagaattattttaaaatattacatagagaaaattaaatagtggaataatattattgacatacattaaaatggttgttattatataaagcatactaaacagataggaattattaacgaaagaggagagtattatgaatagtacattttttacagattttgttatgataacaagctttatgccaatagtatttattggattattactaggcctgttttttgtaataagacaaatggaaaagaagaagattaatttttcaaaacgtatgatagtagctactttattaggattattattaggcgttgtaatacaggcagttgcaaaatttccagatgacattggagctgttacatggataacagaaacaacaaaatggtatgggcttgttggatatggatttatggatttgttaaaaatgcttgtagtacctttgatatttctttcgattatcagagttataataaacatgaaggcagatcagaatcttggaaagctgacatctagaactatacttgtattgcttagtaccacagcaatttcagcaataattgcaataattgttgggaatttatttaaactgggagttggtgaaactgtagtacaaagtcagagtgaaatgaaagaaataagttcaatagtggatacacttagaggacttcttccttcaaacccagtaaaggctatggcggatgctaatgttgtaggagttgttatatttgcaggatttataggaattgcaattaaaagacttactaaaaaatacttagaaatagtaaaaccagcaatagatttagttgaagctggatataagataataacaagtgttgcaatgacagtaataaaatttatgccttatgcagtaattgccttacttgctaatacaatagccggaagaggtatgagtgccataattagtgttactaaatttatagcagctatatatgtgagtataggattagtatttgtttttcatatgattataatttcattaaataaacttaatccatttaggtatataaaaaatgttgcacagccattgatacttgcatttacatcacgttcaagccttggaacattacctgtaacaattgaagcattgactgaaaaggcaggagtagataatggagtagcaagttttgtaggaagtttaggatctaacatgggaatgaatggatgtgcggcagtgtacccagctttaatggctattacaattgctaatatgtcaggaacacctatggatcttagcttttatggaatgcttcttgtaataataatagtcagctctcttggaattgctggtcttccaggtacagcaactatggctgtatcagttgttatttctggtatgggaatgggagcatatttccctcttgcaggaggaattcttgcaatagatcctattttagatatgggacgtacaatgcttaatgtaaatggaactatggtaacagcagttacagttgcaaacagcttagataatatagacaaagatgtgtataataaataaaaacactatattataattaaaacaagagttactagaagggtttagtgactcttgttttttgcaattaaatgaaagtatgatagaataaagacaagcaatatctttttgaattgtatattaaaagaatttaggaggttatataatgaagcagatattgaaaaaaacgtttataattgttgctgcaatatgtactattgccacggtattaccagcaggggagttaaacgttattactactgaagctagcgcttcaacaagcgatgatggatcacttacaaaattaaaattaaaaaattctagtggtaaaaatattcaaatttatgatgacaatgattataaaagtggaagtaaggtagatgacgatgaaatcaatgcagatacaaaatattatgcaaagacttcatcatcaaagattaaaattgatgtagatggagtagatgatgactgtgtaagattgtttgttagtgaaaaaagttcagaaaaaggtgttaaggttggaaaaacagcaactctatcatctggaacaaacaaaattacagtaagagtatataatgaagatccaggaagtagtgtaaaatataaagaagatgatgatgtggtaaatgactacactataagagtaaaatatactggtaatgatgatgacgacgacgatgatgatgaagattatgatgatatttacttaaaaagcattacattaagtgatggtgaaataagtttttctaaaaaaacaactaagtatgatgtatatgtagcttcaacagtaagcaacttaacaataaaagcaaaacctgaggatgaagattatacagttacaattgatggaacagaagtggatgacgatgataactataaagaagaagtatccttaagtaaaggtaaaaatactattgaaattgaagtggaagatgaagatgaggatgaatctagagtttatactctaaatatttatagaggagaaacatctaatggtacaagctctaatgtaaataataatataaacacaaatagttctaatcaatataatccagttacatctagtccggttatttcaactcagccaaattatcagccaactaattcaaaagtaaatcaatgggttatgaataatggaaattggcagtattatgattcgttaggaaaacctttgacaagtcaatggttttttgataataattcaggaaaatactattacctaggtgcagatggtaatatggcaactggatggatttatatgagtggacaatggtatttgcttgataacagtggagcaatgcttacaggatggcactactcaaatggaaagtggtattacttaaatccagctaatggagcaatggtaacaaattcatatgtaggatcatacaaagtagattcaacaggagcatgggtaaaataatatgttttagaagctatattcagatttataaaaggtctgagtatagctttttctttttgttagtatacattaaattttgatcaattctaatttataattaggaatatgaataattttaaaaatattatataaaaattaaattttaaagaaaaaagattaaaagaattaaattaagaaaaagttaaggatatattgtataaaaattaacatatattctataaaattctgtataatgaaattatacgtattatataaaagccagtacgtacgattaaatgcatataattgcatgaatcaaaatatttataatctggggggattgaaatgaaattaaaaagaacagtggctcttataatgggaaccgtgttaagtatggcaagtttagcagggtgtagccaaactacattaaattatggtgaggaacttgcaaaaactgcaaaatgggaagcgacatcatctgaagttacaggaaaaatatctatggatatacaaggtatgaaagaagagatgaactttacatcaactggatatacaacaggagataaggcatatgcaaaagttgatttcacaacatctgagagttcattaaacataaaaataccatcaatagaggtatatgttgataatggagtaagctatataaacaagagctattatgaaggtatatatactaatagcggattagaagttcctaagggattgaaagatttaaaggctgattatataggtatcgatacaggtatggatatggcagctatgaaagcattaacaaatgaaccagaagcaatggctaatcttgttaaaacagtctttggagatagtgatatagatttaccatatgttcagaatggtagagaatatactatgaatcttaatagtaatgaagtagttgatttagctgctaaaggagttaaggctgcatctaataatttacaaaacataaataacacttttaaattaggacttacagatgcagatatgtcacaaataaaggatcaaattaacagtgaagcatttactagtggacttgaaggaataaagcaatatattgcaggttctaacataacttcaaaagaagtttttggagatgacaagtatactacagacctaggattaaatttaataatcaaggatttaggtaatatatcattaaatgtaactggtacaagcactaaagcagaagctaaagatataacaattccaactaattcaattaaacttacacaagtggaattacagactatgcttttagaagatactcaaaatcaagttacacaaccatcagcttactctaaagaagtaagtggattaaaaaatcttataaaaccagcagtataatatagataattcttagaaaataatctttaatataaatactctttttatagtaaatagtgtataaaacgctattgctgtaaaaggagtattttttattatttatgaaatgtatataacatagtcgccttggcgatttttttattgtaattaaatgaatttgaacatattgttttgaacattgaaaggtgttaatataaaactgttcaaaaaatgaacttaaatacaaaattataagataatgtaaaaataaaaggaggtaagtatgagtagaataaagacggctgttattttagcagctggaatgggatcaagattatatgaagtaacagatgattctatacctaaaggttttttgagtataaatggaaaaactcttattgaacgatcaatagaaaagttaagaagtataggaattgaaaagatatatatagtaacaggtcacttacatgaacattatgacaagcttgcagaaaaatataattatattgagacaagaagaaatagacgttatagaacaactggtagtatgacttcactttcaattttagaaaatgaattgaaagaagattttttacttttggaaagtgatcttatttatgaagtctatggtcttatgagaacagccatgtcttatgaagatgactgtattcttcttagtggaaaaactaattctggagatgaatgttatgttgaagtaagagatggtaatctttacaaaatatcaaaaaatataaatgatattaaagatctatatggtgaacttgttggaatatcaaagatctctttagctttatataaagagatgataaaagagtatagaaagtttgtgaataatttaaaatatgatattgaatgctatgaagaaacaaataaaataatcagtaaatatgattatgaaaatgccatttttgatgcggcaaaaaatagaagagttggatatttaaaaattgacaatttagtgtggggagaaattgatgataaaaatcaattggaaagagttgaaaaattagttttacccagattagaaaaaataagtgtataagatatttttataaattattatttgtggagaggattgaaaagttatggcaaaagtatatatggcaatgagtgctgatattgtgcatcaaggtcatctaaatgtaattaatcaagctagaaatttaggagatgttatcgttggtcttcatactgatgatgttataagagggtattggagaaatccaataatgaagtatgatgaaagaaaagaagttattgaaaatataaaaggagttatagaagttataccacaagatacattggatcaagtatcaaatatattaaaagtaagaccggagtatgttgtccatggagatgactggaaggaaggtcaacaaaaagaattaagagagaatgtgattaatgcattaaacacatatggtggaaagcttatagaagttccatatacaaaaggagtatctatttcaaaacttgatcaagatttaatggaaataggaataactccacagatgaggatgaaaagtcttaaagaacgtatttattctaaaaaacctgtaagaattttagaagctcataatggtctgactggattgattgtagaaaaaactaaggtagagaaagatggaaaggtaagagagtttgatggaatgtggataagctctctttgtgattcaacagctaagggaaaacctgatatagaacttgttgatttaacatcacgacttaatacaataaatgatattttagaagtaacaacaaagcctattatagttgatggagatacaggtggacaaatagaacactttgtttatacagttaagactcttgagagacttggagtatcggctattattattgaagataaaacaggtcttaagaaaaattctctttttggaactgaagtaaagcagacacaagatacaatagggcatttttgtgaaaaaataagagcaggaagagaagcgagagtaacaagtgattttatgattatttcaagaatagaaagccttattgcaaaggctggcatggatgatgcaataaaaagagcagaggcttatattgaagctggaactgatggaatcatgattcatagcaaagaaaaagatggaactgaaattatagaattctgtgaaaaatatgcaaagcttgaaagaagggtaccgcttattgttgtacctacatcatataatttcatgaaggaagaacaacttgttgaattggggataagtgtaataatatacgcaaatcatttaataagaagtgcatatccagcaatggtaaatacagcaaagagtatattggaaaatgaaagatcaaaagaagcatcagaaaattgtatgcctataaaagaaattcttacattaatccctggagggaaatagaagaaaaagaacttaattgcattaaaataagaaaaatttaaaattattatttaatgaaaaggggatatatatgattgatgttgataaattctataaaaaacttataaaaaatcaaattgaattttttacaggtgttccagattcacttttaaaatcattttgtgcatatataaaggatactacacatgaagataaaaatatattagctgcaaatgaggggaatgcagttggtatagcaagtggatattatcttgcttcaaaaaaaataggtcttgtttatatgcagaattctggtcttgggaacatagttaatcctattgcatctcttgatgacaagctcgtatataatataccggtatttcttcttgtaggatggagaggagaacctggaaaaaaagatgagccacagcataaaaaacaaggaatgattacactagaaactttagagttactaaatataaagtattctgttattgatgaattcacagaaaataatcaagctgaagaaattattgataaggcatgtgactatatgagagaaacaaatgaaccttatgcagttgtagtaaagaaaaatgcttttaaagaatatgaattgaaaaatagtatatataatgattttgaaatgagccgtgaagaggcaattgaaacaatactcgatagtattaatgatagttctgttattgtatcaactacaggaatgatatctagagaactatttgaattaagagataagaaaaagcaggagcataatagagatttcttaacagttggatcgatgggacatgcatcacaaattgcattaggtattgctatgactgaaaaaagtagggagatttattgttttgatggtgatggtgctatgttgatgcatttgggaggaatacctgttataggtaataagaaaactgaaaactttaaacatattttatttaataatggtgcccatgactcagtaggtgggcaagatactgtaggattgaatattaacataccaatgattgccgaagctagtggatatgttaaggtgtattcatgttcaacaaaagaggaacttaaaagatattctcaaataatacgtgagtgcaaaggaccagcattattagaaataaaagtgaggaaaggtgcacgcaaagatttgggtaggccaaataaaactccaattgaaaataaagaagcttttatgaactttataagacagtaattttagaaatcatactaaaataagagaagaggtatagtgttgtgaaaaggaatatattattaaatccaggaccagcaaccactacagatacagtgaaaaatgctcaggttgtccctgatatatgcccgagggaagaagaatttggacaagttatggaatttgtatcaaaggaattgactaatctagttgcacatgatgatgagtatacaactgtattatttgggggttcaggaactgctgccgttgaagctatgataagttcagttgtagataaagatatattactaataattaataatggagcatatgggaaaagaatatgtgaaatggcagaaatatatgatttgaattttatagaattcataggttctcctgtaaatggaattgattttataaaattggaacagataatatcagaatataatacaaagaaaacatctattaaaaataaattaaatgactataaaggaattgttggaagatataatattaaaaataaagatgatgaaattaaaataataagtcacattgcagtaattcaccatgagacaacaacaggaattttgaatgatatacatagagttggaggattatgtagcaaatataatattgatttgttagttgatggaatgagttcatttgctggcataccaatagatatgaagagttcaaatattaaatacctagcatcaagttcaaataagtgtatacaaggaatggctggagtaagttttgtaatagctgaaaaagaattattggttaatacaaaaaacattaaaccaagaaatttatatttaaatttgtataatcagtatgaatattttcagaaaaactatcaaatgaggtttactcctccggtacaagtactatatgcattgaagcaggcaataatagaaacaaaagcagaaactatagaaagaagatatgaaagatatgtaaaatgctgcgagatactttgggaggggttagaaaaactggatttaaaacttcttgtaccgaaagaaaaatcatcaatgcttcttacatctatagtagaaccggaagttaaagaatataactttgatagtcttcataattatttatatgagaaggggtttacaatatatcctggtaaagtatcatctaaaaatacttttagaatagctaatattggagatatatatcctgagaatatgagaaagtttattgagattttagaagaatattttttatcaataaaataagagtatcacaaaaacttatgtatttattatttacataagtttttgcgattttttatgcaaatttgtgtaagtattaaagtttatgctatataagtgaattgtactaatttttatctatataaatatgagatttgatagaaaacaatgaaaaatatataaaagaataaaaaaattaccataaatgtaataaaaagattgaatttaaagaaaaaaatatatataatagatatatgataaaaataagggagatgagagttatggaaatgaaaaaagtattaagtaacttattaaagaaagcaactgaaacatcaatgacagcttcaaaagcttcagtttgtagttttggagtagaaaaaatgcctgaatcaatgaaaaataatagataggcaaaatctataaaataatttttattacataaagctgaaatcaatgcaatattgatttcagcttttgacttgaaaattatatttattttaattttaaagaaacattaaatcgacaaggattatagaatccatcagttattttccaaccatcaaaaaaatcctttgtataaagtagatgagtatctcgatgagagttcataggaagatcaccaataaagactgcttctttagcaactctctttaattcattaatagctttagttgcatattcaagattaggaaagtaatgaaaagcaccaaaacagaataccttatcaaagcttttgtctttaaaaattaagtcgtttgcttcaccgtgtaaaacagagttattaagtaactctatatgacgttgtactaaagtttcagaataatcaatacctacgtactgagcacagtttatgtattgagctagtccacctgcaccacatgcaacttcaagtactttatcagtttcttttatatcaagttcttttataatattttgagcaatttcttttacattagctgtagtatcttcatatccatctagttcttctaaattatttgttttaccacgtccctttctttcccaaacttctttccaataagacatatcttccattttaaaaacctccaagattaaaatatttaactattcaataaatttcagttcaattattgaacatttaaatattaacattgttcaatgttcactacaacaagttcaaagaagaatgtagaaaaatatattaatccatgactatagaagttattgtaatatattctactatatacgattatatggaataaaagttgaaaatttacaagaaaagaattataatttaagagataatagacaacttagggggaaaatattatgccggaaatcctagatgtaatactaaccataatacagacaattttatttcaatatacagtatcatgttcctctaaaataagagaattaaaaaataattgtataatggctatagttatgtttgtaattagttactggttagttaaaataacagagtctttaagcatactaaatattttttggcattttatagtaatgataatggtttattatctatatgaccatgataaaaaaaatcgaattataaattgttctatattttatatatttaactgtattatggttattatgattgtaaatggattaaatttttgtataagttttagtgattatcaaggcgataaaaatttgcttattacaaaaatttactttattttatatatttttttatcagctatatatagtttgagaataaaaaaaatatgtaattacttcaatcaaaataaatacactaattctataataaccagtagctttataatagaatttatagtggctattagtaatggtaattttttcaatgaaggaccgttttttatagatctttctttacttataggtcaaatgtttatattaataacttctttttatttttttatattatatacaagatcaaaaaaagtttttcaagttaataaacgtttagaagcaaaaaatttagaattaaaaaatataaaagataaacatgcaggagtaatagggtatttgcagaaaatgtattctttgggtcataaagagcaagtaggaataattttaaaagaaataattaatgggaatgaagatgctgtatgtgaaaaaagcattaatgatgaaacatcattaataaatattattgctaaaaatgctattaataaaggcatagaagttaattatgaaaatggatttgatatttcacttattgaaatgaatgaattagaactatatagaataataaccaatatagtgaataatgcagtacgagtattagaagagattaaaaatccaacaataaatataagaatatacaaaataaacatgcaagcagggatagaaatagaaaataatggtccgatgatagtagaaaaaaatattagaaagatatttgaacatggttttactactaaggaaaatagtgatagttctcatgggtatggattaagtattgttaaagagcttatagaaaatagcaatgggacaattgaagttattagtacagaacttaagacgatttttaagattgtgctacctgctaaatgtaataatgtataattaggggattaataatgataaatgataattttatattatatatatttagtacatttataaagacaatatttttttcaattttaatttataaatgtacagaaattctatatttgaaaaaaacgtttaaattaatagtatatttttttagtatactattaataggtgaatgtattcagttatacattaataatgatttttttgaattgatactttttcatttatttcaattaggtgttgtattttgtgtgtatgataagaaaactttaaatccattaatagcattttcttttggatattatttattgtgcatttactcaaatataaatttagggataaatgaatatatattgtcaaggtatagtatagctacatttggtaaatacaacttccttgagaatatagtaatacttattcttatatatttatgtatgcagaaaaaggataagataagagattttataaaaacaatatcagaagataaaataataacaagattatttataggtggaacttttgcgtgtgatgcttttattggtttgttttattgtgaatcatcaaaagttaaaaatataaagatgatattaacattctttatatatattgcaatgattatactaattaattatttagtaaaggttataaataaatcttatattttagatcaacttaataaagagatggaaataaaaaatgatgaattgagaaaaataaaacatgattatggagcacagatatcatatttatatggcttgtttttgctacaaagatgggaaaatttaaaggaagctatagataaaattgtagatatgaatgaatctgtttcaagtggtgtaatagtagataatttagaaaattccataataagagaagcatttgaaccaattttgaataaaggtatacatgtagcaatagaagaaaatacatatttgaataatataaatgtggataaagaggaattacttagaataatttcagaagttggaaaagcattagcaaatttaattaatgaaaagggaataatattagcaacaacatatatttcaattgataatataattattaaggttgaaggtagtggaataatagaagaaggagcactaagagattatagtcttattgatggattaagagataaacttgtaggtataaataaatctgtaattaaaaatggtgggaaaatgctttttaaatataatcatatatcaacacaaataaaaatatcatttccaatataatgcaggtatgtacctgcatttttgttttggtaaaatgatgaaaaaaatttatcataaaattttatagaagatacatctttttcaaaaaaataatttgaaatttatacataatagtgtaaactatataataaggttaaagaccttacaacctaacattatacaaaggggtgctatagaatgtataaaataataagcaaaaaggagctaactggaaatatatttttaatggaaattgaagctccaagagtagcaaaatctgcaaagccaggtcagttcattattattaaaaatgatgaaaaaggtgaaagaattccattgacaattgcagattatgatgaagaaaaagggactgtttcaattgtttttcaaacagtaggcaaaagtacaaaagaattagcgcaatatgaagctggggaatatgtaagcgattttgttggtccacttggacagcctagtgaatttgtaaatgaagatttagaagatttgaagaagaaaaacatattatttgtagcagggggagttggtgctgcaccagtatatccacaggtaaaatggatgaaacaacacggggttaatgtggatgttatattgggaagcagaactaaggatttacttatatacgaagaagacttaaaagctgtaagtggaaatttatatgttgcaacagatgatggatcatatggatttaatggaagagttactgattgtttaacagatttagttaaaaatcagggaaaaaaatatgatcatgcagttgtaataggaccaatgataatgatgaaatttatgtctgcattaactaaagaacttgaaattccaacaacagtaagcttaaatcctataatggttgatggtacaggcatgtgtggtgcctgcagagtgactgttggaggagaagttaaatttgcatgtgttgatggaccagagtttgatggacatttagtaaattacgatgaatcaatgagaaggcaagctatgtacaagactgaagaaggcagagctactttaaaagttgaagaaggaaatactcatagtcatggtggctgtggttgcagaggtgataagtaatggatatgaatgaaagattgattagagtacctgtaagagaacaggacccaaaggtaagagctacaaactttgaagaagtttgtttaggatataatgaagaagaagctgttaaagaagcttcaagatgcttgaattgtaaaaatgcacaatgtagaaaaggatgtccagtatcaatagatattccagcatttattgcaaagttaaaagagagtgattttgaaggtgcagctaaggaaattgctaagtatagtgcacttccagcagtatgtggaagagtatgtccacaagaaaaacaatgtgaaggcaaatgtgtacttggaataaaaggtgaatctgtatctataggtaaacttgaaagatttacagcagactgggcagcagcacataatgttgacttaagtgcaacagaacctaagaagggaattaaagttgcagttattggaagtggtcctgcaggacttacttgtgctggagatttagctaaaaaaggatatgaagtaactatatttgaggcgcttcataaagctggaggagttttagaatatggaattccagaattcagacttccaaaggaaaaagtagtagctaacgaagttaataacattaaaaagcttggtgttaaaattgaaacaaatgttattataggaagaacaattactatagaagaattatttgaagaagaaggctttgaagcagtatttataggttcaggtgcaggacttccaagattcatgggaataccaggagaaaatgccaatggagtattttcagctaatgaatttttaacaagagtaaacctaatgaaagcagcagtagaaggatatgagactccagttagatctggtaagaaagttgcagtagtaggtggaggaaatgttgctatggatgcagcaagaactgcattaagacttggatctgaaagtcatattgtttatagaagaggtgaatcagaacttccagcaagagcagaagaagtacatcatgctaaggaagaaggagtaatatttgatgtattaactaatccaacagagattttagtagatgaaaatggatgggttaaaggaatgaaatgtgtaagaatggagcttggagaaccagatgcatcaggaagaagaagccctgttgaaattccaggttcagaatttgtgatggatgtagacactgtaataatgtcacttggaacatcaccaaacccattaatttcatcaacaactgaaggattagaaattaataagagaagatgtattgtagcagaagaagagactggtcttactacaaaagaaggcgtatatgctggtggagatgcagttacaggtgcagctacagttatattagctatgggagcaggtaaaaaagctgctgctgctattgatgaatatttacaaaaataagatttaaaaatagaaaaagctatacagaatttattttttaaaatgtaccctttgtcaaggacagtttaaaaaaagtctaagcaacattaagaagatgatttctgtaatcaacaggagtcatcttttttaaattccattgagccctataattattatgataggcaatataatcatctatttctttaattaaatcttcaaaagtttcacattctttaatggttgtttcatcctttaagtgtccaaaaaacgattcctgcggggcgttgtcccagcagttgccacgtctagacatagattgtccaattcctttctctttaagtttcttttgaaaaattggacttgtatagtgagccccttgatctgaatgaataaatgcatctttatgtagagttaaaggggtattaaacaagttatcaattgtttgtgtaactatatttatttttaagcttttagataagttgtgagataatatttcattagtagatgcatctagaatagtcgacaaataagccttttgaccatctttataaaatagatatgttatatctgttaataacacttttgcaggtataccttgcttaaagtctctatttaataggtttggtaagactgtatgctctttagtagctttcatcattcttctatatggatttgcttttctgtgcggacaaataatgttatattttttcattatccttctaatgcgttttaaattatagttgataccaaaaaatttttgcaaagtcatttttatttgtctagcacctttttttcggtttttaaactcgaaagcagcaactacatttttataactttcttgatccttagattcttgagcatttcgtttactcattgatttaagcgaaaaataattataatatccggagcgtgaaacgccagacaatccacatagataactaattttattttttattttatatttttcaacaattgattttattacgataaatttttcagaaactaataagtttacttctttattttcacgcccctttccatcatttctaacttttttaacaattcattctcagcttgtaagagttttatctttgcttgaagtttttcatatttttcttcaatagataattccttctcactaggccttccagtattaaattttctagtatcttgtaattgtgatactccatttctacgaaatgcggagcgccatctcttaccagatgattcaacacgtttcatacctaaaatttctatattaaaatcatgttcctcaaatatttgccttggaaatttaccattattattttcaactataaatattcttttaaattcatcagtatatgtaattcctttattactaactttttttacatacttatttttagatagtattgttatttcttcttctgtaaatatcttattgctcattttatcttctcctagttctatttatttaattatacataaaagtaccttacagaatagactttttttatattgtctatcctatagggtacattttattttgagattctgtatagcttttttattaatagtacagtcttctttatataaaatcaaaagaaatttgttcaaatattgaaaaaaataatttaaaatgtaataattatgtataatgaagttttttcttaaagatatattttaaaaggatagtatgtttgaaatatttatgaagggagagtttattatgtataataaaacaacaaacgaagttattctttatggaattgataatattagtgaaaaattggatggaatcatacactcattaaatttagaaaaacaatgttttgaaataaagctaataatgtctgaagctattgctaatgcatttattcatggtaataatcaagataaagataaaccaataattgtagaatgcaaattagaaaatgattttataaatatttcagtaaaagatactggtaaggaaaatttaactttaaaaactaataaagaaattgatgaagatgatattttatcggaaggtggacgagggttattcataatatctgcctatacagatgaagcagagtttaaagatggatgcttaataatgaaaaagtcacttaagtaaaatatttttctagaaattatggacagactctagtttgtcattatgaaaaaaatgtttaaatagggaggaactaatagatgaaaatttctttaaaagtaaagctgatgagtgctttttttatacttatagctttacctatgagtatattaggagctgtatcatataagatggcatctacgtcattacagagttcaactaaggaacatcttatacaacagacttcagatactgcatctttaattgataatgcaatacagtcggtaaaaagtacagtggagatttgtagtttaaatggacagcttggaaagatatctcaaagtgaaaatgcggcatatatagatgatgcatttaaatatatatgtgatgtgcaaaaaagtaatgaagaattcatggaagtattgatagtaacagattctataggtacagtaataattgatagtgaaagtaaggaaccagatattgatttaagtgatagagattatatgaaaaaagcaataagtactggtgacactacaatgagtgaggttttaacatcaagatttactgggaatcctgcaatattcattgcatgcccaataaaagaaaatggtaatgttgtaggaactgttgttggtagtataaagtttgatagtatatctaaatatgcttcaaatgttaagattggtgagaatggctatgggtatatgattgataaaaatggcttagtagtagctcatccagatgaaagtaaaatattaaaagaaaatgtaagtgaaagtacagaaagtgattttaaatcaatagtagaaaaaatgaaggctggagaaaagtcagatggcttctatacttatgataatgtatataagtatgtggcgtttgaaccagcaggaaattggattgttgcggttacagcagattatgatgaatacatggcatcagcgataagtattagaaatgatactttaattttggtggtgttggctattattatagcaatggtttgttcatatatatattcaacaaagggtattataaatccaattaaagaattacagaagttaatgaaacttgcaggggatggagatttaagagtaaaagctagagttggaagcaaagatgagattggggaacttcaaaagtcatttaatacgatgattaaacatcaggatgaaattgttaaaagtgttagaagtgcttcagaacatttaaatacagcatctgaagaaatagcaagttctcttgaagaaataagtgcaacaacagaagagataagtgctacagtaactaatgtagcagaagaatctaaaaatcaaaatacatcaattgtagatgtatctgaagtacttgttcaattatctagtcttgtgcaacttgcacaaaatagagctcaatcaactaatagtaacgctattaattcaaagaaaatagcacatcttggaagaggaaaagttgaagagacagtaagagctatgaatagtataaatattgaaagtaatgatacttttaatgcattaaagcatgtaaatgaattatctgttgaagtatcaggaatagtgacaacaataaatgcaattgcagagcaaactaatttattagcattaaatgcagcaatagaggctgctagagctggagaacatggaaaaggattcagtattgttgcagaagaggtaagggaactgtcagaggaaacaaataataaagctaaggaaatagcaggactggtttctgaaatggttaaacaaattgaaaatgcagtaaaagcaatggaaagagcaaattcagaagttgaaaatggtgtagaagtggtatcagaaacagataaggcatttttagatataattgattctatagaagatatagctaaacatgttggagagattcttgatattacaagtgatgaagttgcatcttcagataaagttatttcgcttataaatgacattgcaactattactgaaaataatagtaaaaactgtgaaggcgtatcgttagcaatacaagaagaagctaatgtaactaataatttaacagctacggcagaagaaacaagtgctatgtcagaacaactgatgggacttgtagaaaaatttattgtatgaggtgaaaagtagtggataataatttaaacataataataccaaaggatttttgtgttgaagaagttgctgattttagaattaaaattaataattatatagatgaaggaaaagtaaattttatttttgattttagtaattgtagttttattgatagtacaggacttggagctattgtttcaatatataaaaagtgtgttgagaaaaatggaagcctaaagttaaaatcattaggaccagaagttaaaaagttatttcaattaacaagacttgatcgtgtatttgaaatagaagaatagaaattaattaggtagagtttagctgtaatattctataagtatggctaaactctatgcttgttattggaaaatgagaaaggacaatagttatgagtaaaattgataattcatcaatagcagttaaagatgtgcagtgtattttagatggaatttcagatgttattaaggtatttaaacctgaccatactgtatatttttgtaatgaggctggatataatttttataagaagagcccaaatgaagttgaaaagaaagtttgctataaactattaaataaggataaaccgtgtaaagattgctgttttgctcaagttgtaaaatacaaaaaagagataaaactagagagatatattcctgaacttaataagattatgaatacatcatatactccagttttagatgaaaataataatattaaatttattattgagagacttgaggacataacagaaagaaaaactttagataaaattttgaaaaatgataaagaaagatatattcatattttaaataattccccagatgctttaatgattatagttgataacagaatagaagtggctaataatgaagcagtaagtttatttgatcaagagcatgaggagataattaatagtaatatatataagtattttgatgaaagatattcaaaaattcttcataagaaatttagaaatataatattaagtaaaaaattaaaagaaaaatatgattgtgaattaaattttgataataataaaaagacaagtgtacagttaacttgcagatatatgatgtatgaaggaaagtcagcaatccttatgactgtgagaaatacaagtgaaagtagaaaagatcttataagggcagcaaactttcaaagaaatagtctgcaaagggactttcaaggtggaaagttttttgaaaatgtttgtgtatatgtacctgcatatacaataagcggtgatttttataggataaataagataaatgatgaattgtttattggaattttaatagatgtaaaagggaagggaatatctgcagcattaaatatatcagcattagagttaatgtttatggaagaaacatttacagaatatgaacctattaatatagttaaaaatttaaatagaaaaatagccaaatactatgaagaaaattatatagcagtatgctgctttagtataaatttttcaaagaaagagtttaagattgtaggtgcgggaataaaccagtttatgtttcaaaaacaaggaaaaaaagcagagaagaaacttgcagaaggaccgtttttaggtatgttttcagatagtgaattttcagagaaaaaaatacaggttcaaagtggtgatagattatttctgtttagcgatggattagattttatatttgatgaagatgagataattaaaagatatatggaaaaagtaacgttaaatgattttaagaaatatattgatgaatatttagaagatacaattttagatgaaggaaaacttaaagatgattctacaatgataggcatagaaataaaataagtactataaatttgtcctttgaataaaaagttaaaaattgtatatactttattaatatgttatttgacatagtatgattaataatatataatcaaaaatgcaagatagatatttgaaaattaaatatgcgtttaagttttttataaacctgggggtgttttggcttcgacgggggcatgaaagatttattaagcgagtcgagggaagcatgtgtcctcgttaataaagtatgcactaaatgtaaacgcagaagacaattttgcattagcagcttaatataagctactcatcagcccgggttgcctacggctcggatcactggtgtcattgaagtgggacacgaagcctggcaaagctttgagccagaggggtattaatgaagctaccgagagtgtaagcctgttcatgggcgtgcacttgggggaatcttaaaacatgaactgcactcggagaaagataatgacgtcggctttcggacacgggttcgacacccgtcacctccaccacaaaacctacgaaaatcattttattggattttcgtggtttttttttatttaaacctaaactattagtattgataattaaatggaaataaagataaaacaaataaaaggtagtactttaaaaaatatgtaattactttttgaattattacgattattaagtaatgataaattaataaataaaatatggaataaataatgtttaaatgaacataaaaagttataatattaataaaatgtaattattatgatatacttaagtatagatgagtaatatattcaagaaaggtactatgatgatgagcagtgataagatagatatagataatggaaaaataatacaagcaaatagaagttatatattaggaaaactagttagtgatattgagtatttacctaatattggatatgaaaaagaaccaataacagtcatgaagaatagtagtaatgttgtgttttacgttaagccaatttcaacagaacctaagtatgtagaacaaatcataaataaatatctcaatagtggatcaacttatattggagtagatagtcataattataatatatttcctgttggatataaattaaaagatgaaagtgaaaaaatagagatagctaagaagctttttgataataaaataattttatttaaaccatatataaatgttaattcaaatgcaaaaatacataaaaatatggatattattagtgtggaagatataaatgaagctcatagtggttataaatacacatatatacctatattaaatatcagtaatgatgaatttgaaaataaatttttaaataatgacccaataagtttgaatggtaattattctgatttatcaaatataggttatgtaatatgtggaaactatatttatggttacattgatagttgtaaaaagagtataagggctatagattcatggatttttgaatctgaaaatttaaaaaaatatatgatagatatgtctagtgaagaatttaagaacaattcagttgctcacaaagatgagatgatatttttagaaagaagttatttagaggaattagatatacatttaacagatgaaggaattgatattgagaaaaaagaagataattatgatacagaaaaaagtacaagtgagtttgcagatgaaaataatgaaaatgactttattcatttaaatattaatactgaaataaaatttctaaatgaatttagagataaaacattagaacatggattatattatactaagacagatttgtataattttcacattagcgtaaaatcgaacatgttaactatattagcagggatgagtggtacaggaaaaactcaaatagcaaaatgttatgctgaagctttagggttgtcagaggaaaataaaaacttgctatttttaccgattagtccatcttatacagaaccagaagatttgttgggatatcttaatgcaactacgggtctttatctaccatcatctacagggttagtggatttactaatatcagcagaacaaaataaagataagatgtatgctgtaatatttgatgaaatgaatttgtcacaaattgaacattggtttgcaccatttatttcattattagagcttaatgccaatgaaagaaaattgtcattatattcacaggattgtatttgttacaataaaatgaagtataaaaataatgtggttattggtgacaatatattatttataggtacggttaatttagatgaaactactaaggatttatcagatagagtgttggatagggctaatgtgatatcattaaaaaaacgtagttttgctgaattaaaagaaaataacgatgatataatcaatgcaaatgaacaaaagtctattaataatataggatttgatgaatataacttgtggattaataataagaattttattaatacgtttgacatagatgaattaactttttttgataaattacatgaattattaagtaaacaagaaagtataaatggaatttcttttagagtattacaaggaatagctaactatataaataatattccatatgatgaagatgaagcattaattagtagaagtgatgcttttgatatatgtgttaaacaaagaatattaacaaaaataaaaggttcagatagagaactagatggattaataaatattgattattcgaatgaaaatgagattggaagtttatataatttatttaatagtgaagaagcaaagaaattaagtgaatttaaagaagttaagataaaaatccaacaaaaattcgaggaattaaagaaatatggatatacaaactaaaataaaagtaaattattataaatggataagaaatgatatatatgaaaaaatatacgatgaatatgtaaagtttttcaatgataatagtagttatttaggtgatgcgtgttttgagtttaatgaatatcaaagaatttcaattgagttaatttcagataataacaatgattatattgaaattgaatcttatgataaagaagaaatgttaagaattaatacttcagaaaatgaaaaaattatatcacctggaggggattctgatgttggattagttccaggaaattatcagttaaaattatatagtaatgaaaaagtttatactgggatgtataaagttactccttgcaatatagataatgaagaattaactaatatgaaatcctttatggaacaaatatgtgaaggaattacatacaacttatacttagagagaaatggttatgaaaaaaatgagttggatataatgactttaaatttagaatcttataaatatctaaaaaataactatagaaatattatgaattcaattaacagtattttgaaaaatccaatagaaaaaataaaaagtgaatatagattatctaaatttagtaaaaaagttgatgataagagtttaagatggaattgtagccataaagatagacaaaatgcaggaaataaatgttttaaagaaaaaagaatattaattacagatgataactatgaaaatattgcagtaaagtttattatagaaaaactatataagctaagtactgtttttgaacagcaatatgaagtttattggcacagtataagaaaaaatgtgtcaattattcaagataaaattgttactatgcaaaatgaattggaaaatataaaatttttaggaaacgttaagaggcgaaagagtgagttaaacatagatatttcaggacaaaatgcagaactgaaaaagtataatgaaaaattgaagaaaatagaaaaagagatacatgatatatcattaattagtgctaattttagaagatatatggacaatacatggttcaaaaatatttcaactaaaaatattagatttcgcactacaacaaaattattgaaaagatatgattataattatttatataaaatctatatagatatattccgtggaaataataaaaagaagtttaagcaaacattatcaattaaaaaaacatcagtattatatgagttatatatttttataatagttaagcaagtatttgaagatatgggatttaaatggactagaggttggttgaagtcacaaaaggatatttatacttgtgatttagaaagtggagaggctattactttagagaaaggaaaatataaaattgaaataatctatgataaatttattaatagggtaagagatgtaaaaggaaaaaatgtatgtgaagtagtttctaatagagaaagaagaagacctgatatattaataaatttatacattaatcatgaatttgtgaagagtactgttgttgaagttaaataccgaaaaaaatcatatatttacaatcataatattgaaacagatgttatgaatcaacttatagcttatagggaattagactattatgatgcaaattcaaaaaataataaagtttcattacaaagagtagtagaaaagataattgcagtatttccatctaataaggaaaatgattactatgtagatgaaacatactattttcagtttatacccataaaacctcagtataatgaagaaaagccattaggatatagatatttgtataatcaattaaatgaatttgttgatgaatctctttgacacttacattgtatgaattaaatcctgaaagtttctttttaacagatttgggagaaaaaataaatttaacaaaagataaagtgaatttatgctatcaatgatatttattttattgaaacaatattggattctaaaactaaattcgaacgtttaaactatgcattaacgttgatggatttaacggaagaacttataattaaatattcaaattaaatgaatttgaacatgagtttacattatagtataatcaaaataattaagcaaactattttggagaaaaaaatgaataaaaacaaattatcaattaaagaacaagttactcatatgaaagaagtacagggtataaaattttgtattgttaatgaaaatgaagcagaggaatttttgaagaataataattattattttagggttaaatcttacgcaaagaactataataagtatgataagggaattaataaagataaatatgtaagtcttgaatttgcatatttaaaggaattatcaatacttgatatgcacttaagaaaatatataattcaaattactctagatatagaacattttctgaaaacacaattgcttagagattgttctgaaaataatgaagaagatggatatagtatagtagaagactttttagaaaaatatccatatataagagaaaatattaatagtaagaataataggaattctatttgtagggaacttatatttaagtattcagccgattttgctatttggaatatagtagaggttttgtcatttggagatttcataaaattatatgaaatatactataaaaaatatccgtataaagaaagcatttataaatatttatattcaatcaaatttttaagaaatgctgcagcacataatagttgcttattgaatagcttaaaaaatccatacaatactagaattaaattatttaaagatattaatacatatatttctaaaattaatggtgtaaattcagatgttagaagaagaaaaatgtctaatcctataataaatgactttgtagttatgctttatgtttttaataatatagttactagtacttcaataaagaaaaattcgatgagtacattaaaaaatataattgatattagatttacacggcataaagaatattttgaaaaaaatcaaattattgtttcagattataaatttataaagattatagttgactatttttactataagagtgtataatgaagttaatgaacaaaaacatttagtgtttttatcgggaaggtgctagcaccatcccgattttttgttatatagtggatttcaaagatcacccgtcacctccaccacaaaacctacgaaaatcattttattggattttagtaggtttatttttgttaaaatactttctatatactaggcaaatgtgtaaaaagggttgtttcatgataaaatagtttctataacaacatagttggataattaagatagttatatattgtagatttggggagatattaagtacaactaataaaaataatgttgatattatattttataagtaatggagaggtagaaatgaaagattatatcgaatttatcactgaagcatggagaaaatttatttcttgtgggaaagttgattcaaaggttagatcggagattgcagattcatggataaggtgtagaaaatatggagtagatcctcataacggaagagggaatgttaaatatactaatatagatgagcttattaataaaaatagtgaacttatttctgttgctagaccagttatagaaagtatttatagtttggttcatgggtcaggatttgccttgtttttagctgataaggatggatatataatcgatgtaataggtgataaagatataatggagaaagttgaagaattaaattttctaaaaggtgaactgtggtcagaaaaagtagttggaactaatgctataggaacagctttatatcttaacaagccagttcaaaccattggagcagagcattatggggaaaatcaacattcttggacatgctccgcagcaccaatatatgatgaagatgataatttaatcggatgcataaatatgtcaggtaactattacaatgctcattctcatactttgggtatagtaacagcagctgctcaatcaatacagaaacaaatgaaattggccacttcatataaattacttaatataactttcgagtctatatcagaaggtatgatagttatgaatgaacagatgaagataaaaagaataaatgaacaagcactaaaaattctaaatatatcgttagaagaagcaatgaatatggatattaatcaggttttaagtggcattgattttcataagatcattgaaagtgaaaacaagtttttgcataatttggagtgggatttttctataaataatgacataataaaatgtgttatagatatacttccattaaataaaaatgagaaaaatagtggtatggtaataacttttacagaggtggaagttgtacataaacttgtaaataaatttgcaggatataaagctcaatatgaatttaaagatataataactaataatctagaaatgaaaaacatgataggtttttctaaaaaggctgcaaaaagtgattgtaatatattaattcaaggagaaagtggtacgggtaaagaattaatttcacaatcaatacataattacagcaatcgggcaaaaggtccatttgttgcagtaaactgtgcttcaatacctagtgaacttgttgaaagtgaattatttggatatgaaaaaggagcttttacaggtgccttgaaagagggacacccaggtaaatttgaactagcagatggaggaacaatatttctagacgaaattggagaattgcctttagacattcaaagcaagcttcttagagtattagataatggaaagattataagagttggtggaacatatgaaaagcaattaaatgtaagggttattggagctactaatagaatattgaaaaatgaaataagtaagcagaattttagagaagatttatattatagattaagtgtaatggaaataaagacaattccacttaggaaaaggaaagaagatatagacttgctcgtaaatgagtttatacaaaagttaaatataaaaaatagaaataaatttataaaagcaaaacaatcatatatagatgaattaaagaaacatgattggcatggaaatataagagaacttaagaatgttgttgaacgagattattacttaagtgaagatgaaataatgaatatagacataaacaatttagattataaaaatacattacaagttttgaatcaagaatcattaaatcaagaggaaattaaaaaaatagtgcctcttgatttggtagaagagaatgcaataagggatgctataagaaaatgtaatggaaatcttcagctaacagctaaattgttaagtataggaagagcaacgttatatagaaagataaaaaaatacaatatagatgtatcaaaatgagaaaagaagtagatatgtatcaaaatgagaataaaaaatgtatcgttttgatacatttttattttatagtttaatagtttttatgtaagagaataatatatacaataaataaaaacctgattatatcaaggaattaaccctaataaaataaaaaaactatgattctattcataacttggtatgaatattgctaataatatatgtgaattaattaacaatttatcaaaggaggagttttaatatgaaagcagcattatggtatgcaaagaaagatgttagagtagaggaaattgaagaacctaaggttacagttaatggtgtaaagattaaagtaaaatggtgtggaatatgtggatcagatttacatgaatatttaggtgggcctatattcataccagtgggacaacctcatccattaagtggtacaacagctccagtagttctaggtcatgaattttcaggagatgtcgttgaagttggatctgatgtaactaacttcaagccaggagatagagtaattgttgaacctatagttgcatgtggaaaatgtccagcatgtttagaaggaaaatataatttatgttcatcattaggtttccatggactttgtggaagtggtggaggacttgcagaatatacagttttcccagaagaattcgtacataagataccagatgaaatgtcttacgaacaagctgctttagttgaaccaatggcagttgcattacattcaattagagttggtaattttagaacaggtgatactgcattagtactaggatctggtccaataggacttgcaactattgagtgcttgaaagcagcaggagcaaaattagtaatagtattacaaagaaagtctataagacaagagtatgcaaaaagagcaggagcagatgttgttttagatcctaatgaagtgaatatagcagaagaagttaaaaagcttacaaatggattaggagtagatgtagcatttgagactacaggagctcaaataggttttgatacaggtatcgatagcttaaaattcgaaggaactatggttataacaagtatatgggaaaaaggagttacatttaatcctaatgcattagtgtttacagaaaagaagatagttggaacattggcatatagacatgagttccaagcaactatggctcaaatgaaggatggaagaataaaagcagaaggatatgtaacaaagaaaatacatttagatgatatagttgaagaaggttttggtgcattaacaggccctgaaaagaagaaacatgttaagatattagtaacaccagacaaggatcttatatcttaatatatattcaatttccaattaataatagaggtattagatagtacttatagatgaagtatattctcgcaagaacaaaaattatatataagattcagattaagaaaaatcagaagctgaatcaagttacttggttaaattaggaggaacgtaaatgtataaaatagttaacaaaaaggagctgacaaataatatattcttaatggatatagaagctccaagagtagcaaaatctgcaaaacctggacaatttattatcataaaaaatgatgagaagggtgaaagaattcctttaactatagcagattatgataaagaaaaagggacggtaactatagtttttcaaactgtaggaaaaggaactaaacagttagctgattttaatgaaggagattatgtagctgactttgttggaccattaggtgtaccaagtgaatttatacatgagaatatagaagaattgaagaaaaagaatttcatctttgtagcaggtggagttggcgcagcaccagtttatccacaagtaaaatggatgcatgaacacggaatagctgtagatgttattttaggaagcagaaataaagatttattaatatatgaagaagagcttaagaatgttgcaggaaatctttacgtaacaactgatgatggatcatatgaatttaagggaactggatcagataagcttaaagaattagttaacaatcaaggtaagaagtatgatcacgcaattattattggaccaatgataatgatgaaatttacttctatgctgactaaggaattaaatattccaacaacagtaagtttaaatcctataatggttgatggtacagggatgtgtggtgcttgtagagttactgttggaggagaagttaagtttgcttgtgttgatggaccagagtttgatggacatttagtaaattacgatgaatcaatgagaagacaagctatgtacaagactgaagaaggcagagctgctttaaaagttgaagaaggaaatactcatagtcatggtggctgtggttgcagaggtgataagtagtaatggatatgaaagagagaatgataagagtacccgtaagagaacaaaaccctaaggttagagctactaattttaaagaagtatgtatgggatacaatgaagaagaggctgttaaagaagcttcaagatgcttgaattgtaaaaatcctaagtgtgtggaaggatgtcctgtatcaattaatattcctggatttgttgcacatattaaggatgaaaattttgaagaagcagcaaaagaaatttcaaaatatagttcacttccagctgtatgtggaagggtttgtcctcaagaaaaacaatgtgaaggcaaatgtgtacttggaataaaaggtgattcaatatctataggaaagcttgaaagatttacagcagattgggcagcagcacacaatgttgacttaagtgcaacagaacctaagaatggaattaaagttgcagttattggaagtggtcctgcaggacttacttgtgctggagatttagctaaaaaaggatatgaagtaactatatttgaggcgcttcataaagctggaggagttttagaatatggaattccagaattcagacttccaaaagaaaaagtagtagctaacgaagttaataacattaaaaagcttggtgttaaaattgaaacaaatgttattataggaagaacaattactatagaagaattatttgaagaagaaggctttgaagcagtattcataggttcaggtgcaggacttccaagattcatgggaataccaggagaaaatgctaatggagtattttcagctaatgaatttttaacaagagtaaacctaatgaaagcagcagtggaaggatatgagactccagttagatctggtaagaaagttgccgtagtaggtggaggaaatgttgctatggatgcagcaagaactgcattaagacttggatctgaaagtcatattgtttatagaagaggtgaatcagaacttccagcaagagcagaagaagtacatcatgctaaggaagaaggagtaatctttgatgtattaactaatccaacagaaatcttagtagatgaaaatggatgggttaagggaatgaaatgtgtaagaatggaacttggagaaccagatgcatcaggaagaagaagtcctgttgaaattccaggttcagaatttgtgatggatgtagacactgtaataatgtcacttggaacatcaccaaacccattaatttcatcaacaactgaaggattagaaattaataagagaagatgtattgtagcagaagaagagactggtcttactacaaaagaaggcgtatatgctggtggagatgcagttacaggtgcagctacagttatattagctatgggtgctggtaagaaggcagcaaaagctatagatgaatatttaaagttaagagtataatatacttacttgaaagtggattttgaatagcataagtcactttcactatgaaaagcaaaaacatgaaataataattttagttttgatatgatccctttatagaagacagttaaaataataaagctgtttatataaagggatattttaataaatagatatttttcaaaatattagtatcacaattgaagatattgtagtataatatacaaaaaggaaacttaaatattaaaaaaagtttccttttaaaatacacaatggaaacttaaaagtataatatagtttcttaaggagttataattatgattaaaaaatacaactataaaagctttaattcaatatttgttggaactttaggagttgcattaggtataagacaaatggctatgactatggttatgccttttttaagtacctatagtaatacattaaaatataatacatcaatgttagctggaatagcacttggtatatttggcttgatgcaagctttatttcaaattccttatggaatttggagtgataaaaaaggaaataaaattgtaatggtaataggattattacaggttggaattggattggtcattgcatattttgctaacaatatttattggttaatatttgcaagagcaatgcagggaagtggtgcaattatagcagtaggttattcgtggatatcaagtacggtaactgatcaaaaagaaagaatgaaatccatgagtataataagtacgattattggcgtagcagcagctttatcttttgcatttggtccattaattcataagtttgtttccgttaaagatatgtttttatattcagcaataattatttttattgcatggtttgttattgttatatttttaaaagatacaaaaaatatttataatgaagagacgatggaagttaaagatgcaataagaattttaagtaaagataaaagttttatagcattgaatattgcagcattaattaacaactttataatgaccgcaatatttttttctatcccgcaatacctagagaaacttacaggcatcgatggaatgtggaagatatttatgccaacagtaatagttgctataattgtaatgagaatagttgtaagaagattaaataattcagaaagtgttaattttttaatatcagcttttgttttatcagcattaggagttttattttatttaaataaggattcttttatttcaatatttattggaacattgttatttatgataggatatatatctattagtacaatcataccggttcttggtaactgtatattagaagatgaatataggggaactggaaatggtataataaatagcctacaatatataggttcttttttaggatcatcaataatagccgctatctgggttaaaagtgaaaaatgttcatttatagttacttttttagttggattattaggtgcattgattgttaaaaaatatgttaataaggagaagttttatgagagatgaaatattgaggatagtagctcaaaatattcaaatatatgggataaaaaaaatgaacttagatttgatttgcaaagaattgaaaattagtaagaagacaatatataaatattttgaaaataaagatgatatgataagatgttatattaaagaagtactagatatagatagagaaagcacaataaagatattaaaaaatagtatggatgtaagtgataaatgtcatcaaatagtatatacgtatcataagtataagctaccatttattattatggatgaaataaggctagattatgaagatgaatggaatgaaataaaagaactgaaaaagttcaagatagaagcaatatgtaaagtattagatgaagctaaaaagagtggggaagtaaaaaaagatatggatttatcaatagtagcattaatgatagatcaggtaagtgaaaagctaatggataaagaagtgttgaaatcaaataatctaaaagttaatgatgtattagatcaagttattaaaataatattaaaaggaataatgaactagaggaattcttttggtatagtaaagttgaaatagttagacttaatttaatatgtcacaaaaatatatttactaagtttatatgattaatcaaaggagaagaaaaaatgatagaaatatgttgtggaagttatgaagacgcaagaaattcttatattggtggcgctaagcgtattgaactaaatagtgcattacatttgggtggtttaacaccaagtataggaagtttaacattaacaaagaaaaacactgatttaaaagttatatgtatggttagaccaagaggagcaggattttgctataatgatattgaatttgaacaaatgatggaagatgccagagtattattagaaaatggagcagatggattagcatttgggtttttaaatgatgatttaacaattaatattgaaaaaactaaaaaaatggttgatttagttaaaaaatataatgcagaagcagtttttcatagagcatttgattgcgtagatgatccaataaaagcaattgaagtattaatagatatgaaaatagaccgattgcttacaagtggattacaaccaaaggcaatgtatggtagggatatgattaaaagcttacaagaaaattatggtgataaaatagaaattttggctggaagtggagtgaatgcattaaatgcagaagatttaatgcattatacaaagatatctcaagttcattcatcttgtaaggattggggcagtgatgaaacaacatgtggtcagtatgtaaactatagttatgggccagagggacatgaaaaggattatgattttgtatcagaagaattggtgagaaaattagtggatttaaaaatataaaaatgtttgattttaagttgaatagaatacagataagaatagattatgctgtcttttaagtgaatcattacttaaaagacagcattaagtctactaaaataaaagattgaattttattttacatctagtgtaatagtcactataaagaagttatctattttttgagtagataattttccattatgcatttctataattttggtacaagtttttagacctattccagtactgctcacagattttagattattatttattttattttttattgtgataattaaaatattattttcaatataataacgtattttgattggttcagatttatcagcatattttaaaatattggaaaatagattatcaaatacacgtctgattgaaattaaattcatatctaaataacatatatggttgcatggaataaaatcaaatgtgaaattttcagcattaagcataaaaaattcttcttgaaatatctgctcaaatatttcatttacattaaaagtttcaagttctaggtgttctttatgactaaaaactaaaaagtattcaaaaagtttatctgataatgattttatctgataagccttttcacggctattatgtatgtattgcataagattttcttcagttttatatttcttatactcaataatatccaggtatccaagtaatgcagtaagtggagttcttaaatcatgggacatagctgtaattagttcgctattagctgattttgcctcattttcattttgtagtcgctcgataaatgattttctcatttcattaatgctttcagcaagaaaagctaattcatcattaccatctattgttatattataatttaaatcaccgccttctaaaattttaatttcattttcaagtgttcctatatacgaaattttcttatttattaaagtaagcatgataattacaaaacatattaagccaatagtagcagatataaaaagagtaatgtaataatatttatattcaaaatagcagtccatataaacttttccatttgtatcataaaatgatatatcatcaaagtaatctgatatatttgtggtttctaccaaagtttcatagtcagaatatgaagcatacctagttgagttatatactaaagtattattttcaaatatataaatatctacatacttatagttacgtacccatttttcaattttttcatgatcgtcaattgaaatgttattttttgatatatatgatttaaagtcagataatgcttgagtacttttgttattaagaaaattacttttatcataataagtatcgagcatatattcaccagcaaaatttattaaaaaagatattaaaatagaaatagttaatgaaattattatagatacagttaatttcctttccagttttgttaaaaaaatttttttactcaattctatatcctttcccccatacagtttttatatattttggattttgaggatcgcactccagcttgcttcttaaatttcttatatgaaccataacggtattgttatttgtataaaaatatggttcattccacacactttcatataaattctgtgctgaaaatattttagatctatttgaagccatcaacaaaagtagtctatattctatttcagtaagtataatttcttcattatctatagaaacttcattagaagttttatttatttttaatccatttatatctatagagtctgaagattcgggagcttcttttcctttgtatatataatatcttctgagtaaggctttgacccttgaaattaattctgtatatgaaaatggttttgaaagaaaatcatcgcttccagcagaaaaagccatacatttatcagaatcctgtgactttgcagtaagaaataaaataggtgcgcttgttttttccctaatttctatacatgctttaaatccagattttataggcatcattatatcaagaataattaaatctgtattatcgtttactttatttacagcatcttcaccatttatggcttcagacacattaaatccttcactttctaaaagtattcgaactatttctctaatttcatcattgtcatctgcaatcaaaatgtttctcatagaatttgttacctcctttttttatagtatatagcctcatgtattttttatctatattttataaagcacttaagaattcttaagatttgatatatgaaaaacttaagatattgtatctagactatatcttacagacagacataagtgtttaaaaagattgaatcatataatttgaaaatatatttaaagaaaggaattattaatattgaataaagagcgtacactgaaaatttcagcagtattcattgctattttattaactgcattattatgtgcatttatgccaaaactgcttttaatgactgtatcacttgatgaatttaataaatacattttatctatggggaatttgggagtatttatgctgatattctttcaaattcttcagactgtagttgcacctattcctggtgaggttattcagatagcaggaggatatgtttatggattaccattaggaaccctatatagcttaataggtcttattataggatctgggatagcattttattttacaagattgataggtggagattttatagcagatctgcttagaaagaaaaagttaaagtggatgcttgatattatggaaagtagaaaatttgaaattatattgtttataatttttataatgccaggacttccaaaagattttatgatatatgtagctggacttacaacgttgagacctatgaaattctttatgattttaatagcaagcagattgccttggataatggcatcagtaagtgttggtgcaaacataaatgctggaaattatcttcttactataattgtattaattatagctattattgggtttataataggaatattttataaagataaaattataaaaaaatttactaatgaaaaatgttaaataaaaaggctaaattatcaactaaaaataaaaaatataaatcataggggagaggattaatgttgaagaaatacattcctaatatacttacatttttaaatttatcctttggaatattatcaatagttgaagtcataaataataattattttatgtctgcgttatttataattcttgcagctttagtggatagatatgatggtagaattgctagaatgcttaatgtttcaagtgaaataggaaaggaactagattcacttgctgaccttgtttcatttggagttgcaccagggattctcatattttttaaatatggattaaacaattatttaattggtacatgtattatgttgttttatattatatgtggatgttataggcttgcaaagtataatataagtgaatttgaaggagtatttttagggattccaataactatttctggaagtgttttagctttattatcattaataattacatatacaaagattataccaggagtccttatgattattttgggatatctcatgatttctaaagtgaaattaaaaaaaatctagatttatcaagttttaatagaaataagaattagaaaagtaatacaatatagaatgaaacagcaagattttagggaatagatagtataaattatatagttagtaactgtcagtatacaaggaaaacagacacatatttacaaaaaaataaaattgtggtagcatagagaaagttataattatagatttagaaaaagaaagtagtaaagctttaaaataaaaggagaaactatctaaatatgaatgtttgtatagcagctttaggagctagtattattttatttttatcaatgataaatttaagttatattaaattcagttttaaagaatttattttaataatagttttaaatcaatgtttgaatataaacataatattattaaatttaagcgaatttgccgtgataatatctatattttttatattaagtatgtatatatgtataaaaagtaaaaatgtacttgcaggtataataatacctataagtacgattattatatatgtacttatagattatacaataactaatatttttattttactatttagtataggaccagaatcagtaagagaaaataatgaattgtattgttttatatatattttagagttttttataatgtttattataagtagaatgttaggatatatgttaaatagaaaaacaaaaatgttagataaatatttttatattaataaaagatttaatattttattaattataagttttcttttaacaataattactgtatataccaatattatactagagcataagagtaattttagaatagaatttataaaaataaatggaatgttgtttttattttattctatactacttatgattattacatatatattaattataaatattactaaggaaataaatttgaaaaataaacaaattcaatttgagaatttacagcaatatacaaacagtttagaagatttatatacagatatgagaggtttcagacatgattatataaacataatatcatctttaatgggatatatagaaaacaaggatatggatgggcttgaaagatactttaataagcgtatactttgtttaagtgaaggaattgaagcaaataatttaaaaataggaaatcttaaaaatattaaggtcactgaaattaaaggtattttatcttctaaactgattagagcacaagagctggaaattgatacatttatagatattgtagaaccaattgaaaaaataaatatggatattattgatttaagcagaattgtaggaattctccttgataatgctgtagaaggcgcagttgaatgtgacaagccttttttaaaagtaggtattataaataaagaaaattctatacttatagtaataataaatagtgtgaaagataaaattcctatatataagatatatgaaaaaggtttttctactaaaggtgaaaatagaggtctaggtctttatagtttaaaagaaattacgagtaaatataacaatgtttttcttgatacagtattagaaaataatgagtttaaacaacttcttcaaattggaaaggataaataatgaaatgcttaaagtatttatatgtgaagataataaggaagaaagagaaagatttagtaaaatcataagtgatattattttaattgaaaactatgatatagaacttgagttagtttcaagtaatcctaatgaattaattaatcatatagcaaagaatgatttttcgggtttatattttcttgatatagatttaaaatcagaaattaatggaatagaactcgcagctaagataagaaaatatgattcaagaggatttattgtgtttataacaactcacgctgagatgagttatttgacttttatatataaggttgaagctatggattatataattaaagatgattataataggataagagaaagaataggacaatgtatagaagatgctaatacaaaatattcagctaaaacgacagaacttcaaaaaatttttactatcaagtctgttgataaaattataaacatagaatataagaaaatattattttttgaaacagctccaatcattcataaggttatagtacatgctatagatagacagatagagttttatgcaaagatgaaagatatcgagaaaagacttgatgatagattttatagatgtcataaatcatttatagtaaatagagataatataaatgaaattgattttactaaaagatgtatatacatgataaatggagaacagtgtttaatatcaactagattaatgaaaggcttaaaaaacaatagattataaaactccttatgtacaatttatagtttacataaggagtttttttattatgatattttaatgcatagaaaaagtaagtaactttacggtagtaaagcattttataaacgttagcattttaataatgaacgttgaagttgagcaaaggttttatactaacaatatatattataaatcatttattacaaatataattttacatattaatatactctaaaattatatataagaaatagattaataaatacataagctataaatgaaaaagtagataaaatatttaagtaggcttattatatctaatttctttaatttgttataaggtaaattaaaaactagatggtttttaggagagttgctatgagtatcgatattaaaggactggaaaagagatttaatgaaagaactattgctttaaataatataaatctaaatattggcaaggggatttttggattattaggtaaaaatggatctggaaaaactacattgatgagaataataacaacattaatggagcctacaaaaggaaatattaatattttaggtttagaatataataaaaaaaattacgagaaaattaaaaaaaatataggctaccttccgcaggaatttggattctatagagattttacagtattagagataatgaattatttatctatattaaacaatatagataattctgttaagagagataaaataaaaaaaatacttaataatgtaggaatgtatgattatagagacaagaaatataagcagttatctgggggaatgaaaaggcgtgtagggttagcacaggcaatgttaaatgaacctaaaattttaatagttgacgagccgacagctggtgtagatccacaagaaagaataaaaataagaaatttattaaatgagtatagtcaaaataacacagttttattttctactcatattgttgaagatattgaaagtacctgtaataatcttgcgattttaaatgaaggaaatctagtttttaatggagatttaaaaactttacttgatttagcaaaaggtaagttgtgggagtgctcttttgaaaatcttgaagcttttaataattttcaaatcaaccataatgttttatcgtataagcgtgaagaagattgtattatagcaaaggttataagtgaaaaatgtccaataaaaaatagtattcctgcaaaagcatatcttgaagaagcatatgtttatattactacaagggagagtatataatatgcaaagtttacgattgatagtatttgagatgaataaacaaataacaagtttgaattttattattataacattaatatttgtgattttttcattaatgcaaatgggagaaatttttcattatcctgttaagaatgataaagatattatataccttaaagaacgtggtggagatgtgagagattgtttatatataaaatcatcacctcaagaacttaaaaataatagtatcaattatttaactcaaattatagaaaagaatcaaatggaagaaaatgatgcaaatatttttagaaatctaattttacaaatggaaaaagaaaatttgagttttgatgaagcgtatgagactttatcaaaagaaaattcagctttaattccatggttagatgcttgtaagaaccaatttggagaaaaagtaggaactgttgatgaggttaataataatataaagacaatattagttaatgaaggatataatactattttttctgaaaaatatgtaacatatattcaattaatttcagcatttcttattcttccattatttttgggattaattacaaaagatataaattgtaatataagtgagattgtatatgtacagccaatatcatctgttaagtatctattaagcaaatatataggatgtcttatttcattactaactatgctatatgttttaggtggaagtatgaatttttatctggctcataaatttaaaataagtggttggcaaggaaattataatggatttttaggctattatataatttttgttgtaccacttgtaatatttttaagttcatttatagtatttttagttttattattaagaaaaactattgctgtatttccagtatatattctttatattatttttaatgcaacccaaggggtatttttaggtcataatacatcgaatgaaatatataaatgtataattcgtttaatatctgaaaatcccgatactaattttattatttttaatagaattttttatctaatattatctgtaatttttattatctgttcgtgtatattatataaaaattcaagaaaaaatccgaggagggctataacattatgaaatctcttttaggctataatataaaactgttatactcgccacttaaatggatttgctgttttatatttattatttttatacctatatttatgtatgcaccaacatattatgattttacaaatatttgtgatatatatatgccatttataggtgttacactttttaccgatattatgcttatagataagaatagtaatattagagaaatactatatatttctaatagtaaattgaaaaaagtttttttgggtagatatttgattataacgattttaattatagtattaagttttatagcaaatagtgttttttttattcaaggacattttaatggacagtcatatttaaatgagccaattacaatattagagtttttaataatttcattagtaagtattttgtttttgggtacattatcaatgacaataggaaatgttttatcaaatcaatatattgcgtatgtatgttctcttatatattggttatattggaatgttaatagtacaagacaatcaatatttaacttatttccatttatagctaaacctacagagtacgtaggttttatatcaatacaacttgctatggtttttctcttattgttaataaatctagtattactacaaaaaagtcctttttttattaatgataagttatcaaaattaaaaacaatgtattttataaataagaagtaataaaatatgttcatattactcgaagaaaaaactattgagtaatatgagtatattttattatatggtgttaatattttaaaaattatgaggatacataaaatgtgagtctgaaaagataaaaagctatttttaatcttctttatattccaaaatatcaccaggttggcaatttaatatcttacatatttcatttaaagttgtaaatctaattgctttcgctttgttattttttagtattgagagattggccattgtaattcctagtttttgtgcaagttctgtagaactcatttttcttttggccatcattacatctaagtttactataatagacatactaagctccttttaaatagttttatcattttcatcttttatttcaatagctattttaattagttgacttaatacaatacttagtactccaatagctaacgaaacaaaggaaaccacaatagatgacataatagttattccatataagtatatattaaaaacataatatagaacaatacatacgatgttgaataaaataatttcactaaaagcacaaaatgatatttgttctaaaagtataggtatttttatattaaatggatctttaattgctatttgcttagagattttctttaaaatgaacaatgcaataatataaggaatagcacagatatatagtcctatagatatactaattgggatattggaattaataattcctaatctactcttaaatattgctgttaatattaatggagtagataggagtgctaaaaaagttaaaattattccagttgtaataattttatttaataaatttgaactaaaatttttattcatgaatcttttctcttctttctcaattaatatgaaatatttagattattaaattttcttctttattttgtgtataaatgacaaaattatatttattattaaccaagtcactcctattaagaaaaagaaccatgatattggaattaggaaaaatggttctgatagtgtgccgtcaggaaggacttcagagcctattaagttataagcaacaaagcatagtgctgtaagaataaatggaattaagtttaataaatattttttcatgttgttacctcgcgtttaaatttattttacagcattatattatcacatgcttatgcataatacaataaaaatttattgaaaaacgataaaaaaatattgaaataagataaaaatattatgttggtagattagtttttaagaatgaaaatataaattaattagtattatgaaaagatattagtagaagattaatactatttttttgtatatatgaaaattacttgagcaaatgtaagagcaatatataaacaacattgacaaatttataagattaactataatgtacatatacttcttatggtattggaggcgtaaacatgagacaatgtatggattctgaaaatcttcatagaagattaaagaaaataattggtcaggtacaagcaattgatagaatgatagataatgatgttccgtgtgaagatgttttgtcacaaattaatgcagctaaatcagctcttcataaggcagggcaagttgtattagaaggacatattaaacattgcgtacgtgatggaatagaacatggtgatgctgataaaactattgatagtttcactaaagctgttgaacgttttgcaaatatgagttaaatataaggttataaaagtagtcaggaatgactgctttttttattttcctcttgaaaatatatacccataggggtataatctacacatacccctatgggtatataaaggtaggaggttttttagatttatatgaaaactataatagaaaagatagaatatttattagaatttggtggaataaagaaagaaattattctgcttataatttcaggtatagcactacttataagtgtttttgacttaattcaattacaatttgatatagcatgggtagcaataattctttgtggaatacctataatactagaagggattattggacttattacagaatttgatattaaagcagatgtacttgtatcaattgctttaattgcagctatatgtattggagaacattttgcagcaggtgaagttgcttttattatgcagcttggagctttgctagaggatttgactgtagcaaaggcacgagcaggtattgaaaagcttgttcatcttacaccacagactgcacgagttatatataataaaagtgaagaggttattcaagttgaaaaagtaaaggtaaatgatgttcttagggttttaccaggagaaactattccactagatggtgtaataatttctgggcagacatctgtaaatcaagcggtaatgacaggagaatcacttccagtggacaagacattaggagatgatgtttctagtggtactgtaaaccaatttggtgtatttgaaatgcgggtaacaaaagctgaagaagatagttctattcagcgaatgattagacttgtccagtcagccgatgctggaaaagcaaaaatagtaggacttgcagacagatgggcaacgtggattgttgtaattgcattggtatctgcattacttacatggattatttcaggagagattattcgtgcagttacaattttagtagtgttctgtccttgtgcattggtactggcaacacctactgctattatggcggctattggtaatgctacaaagcatgggtttcttgtgcgagaaggtgatgcattagagcgattggcttctgtttcaaaaattgcttttgataaaacaggtacattgacttatggtactccacgagtattaggtgtaaagtcaatttattctaatataaatgagaatgatttgtattattatgcagcttgtgcagagtctctttcagagcatccattaggtaaagctgttgtaaaatcttataaagaaaaatttaataatttaaattcaatagcagaagatttttatatgataccagggagcggaattaaagctagtgttgatggtaaaaaaatacttgcaggtaatgcattgcttatgaaagaagactgtgtaataattccaaaagaagcaacagaacaagcagataagtatttaagagaaggatgtactataatttatattgcagttgatggagttctttcaggatttttagcattatctgatactattcgaaaagagagcgaaggtatgattaataaattatttaacattcaggtacatcctgtcttattgactggtgataatgaaagtgctgctggatctatttctaatatgcttaatattaaagagttatatgcaaattgtcttccagaagataaattaaattggattaataaatatcaagagaatgaatttaaagtatgtatgattggagatggaatcaatgatgctccagctttgaaaaaagcagatgttggaattgcaatggggggagtaggtagtgatattgcagtagatgcagccgatatagttttagtagatgatgatattaaagaacttccacatcttctagcattatcaaaaagaatgatggtaacaataaaatataatcttatattttccatggtattaaattttattgcgattatacttgctattagtggtattttaaatccagtttttggggcattagttcataatgctggttctgtatttgttataattaattcagcgttgttgctaaaatggaaataaaataattatttttatattgaaaagaggttgtagcaaattaattttgatacgatctctttttaaaataatataaattgatttgaaatagaccccaactattttattataacataaataaaatttcaataacagtctgtaatttgctatgaaatggtaatataatttaaacaagataagaaaacaacataataaaaaagaaatttcttattttattaaaatacttaaggggatgataccaatgcaaagtttagtatcagctaagatttaaaaaatgtaaggagtgagatagaattcatttaggaacttaagtaaaagattatgaaaagaagatgataccaatgcaaaatgtattttaattaaaagattaataaatgtgaggagtggattaaaagtttatttaacatattaataatcaaggaaagtagtaaaagaaaagaagatgataccaatgcaatatttagttttaatataattaataatcaatgtaaggaggaattgaaaaagttaagaacaataatatattaattaatagagtaaaagtaaaggaggatgattagatttgttatatcaattatgattttatatagtaagaggtgattccaatgtaaaatttatagattaaacaaagaggtgtattaaaattagtaaattaccaaataaagtagtgaaataatagctgtattatgaagaaaaaatcgtaagcagctattatttttttatttaataagtattattaaatatatttatagtttatagattaaggaaatgcttatatataaaagtttgagaatttttatatataagcattttttatgttaagtaatcactgttataaaaaatataaaagagattatttataagcaaataagtataggtaatataaccaaaatacaataactattccattatggaatagtttgattcttaaaatgaattgaacaagatttaaagactttgtaatatatcatatgtagtaagtttgaatttgaattgatttgctgaaatttgtagaaaaaataacaaattaaatttttgaattaaaaaaatagatattaaggggagggattaagatgatctttggtaatataaaatcaaatgaaaatatatcaagttatccaaaagctattcaaaaagctattcagtatctaaaagaaaatgatttagtgaatgcagttccaggaagatatgaattggatggagataatatgatattacagattttagatgtagaaacaactgaaagatgtaatttacgtccagaagttcatgaaacttatattgatgttcaattccttgcaaaaggaaaagaattaataggatgttacccagatatgggagacaatgaagttgatgaaaatcttttagaaacaagggatcttattttctataagaataatgaaaatgcaagagaaactcatctagaaatggaagaaggctcatatgctgtattctatccacatgatgttcatattcctgcaataatgaaagacgaatctatggtaattagaaaaatagttattaaggttaaagtatcgacattataatattatttttatgattttaatgaaaatgatgatttagaggagaatataaaatgaaaaagtttgataaagtcgtatggggcatggttggatgcggtgttgtaactgaaaagaaaagtggtccaggtttatataaatctgaaaactcagaattaaaggcagtttttgatttagattatgatagagcttgtgattatgctaaaagacatggagttccagttgtttataagactgtagaagaaatgcttgttgatccagaaatcaatgcagtatatcttccaacaccaccgaagtttcacaaagattactcaatgaagtgtttagaagctggaaagattccttatacagaaaagccaatggctcttacatatgaagaatgtgaagaaatgattaagaagtcacaagaagttaacttacctatatatgtagcgttctatagaagaggtatggctaagtacatgaagattaaagaaataattgaaagtggaaagctaggaaaaataaactttgttcacttaagacagtttatgaaggttgaagatatcgatttagatagagaaaacttaccttggagattaaaaccagaagcagctggcggcggaaagttcgttgatatggttgctcacgtattagatatcgttgaatatttatttggtaagattgaaaatgtaagtggtatggctgaaaactatggtggatactatgatgtagaagatacagtaaatgctattttcaaaactgaaagtggagtaatgggtaatggaatatggtgttacgttgctgaccacgatgaagaagaaatgttaatagtaggagataagggtagaataagtactactggtttattctatggtcctataaaggttatagttgatggtattgaagaaattatagactatcaagaaccagaacacgttgctcaaccttatattcaaacaatagttaatgaattaataggaaaagaaaagtctccagcagacttagaaagtgcagctcacgttattaaggtaatggatgagattttagaagaatatagaaaaagatataattaatatttagtcatataacattgctgatgctgaagcatattactcatttatatttattaaatttagtatcagcatgttattattaaaattttatataagattgttaattaattaattaacgaagtattgaataattttattaaggagaactagaatgagtgttgaatttattatcggaattttattattagtatcattcgctggattagttgcttatgcagttaaaggtggaaatcttatgactggtatactaattatggctattatatggactgtattaccccttataggtaatgctttagttacaaatccagattttatagcacaaaatagtgacattgttaatatgagtattgtagatgctcttaagaaggtattccaaggtggtcctgaaggatggggtggagtacttataaacttcatatttggtgcttggttcggtagaatcatgttagaaacaggaattgctgctacaataattcgtaagacagttgaacttggcggagataagccaatagttacatctacacttttagcagttgttactacagcagtattctcaagtatgtttggtgctggtgcagttgttgctattggagtaattgtacttccaatattattatctttagggatacctaaattattagctacagtatcatttttattatcaataggtgctggtttatacataaaccctgttatatttaatcaatatcaagcattctatttaggtgcaaatggagaacagacttatttctataatggtggatacttaaaatggggatttgttgctttagctgttcaattgatagttgcaatattaataccagcaatattaatgaaaaagcaaaaaagagttcatgcatgggcggcacaagctcctcagactgaagaagtaaaggcagctccagtaatagctttacttacaccatttataccagttgtattagctattggatttaatgtaccagttatagttggattcttagtagcaagtttctttgctttagctgtttgtggaaaattaacatcatataaggcagcttcagaagtatttaataagacgttctatgatggtgctatagatactgctccattagttggatttatgttaatgattcctatgtttaataaagcggcagaattatgtgtaccttactttaatgctgtattaggtggattgattccaaacaatacattagtaatttgtgttgcgtttgcaatacttgcaccattaggtatgtttagaggaccatttacattagcaggatgcggagctgccacacttggtatattaaagagtgttggattcggaactccattattattcccattaatgtatgctccaacagtaacaatgaacatctcaagttgtattacacaatcttggattgtttggggacttggatatactaaggttgatacaaaagatttcttaaaattaagtataccagcaggttggttaatctgcgctatattaagcttgattacttacataatgtttggtatgtagttttaataaagttccgctttacatatttgtagggcggatttctttgttttcaggtcataaaataaaacttttggctttaattatgataaaatcaatataactacaaagcaataatagttgttaataatgtcataagtttttataaaagtataataggttcattattggggagtatacatttagcattatatgataagaagaggtatttattatatgaaaaaaaataataatgtcagggttggaatagatgttggaggcactcacacaaaagctgtagcaattgataatgatacacataagattataggaaaatcatcagttaaaacaacacatgatgataaatttggagttgcagcgggagtggtaaaggcttttaaaaattgtttagaagaaaataatatagatgcgaaagatgtggtgtttgtagcacatagcactactcaggctaccaatgcattacttgaaggtgatgtggatcatgttggagtaataggaattgtaggaagaggcattgaaggatatttagcaaaaaaacaggttgcacttaaagatataaatttggggaccggaagaataataaagatatcaaatacaataattaaaaggaaaaatttaacaaaagaaaatataattgataaaataaatgaacttaaaggtttaggagtagaagttcttgtggtatcaatggcttttggtgttgatgatatgacagaagaagttagagttgcaaaggttgcagaagaaatgggtatgcctataactattgcatcagatattacaaagttatatggacttacaagaagaacaaaaacagcagcaataaatgccagtatacttcctaaaatgcttgatacatcaaatagtactgaaaaatcagtccgtagtacaggagtggatgtacctcttatgataatgcgtggtgatggtggtgcaatggatattagtgaaatgaaaaaaagaccaatacttactatgctttcaggtccagctgcaagtgtcatgggatccctaatgtatctaagagtatctaatgggatttattttgaagttggaggtacatcaaccaatataggtgtaattaagaatggaagacctgcaatagattattctatagtggatggacataaaacctatgtaagttctttagatgttcaggttttaggtgttgctggaggaagcatgatacgtgcggattcagaaaaaataattgatgtaggtccaagaagtgctcatattgcaggaatggattatgcagtatttactcctgaagaagaaataattgaacccacgttagaattctttgcacctaaagatggtgatcctgaggattatgttgcaataagattaaagagcggaaagagaattacaattacaaatagttgtgcagctaatgtacttggtttgattacttcagaggatttttcatacggaaatgtagaatcagcaaggaaggcaatgaaaccattagcagactatcttggaaaaacagttgaagaagtggccgaactgatacttagaaaatcttttgagaagatacagccagttatattagaactaatagataaatataagcttgataatagtcagatatcacttataggtgttggaggtggtgcttcatctcttattaagtattgcgcttctaaaatggacataaaatatagcatacctgataatgcagaagtaatttcatctattggtgtagcacttgccatggttagagatgttgtagaaagaatagttccaagtccaactcaacaagacataagaaatataagggcggaagtaataaataaagcaatagaaagtggtgcttcgccagatacaattgatgtgcatattgaaattgattctaatacatctagacttattgcaatagcaacaggttctacagaagttaaatctacagatttattaaaagaatgtagtgaatttgaagcaaaagaactagcaagtgaggatatgggtatttctaaagaagaagtttctcttatagagaagaataaatatttttatgtttttggtggagaatataaaaataagaatcaaataaggattgttgataaaaaagggtttataaaagttcagagaaattcaggatctgcatgtaaagtaaaagtagaggcttataaagatgcggtaaagagtctttgggaagaacttacagtgtataaatcagatagtgttttaagaccagatttttatctgtgtataggaccaagagttatggattttgcatcaggaagtgattttgaacaaatgcttatgattatggatgtaagtgtacaaatggcagacccaaaagaagaaattttaattataggagcaaaaaatgaaatctaatgataattttgcaaataaatttgtaaatgcaatgagaagtaagagtatagatgctagaacaactgatacagatattccagagatagaagaaatgctaaaaaatttagtcatgattgatgatgaaaagtggggatattatgctttcagacgtgaaccactaaaaggaaaatttagtgaagatgatagattaatattaataaataaagcaaatgaatgtggtaaaaaatatgctaagaaaataagagaaaaatttagtcatatgaatacatacgatatagctaaggaaatggggcttgaggtagattatccagatagacctaatggtggagggcacataatatttgcacagtttgttgaacctaataaagttacagtatttaaggatagtattaacaaggcagaggagttaataacaagcaaaaatttagtgggattgttttcagatataaatattgaagagttattattagcacatgaaatatttcatttcattgaggaaaatgatgatgacatatttacaagaactgaaaaaattagattatggaagataggtcctataaaaaatgactctaatatagtctgcctgggagaaatagcaggaatggcatttgcgaaggaattactaaaaataagctattctccatatattttagatgttttccttgtatatttatataatatacaagcatcatatggtttgtataaagaaattatgagtataaataataaagagtaattttaaatttgagtatatcatctaaatttttcttatataacaggaagcgtttagagatatactcagctttatttttgggaatttttaagtaaaaattctctgaatgcgttaatttctttacgtctactagtattgatattagaaacaagtgccagatttgaatttatggggtctttcagaggatgaacagctatattatgactgctaaagggctttaaaacattatttacaattaaagttataccaagcccttctgaaacaagacctaatatggtttcaatcttatttatgttgtatataacatttggagtaaaacctaatttagaacattcatctagacatatatcataaacaccagatttagaacaaattataagatcttcgtgttttaaatctccaaaagaaatatattttttctttgtaaatggatgatcattagaagttacaacaactaattcatcatcagctatatgtgttatattgaataattttttttctaaattaaaatctcttacaatagcaagatcaatttcagaattcttaagcatgcttaaaacagcttcattttcttcttcaaaaatatttatatctatgttaggatatttacttttgaaagaagctaggacagatgctaaaccgtattgtgatataactgctattgttcctatgtttaatgttgttttctttgaaatagaatgctttttcattccttgaataattttattgtaatcatctaaaaattttaatgcatatacataaaaatcttcaccagcacaagtgagttttgtaattcttgaggttctatcaaacaatatagtatctagttcggtttcaagagattttatctgttttgataacgaagactgtgatatacataactcatgagctgcaggagaaaatccattgtatttttttacagctagaaaatattgaatttgttcaatagtaataacaatcaccccttgtattcaatgatggaatatattatatcatgatattatgtattttacataaatttaataaaaggatatacaataaaaactattcaaactaataaatttgttaagatggtacaaaaaataatagataaattactaaatagataaaaaactatttacattatgacaaaaaatgatataatacaacaagtgggacaatgaatattgactcaggtatatttctatttcttaagtagtaaatataacataatttattaatcaaaaaataagtagaatctattagctaataaataggttctactatatttttaatttttaaccaaacaatattaatattggacggagagtgtgcagaaatatgagaagattaatattagtaacatcaccaccagcatgtggaaaaacatttatttctaaagagatatcaaaagctcttaaacctattgtttacttagataaagatacgctaatagggttatctaatcaagtattcaaagttgcaggagaagaaaacaatagaagttcagatttctttgaagaaaacatcagaaatactgaatatgaagttgtaattgacttagcattagaagctttagattactgtgatacagtattgattaatgctccatttacaagagaaataagaaatcttgaatatatggataaatttagaaataagcttaaagaaaacgactgtgaattagttgttatctgggttgaaacagataaagaagtttgtcatcaaagaatgattgaacgtaactcagatagagatacatggaagttagaaaactgggatgaatacatatcaggatgtaactttgaaaaaccagttggtattcctgaattaagagtatttaaaaactcatctatggaagaattcaaccaatcaatggctgaattagtagcatattttaaaaattaattttgttaataatgtgaaaatattaacaaaaatagcttttattatcagactgtgcataattaggtaaactattgtgcatagtctgattttatttatgtatatgaaattgtaatgattgaatatattgaattcaacagagttaaagtgttgaaaatcaacaagtgagaattgatagtaaaggatcaaatcaaggataaaagagatcgggagaaaattatggattatatagctatagattttgaaactgcaaatgaaaaaaggagcagcccttgttctataggtattgtagttgtcaaaaatagtgaagttgttgaaaagatacattatctaataaaacctaaagaaatgagatttatgcctataaatataggcatacacggtatacgacctggaatggtagaaaatgaaccagaatttgatgaaatatggaaaaggattaaaggatactttgataatggatttgtgattgcacacaatgcatcatttgatatatctgtattaagaagaactatggaattatataatatagaaccagtatcttttaagtatatatgtacaatgaagctttcaaagaatttttatcctcaaatagaaaattctaaattaaatactgtaaatagattcttaggatatgaatttgatcatcatgatgctttagctgatgcacttgcatgtagtaatatccttattaatatttcaaaagagcttgggaatgaggatatagatgaaatatgtaggtgtgttggagtaactattggaaatgttaatgaagaaggatataaaccatcatcagcaaaaggaagaattttcagaaaatcgtctagagtatcttcatgcaataattcaaattcattaggaaatctaaattatgatgtatttaagggtgatactgttgtatttacaggtagattatcatctatgacacgagatgaagctataagacttgtaagaagacttggtggcgcatgtgggagctctgtaactaaaaaaactaccatattagtttctaatattaaggatatacatgagttaaaaagaaatgaaatgagtactaagatgagaaaagcggtagatcttaaattaatgggacaaaaaatagatttcattgatgaaaatgagtttataaaaaaatcatttatgtaataatatctatttgaatttctaaaagtaagttgtatataatatcaccccctttaaaatatatcttgacgtatataaataatattatagcaaaatatgtaaataaatcaaaatatgttaaaattctatgctttttagagaaaattataatataataataaaaataaatttaaaatattgaaaagtattctaaaatagacatacatatgtcagtaatggatatatatactgattggaaacaacatacaattcgacaaaaattctaaattgaatattatataattaaattggtcaataactcagaatatgaattgcggtaatgggggagtagtgatggacagaatttttacaaaagaagaattagccggttcagcatataatctaataaatgaattattaaaagatgctgaatttttaggggagaaattttataaatcaatcataattgatgatgacaatgacatttctgtgctagataataataagaaatttcaaagagaatatagcttaagtgaagtatcatacttattatccgacagtatagatggcttttgggaaaccgataaaagttttattgaatatgtaaattatttagaaaagaaaattgaagataagtattgtgaattaaatcaatataattttatagagtattgtaaaagtgtatacaatcttaaatataagacattgaatgtatacagtaaattaaaggaaattgagagattagtttaataattgtaagggtaatttcaacttaatggtatttttaaagagatgagaatgagagtaaaaacttctgtatattttaaaatatacagaagcttttttgacataaaaattaaagttaaacaaaaatcagcataaatataaaagaaaagatagtaattgaaaacgatatagaaaacaagtaatttgataatatgctaaaaattttaaattttgttgcaaaaaacattaattatttatataatctaatacataaaataaatatataaacaacgttcggatgaagatggtgggagagatatcattttatattattaatattaaaatgatacaccgaagagggaaatctttcaggtattaggaccgccattggacgagcctctggagagacttatttaataagcaccgaaggagcaaggttgtatacaataagtatacaattgaaactctcaggtaaaaggacaggggaaaagacagatatgcagttgacaattgagaattgatgattgacagtttaagaagaaatcattatgtgatttctgaaaaatatatttcagattcaattataaaattaaagaattttaatatattagtagtatctaaaattaagatactaaaaaataactttcaattatctaatttcaactaccaactgaaaaagtcttatctcctccgaaatcattatattagggggattttttttatgttattatcaaatttattatcaggaagcactatggtgcaggaaatattccaaaaaatcgacgatattatatgggggccgcctttactaatacttttagtaggaacaggtatctaccttacacttcgtctaaaattattacaaattttcaaattaccattggcattaaaatatgtatttggtaaagatgatgaaaagacaaatgatcaagctcatggagatgtatctagttttggtgctttatgtacagcattatcagcaactattggtacaggtaatatagttggagtagcaacagcaataacagcaggaggacctggtgcattactatggatgtggcttgcagcattttttggtatggcaactaaatatgcagaaggagttcttgcaataaagtatagagaaaaagatgaaaatggtcagatggcaggaggaccaatgtactacatccaaaatggattaggtatgaaatggcttgctaaattatttgcactctttggaattggagttgcattctttggaattggtacatttggtcaagttaattcaattgcagcagcagcagcaacatttaatgtaccattaatagttacagcagttatagttacagcattagttgcaatggtaactttaggtggaataaagagaatttcaaaggtttcagaaactgttgtaccatttatggcaggtgcatatattcttgctgcggtagttgtattaatatgcaattatagatcaataataccagccttatcattaattataacaagtgcatttaatccaagcgcagttggtggtggagttctaggaattactgttggtatggctattcaaagaggtgtaggtagaggagtattttcaaatgaatcaggtcttggaagtgcaccaatagcagcggctgccgctaagacaaattcagcagtaagacaaggtcttatatctatgacaggtactttctttgacacaataataatttgtacaatgacaggtcttgcaatagtaataacaagtggagaaacaggtatatttacagctggatctgcgcttgcaggagcacaagttacaactgcagcatttacaaattctataggaacagttggtaaatatatagtgaatataggattagtattctttgcatttactacaattcttggatggaattattatggtgaaagatgtactcagtatttatttggagttaaagctattatgccatatagaataatatatatagtgcttgtagcaataggtccattcctaccattagaattaatattcataatagcagatatagttaatggatgtatggcattccctaaccttgtaggtcttataggacttagaaaagttgtaataaaggaaacagaagagtattttgcaactttaaaagaagaaaaggaaattaatacagaaaaaaatttagcttagaaagttaatatatatacacatagaattaatgaaaagcagttctttttagagctgcttttttattatgtagaaaagtataattatagaataatgagtaaaggtgtggactcaatagatctagggagttgagatttaatatttaacagaatactttttttcagtttctataataggaattttatcaacaatgatttcatcaattcttgaaaaattatttccctttttaagtaaagatataaatttgtttaaagtatcttctgaaccttgaatttctatctgaacttttccatcatataaatttttacaccagccagttagatttagatttgtagcagttagttgtgtgaagaacctgaacccaacaccttgaactcttccatctactaaaatcgaataccttatcataaatagttcctccattatttattatatataggcaaaaatatatgtagtttcttatagactgttgattatactagaattatatcataataaattaatagtagaatataaatatataagtatttataattttctgaaaattaagtataatattaatatgatagggaaaaatattaaaaggtgaaattagcgtaaatggagggcaatattatggttgagagaagtatggtattaatcaaaccagatggagttgaaaggaatattataggcaatatcataagtgtttatgaagataatggcttgaaggtaatacacttgaaacttatgcagactacaagagaaattgcagaaaagcattattgtcagcataaagggaaacccttttatgaagaactaataacatttataacaagaagtccattggtagcaataatccttgaaggggaagatgcagtaaagagaattcgtcagattaatggagcaacaagtcctgatgaagcatctgcaggaacaattagatttagatatgctagaagtaaaacagaaaattgtgttcacgcatcagatacgtcagaaagtgcaaaagaagaaattgctttgtggtttccagaggttgatgattaagaatataatttaggtatcaattactgaactaatattaagtaaaaaagaaaaataaaattccgttaaaatgtttattaacggaatttttttgtgtcttaaaaattagcttgcagtttttatattcatccaagcatcatcataaagttttaaggagtcacctaaatctacaaaaacttcacatttatctaatacttctttagaagggtatgcaccaggatcatcctttatagaatcttctagtagttcataagctccagtattaggggtagaaaattgaatatattctacattttgaagtgcattttcaggtttacataagaaatctataagtttttcagcattttctttattttttgaaccttttggtataaccatagcatcaaaccatttattagagccttcgtcaggaactataaattttaattttggattttgtgagattatgtacgttgcatctccagaccatacaggtgctatagcagcttcctcgtttatcattttatcttttacttcatctacatagtaaagagggtccatagtcttcttttgttttattagctcatctgtagcagcagctatttcatcaggatttgtactgtttatagaataaccaagttttttcaatcctatagcaagagtatctctcatagaatcaaacattattaattgtttattgttatattttgtatcccaaagtatatcccagctgttaactggttctgtcacaatgtcaggattgtacacaataccgatagttccccacatatatggaactgaatattcatttgtaggatcataagcaaggtttttatattgatcaccaatatattcgtagtttggaatattgttaaaatcaattttttctaccatattttcttgaatcatcttttcaatcatataatctgatggaattactaagtcataacttcccggagaactctttaatttttgatacattatttcatttgtatcataggtagaatagtctacttttattccagtttctctttggaattcgtatagtaagtcttcatctatatagtcgccacagttataaaaatagattgttccatttacaccaacattagaatttccgcacccggtaaataaagttacacttagtaaagatgttaatgctaatgcacataaacgttttaattttatcaatattatcacctcaaaatacttatttatagcccatttaaagttttaaatgggctattatttattattaattagttttatctgaattttgttttctattcacaatcaacagtaatgcaagtactgttaagaacattaaagttgaaagtgcattaatttcaggctttataccacgtcttgccatagaataaatttcaattgaaagattagtaactcctggacctgtagtaaagaaactaattacaaaatcatctatagacatagtgaatgccataaggaatcctgaaaagattccaggctttatctgagggataataaccttccataatgtataaagtggagtagcacctaaatcggcagcagcatctaaagtattttcaggaagctgacgcatctttggaagaactgataatattacataaggaatatcaaatgtaatatgagctaaaagcatagttgtaaaaccaaagttgaagtttaggaatataaataaactcataagtgcaattcctgtaactatatctggattaagtactggaagatagtttatatttaaaattaaagcttttaatttacctttcatttgcgaaattgctatagcacttatagttccaacaatagttgcaattactgatgctaataaagcaattaatatagtgtaatacagtgctgacattaatctttggttactaaaaagctgttcataccattttagggtgaatccagaccattttcccatggttttagaattattgaaagaaaaaaccataagggtgatgataggagtgtacaagaataaaaagataataaacaaataaaatctttttataaagttttctaatctgcttaccatagctgtgtacctccttctttatctgaaccgctgtcaaatttagacgttaaagccataaatataagtatgattatcatcataaagattgaaatagcggaaccaaaattccaatcccccattgtggtatattgctgttctataaggttaccaagaagcataaattgaccgccaccaagaagccttgaaattacgaaagtagaaacagcaggcataaataccattgttatacctgaaaagattccaggaatgcttaatggtaggattacttttaaaaatattttaaatctatttgcacctaagtcagctgctgcatttattaaatcctgatccatttttattaaaatagtatataaaggaagtaccataaaaggcagaaagttatataccataccaagaagcacagcaccatcattgtataagaaagaaattggaccaattccaactttacttaaaatattattaacgatacctgttttacctaaaataggcatccatgcgtaagttctaagaagaaaattcatccacattggaagaatgaatagcataatcataaaattacgtctacttactttcatttgtgaaattatatacgcaactggataaccaacaataaggcataatattgttgaaacaagtgcaagccatattgatcttaaaaatatattaaaatattgcgatgaaataagtctgctatagttttctaatgaaaaggaatagcctgaatcagtttgtaccgtaaagctaaaaaataaaactattaataatggaattacgataaatagcgcactccaagcaaaataaggatacgccgctaaggacgtttttttcttagccatttttatcactctttttcataatatgtatgtcttcaggataaatatctaaccctatagtagatcctacttcagcagattttgtgttgtgaagtataaattcataatcatcacttacaacagtcatttcgtaatggacacctttaaatactacggaagtaacatgtcctttaagcatgctgttttctgcattaaccattttaatgtcttcaggtcttataacaatatcaacaggttcattgatttcaaaacctttatcaacacattcaaattttttgttacagaattcaacttcaaagtcttttatcattaagccattaagtaaattactttcacctataaaatcagccacaaaagcattggcaggttcgttatatatatcttcaggtgttcccatctgttgaattatacctttattcattactataattgtatctgacattgtaagagcttcctcttgatcatgtgttacaaatacgaaagttataccaacttctttttgaattttctttaattctatctgcatttcttttctaagctttaagtcaagtgcacctaaaggctcatcaagaagtaatatttcgggtttatttacaagagctcttgcaatagcaactctttgttgttgtcctccacttaaagactctacttttcttttttcaaaaccatctaaggcaacgagatgtagcattttttttacttcagcttcgatttgatctttaggtaatttttttaatttcaaaccgaatgctatattatcaaaaatattcatatgtggaaataaagcatatttttggaacacagtatttacctgtcttttatatggtggtaatgatgaaatatcttcatttttaaacattaattcaccagaatcagcgctctcaaaaccagctattatttttaatgtagtagtcttaccacatccacttggtcctaaaagagttaaaaattcatttttcttaatatttaaagataaattatttaatactgtattatcaccataagttttgctgatattttttaattctataatgttttggctcacaaaaacacctctttctattgtttaaaatgatgggggagtactaacccatattaccttagctggagatttaccagtattttcgataaaatgatttacttttgctttataataaaagctttccccttttttgactttatatttcttttttcctaaatgaagaattatcgttccagctaaaacatatccgaattcttcaccttcgtgaggctcttcttcgatatattgtccaccaggtttgagtgtaatcataataggctccatttcatttttttgagcatttggtataagccacattaaggagtactttaaatcgtcatcatctttttcaaacatatcatcttttgtatatgttactttttcctcttttgtatcactaaagaaatctggaagattagttcctaagatttcaagaatatctattaatgtagcaatagatggtgaagttaagtcattttcaacttgagaaataaatcccttagataattcacatctatttgcaagctcctcttgagtcagttgtttttccattcggagaatacgaatcttttctcctatttgcataaaattcacccactaacaatttttataataatcacttttactaaacaataagtttaaaattactaaacaaacaatgatattatatatactttgaatagaaaaatcaatatctttttgaaattatcaaagaaaatttgtatttaatatgtaggattacaatatttcatagggaaaaataaacagtatttactaagtatattgtgatataatatatttaatgtgcttaacatatagtaatagtaattaaaaaattaatataaatgtactaacgttaaagaggaggagttaatgaagagtaaaaggattataatcaacagtagtattatcttgatttttcttgttatagttgttggagtagcattttataaattatttggagaatcatctaaagaaataaatgcatcaaaacagtttatgtctaagttatattccatgaatgcagtagatactacagaaaaattaacaaatttaaaatatgaaaggcttaaggttataaatagccaaaatgaattagttaataaaacaatagtaactcagagttatggtatagatttagataaggaaaacaatgtggttggttttgctaaaaaagatatgaagatgagttctagtaagctttcagagagtgaagctaagacaatagcagaaagatatcttatggaaatctgtggaaacgatttaatttatgaagatacaaaaaatgaagatgatttgccgtattattcttttgtatataaaaagaaagaaaatggatatcgattgtattttgatgaaataaaaataaatattgatagggatagtggttatattgatggttattctaatactacaatgttgaaaaaatgtatggaacctaaaataaatataagccaagaagaagctgagacaattgcaaataattattttatagaaaataatataccctatgaacttttagaaacaacagagctagtatatgcaggaaatacaaaaacagaaaaaaataaaaacaatcagttagaagtatgttatgtagttagtgtaaaagctaaaaattccgatgaatcacaagtgttaattaaaatatttgtcaatgccgattctggtgaaatatataatgttataaaagagaatggtgaaagtaaagttttaactgttaattaaaaagcgtggcctaaggccacgcttttattaattccattcagtaacattttttaattctggaattgaagatgctttgaatacaggatcttttattccagcttttttctgtgctctataatcatcaagagctttaaatgcaattttaccaagaagtgcaattgcgattagatttgttattgccattaatgccatgaatacatcagctagattccaaacgatatccatacttactgttgcaccaaataataccattacagcaacgcagattctatataaattaagatatatttttttcttagttaaaaattcgatatttgcttcaccataataataattacctacaattgaactgaatgcaaaaagtaatacacatatagcaatgaaaatacttccaaagcttcctatttgagaacttaatgcgttttgagttaattgtataccagtaagaccaccagataaatcaacatctgaaagaagtattataaaagcagtacaactacaaattactattgtatcagtaaatacacctaaagtttgaattaatccttgtttaactggatgagatacattagctgtagcagcagcatttggagcactacccattccagcttcatttgagaataatcctctttttattcctataagaagagcgccaccgattcctccaccaacagcttgcttaacaccgaaagcattttcaaatattaaagcaaacatagcaggaagttcacttatgtttgttattacaacaaaaagagctactaatatataagcactagccataataggaactattatttcagagacttttgcaattctatgtattccaccaaatattattgataaagttaaaagtgtaagtatagcaccaacaagaatcctgttaacaccgaaagcttcattaagtgcaagtgaaatagtgttggattgtactgaattgaatacaagaccaaaacatattgtaattaatatggagaaaattattcccatccatttcatgttaagagctttctccatgtagtatgcaggtcctcctatataggcaccatttccatctgactgtttgtatatctgcgcaagtgtagattctacaaaacttgaagcagaaccaataagagcgattaaccacatccagaagattgcaccaggtccaccaacagatatggcaattgcgattccagctaaattaccagtaccaactcttgatgctgtactaatacaaaaggcctggaatgatgaaactgatcctttttctttttttgatgtagcaccatcagtaagaagtctgaacatttcttttatatatctaaattgaacaaatcttgttttaaaagtaaagtataaacctaataatattaatggtgctattaatacataagtccataggatatcattagatacgttgattattgtatttaatttttcaataaaagtattgaacattgcttaaaaccccctagttaataataaaatttttaaaataaaatgacgaaaattgtaactgctattattttatactaaagaatataaaaatgcaagttacatataaataaaaattcataaaattaaattttcatattaaaaaccagtaaaaatcacatattatttattaaaaaatacaaaagttgaaagaagtgaattatgaaaattcatataagagaatggcatgaataatataagcacgaattaataattatgtaatattattatagttcgtatatctatacactaaataaaaaactctgggaagattcccagagtttatttattgaataggtgtaattattggatgagcgtttgtttgaggtcctggagaatctactggcgtttgagtaggatctacaacaggtccgttttgattattattgtgattattagtgttatcactattggtattttcatggtttacattagaattattattttcacctgtttcagttgattgttcttcggtttctgaagtagttgtatcataacttgatggaagaaccatataataatctgctgtggctgaatttggatgcttctttttaatgtatatagcttttcgtgttaagaaagaaggggtaccaggtgttgccagcttattattcaatctatttatatttgtaactacgtgtgtatcacatgtagttgttggttctgttccttcttcgaataattcttcgtaaactctgcttcctcttggatcttgagaacatactgcgctaggtaagagtcctgaatctttacatacagctacttttactattccaggtggtggttccaattcttttacagaacgaccttcatgagctttttccattaatgttccccaaatttttgcacaagcacttgatccgcctataagttttgttggattgtcatatccaagccatactgatcctgatagataaggagtaagtccagcaaaccataaatcacatgaatctgatgtagtaccagtttttccggatacaggcatttcaccccatttagcaggtgtacttgagtaataggttactggtcctttgagcatatcgtacataatatatgctgtttcacgtgagaatacatctgttttatctaaattttcattatctaaaattgtttttccagttgcatctacaacctttgtgtatagtaaaggtctaacatattcaccttcattaccaaaagtaccaaatgcaccagctaatctataagtattacctccatcaggatctttaggatcattgttgaattgtcctaaagctagtgcggcaatagaactttttgatttatcattgtattttaatcctaatttttctccgtattcaatacctgttttagttccaagcatatcttcaacaattacagctgcagtatttttagagtaagttaaagcttcgcgtgcagtcataagaccttggtaactaaaatcagagtttgaaggattatagtttttaccaccgtctagtttgttttcaggaagtggtgcatcatcaataggtgttgcagcggtaattacaccttcgtttatagcagggccataaacagttaatggttttgtagttgatcctataggtcttaaagcattatatgctctgtttgtagattgaggctgttgtttacctcttccaccaaccatagcaagaacttgaccttttctgtagtcaacaattgtagctgatgcttgaagtaaaggaacaccattactgtcataagtttcagaatttccaagccctaaattattgtagttatcaagtgttttctgtgtgaaatcttgtaagcttctatccattgttgtatagattttaagaccaccatttactactagtttagaaacttcttcatcagtataattgtattttttctttaaatcttcttttacttgtgaaacggcaggatatacaaaccattcataattcaatgtataatcttgcttactctttttaaatacaagtcctccgttttttacatcttctattgctttattgcattcttcttcactgatgtagttattctttttcatcattgttaaaactgttacagttctattaatatatggtgtaggatcttttatattattttcgttataagcactataagttgtaggtgcttgagttataccagcaaggtaagcgcattcaatcaatgataagtcagatgtatttttactgaaatataaaagagatgcagcttcaacaccataaacttgaccacccagtggtattgtatttaaatatgctgttaaaatttgatcttttgtcaattttttttcaagattaagagctaaataaatttccttgacttttctttcaatagaaacatcatttgttaaaatagtatttttaagtagctgttgtgtaagtgtagaagcaccgtgaagtcccctctgaccagttaatattttctttacatccaataaggctgctccgacgattctttgaatatctattcctttatgtttgtaaaatctttcatcttcaatagacacaaaagcattcttcaaatttgcaggcatttcgctagagtcaataacataacgttcttcatctgtatgtagattatccataaaatcgccattattatcaaaaaggcttgaaggctgatttaacgataacacagcatcaacatctaaaggtggcgtagtttttataatagcaaaagcgtaacctgcagccataacaaatagtgctaaaaagcaaaataaaataccaaaagaaattcccttaaagatcttttttttattgctttgttttggcttctttttgctatgaggagtgctttttgtttttgttgagttgttaactgccattttatcctcctaaaaatttaaggttgtaaatataataatattttataccattatagcatatttatagtatgagtaaatcattaactcgatataaaggtgttcatatggagtactatacaaaacgtaaaaattacagatatattaagtttattttagttatcgtaagtataattgttatttttaatttattaatagtgttttttgataaaagagtgtttccatcagtggtagaaataagcaaaataatggcgaaaacacaaacattaaacattattaatgaaaagagcttagagatattaaatgaagattttaaatatgatgaaatgataaaaattcaaaaagatgaagagggaaacataaatcttatacaggctgatactgtaaagctgaattacattgcagcaaaattgtctaatgaatgtaatgcagcacttgaagacatgaaggataatacaattgatgtaccgttaggatgggttacaagcagaagtgttttctataagttaggacctaatataaagatgcatatagaacctataagtaatataacaacaagctatgaatcaaattttgaaagtgcaggtataaatcagacaagacataaaatctatttaaatatcacagctcaaataagattaaaattaccattaagtgatcaagaaactacggtaacaacacaggttccagtaagtgatacaataattgttggcaaaattcctaacatgacattgggagttggaacaattgataattcacaagtgacaagtgacaattaaaacaaaaaatccccttaataggggatttttaattattgattataaataacattaatcaataatattaagttatttaagtatgaattaacttaacttattaaaatataaaaaatttcttagaaattttaatacgaattgtcaattgtccaatgtcaattgaattaagcttcccagttaaatacataagggatgtttctatagaagtcaccatagtttaatccatatccaactacaaatacatcttcaatttcaaagcaacagtaatcaggttttatttctacttttcttctagatggtttatcaagaagcacacaagttttaactgatgcaggttttagatttttaacatggtttactacaaagtccatagttataccagtgtcaacaatatcatctacaataagaacgtcccatccttcaatattatcaggaatatcattaactattttaacagttcctgatgatgtttcactgtgtccgtaacttgatgttgtcataaagccaacttttacatttaagtcaatagctcttactaagtcagcagcataaacaaagcttcctcttaataatgataaaacataaagatttcttcctttatattctctgtttataatttctcctaattctttaattctagaactgatttgatcttcagaaaaaagaatattacgtttcttatcttccatattgttaaaaactcctttaaaaatatttgttattttattatttttatgtttacaatataattatatatatttttatacttaaagtatctatttattattacaacaaaaacatagattaaactacataaatatgtatattatattttgtacatatttattgaaatatagtattttatagttgaaaaaaattttgtagaaaatgcatatattttaagaaataaaaaataaatattattttgaaagtaatatatgcgacaaaaaattcacataaaaaaatcgttggaaaaatttcaactaaaaatgccaaattaatttaagattatacaaaaaacacatgtacaaccttaaagagtgtattttatttaagttgtaattaatgaattaatagtataaaattatatgaaagttgtcaagatagcttatatgaggtgattttatgatagatggaaatatagaaggtattaaaaaatctctgattgatgaattagagagtattcattcaataaagactcttaaagatgaagtatgtaatttggaaattttaaatataatttctaggatttcaagcttaattgaaagagaagttagtgtagcaataaacagaaagggaaatgttacagctgttgcaattggagattcaacatcagtagaagttccagttataaacatagatgaaaaaagacttgcaggagtaagagtaattcatactcatccaaatggttattgtaacctttcagctctagatcttactgcacttttaaaattaaaacttgatgcaatcgtttctgttgcagttatagatggaagcatagtagatttttctttgggaatgcttactttatacaataataaattagagtatgaagaaaagagtaatctgtcactagatgctatactgtctgtaaatatattagataaaataaagtttatagaaaatttaataaaaacaaatgatgtaatagaggataatgaagaaaaagcaatattggttggttctgatacaagagaaagtcttgaagaattaaaggaacttacagaagcttgtaatatacctgttttaaatacagtatttcaaagcagaaataaaatagatgcagcattttatataggaagaggtaaggtgctagaaattgcatccatgagacaggttgaaagagcaaatgttgtgatctttgatgatgaattatcaggatctcaagttagaaatttagaagcagcaataggcgcaaaggttattgatagaactactttaatattagaaatatttgcaactagagcaaagacaaaagaagcaaagattcaagttgaacttgcccagttaaaatatagattaagtagattacagggacttggaactatactatcaagaactggaggaggtattggtacaagaggacctggagaaaagaaacttgaaacagatagaagacatataatggaaactatatatgacttaagagctgaacttaaaaagattaaaaagacaagggaaattcaaagagaaaagagaaataaggaaaatattcctaaagtatcacttgtaggatatacaaatgcaggtaagtctacccttagaaatgcattatgtgatcttgcagctaaaaaggaaaataaaacaaaagaaaaagtatttgaagcagatatgctttttgcaacattggatacaacaacaagagctattacattaaagaacaagggagtaataacattaacagatacagttggatttgtaagaaaacttcctcatgatttagtagaagcttttaaatccacacttgaagaagtgattttttcagatctcttatgccatgtgattgatacatcaagtgatacagctgttgaacaatatattgcagtaaatgaagttcttacagaacttggagcaatagataaagaaactattatagttttaaacaagatagataaagcttctgaagagcaaataaataagataaaagaagcattagaaggaaataataaaataattgaagtatcagcagcatttggaactaaccttgaagaatttttagaacttattgaagaaaaacttccatataattatagaaaagttgaatatttaattccatatgaaaaaggtgatattcaatcatttctacatagaaatggaagagttttcgaagaagattatagagataatggaacatacatgtgtgtagaagttgatgatgaagtttataataaaacacaagagtatattataaaataaaattaaattaaatagatgttgtacttgacatatatcagtagttaattaatttaatgattaaacaataaaaattcagtatcgtaactatgaaaatttcatatcttaagtatagtttatggtattaagagtttaaatataaaaataatatattgagtttattttaatatacctcggaatatttcccggggtatatttgtaatatgctcagaaaatattgtataatgtatgtgttttacgataaagggataataattatttgagtaaagaaggtgaataaaaatatgttgaaagcaatacttaattatcagaaagcatcagaaaaacttattaattcacttcagactaacaggaaagtattagcggtttttgcttttggaagcattgttaatggggatctttgggaagaatcagacattgacatttttgttgtttataaagatcaattttataacatgagagatgtatattcggaaatactagatattcctgtacatatgaagatacttaataaggaaaaattcttagagttatatgagaataatgggaaaaaaggtgagataagaaacatgctcacatcatcaaaacttgttttttcacgagatgaagaaatagatatattgttcaataaagcaaagtatagtatggataagtttgttgaaatatggaatcttgtttatcttggaaagctgataaaagatttaggtgttacgaagaaatatttatataatgatagattatttacttcatttgaagtcttaataagagcattagatagttttgctaaattatatttgaatatcagtgggtatacagtaagcagggatgcaattaaaatgacaatgaatttaaacaacaaatttaatatgcttgttgaaaatcttatagaaaaagaattaaaacaagaatatataagttcaattgtggaatatattgatgactatttagctgataacataagcattgctgcaaagtttcttttaaattatttagaggaaaagaagacatatttaagttcatatgaaataaaaagtgatgaaatatttagtcaatttgatataaagatagaggatatattaaaagaattatttaagaatggatttatagagaagaactcaagaaagattgagcttccagcaagagaaaaacttcttaatgaaaatgtttatgcatatagaaagtataaataaattatttaattgaacgttcagagtaaatagttgaatttggggtgtaattatggaattatatgatgattttaaatttgaaaaagaaataccaaagtatattcagcttgcagaatacattaagtctttaattgataaacgtaaaattaaagatggagataaacttcctacaataagagcgctttctcaaaagctgaaagttaataatgttactgtagtaagtgcatataataagcttaaaaatgaggggtatgcttatcagaaaataggaagtggaagttatgctaaaagaaaagaagtattttcaacttttagaaaagagtattccaatagtttaaaaaatatagattcacaaaaaagcgatgagataatcgattttacaggtgaaacttctgcagaagtactgtttccaatagatgaattaaaagaaattattaatgaagtccttgaaagagatggtgcgaaggctttaatgtctcaaaatagaagtgggtattcaaatttaatatacacaataaatgaagtattttggcaaaataaattgaaaaatgatgatataatagttgtttcaggcgcacagcaaggaattgatattgcatccaaaagtattcttaacataaatgataatgttattgtagaaaaacctacatatgttggagctttatctgtatttaaatggagaaaagttaatatatttgaggttccaataaaagaagatggaattgatttaaaggcatttgagaagattttacagaaaaatgaaattaggtgtttttatactatgagttattttcagaatcctactggagtaagctatagtatagaaaagaaaaaacgtattttggatcttgcagaaatatatgatttttatattatagaagatgactatttatcagaacttatatatgaaagttcattagaatatatgccgtttaaatggcttgataagtatgatagggttatctatataaagagtttttcaaaaatattccttccaggaataaggcttggatatcttgttgcaccagaagtgtttaatgaggttcttcaaagttctaagcacaacacagatattacaacttcaagtttgatgcaaagagcacttgatatgtatattgcaaaaggaagctggaaaaataatattaaggaacttaacatggaatacagcaaaagatataatatgataaaagatattttagataatgattttaaagatattgtgtcctatgtggatccaagaggaggattgaatttttatctgactcttattaataaagaaatagatacaaaggtactttttagaagattaaagaaaaagaatatatatataacaccaggaaatgttttttatacatcatcaaatgaaggacaagattctctaaaaatttctttttatcaggttaatgaagaaaagataaaaataggaatggacttattaagagaagaaattttagcaattgaaaattgatagtttagtataaatcttttgtggagagttttgaaaatgtattagtattaataatggatattttttaggaatatcaacgataattgccaattattcattgtcaattgtcaactgaaaagatgggagttgaattaatggcttatattactataagagatagaggagaagacagctttgaagaaaagaagtcagaatttataggttatgctaaaagagttgaaaatgaagaagaagcaaaggaatttgttaatgaaataaagagtcttcacaagcaggcgagacataactgctgggcatatgttattggagaaaaaatgaatatacaaagatattcagatgatggagagccacaagggacagctggaatacctatacttgaagtaatgaagaagagtaatgttacagactgtgctgttgttgtaacaaggtactttggggggatacttttaggtgctggaggacttacaagggcttacacaaaaggtgcaagtatatcaataaaagcagctggaattgtagaaaaagttaaaggactaaaaatcagctttgaaatggaatatgatctttttggaaaaatacagtatatatgtggtcaaaactcatggcatattgaagatacagagtatacagataaagttatagttcacatcctttgtgaggaaaatatagcagatacaattgaaggtgaaattgttgaggctacaagtggaaaagtaattgtaagaaaaagtgaagaaggaatttactttaaagaaggaaatagattatatgcacagatttaatgtgtaaattgtaaaaaatgtaagtataattgtgaattaacataaaatgtggtataatctttcatgaattttatattaaaataaagcaaaaagacttatataaaaagtcatttaataaataataagaatttagatgcttaaattaaggaggaaataaaatgtcaggacattcaaaatggcataatatacaagcgaagaaaggtaaagctgatgctaaaagaggaaaagtctttactaaaataggtaaagaattaatgatggctgtaaaaaatggcggaccaaaccttgatataaatgctaagcttagagatgttgtagcaaaggcaaaagcagcaaatatgcctaatgatactataacaagatcaataaagaaagcatcaggagaattaggttctgtaaactttgaaaatatagtttatgaaggatatgggcctaatggagtagcggtaatagttgaaacattaactgacaataaaaatagatcagctggtaatgtaagaagtgctttcactaaaggtggcggaaacatgggaactcaaggatgtgtaggtttcatgttccaagaaaaaggtgaacttgttatagaaaaagaagaccgtgatgaagatgaaatgatgatgttagcattagatgcaggtgcagaagactttaatgcagatgaagaagaagtatttgtagttactacagctccagaggattttggtactgtacgtgaagcattagaagcagaaggaatagagttcttagaagcagcagttaagatgattccagatacatatactgcaataaatgaagatgatgctaagaagttccaaaagatgttagacttacttgatgatgatgatgatgtccaagaagtgtatcacaacgctgagttccctgaaggttgggaagaatagggcgtttagaggtactctgaacttcaaaaaatcatttgataatggtatacttatttaaaatttacactttcaatattgatatacatagtgtgtcaatattggaggtgtttttttgttgctcgaagatttattaaaagagtataaatacgatatgcaggtgaggaattacagtaaaagaacaataaaaacctgctataattcaacgcttaagtttattgcatattgcaatcatgaatttgatgtgaaagagatagaggagctacttcctcttcacttgaaaagatacataacttatttgcagggactggggcgttctgaggtttatatgaactctattttaaaatacttaagagggtactttaaatattgtgtcatggaaggttacataactgagaaacagaacataactcaaaaagttagatggctaagagaaaagaagacattaattactacatttactgatgcagaagttcaaaagatgattaaggtttgggactacaagaacttttacaatgctagaaataaagctattattgcgatgctatttgaaacaggcataaggaataatgaactttgtacattaaaggtattggatgtaagaggtacaattataaaggttttaggaaaaggaaataaggagaggtatgttccaattagctctgcattaaagaaaattctaataaggtatgaacgtattagaaatgagtatataaaagataaaccagtaacagatgattactatttcctatcatataggagcaggcaattgactatagaagcagttgaaagagtagtaaagcaaactggtgaaactgcaagagtaagaaaggaaataagatgttctccacatacatgcagacattactattgccaatttttattgaggcagggagtagattcatacagtatttcacgtttggttggtcattccaatacaaacataaccaagatatatttacagagcttagatgatgaaaagattgttgaaatggggtctaatgtatctccgttgatgattctaaaataaaaaaatagctaccacgccaatggtaactactaaaactgaatatagttttataaatctttgcacctcttcagcgagaggattaaagttaattcgcaatttaagtttagttcaaaaattgaagaaatgcaataggtttattaatcatgccattatataggtatggtttagttgttatgcactattgcaactctaaattcaatagtaggtcagttgagccactgcattaaaatcaactattacatagagcgattgaaaattatctttgttatatcttttgtaaggtgtgtgtgtaatgtaaggtgagtggcaaccaataccctataaataatagtcatggtggatacttaggagactagtgtctcggtagataacagaatattaatgataaaacatattggatgagtatagtatggtaaagctgttattgtagaaatacaagtaaataacaaagatattaaacgaggtcttaattgctttatacagcatgatacaataatatttatctacttatacagctacttttattactaatgtagctgtataggtagataaattatctttgctcagaacttattacattaccagcatatttattgtagattattatacgatatggtaaaataatgtaaaagtaatggtggaggtaaagtatgaaatacattgagtgtatatataatgatggtagtggagataagcctttggaattagtagatgtaacagaagaaaaggcgaaagaactagaaggtaaaatcttttgtaatggtgttagtaatggtgttatatgtagagctcctttaagagcagctcataattcttttgatggtggaaaaacaatgcattttagagcaagtaacgaagaacatattttaggctgtccttataaagatattgttgatgaaaatggtacaagaagaaactcaacgatagttgatggttattttacggaagaccagataaatagtttcgctagagaattagacaatagagtgagtggaaaaaagaaaaagcaaccaaggaaaccgactaaacagggcaagacaagaactagaaattcaggaagtaaagataataatgaaggtagtagtgaaaacggtagaggaagagttagaggtggaactgttgtggctggtgatagagatactggtagaaagggaagaatgagaactctgacagaagtaactatggaagatgtaaatactgaggtgggtatttatggaaacttaaaaagctttagtgtagatggttatggagaggcaactttgttatataaagaagaaagattaaaaaatgttcaggttaaaatagggcaaatatataaaaataacaatcctcaagagtttggtaaacttttaaaaataaaagattatgttgattttcttatggataataataaggaaattcgttgtatttcagcaggattagtaaataaatatgagaataatgataatttaattattgaattacaaactaataggagttttagaataaatggaaaaagtgtttgggatatagttagaacacaattttaatattaaaaggagctgagtctgtacaggctatggctcttttttttgtaccataaaattgttcttttatcagcgtgatagataatggacaggtcattctgcattagttaaaatataagtaactaacaaaagagaaaacagtaaaatggtttcatatatactgtaaaggcgacaaaggagaatagaagggtgctaggaatttattttgatagatactatgagagcaatgatgtagaagaaaagaagagattgagaaagttattttctaaacatttatgggagtctattccgtatgagaagggacatagaagctttagatttgatgttgttgatactctgatagaagatgaagcggttagagagctatttaaaccataccagagaataacatataagatattaaagagcaggcataatataaacaagttagaaaagttggatttagtaaaagcgagaatcaacagtaattatggcgtgtattgcgatagagatatatatttagggaaggagtattataagtaccttggtcatatcagaaatatatattttaattatatagatggtaaatataaattagtagaagaggtaaagaatgaagttaatgatacatatcagaaagccatgcagttaaaagaagaagctcagttaggaaagttgaatatgtcatgggatgaatatcaacaattcatagaaaagtgcctggataggatatttgaaaactatattcctatagctgaacatcctaaaatagattggcaagaaaatgaccattttgaatgggatgaagacaatggtatattaagttatgttaattcaagcttaaacggatatttaaagaactacattagagattcaaataaattaaaagagaaatcttgtgtacaatgcggaacaacaattacacaagctaagactaatcagaaatattgtaatgaatgcaaatcattaaaaaagagaaagccagagttacgttgtagccaatgtggaattaagattgataaccctaagcctagacaacgtttctgtgaactctgcaggaaagagaaagataagcaacgtcataaacgttataataaaactagaaagaagtaacgacacttaaaaatgatttgtggtatttacctttctatgggtgtaaaacaaaatttaaaaaagttctacctttgttgtagggctttttattttgcccaaatttacaaatgaaaaggagaaatagttaatggaaggattcgtaataaacattaacagcaaaaataagaaagcaataatcagtagagatgagatggagtttattcagctaaagtttggatattcggaatacagaagtattaatgatatttctgattacgatacagatgcagttttttcatattgcataatatgcgatgaaagaacaggtgaagtactagcagatttatcagaagatgattatttaatgtatcaggatgaatttgaatgctattgcaccagtaaatacagaagatgtacttaaagcatggagtgtcttacttacaattaacaattcgaaggagagaaaaaaatgattacaaatgaagaatatttgatgaaacatgttaagaaggctgagagggagttaaggaaggtagcattgccatacagtagatatgaatttgttgatactgatgaaataaattttgttattgaagataatgatggtgctgatggatatttcagaccaggagaagtaaatactattatggttaatagctcattctttaaaaataagtttaagaaaaaatacaatcgtagtctaataagtgtactacagcatgagatgattcatgcatatttacatgaattagatttatatgatttacgtgtacatgcagacagttcaccattatttgcaagcatggtcagttggtttaatactcatagtaaaaagaagattgatataaggcaaaatagtggattgaaagagcgtttctatctatataatagagaattagtctacttttcggtagataaagatactacatttgaaatgcttaagaaaagaatggtgaaatggcagataacattacaaaataggttggatgatatagcatgtgatattatgagtgcctccaactgcaagcaagtatgtgagttttcatttaatagttacagtgaaagtgaaacaatgtgtttcgcaaaatatagaaagataaaattaaataatgaaacgggaatgatactggaatcaaatcttgtagcattaggaatggatataaatatatatgagacagattctgggtttactattgaagagttaattcatagttgtacagaggatgattgtaacggctataagcattacatgaatacaattgatgacgtagcatagtaactaaggaggagcaagaatgagcagaacaattaaaatgaaagaattagaaagaacagtaaatgatttttggagagtacagggaagatactacactacagtaacagaagtaattggttatgaaggtgtagtattttctatatatgatactgatacggatgaggtgatattagacttgaatgtgccttatagcgagtgcacatatgaacttacaatgaagttacatgaggaaataatcaacaaatgctataaatgtcaacccatgaatgtaagttttcgatcatttaagaatgtagtttttttagtcttcgtcttgcttaaaatgatcttttagtctatatgactttccattaattgtaacaacattggcatgatgtaaaactctatctaagatagcattagcgataacagcatcataaaaaatatcatcccatgaattaaaatttatgttagttgttaaaattgtgctttttttctcatacctcatatcgattaactgaaaaaataatttcgaatcttctttatctataggtaaataacctaattcatcgattataagaagcttatatttactaaaatgcttaattctagcatccaacctattttctagatttgctcgctttagctgttgcaacaaatcattgcacttaatgaaataagtactgtaacgtcgcttcgcagccgcgattcctatagaagtcgcaagatgtgttttaccaacaccactagaacctaaaaatacaatattttcttgtgattctagaaaacgtaatgttaaaaaatctaatatttgatctttattaattccaggttgaaaattaaagtcaaaatctttaatttctttttgatgtggaaaagctccaaccttaaccatagatttaatcatatttgcctctttataatcaatttcatgagctgttagcttaataagagcatctacaaaggctaaattattctttgttgtaaaatcaataacttcgtccaaatgagtaatcatttgcttcatcttcaaatattctaaattatttataagttgtgtatatgtactattcattttggtatacttctcctatcatttttaaattatttctagctatttctatcatttcatatgattttttattaaatgttaaagcactaatttcagtataatgttcagcatgataatttaatttctgattttgtattttatgaatagtaactaaatttgtgttataatacacatgtagttgatcatcatacacttgaagttttagttttttgcctatatattctggtggtacagagtattgatttgatttatatgaaatcatactttggcgatttactttaacacttgtggtgattattttgtaatgatttcttatctgctctttaggcagttcggataagaaatctttttctttttctaaatgtaatataggtattttgccagttgatgtatggcatgtactattaattctattgtttaaatctgaaacaagcttatgcagaccttcataatctaaggttccattatatgctcttatttcatctaatagtttcataggtgcttcaactttagcttttgtattcggtcttcctgctatgcagggacgaacattaaatccatagtcatctgcaaattgttgaaatttattatttacttttcctttagaataattggttctagcttcatccataacagttttcatgttatctgtaagtaattcttcaggtacgcctccaaatgtttcaaatgactcatctaaaaaagaaagtaacacatcttgtgttttatcaagagataatttatatactctaaaccttgagtatgaaagtattaatacaaaaacatttatattaataacttctcctgtatttaacacaaattctatattttctttccaatccaattgtgcttgtttccctctctctgtttcatatctcataggagaagtagtggatatatgtccttttttcctattattaaagtactcattgaattctgagtgattagaaatgtatcttctaaacgaagattgtgcgcaatctaatccatgattatctttaagatattgccataaaatgcgcttataataaaatacttgaattgaatctttaccaagaagctcttttataataggatcaaaagcttctactttagatttgcagtttctagtggtaggtttgacatatccatttaaatatttgcctacggttcgaggatcaacaccaagttccctagctatttggcttttatttactttcaaattatttacctccataattgattttagcttatgaagatcttccaatgtattaattttaacttctgaataaatatttgtttctataatcataattacccccaataaatcttgagtaattataatttataaaaactaaattgtacattcttatatgatcgtttccttacacttttatcgtatcatttatacaatataatcaaaatgattgtaggaggaactgggattggaaaatcacattacataattaataccctgattaaggaactagttgatgaaggggagaaagtattgttactagctaataggagtacgttagtcgaacaacataaagttgatgtattaaagattaaaagaccagaaagtgaggaagaaattctagaggaagttaatagaaagctttggattgaatttgagggtagagtaagaatagttacataccatacactggcagagagctgtactgaatatcttcataggtataatcatgttatttgcgatgaagctcattttattgtgcaagatgctctctttaatgagaagtgtgatacggttttagaaaaactattagagctatacagttatggaaagaacatcataatgacgacagctacagaatttgaattaataccgcatctttggctatatggagtacgtgaagagaataataactttaggattttcaattataatgataaacataactggtatgatagaatacaattaaattttacatcaaagaggatagcagacatagcaagattagtacaagaagatgcaaaatgcatcatattcacaaagaaaaacaagatgaaaagaatggctgaaatattaggagatgcagattacatacattctaagtggaataatggtgcaaaggatatagagatggagcagaaacaaatacagctaataaagagccattcatttgaggaaaaacatttgataacaaactcagcccttgataacggggtttctattaaggataagaaggttaaaacaataataattgatggagtctatgatatggttcagataatccaaatgataggtagaaaaaggtttgatgtagatgatgaagctgataagttacaagtatatataataacacatcacaatgaagtaaagcgagagtatgataaggtattgcaggaattaaggatgtatactgactatgagataatgttaaataaaaatacagacgaagcgttgattaaatttaatgatatgtataaggaatactttaaagtgaatcataacaaacagcctaaactgcatgttataggaaaagatactgatggaataacagcaaagttcttcttaagaaatagttatcttgccaaattaggatgccagaaggatgtactatgtaaattaaataacatagcactaaatgtaaatgagttctttacagaatgtcaaccaataaaaaatttcataaacataaatcagaattttgctaatatatttgcggagaaatacaagcacatgagtgaagtagtaattgacaaaggtgtaagcaagaaatacttggaggaaaagagaactatacaaataaacagagatttaaaactgctagatgtattagaggaatactcacaaaaggaatttattgcgttgaatgagctggaggcgtttaagaatagattgaagactgaatttggaatgggagataagtcaagaagcaaaggaatttcaccatctacaataaattatgagattaaggaattaggatattatattgatagcagggcaaagaaaataaatggaaagagccatagagtatggatagttaataaagtaggttagaataatggaatgctaaagatagtgttctttttttatctataattttaaattaaggtaacaaaattgtagtaaattactagtgttttctaaagaaagattaataaaaacatgtaaaattgttaccttaaagaaataataatggaaaagctaaatagtccgttaggactttcatgagcaattcattgtgaaatgctatattagagatttatgtgtataagtatagagccttcagcgtatgtaaatagttatgttcataccctaacgtaatctactgcgtagaccgccctattaagggctttacttataacttcatatcaaatgatattcgttaatgtttatgtgggcttataactgctacttataggaatattagatatattgattatatatacatatagggtattaattagtggaatgatataataattataaaataaataataattaagaaggtgttctaaattgaagaaagagtataatggtcagtggtattatgctgagagtgaggatgaaaaatttaatggaagattaattattgaagataatagaataatattaaaagtttatggaagaatgtgtagacataatgaatttgagttatatagaactataaatggaataactaatgatggaaaaaaggtaacattgataaaatgtatgtgtattagctatccatttttaggtggtagtgaaatgatatacactgctgaaaagctgattttgggaaattgctataaagatagtgatgctattaatataaaaacaattacttgtaactatacagatttagataaatggttttttcagaatagtttaaaagttgagagtaatgaagatggatttgatatacggtataatgaaccagaaattgaagaatttgatataggagattttaaaataatctttaaaagcaaaaagagttgtaaaggaaatttatacaataaaataacttttgaaaataacttaagtattgagttttcttttaaagaaccagttaatattgtagatgctatagatacgattaatcattttagaaatttattaactatatttagtaacaataaaatatcattttataatataagactagtagattatgaaaatataaatatatcactgatattaaacaaaatgcacgttgagaaatttactgacaaagagccatatgatatctttataagatatagtgatatcaaagaaaattttaaagatatagttgaaagatggtataaaaataaggaaaaaatacaaccaatagtagattatttaagttatcttattgaagaagataagtttgttgttccacttacctttatgactaccatacaagctattgaagcttttcatagaagaacaagaaacaatgtaaaaataaatgaagatgagcatgaaataaaagttagtaggattttaaatagtcttagcaatgaggacgatattgagtggttgtctgaaatattaaaatatacaaatgagccagcattaccaaaacgtttaaaagagatgtttaaagaagttaagttcttagttgcaattccatctaagatacgagataaattatgttggaaaatatgtaatacaagaaattattatactcattttagtgaagataagaaaaaggatataatgagtatcgatgaaatgtttagccttacaaattatttgaagttaattttgagagtattaatatttaaagatttagaaataagtgatgaggatatttctaatagattagaagaggtggatgatgagaaatatgtgataaagttttttgagaaagaatttaaaatatagtgttatatgaatgggatggaaagtagaattaatgaaaaaattacctgaaattaactattgcacgtccacactgggtatctttatacgatatcgaagggcatttttttatgaatttaagccttgtaaataaagggctatagaggtgtgattttagttgaatctaggtaaatacttgtaaagctagtaataaagccgttattacgatgatgatacgatagagtactttgttcaaaattagaggaatatatattatacttaattatagataatatgcagtgaatgggatgatatgaatgagaattgttacatggaattgtaatggtggatttagaaataaatttgaatatattaagaagtataatgctgatatttatgttattcaagagtgtgaaaatcctttgacgagtgatgataatagctacaaggaatttgcacaaaactatatgtgggtaggctataaaaataaagggttaggtatttttggaaatcaaaatatcaaacttacaaataacaattgggatacttatggtttagagtggtttatatcatgcacagtaaatgataattttacattacttggattgtgggggagtggaaattacatagaagatatatatgtatatttaaaaatacatcagaggcaactagagggcttagaaaaagtagttgtatgtggagattttaatagtaatagtatttgggataagaagcataagaggagaactcattcagcagttgttgaagatttagaaaagttaaacttatacagctgttaccatcttaagaatgatgaagtacaaggaagtgaaactaaaccaacattttatttatacagaaagagcaataaagggtatcacattgattattgcttttgctccaaggagcatttaaaagatttacagataggagaatttagtaaatggattaaattgagtgaccatatgcctttagttgtagatgttgatatttaaagtatgtaaagaaaaacacttggtacgtattgtatacaaaactaggaaaatgatatctttgaaatgacttgaataggtactgaaaatctatattttaatttacaaagttttaatttaaagtttcttatatggggtgataaaagatggattacaatgaattagtaaaaaagagaaagcaatttaattttgaagatttaccagctgtaaagaataatgggaaagaaataacattaaaaaatccacaaaatattgaaggtggacagtatgatgaagagaatgaattaaatccatggtcaagatggcaaggtgatttgaatgcagagatacttgtaataggacaagattggggtggagaagagtgttatagagaacaacaaggaatagatagtgatgaagatgttactaatgaaaatttaattgagttgtttaaatcaattgggattacagttcggaagccaagtgaacaatattcaaagaaaatagaacaaaatttattttttaccaattgcattctagggattaaagaaggtagcaaaacatgtgctgtagatagatggattgaaataaatgcaaaagaatttttgaaacctctaatacaggaagtattaaatcctaaaataataataacacttggattaccagcttttaaatcagtaaatgaaatattcaaaataactgaagagaagaattataaattgaatatgaaatctgtgttaactaaagaatatccatatatacagaatgatataaaaatattttcattttatcattgtggaagattaggtgtgaacaatagaagtttagaaaaacagattgatgattggagtattttgaaaaagtatgtataagtatcataacttaaaagtattgacactgacaaaatcataacgtaaaatcaatatatagagcggtgtctaaacttagtgtcaaaattgaattttaaagtgaggtaataagttatgatttatgggtattgtagagtaagctcaagaggacagttagataataattcattcgagcaacaagaaacagagattttaaataaatatgaaaatgcaataataattaaagaacagtttacaggtactacaactgatagacctaaatttaatgaattaatagaatcattacaggaaaatgatattttagttgtaagcaaattagatagattagctcgtaatacagttgaaggaatagaaatagttgaaaaactatttaataaggggatatcagttcatgttcttaatgttggattattagaaaatacaacaatgggaaggttctttttgactacattacttgcagtagctgaaatggaaagaaatacaattatagagagaactcaaaatggtaaagcaattgcaaagaccaaagaaggatttaaggaaggcagaccaaagacatataacaaaagtcaattggataatgcactatcaatgttatcaatcaatggtggtgacaggtcatataatcaagtatctgaattactagggattagtaagagtacattaatcagagagaataaaaaaagaaaattacaataattatttctgaaatggaaagaaatatgataagtgttagggtgaagtctggtgtagttaatgaaacagcaaaaggaaagataattggaagaccaagtttaacaattaaggatatacctgagaaggtcattgatacacataagcttgatgatggagcaatcagtaaaactgactatgcaaagatatgtggagttagtagaccaacattagataagtacctaaaggttatgagggaaggataaacaattatgggttctatatattagaaggtagggggtatcttaacattgatagttaattaccaagtgttggaagtgggcttagcagttaaatctacaaactctgtacggataaccaccgaacaatgaaatggtatttattgacttaaggatgttttcagttataattattatgaagggtaggaagcaattcctaggtaaaaaggaagagtatgtccaagtactctttcatttgacgataccctctaaaggtgtgataagtaagaacagtagtatgtaatgtgctattgttttttctttatctatgaagaaatattttgtcagtaagttatggaggtgtaaatatgattcaagaaattaatttatacgtagacgatataagaagatgtcctgatggttttgtggttgctaggaattatgaggaagctattgagctgttaaacaataatacaattaatattttatcattagaccatgacctgggaatcgatgagcacggagtcgagaagaatggttatgatatcgtaaagtacatatgtgaacatggtattagtccaaagaaaatatatattcataccgataatgtggtcggcagagataatatgtatcatacattgattagtgcaagaaatagaggttttattgagcaaagtacagatatatataggcatggatatgtggaaaataggatatagggatatgtgaaggagctgtttggggcttcttttgatattgtaaaattattagagttgctaaaaaaggatgaaagatattgaaatttactttttaaatatagaaatgttataagtgtaagagcgaaacatggttttgttaatacaaaggcgaagggtaggaagaataagtttattaattaaggggtacaccgcagaagatgattgatacttacaaactctttgaagagggtgcaattagtaaaaatgattatactggatatgtggagttagcagaactacattgaataagtacttaagggttagggtataaggattgactaatgcttatagtggagagctagatataaaaaacaagttttaaattataaatattagtgataaaagtaacttgtgcacctctgaatttatgtttatagatgagttaataaaaggtgaaataatacaaagaaaatgggatatttaaaggttaacctatataagactatagatataatatattaattttaatagcaccttattaaaatgtaagaaggaaaaagattgattatgtagaatatatatttagaataacacaaagtgtataaggagtgataatatggaaaaaccaagagtgtttataggctcttcggctgaagaactttcagtggctgaagctatagcggaaaatttaaaacatgattgctattgtgatatttggtcacaaggattattcagaccatcaactactacgttagattcattattgatggatttgggtaaatttgactttgctatctttgtttttagtgctaatgatgtaaccaatattaggggagatgaatataattcaataagagataatgttatatttgagactgggttatttataggaaaactaggaagagaaaaagttttttatatagctcctaatgatgtggagatacatttaccaagtgatttgataggttttaccccggaaaaatacgatagaaatcatcctaatcttgtagcaagtgttggttcttcttgcttttcaataaaaaggagaattgaagaattgatagtaagtaaataatgttagatatagtaagaaaaaatttaattgtggtatcaactaaaaatggacaagaatttgcaagtataattcaaaaggaatttgaagaaatatcatatacagtattaattaatcaaatagaagggaaattgctacaaaatgaactgcagagattaacagaagagttaagtaattttgattatgcaattttagtaatacattcaaatgatttgcaaagtattagtgatatatcgtttctgcttggattattgattggaaatctaagtttaactagaattgcgatattatcacctattaattcgaagcttgataaatttagctcttatcttaagtatatcgaaccagaatattatgatgatacacatcctaatgatactagtgcaatttcgcaaggattacacaaaattattaatgtatgggatagtgtagaaaaaagaaaaaatggacatgattatgaaatacttgaaaataagaaggaacttttaagaatagctttgggaagttgtggagagaataaagaaagatttgatagtttcttaggatattttgataaatgttttaatgcggtgtataagtctcataagtgtagagttttaggaactacattatttttagctagaaataattttatagaacaaatatctcaatctggaataataaaaaggaatcataaattttcattagatgaaaaagacaagggagttgttgaatgctacaacaatcctgataagttactacttacagaaaaaaagggaaggtatttagaagatgaagatgtttatgaatatatattttataaatgtattcataaaaaatttgttttgacagtacatataaaatataaaagcaaaataagaaatgatgagtatcaagattatctggaaacattacgagataataataaaggatatataggtattcttcaattatttttaaaaggaggtaagcagtgttgcgagtatcaaaaagatgttttggaataactgatattattaaaccaatatgtaaggggagacgttgtaatatggctataaggaagtggcaaaacagggttacttcggatgacttaacttttttagaaagctcaaatagaaaaacaaaggcaattattgttgcctcaattaaagaagatgaagaaatatacgtaatataggtattaaatgtagcatatgtataatcttaataaagtataattgaataattaagtgggaaagaagaggaatatgaacctcttcttttttttatgtcgatttgataaaggaaaacatttgaatggtaatagaaaaactaactttattttctggactacggtaaaccatattgacctatacaacgctatgatgataaactgttagcagattaggtaaaactatcataataacgactatgatatatctatagattttagatgtaaaatagataagtaaatacaatgagtaagtttaatgtaagaagtgccttcactaaaggtggcggaaacatgggtacatcagggtgtgtaggattcatgttccaagaaaaaggtgaacttgttatagaaaaagctgatagagacgaagatgaaatgatgatgcttgcattagatgcaggagcagaagatttcaacgctgatgaagaagaagtatttgtagtgactacaacaccagaagacttcggaacagtgagagaagcattagaagcagaaggcgtagagtttttagaagcagcagttaaaatgataccagatacatttactgaaattgatgaagctgatgctaagaagttccaaaagatgttagacttacttgatgatgatgatgacgttcaagaagtttaccacaatgctgaattcccagaaggttgggaagaataatctggttagattagataaatcaaaagattacaggtttttgtaaaaattggaaagactaatattgattatgatatacattcaattttatgtatttggattgatgtatgttgattttagaaaccattttctatctttgattagatagaaggtggttttttgttgttgaaagatattataatatgaataatattccattatacaatacaatattaacataaaaaacaaaggatggtgttatagatggttgctgaaatttttgaattgacgaaagctcttggaggtttaatctttaaaattgtaaaacttggagttgtaatagtaggtattattacaatactaaaacactgataagaatataggaatttcacatcttctataataaaagttttttattatagaattcatgaaatttaagaatttattgtgtaatattagaaaaaaggtaaaatatatgttattaacatgataaatgtaagaaaatattattgttatattaagttaaaaatgatattatatatatggaaatagaaaaaaatggtatataattacattgtgttagattatatataagtaaaaataaaatagattatcatgtagttggaaacgaagaatagttctctcaatctgggcaccttgggaactaggagttagtggtgcaacccgccagcaaattaattagtattaatttgttggttttttttataaaaaataagaggaaaaaatagattattatgagatttatgtagatataggaggatttataaacttggattatatattagtaataatattaggattggttataggaagttttttaaatgtttgtatttatagaattccaagagaagaatcaatttcgtatccaccatctcattgtggaaactgcggtcataatctacaccctgtagatttaattcctataataagttatgtgtttttaaaaggaaaatgcagatattgtaaggagaaaatttctataaggtatcctatgatagagggattaaattgtattttgtatttagtaatatatatgaaatatggttttatgatatatacagttgaattttgtattctaatatctttattgattgtaattagtatgattgattacaatacacaagaagtttacacatcaacaactgtgtttggagcaatagttggagtaatatttatactgattaataagtttgtatatggagaaaatgttatgaatttattaatgggcggattaacaggagcagcaataataggagcaatagtatatttgacaaaggggatgggtgaaggagatatagaaatagcaggagtatgtgggctatttataggtgtcaaacaaattattttagcattatttttagcaattatgctaggtggagcagttggaataattgtgattttattaaacttaaaaaatattaaagataaaatagcgtttgggccgtttatagctataggaacattaatagctattttgtatggaaatgcattgataagttggtattttaatttactagtttaaataataactttaaagaattttcacttatgataaaagttaattagtaataatagaggggaaggatagctttattatggcgattgagaagagaagattaggaaatattcttgtaaatgctggcaaaataacaagcttccagttacaagaagcattaaaagctcaaaaatcccttgggaaaaagcttggtgaaattcttgttgatagcaagataattactgaagatgagataattgaggcaattgaacaacagactggaattaaaaagattgatttgaacacgatagaatttaacagaaaagctataagtttaattccagaaaatttatgtaaaaaatatacgcttatacctttcggatttgaaaataatagaatcaaagtaacacttgcagatcctttgaacatatttgcaatagatgatgttgccatatcaacaggatttgaaatagaatcgtttatttctagaaaagcagatataaataaatatattggaatatattacagtagtcagcaagttgataatgcagcaattcaattatcaaaagaaagtacaaaagctttaaaaaaggcaaaagaaaatgttgatgtaataagcgatgtaaatagtgctcctgttgtaagaatggttgattatatgtttaaaaattcaattgagcttaaagcatcagatattcatatagaaccatttgagaatgaaataagaatacgatatagaatagatggaaagctaagaactatcaataaattaggaattgaaagtcttgctcctttagttaccagaataaaaattatggcaggacttaatatagctgaaaagaggattccacaggatgggaagataatgataagagtcgatgataaagaagtagatcttagaatatcagttcttcctgtagtgtttggagaaaaggtagttataagaattcttaataagggaagtggaataataagaaaagaagatcttggtatggatgaagaaaacataaaaaaggtgaacagaataatttcaaatccacatggaataattcttgttacaggacctactggaagtggtaagtccacaactttatattcaatattaagtgaattgaattcaaatgaattaaatataatcacggttgaagatccggttgaatttactatgaatggaataaaccaagtaaatgtaaatgaaaaagcaggactgacatttgcaagtggccttagaagtatacttagacaggatcctgacattgttatgattggggaaattagagatgaagaaacagcagaaattgcaataagagcagcaataacagggcatcttgtattgagtactcttcacacaaacgatgcaccttcatcaatagcaaggcttatagatatgggaataaagccttatcttgtatcaacatcagttgcagggataattgcacaaagacttgttagaaaggtatgtagtaactgcaaaacatcatatgaagcaagcaattatgaaaaaagagttttaggacaagatataaatgataaattaattttatataaaggatgtggttgtggatattgtcaggaaacaggatacacaggaagaattggtatatatgaaataatggagttaacaagaaaacatagacaagctatagatagtgaagttacttcagatgttttaagagatataggtattgaaaatggaatgaatactttggaaatagagtgcaaaaaacttgttttgcaaggcgtaactactatggaagagtttgaagcaataacaacttcagaagtttagaaaaaataattcagaatattcaatcaataattaaaagtcgaattttaactatgatgctttgtattaattttttaagtatgaatattaagttgaaatagaaatatcaataaaaatgaggaggagagtatggcgaaattcaaatatagaataatgaattctgatggtgaaaaaatcaatggaaattatgaagctaattcaaaagaagaagttattgattatatttcaggaaatggatattatcctcttttagtagaagaagtagttgaaagtaagaatatagagtttgcttttaatgaaaaagtaaaacttaaggatttatcaatattttgtagacagttttatacaatgcttgatgcaggtgtaccgattttgacttgtttaaaaatattatccgatcagattcaaaataaaaaacttaaagaagccatagttaaagtcaatgaagatgttgaaacaggtgaggttttatcagatgcaatgagaaagcataaagatgtatttccagatttgttagtgtcattgacagcatctggtgaagcaagtggaagtcttgattctgtaatgctgagaatggctacccattatgaaaaagaaaataaaataaacaataaagtgaaaaatgcaatgatttatccaatagttcttggatttgtatcagttgttgcagttacatttatattagtatatgtaatgccaacatttatgcagatatttgaagaaagtggaacacagcttccatggtctactaagtttttactcggacttagtagtggtatacagaataattggattgtaatgttatttgttcttattatagcaattttaggacttaggatatttttaagaagtgaacaaggtattttagtttcaagtaaattaaaattaaagcttcccatacttaaaaagttaaatgaaatgataatagtatcaagatttacaagaacattatcaatattgatggcaagtggtttatcgctaataaaggcattagaaatagtatcggaagttgtaggaaataagattgtagaaaatgccatgataaagataaaagatagtgtaatgcgtggtgacagtttatattcttcaatgaaagaaagcaatatgtttccggctatgttgtattcaatgataaaggttggagaagaaacaggttctctagatgatattttaaataaaacagcagacttttatgatgaagaactagagacaacaattcaaacttcagttgcacttttagaaccaatattaatagtaattatgggacttattattgcatttatagttatttcagtaatgctacctatgtttgatacttatactcaaatttaaaagcaatgcgtaatgtgggatacagagcgcattgacataaataatataaaaattaggaggggtttataatgaaccaattagtacttaaaaagaaaaatgaattaatgaaaaagaagaaaggttttactttagttgaacttattattgttattgcagtaattgcggtattagctgcagttgctattcctaagtttggaaaagttaaagaagatgctaatcttagagcagaccaagctaatgctaagataatagctacagcagtatcatcagctgtagcggatggaaaaactttttcaaataaaacattagcaacagcagatatggatatagttaagggatatattgatggaaataaagtaccttcatcaaaaacagataaagcagaatttatagtaacttatgattcaacagaaggtgttaaaattacattaggtggaacaactaaaacaccagtatatccagcagaaaactagattagtattgaatagacataggaattatgatctataaataaaatattaatgtttattcatagcgtaataaatattgtttgacaataaaaaatataaataatatttattttcaatctaaaataatatttattttaaagcaataatatggaaacatattattgctataaataaaattattaagaatatggaggaaatatgattaaaagagaaagtttagatgagaacaaaaattctttgaatataaaagaattaatgaatatggatataaaagatttaaagtttaacttaccacaaaatataaattttaataaagtaattccagaaaaaaagaaaaaagtagtagcttttgacttaggaagcagtactataaaaatagttcaaggaacatactataaaaatgaattaacaatagataaatacattaaaattccatctcctaaagatgcagttattgatggtgaaataaaaaaagatgatgaattagctattagaataagtgaaattttaaaatcaaacaatataaaagctaaacatggaatatgtactacaaattcaactttaatcattaacagggaaatattaatacctaaggttgaagaagaagaaatggatactgtagtaagatatgaaatacaacagtatttacctataaatttagatgactatgttattcaggtaacagtcttaaatgaagaaaaagatatgaatggatcagataaactaaatgtacgagttatagcatttccggataaaatagcaaagggatattataaccttttgaaaaaattagaattagaaccctatactttagatgtaaattataatgcagtaaataaattagtgaattatatagaaaatgaattagaatacaacagtaatgatgcagttgcttttattgatatgggggcaagctttattactgttaatatatacaaagataaaaagcttgactttacaagaataataaaagccggtggaaatgatattaatgattatttatataatctatatcatagaaattttgaagagtgcgaaaattttaaaattaatggaattgatttattaaatttaaatagtcaggaaaatgattcagcaagggaaattgcagatgaatggattgataaaatagaaaagataatccaattttatagaaataaaaatatgaataccaatttagaaaaaataataatttttggtggatgttcaaagttaaaaggttttgataaatatatgagtgagaaaattggaatacagacaagaagaattaaagaagtatccaaaatgacatttaaatctaatgatgatggtgaacctattgatgattttataaatgttattggaagtgttataagactttagaggggagctgataaaaatgaaagatttgaatttttttgcaccctatcagggaaagaaaaaagaaaagactagtactaatatgtatatatatggtgcagctggattagtgggatttgccattttaagtacattaatatttaatagtgctaagttatttcttttaaatagggaaataagcaacttcacagaaaaattaggagattctgaaatacaaactgaacttaaagaggcaaatagtataaacaatcagattgaagtgctgactcaatatgatacagccttatctgatgtggctaaaagtataaaaaacagaaacaatgtttcggatgaattattaaataaaataaattcaacaataccaagtgaaattacatttaaaaatttagtggttgcaaataatacattatctattcagggaacagcatcaaatagaacaagtattgctgaattagaacataacttgaaacagcttaccataatggatgatacttatgtgaactcgataaaaaacgcaggtgctgtagagggggaatactcctttgatataaaatgtgtgttaaaggatgttgattaattatgaatattagcaatagagaaaaaataatgctatttatattaggaattatattaataggaattggttattacaattttgtttatactcctatgattaataaagtagaagttaaaaaacaggaaaaaacacaaaaagaagaggaatacaatcagaccatggcaactattaatgcattagaagatagaaaaggtgatattaaaatattaaaatcaaaaatatcagactgtgcagctaaattttatcctacaataagccaggagcatataattttagaactagataagttattaaatgatagtagtcttaagggtggtataacttttgaacctatagcatcatcaactgttgaagaagttacaaaggaacgagttgatattaaagaaagttctcttcaaaagtttgtagacaattatgatagtgtagatggaaaagaaaatagtcaagatagtacaaaaaataaagatagtaatatagaaaaaaattcaaatgtagaagagaaaacttcagaaaataatataaatcagaatagtgaagcaaatgtagaagagaaaaaagaaaatacaattcaatatataaaatgtgtagtaaattttgatggaacttataaatcacttgatacttttttaaataagataggtaacaatgaaaagaaaattgttgtaaactcaattaatataactcaaaaatcattagatggagtaagtggtacacttggccttgaaatatatgctgtaccaagaatagatgatgaacttgaaaattacttgaaatggatattaaataacacatatggaaaagaaattccattttcaccaggagcagcgacaggagcagttaaaagtgaagcagatacaagtgattttgttatctctgcgaattcaataaattctgatctaccaacagttgttatggggaaatctaatgatgatggcagaataacttatgtatatgcagacaaaaattcagcagaaagtattcaaattgaattaaatcagcatggtgataaatactattataaatataaaacttcaagaggaacatacccaaatgattatagtggagaaggagcacagtttgcgccggaatcatcctcaagtatctctctggatgtattcagtgaaaagagagtaaattctgatgataaatctggagttaatattaaggttataaataatacagacaagctttttaatataaatattagtggagatgatacaactaatccaagagtgacggttgatggagacagtagtaagataagcgttaataaaaagtaggtgttattatgagaaaaatatcccaaaagcataaaggatttacacttcttgaagtaataataagcatggctttaattggaattctttctattggtgtttacaatgcttatttaatgcttataaggcacacaaaagatggggaaataaaacaggaaactgctcttattggtaagaagattgttgaagaagtaaaaagtggacaaagaagttctgataatacaaaaatttattttgataaagatggaaatgttataacaaatgaatcagaagcactttatgtagctgagattacaagaaatcataagaatactgaaactggagaaaatattaccattaacaatggagagtataaaaatagaatatttgtaggagaaaatagattatcatatacagaaagtgatgttaaaactgattcgttaattaatgaaagcaaaaaaataatagtgtatataaatgattctggaacagcaggaaatataaaattttacaacgatacttcaagcgaaatttcaattagagatatgaattatgttgcattagattttaaatattatggaattgcagagagtatagtggttgaagttgaaaatgcatctaaaaaacagttaaatctatatattctaaatagcattaaaaaatcagatggagattggaatgtagatatagacaacaaactcggtgttttaactgaatgtcgtagaagtgataatgatggaaaatcaggtacgctttatgatgtgaaggttacagtctcaggaaaaaacagcaaaggaataaatgaagataaattgtttgaaacaggttttgttgaaaatgtaaacacaccatagtatgaacggagatgattgtatgagaattaaaagaaaaagaaaaggttcaagtttaatatttgtggttattatgtttatgtttgttattattgtttcaagtgctatgctgtccatggttagtagtaactatgctggaagagtcactgaaagtaagcgagtaaagaatttgtatggagcggaaagtggacttgatattgcttataatgtaatcgccaagactatagataatgctaatgagtatagttataataaaacagaaatttttaaagatgaagttaaaaatatgaattatactgaatttttaaatgttaaagatgagaatagtgatgaaaaaataaaaaataaagcacgtctttatgcattatatgcagatatagattacttgcaattaaatgaagatagcaacaaaagtaaaatagaagaagataataaaaagatagatcaactaattaactatgtgtttaggatttattttaaggattatattaatgcaaatctatatagtaatatatgtccggaaggggaaaactcaggtaaaggaaaatatgctctagatggaagaaaaactagtaatgacgaaaataatttgcaagaagtaatctacaataatgctagaataagttttaaacttgaaagtcttgatgaaaacagtcaattaaaatggagtgaaaaagactcaaaagtaatttctggagataatctagtaacaaaatattattttgattatgaagataaaattcgtaaagaaacctatgatttaaattttaattattatgaaaaaattactttgcctattaatttgatatctaattttaaagaacagagtaatgtaggagaaaatgaaagagaaatagaatctgtatatactatgatagtacctaattatgatgaagtagcttttaaaaaaagtgtatctaccaatgatatacctggacttacagttggcggaacattgagtgtaaatgcagctgatttagatgtttatggagatatattggttgaaagtaatggaagtgatgtatcaacatttgaaaataaatataattcaggaatagttattaatggtgatataatgtcaaattcacttagtactgttaattttaataacaatgtttattgtagaaaaacatttaatgttcaaaataatgtaatagtaaatatgaataaagatttatatgctcaaaatatttatgtaaatacaagcaaacaaaatactggaacctatatagggataaataatgatgataactcaaaagttgtattggataatgatttagaaatgaatgctaaaaatacagtcgttaatatgaaaaatttttatggagtaaatgataagacaatagataatgcttcaggaaaagatgaaaaagcaaaaaaatcaagcagcataataattaataactgtgatgacaatagaaacagctttttgacaatagaaaatgaagcttatattaatggtgtggcaaatataaagacagaaaatggatatcaaacaggtgaatctgttgctgtaaaaggaaattatgatgcttattctatgccggtagagaatgatgataaatttaaaaatgatgcaccacttaaagtattagatacagatgatattaataaaaaaatagatcatttccataaatattggatttctaatttagataaaggattggattatggaggtgttatttttaatagcataaaggataataataaagtgaagtcaattggggatatcgtttatggagaaaaagtagatggtgttttaaaagcacaagtacaaaaggcaaattatataaaaggtgatgcgcaggttaatggaaaaataaataatttaaagaaaaattacgcaatcaatatgtataatttaaatatagaaaataaaaaagataaaaattatgttgaagatattaatgatagtacatttgaaaaaatacagaatgtaatagtaacaaaagaaaatcatgatgatgtggatacagatggatttaaatataaaaatgaagattatataatatattcttctgtaaattcaaataaatttaagggagtaatggttgtaaatggtgatttgacaataagtacagattatgaaatagaaggtgatttgattgtttccggaaatctaactgttaaagatggtgctaaagttacgttaaaatataacaaagattatacaaaaaacattcaaaataaaaacttgactatttttaatcaaatcttccctaatatggggtatggatatagtgaggaatcaagtggttctgatggttttacgacagaatctaattcaacaatatttataaaaaataatttatggaaaattaataaataggaatgaagaggaagtggaaatgagaaaaaaaacaggctttactttaattgaaatgatcattgtaatggggatgacagttttaataatgggaattgcattatctgtttttatgacgggaaacaaggtattttctgaatcagatattaaaaccactcttcaaatggaagctaaagatattcaagaaaatataagtgaaatatgtatgaattcaagcaagataatattatgtgaaatagatagtgataatgtgactgaagaaccttataacggagaaattatgtcaaataaattcataagcatttcaggtgacgaaacacgagataagaaatggcttcaagtatcaaaattaagtttagaatcgctgactaaaaatagtgatgttaatagttacaacaatatcactaatttagaaaatgttaatatatcatatgatgagaatacaaaaatattaaacataggctctaaaaagacagttgttgatgttaagcatttctatgttcaaccattaaatttgaatgataacaataataaaatttctaattcgaaaggattgaaatttaacattattttagagaaaaataaatctggaaaaactatagaatatactattgattttactgttacttttaggaatatatgataaattcaaaatggggggtgaaagcatgttttcaaaagtaaagttaaaatttagtttatttgctctctctattttttgtatgtgtattttaagtaatatatttacagataatgagaaggtgtcagcaatgtctagtatagatggtagtaatattaaagtaagtctttctagcaatacagatgttacagtaaaagaaggtgaatctacaaatataaaatatagtgtaaaaccacaagaatatacaacaggtatagatgaagctgtatttttagtggatgtctctaacaatatgaaagacaaagataatgggactagaggaagagggcaatttgcacaaaatgtacctgtaaatattaatgaccttgttaataatagcgaaaaaaatctagggataagtatgaacattaagggaactgtaatagggtttgctgatgatgcatattcattgattaatcagaatttagacaaagatatgaataatgtacaaatgaggcaaagtaataatatagatggtatagcaaataatattattggaacaataaataatatgtcttcaaaagaaagaaatattaataatgcattggaaaaagctgatttgctatttcaagattcaaataataatacggaaaaaaaccggaataaggctattattataatatcaagtggaaaaataaataacataaattcatcaacaatgaacaaaataaagaatagtggatatagaattataattctagatgtaagtagcagtgatgacaattcaacagattcggaaagtgaaagtaatttgaaatctgtaattagtaatttatcaggagatgaaaattatttatttaaagaaattcatcctagtgatagtacaagtttatcaaaagatgataaagaaaaaattgctatgaacaagaatatatattttaaaattattcctaagtatactgactatgctgattcatcagtttggagacctgcattgcaatcagctatttatggaagtgttgggaataatgtatcagataattcttacaaagtagaaaatgctaaattaacatttgatttgggtggaaattttcaaataggtgatagagcattaattgaatataatggacaaaagaaatatgtcaatattaatacagtaggaaataataaaattaatatagatgtatcagaatttataacgtatataaaagatgcttatggatttaaacctacatatgataatattgttgtttcatttgatgttacagcaataggtgcaggtggaacctttggaaaagattctgatggaaaagacttaagtaaattttcatataaagaaagcttgggaaatgcagagataaatagggaatttcccttagaaacaccaatagtaagaattggaacaaacgataagcctcaaataagtataaaattagatagactaaaagttaataatgttgaaactaaaaattattcaaatttatgttctggtgatgaaattgaatttacctataaaataagcgcagaagatttacagatagaagatataaatgaagaagttaaaaaagatatagtattaattcttgatacttcaggaagtatgaattttaacttttataatgatagtattccatataatgaaagagataaaaggatatattcgttaaaacaatctgcaaaacaatttattaataaattcaataataaggataatattagaattggaattattccatattcatattattctggatatgcaaataatataaagcaacttacagaaataaatgataataataaaaagagttatgagaagtatatagataacataaaagtagaaggtgcgacaaatcaaggagatggtataagagaagctgggaaaatgcttcttaatacagatggaaattcaaaaaaatatgtcatactaattactgatggtgaagctacagcaattacaatagaaaaacctaacattattattaatgatagtgcttattattgggctaataatgtgttttcttttagaaatggtgacttggtgtcaaggcaatattggtatggtgcacgatatattgatgattattataatgatattgtttattttaataatggaagtagcttctatgttaatccaatatatgattttaataacgttcaaaatacaagatacgtagattttggggataatagattgaatgagataaaaattaaaaaggcaactgattatgcaacaaatataggacgaaaacttaaacaaagtattcctgaattaaaagtaatgactataggatgtgcattaaatgaaagtaccgtagatttagcaaaagaagtaaacaatagtatgaatggagattattttagtgcaaatgattcaaattctatggaaagtatatttgatgaactagcagattctatattatctgattatgacataaaaaatgttaaactaaattttaatataccagaacaatttgaattatctagtaatgattcaaatattattgatgttggttctagctatgagaaatcattacccaatataatttaccatttaaattatgataaaacaaagtatagtgcagatcctgtatattttactattaagttaaaagttaaaaataatagtaatgcagggaatgttaacttcggaaatgatagtcaggtttcttatgatagtatacttaacaatagattaagtaaagaattaccaatagataaacttagaataattaacaaaagatttccagatataaaagtggaactacaatctcctaaagatgtaaattatgatggtaataatattgatattaaatataaaataaatgcagattcgttttcttatgaggatatatatggagaacttaatgctaaagatatatattgggttatagattctgatgctatgaaaaattttaatataggtaataatatttttaacaaaataataagtgatgacaaattaaaggcattaaaggcaagatattcattcataacatatggggatagtaatggagatgctgaaggtattaaatattataatggaacactagattttaggcggacagagaatgaaggtgtatatggagaatatattactaatttaataaattatgctagcagtcaaacatctgtcatgggtaagtatagtatagtgcctgctcttaataaagtaagacagattaatgctgagggaagatcagattctaatattactgaattaatagatcaaaatagaaaaaacacagtagacaagtatatagtaatagttggtaagaatagtatagacgatagtaatcaattaggtaatattgcaagacaattaaaagcagagggatataaaattataactttgaacttaggagatatacctatacgagataattggaaatatcaaggtggatatacaaatagtcaggaaggacttattgatgctaataataatctaaaagatgttcattgcaaattaagtgatataataatgccaggcaatgaaactttagacgagaaaaaagacgataattattttttgaagattaattatgacaaattcaatgaaactaaaaaaaatgagagtcaaatgaatcaattttggaatcaacaggataatttttctactaattggttaaacaatcaaatatcgccggaaatagcaaacaaatttattggctcaataactgatgagtttaaaataaataatatgaaattttcatttgatttgcaaaataaatgtatattaaatggtaagtcatatactttgaatggcataaatgatattcctaataatgataacaatgtgattgaattccaaatacctggaatttcatataaatttaattctagtacaggtgaatatgaaaatatatcgttcaataaaagtaatgaaccaattatgaccttaaatataagacctaattataatataatagaagattttacatttagtaataatgaagcattttttagatataatgatattttttattcaaaagaagaatctataaagctagaaactccaaatataagatttaataaaaataaggaacgtccagatttgttttaggtgactgtcacctaccgaaatatgtcgagaataaaatctgtataagttgacaataattatagaaaaaacttatataggagaaagaatgtgagtagaacaagtagaaaatggtgtccgaattcaactatgcatataactataagaggtaatagaaaatacactatttttagagaggacttagactatgtaaattatatgaatattcttagagagtcgctagataagtattcaaatgagtttgaaattattagctatgtgttaatgacaaatcatatacatttacagattgaaacgaaggaaaggcatattggaatattcatgcagagattaaatggattgtacgcaaaatattttaataataaatataattatgtgggacatctttttcaagaacgatatctgtctaaaataattgatagtagttcctatatgattgaattaagtaaatacattcaccttaatccagttagagcaaaaattgtagaaaatccggcagattatttatggagtagttataatgtttatatggataaaagaaaagataatataatacatcgtgaaaagatattatctttttttgaaaatgacaatgcaagtgaacattataaaaaatatgtggagaatttaatagaaaattaaaaaaagagctgttacaaaagggttaaacatactaaataagtagtttaaattcctaatgcaacagttccttttaattagacatttttcggtaggtgacagtcaccattagttaaaagcattgtatatagcagcaatacctttttcgaaattatcattttctattccaactaaaatattcatttcacttgaaccttggtcaatcattcgtatattaacatcagcttgtgaaagtgcagcaaatatttttgcagcagttcctctttgtttagccataccacgtccaactgttgcaatcattgccattcctggatgtacttcaattgtatcaggattacaagttcttttaatttcttcaacaacatgctgagttttattctttaattgtgaatcagaaattacaagacaaacagtatctattcctgatggcatgttctcaaaagagatattattttgttctaatactgataaaagctttctacagaatcctaattctgagttcatagatgcttttgttattgaaataacagtaaagtcttttttaccagcaataccagttattatagttggattatctgagcagtcagaattttgtactataaatgttccagaatcctgaggcttgtttgtatttttaatatttataggaataccagtttttcttacagggaatattgcatcttcatgtaaaactgaagctcccatataagataattctctaagttccgaataagtaattctacttattggctttggattatctataattcttggatctgccattaaaaatcctgaaacatctgtccagttttcataaagatctgcagctatacttgcagaaactaaagcaccagttacatctgaaccacctcttgaaaatgtaacgatgttaccatctttatctgcaccatagaaaccaggaattacagcgtttgaaacttttgaaagtttttctcttaaagcttcgtctgttgcaattgcatctaatgaaccatcagcattaaatacaattacatccttagcatcaacgaactcaaatcctaaatagttagctaaaattaatccgttcaaaaattctccacgacttgctgcataatctttagatgcaccagcttcaagatcttttttgataatttctaagtattcgttaatattaaaatctagattcaaatcattgataattcctaaatatctttcttttattaaattaaaaacatcatctaaagatattccaacagaaatgtgtgattggcaaagatataaaaggtcagttacttttgaatctttagagtgtctttttcctggtgctgaaggtaccacatatcttcttccagcatcagcgtttattatttcttttacctttttgaattgattagcgtcagccagtgagctgccaccaaattttgttacgattgtcttcatatttatagcccccaatatttatatgtatttataatttttacataataaattgtagcaatttatctaataatgttcaagaaaattattaataataattgattattaataatttcataaagaacatttaggtgatttgattaattatagtgaagatagattgattttaaagattttaattaaaaattaaaaataatatataatgaagattatatgaaattcatttcaaaaataatttgttatatataatgtaaaaatttcaaattatattattgaaaagtatgttggttattgtttatgttatggaattatagtatatggataattatattatataaaagggtaattataacttaagaatataggaaaattattcattgataacattttcatgtaaaaaagcttacaaaaagtattgacttgaaataaatagcaatatataatgaaaacataaattaaataagtttgacgacgaagtcatagaagtattaactttctatgacttcgttttttattatccaaaataattttctgcagaatttataggagatagtaattaatttgtaattattattaaataatggacaagggctgtttttaactacttaatgtaataaattcttaaaaataggaattaaagtatatttggcttgttgtacatttaatagaggaggatattaatatggatacaaatatggctatagatactctttgggtattacttggggggattttagtattttggatgcaagcaggttttgcaatggttgaaacgggttttactcgttcaaagaatgctggtaacattataatgaaaaacttaatggactttgctttaggatcacttatatattggattataggttttggtttaatgtttggaaaagatgcagcaggaataattggtattccaggattttttacagatggaactgctgaaaatgcagctacttcagttaataattatgcatttttatttttccagacagtgttctgtgcaacagcagcaacaatagtttctggagctatggcagaaagaactaaatttatttcttattgtatatatagtgcaatcatcagtgcagttatatacccaattgcaggtcactggatatggggtggcggctggttagcgcagttaggattccatgattttgcaggatcaacagcagttcactctattggtggatggtgtgcattagttggagcaacaatacttggacctagaattggtaaatattctaaagatggtaaatcaaatgcaattccaggacacagtttaacacttggtgcacttggagtattcatcctttggatgggctggtttgggtttaacccaggttcaagccttggtattacaggtgaaggtgcattagaattaagttctagagtatttattacaacaaacttagcagcagcagcggcagcaacagtaacaatggttcttacatgggttaaatatggaaagccagatgtaagtatgtctttaaatggtgttcttgcaggattggttgctattacagcaggatgtgatgttgtttcacctcttggagcagcaattataggtgttatttcagcatttgcaatggtatatggaattgaatttgttgataaggtattaaaagttgatgatccagtcggtgcagttggtgttcactgtattaacggtgttgttggaacaattttaactggtgtatttgctatggatggtggattattctatggtggaggcttcaaattccttggagttcaatgcttaggtgttgcagcagtagcaatttggtctgtggctacagcaacaatcttatttaaaggaattaaagcaacaattggtttaagggtaacaagagaagaagaaattagaggtcttgatatagaagaacatggacttgaaagcagttatgcagatttccaaagtgtagatataaacatgtaatcagttaacaagtagcagttaacaagtaacagttaactttttagtttgaatatttgaaagaaatttttgagaatatgaagtaataagatattatgcaagaatataaaccaataactgttaactgaaaactgttaactgtcaactgaaaagaggggggttttaaaaatggcagatagtataagtaaaatagaaataattacaagaaagagcaattttgatgaattaaagacagcacttaatgaaataggtattatgggaatgactgtaactcaagtattaggatgtggaactcaaaaaggtgatatacaatattatagaggtgttccaatggaattaaagttattacctaaaattaaaattgaaatcattgtctgtgaagtaccagttcaaaaggttattgatgttgcaactaaaatattaagaactggagaaattggagacggtaagatatttgtttatgatgttaaagatgtagttaaaataagaacaggagcaacaggtaaggaagctttaattaatgaataatagataataatgcttttattaatacaaatagatatttggtcagaatttagaatttaaggattctgattaaatatctatttttttatacttaaatttatggtaatataaaaactaataatttcatataaataacataaaaagcatagaaaattaagcaccaaatattaatgcgttgaatataatgaattgaagaagttatttttaaaacgactttaataaattaagtattttcaaattataattatttttattaagaaaaatatataaaaaatatatttttttaaataaagtgttgatttacaacaaaaaatactatataatttgaatataagatatgaattgagcaagggcgttcaatagatggttaaaacctatctattgtgcgtctttttttagtaagaaaaagggggaattttcaatggcaaaatatacaaaggaagatatcttaaaattagtagaggaaaatggagttagatttataagacttcaatttacagatatcttcggagcattaaaaaatgtagcaataacagaaaagcaattagaaaaagctttagacaatcaaatgatgtttgacggatcttctattgatggatttgttagaatagaagaatcagacatgtacttaagaccaaatttagatacttttgtaatattcccatggagaccacaacaaggtaaagtagcaagattaatttgtgatatttacagacctgatggaacaccatttgaaggagatcctagatatgcattaagaagagctattgatgatgcagcagaattaggatttgaaatgaatgttggaccagaatgtgaatttttcttattcgaaacagatgaaaatggtcaggcaacaactataactcaagataaggctggatactttgatttagctccaacagataaaggcgaaaatgcaagaagagatatgactttagcattagaggaaatggaatttgaaattgaagcatctcaccatgaagttgctgaaggacaaaatgaaattgactttaaatacggaccagcattagaaacagctgataaaattatgacattcaaattagttgttaaagcaattgctcaaagacacggtctacatgcttcttttatgccaaaaccaatatttgggataaatggttctggaatgcacgtaaatatgtcattatttaaagatggtaaaaatgcttttgcagatccaagtgataaaaatggattaagtaaagaagcttaccaatttatagctggattattaaagaacataaaaggattatcagctgttactaatccattagttaactcttataagagattagtaccaggatatgaagctccagtttatttagcttggtcttgcagtaatagaacagcattaattagagtaccagcttcaaggggggcagggactagagtagaacttagatgtccagatccaagtgcaaacccatacttagtgttagcagtgttattacaagcaggtttagatggaattaagaataatttagaagttgaaccagaaacagttgctaatatctttgcaatgagtgataaggaaagagaagatgctggaatagataatttaccaaacaatttatatgaagcagttaatttcatgaaagaaagtgaattagctaaagctgccttaggtgaacatatttatgaaaattacgtggaagctaaagaagctgaatgggatgattatagaactaaagtacatgattgggaaattgagaactatttaaatagatattaatctagtagctctgattatcatttaaggtggggattgcaatgatgcaaaaaggaaaaattattatagcagtaggtaatattgaaacagcaacaaaattaaaaaccctattaactcaagagggatatgatattatagccctttgcacatcaggcaatgaattaattagattagttatgcaatattcccctgaccttgtcttagttggatataaatttaaggatatgagtctactagatgcttatgaaaatctagtggactataccagttttttagctcttgttaatgaaccttataggtcatatatagaagaagacacagatatatactgtatgggaactaagatttctagtgttcttttaacaaatgcaatagatttaattttccaaagtaaaaggagaattaagaagttaaaacaaaaagttgaaaagctggaacatacgcttgaagacagaaagcttattgaaaaagcgaaaggacaattgatgtcaacgtctggacttacagaaaatgaagcttttagatatatgcaaaaaataagcatggattcagggagacgaatgaaggatattgctagtttaatattacaagaacttgaataaaatcaaagaaatatggtagactaaattctaacatatttctttaaaataatagatttaagttttggtaataaataatacgagtaaatgaattgcaaatattaatttactcgttacttactacatataaaatagattattaaaaattaagtattaaaaattaagtattaaaattttacatgttaaaagttatggtaatgttgcttcctctttttagtaggggctaacagtagcataagattaacaatatattataaattcaggggggaaattagatggaaaataattatccaaatgcacaaggattatataatccattttttgaacatgatgcatgtggtattgggactatagttaacattgatggtgaaaagtctcatgaaattctatcagattgtttaacaatattagaaaaattaaagcacagaggtggaactggtgctgatgaaaatacaggagatggagcaggggtattatttaatatacctcatgaattcttcaaagaagaattaggctctaaaggagaaggtctaggtgatgagggagattatgcagtggcaatgttattcttacctcaagaagaaaaggcaagaaaagaagctgtaagtctttttgaagatatatgtaaagaagaaaaccttggacttataggatggagagaagtaccaactaatccatcaatacttggaaaggcatctttagaagctatgccatatattatgcaagcttttgtaaagagacctaatggtacaaaaagaggaagagattttgaaagaaaattatatattgtaagaagaaatattgaaaaaagagctggatggataagcaaatttttaaatgaaactttctatatagcatctttttcatcaaagacaattgtgtataaaggtatgcttttatcaacacaacttagagaattctatagagatcttgatgatgaaagattagaaacttcacttgcattagttcactcaagatatagtactaatacattcccaagctgggaaagagctcatccaaacagatttatgattcataatggtgaaataaatacattaagaggaaatgtaaacaagatttactcaagagaaacaaatgttaaatcaagagtacttggtaaagatttaaatagagtacttcctataataaataaggaaggatcagactcagcaatttttgataataatcttgaattcttatatatgaatggtatggatctaactagagctgttatgatggcgattccagaaccatggtataagagcaagactatgagtaaagaaaaaagagatttttatgaatataatgctacactaatggaaccatgggatggaccagcatctattgtatttacagatggtgaaaaagttggtgcagttttagatagaaatggattaagaccttcaagatattatattactaaggatagaagacttattctttcttcagaagttggtgcattagatataccagctgaaatagttgaaaagaaagatagattaatgccaggaagaatgcttttagttgatactgctaaaaaggaagttataagtgatgaagaattaaagaatgcttatgctaacgaaaatgcatatggtgaatggcttgaagaaaatcttgtgacattagataagatgaaggaaagcaaaaagcttaagatagaatatgataaggaaacaagaagaagacttgaaaaaacttttggatatacatacgaagaagttaagtcaactatgcttccaatggctgaaactggagcagaaccattagcagctatgggtgttgatactccaattgcagtattatctaagcaagcacaacctttatttaactactttaagcaattatttgcacaagtaacaaatccaccaatagatgcaataagagaagaaatagtaacagcatcaaatgtttatcttggaccagaaggaaatattttagaagataagccttcaaactgtgaacttattaaacttgattcaccaattataaataatgatgaattagcaaaaattaaagcatataataaaggaaacttaaaatcaaaagttattgatatagtatatgacaaaggaacatctttagaagatgcattagatgaattatttgaaaaatctcaagatgcatatataaaaggatatactattttaatattatcagacagaaatgtttcagcaaataaaattccaattcctgcattacttgctgtttcagcacttcatcaatatatggttcaaaaaggaacaagaacttcagttggattaattcttgaaagtggagaaccaagagaggtacatcattttgcaactttacttggatttggtgcatcagctattaatccatatatggcttatgaaacaataagaggattaatggaagatgaattattagaaggaattgactacgataaggctgtttataactataataaagcagtacttaaaggaataactaagattctttctaaaatgggtatttcgactattcaatcataccaaggcgctcagatatttgaagctataggtataagaaaagaagttatagatagatacttcactaatactgtaagcagaattgaaggtattggattagatgaaattcaaaaggaagctgaaatcagacatgaaaatgcatttaaagaaaaaacttattcggcagatttttctttagatacacctggatatgaaaaattaagaagtggtaacaatggtcaggaagagcatttatataatccattaactattcataaattacaagagtctacatggactaataattatgaattatttaaggaatacacacagttaatagataatgaagaggctgaaataaatttaagaggtttattagaatttaactatagttctaatgaaattccactagaagaagttgaatcagttgatgaaattgttaagagatttaagactggagctatgtcttatggatcaatttcaaaagaagctcatgaagctttagccattgcaatgaatagaattggtggtaaatctaacactggtgaaggtggagaagatagagaaagatggaacctagatgaaaatggagatagcagaagatcttcaatcaaacaggttgcatcaggaagatttggtgttacttcagaatacttagttaatgctgatgaacttcaaatcaaattagcacaaggtgcaaaaccaggtgaaggtggtcagcttccaggaggaaaggtttatccttggattgcaaaaacaagacattcaactactggtgtgggacttatatcaccaccaccacatcatgatatttactctatagaggacttagctcaattaatctatgatttaaagaatgctaatacaggtgcaagagtttctgttaaattagtgtctgaatgtggagtaggtactgttgcagctggtgttgcaaaaggtggagctgaagtaatattaatttcaggttatgatggaggaactggtgcatcacctagaaactcaatcaaaaatgcaggacttccttgggaattaggtcttgctgaagcacatcaaactttacttcttaatgaattaagagaaagagtaagagtagaagttgatggtaagcttatgagtggtagagatgttgcaattgcagcacttcttggagcagaagaatttggattcgcaactgcaccattagtaacacttggatgtgtaatgatgagagtatgtaacttagatacatgtccagttggtgtagctactcaaaatgaagagttaagaaagagatttaaaggaaaaccagaatacgtagttaactttatgtattttattgcacaggaacttagagaaatcatggctaaacttggatttagaaaaattgatgaaatgattggtagagtagatagacttaagcaaaaagaaaatattcatggctggaaggctaaaaatattgatttaagttctgtactttatactccagataaatatagaggaaaagttgttaaatttaatccagaaaagaaatatgattttaaattacagtcagtaattgatgaaaaaatattcttagataagtttaaagatgccattgaaaatggtcaaaagacaagtatggaagttgatataactaatacagacagaacacttggaactatacttggttcagaagtaacaagagtaaatggacataagggattaccagaagacactataacaattaagtgtaatggttcagctggtcaaagttttgcatcatttgtaccaaatggtttaacatttgaagtagaaggagatgctaatgactactttggtaagggattatcaggtggtaaattagtagtatatccaccaaagaaatcatcatttattgcagatcaaaatatattaattggtaatgttgcattatatggagctacatcaggaaaagtatttataaatggtattgcaggagaaagattctgtgtaagaaattctggtgcaactgctgttgttgaaggtgttggagcccatggatgtgaatatatgactggaggaaaagttgttgttttaggtaaaacaggaatcaactttgcagctggtatgagtggtggagttgcttatctttataaagaagatgaaaacttcagaatcaatataaatgaagatatggttcttttagaagaattaaacttagatgatgaaaagattcttaaagatttaattgaagaacatgtaaatactacaggttcaccaaaaggtaacaagatactatttaactttgaaacagaaaaatctaattttattaagataatacctagtgattataaaaaggtaatagaaactgttgaaaaatacaagaatcttggatgtgacgaagatgaagcgttaattaaaacattccaagaagttaaaggtaagtaggaggcttgtgaaatatgggaaaaccaactggatttttagaatatgaaagaaaagtaggaaaagatagagatataaaagaaagattaaatgactatgatgaattccatacaagactcactttagaagaacaacaaattcaaggtgcaagatgtatggattgtggagttcctttctgtcaatcaggagttattatttcaggaatggttacaggttgtccgttgcacaacctgattcctgaatggaatgatcttgtttatagaggaaaatggaaattagcttatgaaagacttcataaaacaagtccattccctgaatttacaagcagagtatgtccatcgccatgtcaatcagcatgtacatgtggtataaatgggccttctgtaagtataaaggaaaatgaaagagcaataatagatactgcttttgaaactggaattgtaaaggctaatcctccagcaaaaagaactggaaaaactgtagcagtgattggatcaggtcctgcaggacttgcagttgctgacaagttaaatagatgtggtcataaagttactgtttttgaaagaagcgacagaccaggtggattattaatgtatggtataccaaacatgaagcttgataaggaagttgttttaagaagaattcatcttatggctgaagaaggaattaaatttgtatgtaatgcaaatgttggtgagaattacgatgcacaaagaatttgtgatgaatatgatgctgtagtacttgcaacaggagcatctcagcctagagatcttgtgtgtgaaggcagagaaggggttaagggaatacattttgcagtagatttccttaaagcaagtacaaagagcctattagattctaatttaaaagataagaattatataagtgctgaaggtaagaatgtaatagtaattggtggtggtgatacaggtacagactgtgttgcaacatctttaagacatggatgtgaatcattagttcaatttgaaataatgggagaaccatctaaaaaccgtagtgcaaataatccatggccagaatggccaaaggttcttaaggttgattatggccaaaaagaatttatagaattatttggtagagatccgagagaatatttaacaaccgttacaaaagtaaatgctgacaaagatggaaatgttgaaagtgttgatactgtaaaagttgaatggaagaaagatgaaaatggaagatttgctcctattccagttgaaggatcagaaaagaattacaaagctgatttaatattattagctatgggattcacaggttctgaagattacctaaaaaatgcatttgctgttgaaagtgatgctagaagtaatgttcagacaaaagaaggttcatataagacaaacgttccaaaaatatttactactggagatgcaagaagcggtcaatcattagtagtaagagcaatagctgatggaatagaagcaggagaagctgttgataaattcttaagaagttaaatctaatatattaaaaaatatataaaataatcggaaacactagaaatgtatgtactacattttgaagtttccgattatttttaattgttattgtgtaaggatctaatcgatattattttttagtaacagtgatattatcaatatcgtaatatccccaatcattttggagtttaattttattatctcctgaatttaaagatatctcatcaaggtatccatcgataaatttagttgattgttttaatagtttatctccgtggtcagagttatttacaataagttttgtatatttgtcaccgtattgtgatgcatactgtacatttaagtaataagtccctgaagaaggaacgtttacatttaattcgatataatcactattattatcaaaaccagtaacatatccacttccagagtatccagaacgttcagttgatttttgaacaccatttaaatatccatcttcagcttcaacagttattttatttccagatgttccttgatcacttccacctgttgaaccattaaacactgaacatatttttgaagtattttttattccgtttttataatttaataatttattaccccattcagttaatgagtttccagaccagtcatttgcaatatcaagatatatccagtcagtaccatttccataccaagaccatcctatataacctactgatttttcttggcagtaattcataatagtttcctcatcaacatcgccattagtatgtcttattccgaattcaccaatacataatgctagattttgattaataacactatcgatattagtttttacagtatttgcatctccaccagcatattcatacatatgaattgaaaacattgtatttttatctggatcagaattaaatacagctttaccataatcagctattgattttggatactgaccccatccagcagaatcaaccataatagtattatcaatacctgctgctcttaatttaggaattgctttttcatatccttccgcccatttttgaccatcccaagtgccgtaccattcatttacaatatttaatattacagttgattcttttccttttaatgcatctttcatacttatccaataatttacggcattatcaagctttgaataatcatcagagcctgtagcatcatggacttctaaaactgctactagattatttttctcacaaagtgaaatgatattttttacagtattaatatcatcatatccccattgatcgccatcacctaaagcgactcttacagtatttgcacctgtctttgctatagcaggaattgcagtagattcttgacctttataccaggcgtgtgcatgatttattcctctcattacaaattctttaccatttgcatcatacaatttagtaccacttacctgaaaaccattacttgaagcggcatacgctgtaattggcataggcatcataaaagcaatagtttgtgccattactattgctccagctattagggcttttttaaaggttttgaaaattttacacatttattaatcccccttttttgatttttttatatttacttttgtgtattgaagagatgatgtaagctaataaacttatctttagcatttatgataaaacataaattttattgagtttttataatttttactcctccttttgtaacttattggttaaaaattatgttaatatcatcatgataaggttatcataaatttttggagaaattttaataaaaactatttttagtaataaatgttaatttttcttagattttgtttataaaacttttaatttaataattatatatgaatctacaggaataaagtataaaaattataattttataatacataacttagaataaaatttgtgtaaagtaaaattttgagatctaattaaatagcgaaacatttgtaattatcaatataatataaaaagaaatgtataaaaatagaaacatgttttacacattgtaaatttagatatgttaaggtataatataagaaaaaatagtagacattgaggatgagtgtatgaatagatatatatatataattggaacagtatgtgttttatttgtagtagcaactttgtttattaagcttcttccatttctaattgttgctggaattataatttatgcagtggttaagcttaaaggaaaaattgaaggcgaaaaaagagatgaagatgtaaatagaaatatatataacagtaatagcagtacaaatagtaatgcacaagatgtatatacttcttcagatgattacactaacggagaaattatagatgttgattatgaagatgttgataataagtagatagataaatggaaataacagaattggttgaattactgattctgttatttttattattattttataagattaatgataaaatatataataaaaataatataagatttaatccattgagaaataataacatatttaaataaaaacatagggagaaatgctatatgaattttagaaaattaaaaatattttatgaaacagctacagaacttaatatgacaaaagttgcaaaaaagctttatataagtcagccatctataagccaggctattcatgaaatagaggaagaacttgatgttaaattgtttgatagaataggtaaaaaattattcctaactcaagaaggagaagtttatttaagttatgttagaagaatcctgaatttatatgaagagggattaaaaacagtaagtgatatgagcaaaaatgaaaagggaaaaataaaaataggagcaagtacaactattggcatatatattttaccagatataattaaaggatttttacaagaacataaaggtatcgaggtatcattgagtgttgctaatacagaaaaaatagaaaagatgatacttgaaaacgaaattgactttgcttacatagaaggtagatgttcttatgaagaaataattaaagaagagatgtgggaagatgaacttatattcatatgcagcctgtcacactcatggaatagaaaagagaatttagaagatggagatatagcaaaggaaaagttaataatgagagaaggtggaagcggaacaagagaagttgtagaaagtttttttgaaaataataatattgaatataatgtatttatggaacttggaaatacagaagctattaagaaaagtgttgaagcgaatttaggtgtaagttgtctttctaaaagaagtgtaatagaaaaaattgaaaatggaagtttgagtggctttagaattaaagataaaaaaataaagagaatgcttagtcttatttatcataaagataaatttttaagcaacaatataaaaatgttcatagattattcaagaaaattctagttgaagtatagaagtttatatagtattgatttaaaaatttacaataaaaatttttaagaactttataaagagataggattaataaatatttaatataaataaaaaacaatcataactaaatagttatagattatataaataactagtatttcacttattaatattttgagattataattatttttgtattaagagtagaactcagcaaaaaggaaaaaaataatataaagctgatgaaaatatttactatgaaaatacaaaaagatttaagaggtgatatactattatgaaaaaaataaaagatataatacctggtttcattattgcagtatttgtagctttgattgggaaattcttaggtactcttgtacctagtctaggggcatcaagtttttcaattattgcaggtattatactaggaaatactatatttaataaatcaaaatacaataaaggattcaatttttcggaaaaagatttactttcatattcaattgttcttatgggagctacaattaattttatgcaaattgctacattgggatttaatggtgtattatttattgctatgcaaatgacattaacaatattaattacatatttcataggaaagaaaatgggtttttctcagaagtattctttattaatgtgttcaggaaatgctgtatgtggttcttcagcagttgctgcaacagcaccatgcatatatgcaagtgataaggataaagctatttcagttactatcgttaatttgacagggacaatattaatgtttgtccttcctatgattgctgcacttttatataagaattcattaacagaaacttctgctatgattggagggattcttcaatctgtaggacaggtaattgcgtcagctaaatttattaatgaagatgtagttacaatggcaacaatatttaaaattataagaataatatttttagtgtttgttgtaatgggattttcaagaataaatataaaacatgaagaacatattcctaaagaagaaataatagaaagagaaaagaagtcgcatgtaagcataccatggtatataataggattctttatattatgtattgcaaatagttttggattaatacctgtaagtattcagcatggatttaaaataataagcagcaattttgaaataatagcattagctgcaattggtttaaaagttaaattctctgatttagttaaagaaggacctagatctttagcatatgggcttttagtaggaacatgtcagataataatagcggtaacattaataaaaatatttttatagttaagactaggatatatagtattgcacagtattatatatcctatttttgtgctttatatatttagcataaaaattgaaaaaaatacaatcataatgtataattaacagtgttaattacagttaaataagcaatttaagggggcaattataaaatggaaaaaataaagatgtcaactccattagtagaacttgatggagatgaaatgactagaatagtatgggcaagtataaaagaagaattattaaatccttttattgatttaaaaacagaatattatgatcttggtttagaatatagaaatgaaacaaatgatcaggtaactgtagattcagctaatgcaataaagaaatatggagtaggtgtaaagtgtgcaacaataactcctaatgcttcaagagttgaagaatataatttgaaaggaatgtggaaaagtcctaatggaacaataagggctattttagatggtactgtatttagagcaccaattatagttggaccagttaaaccatatgttagaagctggaagaaaccaataacaatagctagacatgcttatggtgatatatataaagcttcagaaatgaagatagaaggaaaaggaaagtgtgagcttgtatttacttctgaaaatggagaagttcaaagagaattagtacataactttgatagtagtggcgttgttatgggaatgcacaatataaataaatctattgaaagttttgcaagaagctgttttaattatgctttagatttaaaacaagatttatggtttggtgctaaagataccatttctaaaaaatatgaccatacatttaaagatgtatttgaagaaatctttgaaaatgaatataaagaaaaatttgaaaagtgtggtatagcatataaatatacattaatagatgcagcagtagcaaatgttattaagtcagaaggtggaatgctttgggcttgcaagaactatgatggtgatgttatgagtgacatgatagcagcggcctttggttcaattgcaatgatgacatcagtcttagtttcaccagatggaaaatatgaatttgaagctgcacatggtacagttcaagatcaatattactgtcatttaaaaggtgagaaaacatctacaaactcagttgcaacaatatttgcttggactggagctttaagaaaaagaggcgaattagattgtaatgatgaattagtcaattttgctaataaattagaaaaagcatgtttaaagacaattgataaaggaataatgacaggtgatttagctgtacttgcagtacatgataatattcaaaaagctgatacctttgaatttataaaagaaataagaaaaacactagaagaaatattataatatataagctgtaattatgatgctttcatcagacattacagcttatttatttgtttggtcatatttataattctatattccaattaaatcatatggtttaaagagctgcaaataagtttttggttaatttaattcctaatgataaacatttaaattaataaaaatacttgcaatttatgaaaaatttgtgtaaaatagatgatgtcgaaagacaagagaatattaccgtgtagttcaatggtagaacgacagattctggttctgtatgttgtgagttcgagtcttaccacggtagccattctttttctaatactaacagattgttgttagtattttttttgtcctaaattattaactaagttatatggataattatatcaatgattttattgatgtaaaatgaaaacaaaacatattacttttattaaaaatatagtgtgtttttaatatgtcattaatagacttttatagagtgataagatataataaaaacacaataagaacattcacataacattatatgtgtacgtttaaattcctatagaaggaattggggagggttttaatatgaagatgacaggaacagttaattatgaggttgaagatgttttcaatcattttataagaaatgcaaaaagagattttagtgattttaatgaagaaaatccagttggatgtaaagttgaaaaagatataactacaggaggcccaaagccaataaaatgtactgttgaaataacagattacgaaaaaaataaaaaatatgagataacaacttctaacgaatactcaacatgtatatcaacatatacgtttttaggtcaacaagatggaactactagattgaccatttcagaaaagcagacaacacagaaatttattcaactcacaactttatattttcaaagatttttagcgagacgtgcatttaaaaattcatttaaaaatatcattgatgttttgaataatgaacttcgaatacattttgaaaatcttgaaagatcaaagaaaaaacacagttaggattttataaataaatttaaaaagaaagaacaatgtagttttattttattaaggctacattgttctttttgtaaaaagaaatattatatgttaatggctaaactgtaattttggcctttaataaaattcctattaagcccagtttccatctttaaatattgatatttttgttccatcttcttttacaccaactatatttgtatccttagttcctatcataaagtctacatgagtcaatgaaaagttcgcttttgcttctaaaagctgctctttattcatgttttcaccattcttaatacatgaaggataagaagaaccaagtgctaaatgacatgatgcattttcatcgtataatgtgttaaagaatataatattggaattagaaattggagagtcataaggtactaatgcaacttcaccaagtcgacatgaattttcatcagttttaataatttctttaaggacatcaagtcctgtttcagcactacagtctataacttttccatctttaaaagttatggaaaaattgtttataagattaccacagtagcttaaaggttttgaactgtatacagtaccattgacaccatctagtttaggtgttgtaaatacttcttcagtaggcatatttgcaataaattctacaccatttttagtagtatctttaccaccacaccatatatgattttttacaagttcaacttttaaatctgtgccaagagaatttgtgaaatgtatatacttgaaagcatgattatttaattcaataagttttttgtttagattttctagatgattattccatgctttaacagggtcttcttcttttattctcataacagtaaaaattgcatcccataattgttcgatagcttcttttgaattagaatttttaaaaactttattagcccatccttcagtaggcactgaaactatacaccatgcattttcatttgagttacatgcttcatagtatcgttttaaagcttcacgacgacttttttgaactgtagctattttagaagcatcaatatcttttaaaagatctggatcagaagctgatatgcttaaaaatgaagcaccttgttcaacataatagttgtatttatctttttcaaattcaggtgtaaatgataacacttctgctgaagtgtattcatattttattttattaaatttctcatcattgtaattaattactacatcagaagcaccagccttatatgcttcttctgcaatcattcgtgcaaactcgctacattctatagggctgtttataacaagcattttatttttttgtatgtttatgccttttaatgctgcaagttttgcatattttgatagtaaatctttaaacattttattcacctcattattctattattgataatattattgcattaatcagaaatattatcaattgactgatataattaaagtataataattagtttataataatcaaggaataataaaaaaataaaactaataatacttttttcagataatggatgattaaatttgatataatagagtttataatgaataaagagaattaatatttatatgatagagaaaactattatatataattgttacgaaaaggaagatggaagaatggataaagaatacttattacttatagatggatcaagtttgcttagtacacaatattatggaaatttaccacgtgaaataatgtttgcaaagacaaatgaagaaagagaagctttttacgggaagataatgcaaacctctatggggatttatactaatgcaatatatggatttatgagaacttttttaaaaatattaagagagcaaaagcctacacatgttgctgttacatgggatttgagtagagatacattcagaagagaaatagatagtgattataagggaacaagaggggagacgccatctccacttaaagaacagttcaaattatgtcaggaaatcttagccaaaatgaatgttatgcaatttatggacagtaaatatgaagctgatgatttttgtggaagtatagcatctaagcttgaaagtgaaattccagtaagaatacttactaaggatacagattatttacagctggttagtgaaaatacaaaattatggctcatgtttacgactcaggagaaagcagatgatttatttaagaaatatgaaataaaaaagtcaacagctaatattccagataaagcttttgaacttacaccagaacttgttaaaagtgagtatggaattaaacctgaacaggttgcagatttaaaaagtcttgttggagataaatctgacaatataaaaggtgtggctggtgttggagaagcaagtgcagttccacttataaatgaatatggaactgttgaaaatttatatgaacatataagaaatcttgacaagaaacaagaaaaagaaataaaggattattggaagactaaattaggaataaaacgctcaccattaacatatttgctaaagacaagtgatactgaaattgtgggagaaaaatcagcaattataagcaaaaagctagcaataataaaaaaagatattgatcttggagagttaaatagggattctctaaaattaaatatagatatagaaaatggaaatgctgaatttaaaaagcttgaatttaaatctctaaatttaaaagatgcaatttctcatgagaatgaagacgaaaataatgaggaaaaacatgaatgtaatataaaaataaatagtatagataatatagaagaattttcagaacttatgaataaagtgaaagatagaatttatataagttatactttaaatgatagttctatttattcaaaacttgatcttaagcacataataattattagtgaagaagacataagtaatgttatagattttgaaaaaatttctagagaagataatataaaatcaatagagcttttgaaaaatattatggaaaatgataaagtaaaaaaggtaatacatgatggaaaaaatcttgttacttttctaaataagaataacataacagtgaaagaatttgattttgatacagctatagcagcatatttattagattcagctcaaagtaagtataatttaacagagttaatcgaaaaatatttaaataaagaaattgatggcattgagtcagaaaatgaaggtattcttggatcatatatacctaaattatatatgatcttaaaatcaaatatagaaaaagaaaagatggataaactttattatgaggttgagcacccattaatatttgtattatcatctatggaaagtataggttttaatattaaccaaagtatgcttgatgaacttaaaataaaatttgatagtgaaattcaaagaactcaaaaagaaatatatgaacttgctgacgaagaatttaatgttagctcacctaagcaacttggtaaaattttatttgaaaagcttgatcttccaatcataaaaaagactaagacaggatattcaactaatcaagaagtattagaaaaacttttggataaacatgaaataataccaaagataatgtattacagacagataaccaaaataagttcaacatatgttgaaggtttaaaaaatgttattgatgaagatggaagaatacattctaattttaatcagactgtaactacaacaggaaggttatcaagtacagatcctaatcttcagaacataccaataaggcatgagcttggaagagagataagaaaggtgtttataccattacaagaaggtgacactctagtttcatgtgattattctcaaatagaattaagggttttagcccatattgcaggtgatgaaaacatgattgatgcatttaagcatcatagtgatatacatacaaagacagcatcggaagtattcaaagtacctgttgaagatgtaacatctcttatgagaagtagagctaaagctgttaattttggaatagtatatgggattagtgcatttagtttatcacaggatttaaagattccaaaagcagaggcacaagagtatatgaatatatattttgaaagatatcctaaaataaagagttacttagaaaacatagtaagtgaagctgaagaaaaaggatatgttttaactatattaaacagaagaagattcataccagaaataaatgcatcaaataagattgttaaagcattaggtgaaagactagcgatgaatgcgccaatccaaggaagtgcagcagatataataaaaatagcaatgattaatgtttataataaattgaaagaaagtaagatgcagagtaaattaatacttcaagttcacgatgaacttattttgaatgtaaaggaaaatgaatttgaagaagttaaaaaaatagtagtagatgaaatggaaaatgcaattaagctaagtgttggacttgatgttgatataaactcaggaaagacatggtatgaagctaaatagtaacaaatgtataattgatgattaacaatttacaattaaggaaaaatagcaaagctataaaaatcatattaaaaaaatatgatttcattccttaattgttaattgtccattaaggagtaaaaaaggtggtatagaaatgattaaaattggacttacagggggcattggtactggtaaaagtacagtatcaaaaatactttcagctgaaggatttaggattatagatgctgatttagtatcaagggatgttcttgagaagaatcctagaatacttgatattatacgaacacagtttggttcgggttttttcgactggagaggcgaattcagaagaaaagaatttggaaatcatatatttagatttccaaagcagagaattaaatatgagggaataataattccttatataaaagaagaaatagaaactgaatttgaaagatatgagaaaaaaggtgaaaagatagtgattcttgatgcacctactctaatagaaaataacttgcatttagagatggattatgtaatactcgttgtagcagacaattcggttcagatacagaggataataagcagagataagcttacaaagtcggatgcagtaagcagaattaattcccaaatgcctgttgagcagaaaaaagagtttgcaaatatattaatagataataatggcgatttaatagatacacagaaacaggtatatgatttaatcgattttataaaattaataagctagataaggagaaaataatgaaattcctaagatatgttttttgtttactaataattttattagctgtcgtagttggatctaggtatgttgtgaaagaaaagtttttcccttataaatatcaggaatatgttgatatgtacagtaaagaatataatttagatcctctatttgtattatcggtaatgaaaacagagagtaaatttgatgataatgctcattcacataaaaatgcagtaggacttatgcagataacagtagagactggtgaatgggcagctaatgaaatgggatatacaactttttcaaaagatgatttatatgatgaacagtataacattagaatgggatgctggtatctgagatggcttggtgacatgtttgataatgacagagatcttatggttgcagcatataatgcaggtccaactaatgtacaaaactggcttaaagataagaattattcaagtaatgggaaaaatattgaatacataccttttggagaaacaaaaaagtatgtggataaggtaaatacgtattatagcgtttatgaatatctttatagtgaagatgaaagtatttttgatgtaaacaaaatattagatttaataaaaagtatttggaatgttcatttttttgtataaaatgtataatataattgtgaaaggattaatcaaattgtattaattcttttacaatattgagaaaaagtacttgaaataattctaaatatggattattattaacttaacaaaaaaatatgcagatgtggtggaatcggcagacacgcaggtttaaggagcctgtgctttataggcgtacgggttcaagtcccgtcatctgcaccaatttaggggtttatctcccgattaacttgaataaagtacacaggtttttttgtagaaatacaaattgatttgtgtatttttttattgtttgggagtgatttttttgaaaagaaaaaagattgaaattaatacaaatgatatgacacttgatagagggtatgatgaatttataatgcattgcagagcaagaaatttaagagaaggtactataaaaagttatgatggtagaattaaaactatatataagtttatagatcctaagactcctatagaagatattactcaagagacagtcaataattttgttataggatgtaaaactaagcttgaaataagggatataactattaatagttatttaagatcactaaaaactattctttattattttatgaaaatgggatatatggagcaattccacatagctttaataaaatatgatgaacctatagttgaaacttatacagattcagaagtaaaaatgttgctaaaaagacccgataaaagcaaatgtacttttgttgaatttagagattggaccatatgcaacacgctttatgctacaggtatgagatgcagcaatatattaaatcttaagattaatgatattgactttgaaaacaatctgatttatttgaggactacaaaaactagaaaacctttgatattgccagtaacaagaacactgcaaggaatattaaaggaatacatatcaataagacatggtgaaaatgaggattatttattttgtactgcttatggagatagaatgacaagagatgctataagtggaactatgagaaaatataataattctagaggtgtaattactactggtatacatagatggagacatacatttgctaaacaatggatacttaatcatggtgatatattaaagctacaaaaaatacttaatcacaataatttagatatggttagaaattatgttaagatatttactaatgatctacaaaaagatatggaacaatttaatcctttagagtttattagaaaaaaatcaataaaaatgaaaaagtaaaataaagaagtaatcaaacatattaagttatgtaagattacttctttattattttataattatttgcaagttcgattactttaagtaaaaaatctttagtatctgtatcaagtatattaatattgtacttttcttcagttctttccaataggtagtctaaacttacattaaatctatcagctatcttgactagaacatttaaactaggttctacaccatcattttcatatccatttacacttgatctagatacatttatatattctgcaagctggtcctgtgtaattccttgttcttttctaagtaatttaattctttcccccaacaatgtaatacgctccttatattcttttaattataattatacaggagctattattatataatggctattaaacaaccattttagcttgtaaaagacgatattatagtcattataattgttgctatatacatactagttattttatatgaaattttactttttgaaatattcacaatcaatatctgcaaaaaatataaacaattctataggacaacatttaagttctttactcattttttttattacatccatagatggatgataattattaacttttctttccaatctacttacataacttttgtttttccttattcttcttgctaattccgattgacttagacctatttctcttcttttgcttcttatcattgatctcctccattgtcttatatagtcggaaagttgtgttatactcaacgatttagagtgtataataagtgtacagcaaggaacataatgtttacaatgtataaaaattaccaactcatacaaacaatattgcaaacacatgttctcatatggtataatttatttgaaattaagggagatgatagcaggtgaatgaagcacagcaatatctaaacgaaatactaaataaatataaaaaataaaggcaaaaccaatacggttaagcctttttattttgcaattttactctaatttctttttttaacattgtatcgatgatatcctttgtttcagaatccatattaccatctttatctatagaaccattatctatgaaaaaatttaacaattcatttaatgcatataaattatcgtaattatcaactccgtgaagccaccaatttatacttctaccactaagtttactaagagcatttaaaaattctgtattaggttgacgtttgccattaacaaccatacttacatatcctttgcttaatgacttatctttattaattatatctatttgttttacattattatctttcatataggctgtaagcctttctaaaaattccaataaaaacacctccaattagtattataaattaactattgttaaaaatcaacaattaaagtataaaaaagttaactattgagaactgaacaattaaaaagttatcatttgttaactaaaaactgagaaaaataaagaaaaaaatagtaaaatgaagaaatattcagataatttagtttaaaaggcttaaataaaagttcacatatgttaactttggtgagataatgatattacagacaagggaggtgaacaatatgccacttaatattgacaaattaaatgagctattagtagaaaaagaattaaattattcggatttagctgaaaaagctaatatttcaaaaactcaaatttctcgtatcgtgaataagaataatcccgaagtaagattaaaaactattagtgctctaagtaaggcattaggagtatcatacaaagaactttatatatcaaagtaaagaaggtgaagtcatgaatgaatcacaaaaatatttaaaagaaattattgaaaaattcaataaagaaaagaaagaagggaagtaatgaacaataaatttgtacaagcttcaatgataacagacagaagtaaacaagaacctaaaagattaagtagcagagaagtttatcaaatgatggatttaaaacaacattcagatttattaagaaaaattgatggaattaacaaagattttactcaaagcaaaattgcgttcagtaaatattggatagaaggaacttataaagatgttagtggtaaaaccaatagagaatttcaaatatcaaagaaaggttgtgagttcctagcacataagaccacaggaactaaaggaaacctatttacagataaatatatggatagatttgagggaatggaaaatgtaatacagaatagtttacctataggattagaaacaatgcaaggtatggctttcttatcagaaaacatggcagcaataggacagcatgtacaagtattaacacaatttactatgggacttaaagaatatgttcaggatagtataaaagctaaagataaacagattgatgatttagcagaacttgttggaataaggtcaaagaataaatgtgatttgatacagattgctaagaatatattagttagaaaatataacttaagtaggataaattcaagcatggaagtttataaaagagcaaaggcaaaaatatttaaagaatttaacgttactaagtgggaagacataccagcaactaaatataatgctgtacaagcatttatagaagagtgtctttaataagttaacataacaatttattggttaagctgtaggaaatacgcacaacccactacaggctaagagggagtaatagcgagatagtttattaataggaggaattaattatggcttttaaatggctaacatggttaaagggacaagttacaaaagaacaatttaaaacaattttagatgcaacagatcaagacattaaattcaataggcttgcatttggtaaaagaactaatcagatggagtatgtaaatatttgtagtagaacagcacagactgttataagagcaggtatttaaaatgattatttctaaaatagttgagatttcagacaatagagaaaaggctaaaaaaattgtctattggttacaaaagaatagagaagaagggaaagacttaagaagttttggagaaatactccaggaagaactagataaagtaaaagctacaaaggacaccggcaagtaatcctaagtagcataaataattgtacaagttaattataactcataggagggatttgtaaatgaataaagagttaaatattctacaggctattgaaatgccagtaggtacaatattcaaaggtataaatacttttaataaggaacgtgaagtagttataaaggaaaataagggtcgtaaaaaactatttgttataaataaaaatgtagaaccaaaggaaatcgagttaaatgactttactgcaaagtttaaattcataccaattcaaaagccagtttcatttatggaagcagtagaagcatcaaaagaaggtaaaagattaagagtagttcatgatgcgtattgtgaagctaaaggatttaaggaaataggaaaagtttttgaaatgataataagtgcaaataaaaactttggtgatgaaatagtaaataaagctattattgaaaatatttcaaatggtaaatggtatatagaggaggaataaaaacatggaaaatacattattaaatcaaaatttacaagaagaaagagctcaaggatttaaggttgaaaatttagaaagtgctacatggtgctttagaaagttaagagctatttcagataaagaaagagaaattcaagaagttgcagcaaaagaaattgaaagagttgaagcatggaaagaggatcaattaaaacagtataaagatgattctgaattctttgaaggttgcataagtgcttattttatagaagaaagagcaaaagataagaagtttaaattatctacaccttatgggaaagtatcagcaagaaagtctaataaatggatttatgaggatgaagaagctttaaagacttatgtaaaagaaaataatattgaagcaattagagttaaagaagaactagataagacaaatcttaagaagatttttaaaaatggagtcaatcaagaaacaggtgaggttttaccttatgtaaaaattgaagaaagcgaaactattactgttaaagctgagtaggtgatcttatggaatgggaattaggaagatgtgacgataaatattttctatttcttataaaagataaagaagttttaaatattgatattagcagaaaagaagctaaaagcattgaagaaaaatttaatattgaagcaatagaatatccattttaggaggaatttaaatgagtaaaataattggaatcatgggcgaaagtggagccggaaagacaacaagccttagaacactagacccaaagacaacttatgtaattgatgcagataagaaaggacttagttggaaggggtggaagcagcagtacaacatagaaaataagaactatattgcaatggatgaaccacttgccattagaagcttatgtaaaaatatcaatgataaggctaatcatattaaaactttagtgatagacacattgaatggtgccatggtagcagatgaaatgagaagaagtaaagacaaaggctttgataaatggcaggacttagcacagtgtatgtggggcgtaatagatgattgtcttaagtatagagaggacttaacagtaatttttatatgtcactctcaaacagatatgaatgatgcaggttatatgtggacaaggattaaaacaagtggtaagaagttggataagatttgcttagaaagtaagtttaatacagttctactggcaaaagtagttgatggaaaacacatatttgaaacacagagtaattttagtacagctaaatcacctttaggagcatttgaaactgaaactattgagaataacatggctgatgttttaaaggctttggaggagttttaaaatggaaacagttttaataagcgtaatggtatttgctggattattaataatattatacgcagctatgaatatataaataatttaataattgaaagtgaggataaataaatggcagatatacaaataacaaaggaaagagcagaaagcttaattgctacaattttagaaaagagagaggaaaataagaacactaaggcttatattactggagcaaaagaagaacttgaacaattcatgttgcaaaatgatttaactgaatacacttgtaaggctggtacagttaaaattgcagattcaattagagaaggattagttaaggaagaagttgaagcagcagtcacaaaagtaaatgcaaaagaaattgatcacattgaaatgaaagacctttataaggaaatagaagttcattcaattagtattaaagcagctaagggggataaataattatgattaaaccaaacgattttgagacagtacaaggatttacaggatttgaaccattagaagcaggtggacatatttgtagaattatgaatgttgaagaaactaaaacaaaaaatggtggtaaggatatgatagttatttatttagatacagataagtcagataaacaaccaaactactattcagaagcttatagaaatgataatagaaatcctaagaagtggaataacaatgcaatatgtagacaacttgtattagatgcagatggatttacaaatagagggtttaaaagttttattgattgtgtagaaggcagcaatcaaggttttaaagttgtatggggtgaaaagttctgcgaatgtttaaaaggaaagttagttggaggagtattcggaagagaagagtacttgaatgataatactggtgaaactaagtttgctactaaatttcaaaattttagaacagtagacatgattaaaaaaggtgttgaagttccaaaagataagttattaaatcctagtggaaataattcatatgctggagatattacacctgtagattatggtgattgtccattctaatgtaaaggagttaagcaaacatgagttgttcagttaaattaattaacttaaaacaagttataaaaagtaagggaatagatttcaaacaaatagcttttgctgcaggcgttgcacataatgttgcttcaagatatataaatggtcaaaaatgcagaatagaaaaagcaagaaagatttcagaatttgtaggtgtagatttaaatacacttacaggtaatactatttcagcacaaaagattaactatacaactccttgccataatcaaatttgccctttatgtaagaactgcatatgccacaatgatgtggttcttacaggcaaagcagattgtgtaagtaagaataaagttgcaaaaaagccattcaaaggtagaagtactaatgacaaaatactaatggcagataggagatagcaatgagatatcgttatacagataaggaaatgaagaagatattagacaatatggtagttatagttgattctcgtgagcagaacaaccaacatataattgaatttttcaataaaaagaatataccatataagactattaaaaatgattttggtgattatacagctatgttgccagctggaacacttacagggtttacaagtgatatttactttgacagagatatagcaatagaacgtaaaaactctattgatgaaatagcaggtaatcttaaggaagatgcagcaagaataaaaaaagaactggcacacatgaataagtatgatattaaatatttcttttttgtagaagataagaattttcatgagaatttaagaaatggaaattttagaagtcaatatgatccgttcacattgatgcagagaattaaaaaaggaattgaagctgaatacaataccgtaattgttccaatagataagaagtttataggttcggaaatttattacactctacagggatttgtatataacttatttaagcataaaggctttattttagaggaagaaggggaagaaattgattaataaagaaactgaaaagctgatttgcaagaaagcagttgataattatggagaacactcacaaatgattaaatgtgttgaggaatgtagcgaacttcaaagagcaataagtagaacaatacttgaccaacctatagggaatgtaaaaccaaaggataacttcaatgaagagttggcagatgtagaaataatgttacagcagatgaaaagtacaagttactttgataagaatttatttgagttttttaaggaagaaaaattaaaaagacttgaaggagttgtttggtgatgaaagattatcttaataaccaggaggttaaagaagcattaatactaacttattgcaaaatattagtacagcattttgtagatggtaaggtaatgactaaacaagaaaaaaccaaccttaagaagggtggcacatttattaaaaattcacttaaaagtatgatacaaagattaggagaaagtagtgctaaaaaatatgttagattatatgaaaattcaaggataacagtaatgaccaatagtgaacttgaagtattagctaagagaaaagatgcagaattaaatgcagcttatgaagattctaaagaatactttgacctagttgagttaacaatggattgtaattgcaaagattgttgtaaggactggaagcaatgtaatttatgtaatcactttgataacaatgagataattcctttttatgatggttatgaaagtgaagttgtaaaagatttaggaaattgtaaatatgcctataggggtgatgatgttgagaagaaacattaatgagattatagatgcagcagttgttaatacattaagcagattaagaaatgaagagccaaagcagaaagtagttaaaagaacaggaaataaaaaagcattacatcaaaagggttcaaataaggtaaagctatggacaagcaaatagaacttaagagattgatagcagactttaatgtagttgtaaataggcttaataaagctgataagtatttcaacaatgaatctgatagaaagtgtactgatgaagattttgagaaatttgagccaacttatacaagtttattaaagcaagctagtgaatttgcaaatagaatagaaaatttcataggcagaccacttacaacatatgaaagcctacatggaattaatatataaattaacctataggaggaggtacaattttggaagaaatatggagagacataaaaggatacgaaagtatatataaaataagcaatttaggaaaagttttaagcataaaaagacatggtactaaaggaggaattttaaagccagctaataatggaaatggatatttaatagttggtttatgcaaaaataaaaatgaaaaaacttttaaaatccatagattagtagcagaaacttttataccgaatcctaaaggttataaatgtgtaaatcacataaaagagtttgaaaaaacaaataattgtgtttctaatttagagtggtgtactaataaatacaatactaattatggaacatgcagagaaagaagtgaaaacaatcataaaaaagaagtttttcaatatgacaaaaatcttaatcttataaaaaaatggaattgcataaaagattgtgaaatagaaaattttgatacaagctcaataacaaaatgttgtaaaaataaaagaaaaactcataaaggttttatatggaagtatcacgaaataggaggtgtaaaaaatgaaagaattaaatgatattgatttaaaacaattaatagaagatgaaactggatataaatttaatcgtgaaggatatgtaaattgctgctttcacaatgaaaaaacaccttctatgagtgttaaattttttcctaatgctaataagcaaagatataagtgttgggggtgcgagtgccaaggagatgcaatagactttattgttaactataagaatatggattacaacgaagctagaaagtatttagacctagaggttgaaaaaaaccctacagaggactttgaagaaacaataagacaatttgtacgtaatcaagttgcaagaggaaataagcaaggttataagcctttaggaatatttacatttgttgatgaaaacaataagcctatttattcaaaggtgaaatttttaaagcctgatggtaaaaaagaaactccatattaccacatagaagaaggtcaagttataagaaatagaagtcatgaagaagtaccttataactactataacctactacaaggaattgctaataataagatagtggttattgttgaaggtgagaaagatgttaatacattaagacagatgttacctaaaaaccaatatgtagttacttcattaaaggattttaaagcttatgataagatcaagtctgaatttatgaaagtatatgtcattggagatactggaaaagctggacttaaatatgttgataacattaaatataatttcttaaatacctgtaagagttttaaaattattaatcttaaaggaatacaggctttaggtgataacaaagatgtaacagactggttagaagctgggtacaccaaagaagatttacttaattgctttgatagaagtcttgacttaaaggataagaaccaattacagcaagataaaaacggaatatattatcttaaatatattaagagcaaagaagattatgacagagaatatcttactaattttaatgtattagaagccagcaaggtaaataaaattgatgcagaagtacaaggaataagagtaaaattacaaagctgcattgatggaaaaatagttgaaaaaattggtggtagtaaaatatttgatgatataagagcctttagaaacttcctaggcatggacttctcttttacaggcaagaacaccaatgaagtggttaagctaaaggattggataaataagtactttgcactagataacaaagaaatataccaaggtgctaaattcctacctgtagatgataaatttgaacttattacagcgacaggaacacttaaagctgattctaaagattattcgattattgcagaccaaacaaaaatagacatgatggatattccagagataactacagaagaattgcaagaattaatgcagaatttatttggattttgtgagtatagtaaagcaatttcaattatcggaagtgtaataagcttcttggaggtaggacagaatattgcagctaatgaaaaattacatcatttgcttattgttggagaatccggatcaggaaaaagtacaattcttgaaagagtagttgctccacttcttaattaccctgtagaagaaaagaaagctatttctacaactacatttgctactcaaaagatactttctacaggaaattacccagttctatttgatgaattcaaaccatctatgatggaccaaaggaaaatacaaaagttaagcgatatgcttagaaatgcttatgataggacaactattaatagaggagataaaagctttgaaattaaagattttaagcttactagacctattgtaattgcgggtgaagaaagttatccaaatagtgaaaaagcacttgtaacaaggtcttgtatagtctacataagcaaacatgagagaagtgaagaaaatacagaatctatggtttggttgatggaacacgaagaactacttaaaaagttaggtaaaagtttaatactacaggctttaaaactcccattagaagaatataagagccttagatatgaattaagacaagtatttaagaatctgaaagatagaccacagaatacagctattaatattgctacaggaattgaattacttaataaggtacttattaaagctgatttgaaacctataggaaattactatagcagcattgaagcaaatatacgtgatgaagttcttgataatggagaagatgcttatagcgaagttgaaaagatgcttattatgtacaacaacatgatacaaaataataaccattttgtagatgatgatgcagttcaatttgctaaagatggtaaagactttggaaaacttttcataagaacacaacttatgatagatgcaatatttaaatattgtaatgaagttaaggaaattgatactaaaacattgttaactagtagagattttaaaaaacaagcaaagaaagctggttacattaaaggtgtaaatactaagcaattaagaattggagcatatcaaacatactcaggtaaaaatgcttggtttgatgaatatgacaaggacttgcttaagaaattaagaattgacagtattgttgactgtgatgactgggaagatgctgttagttttgcagaaggtcaattttagaggggcttaggctcctttaaatttaaatcttggaggaagatattatgaataaaataaataaggacattattgtaactgaaaagaaatatatagaagaattaagaaaacttcctaaaaatagcgatactgaatttgtttgtgagaaatgtggtgctttattaaaaataagagaagggcgaaaaaaatttttaggttgtggaaattttccaaaatgcaaaaatacgcattctttaatagttcaatttaaacctagttcaattcattctataagggcaaatgaaataatatctgaggttgggggttggaaatgtactagaagtagcacctgggtagtcggaggatacaacgaagacatgagaaagaccgattgcggttctaacaacaacacaatactgcctatattatgttctgatgatatattttaatttttaatatcataaaagattaaatagttcagaatatgcagaaagggtgaagtaaatggataattattttaacgatggatattggaaatgtaacagatgtgatacagtatttaaatcttattcattaggtgatacaaaggacgtaagtttttgttcgtattgtggaaattcagaaataataccttgtgatgaagatggaaatgaagattaatactgcacaatacttataaatcacgaaaaagaaggtgatatattgataatcaaaaatgaaaaatgcattggttctaatagggaatgtaactgtgtaagtacctgtagatatctattagatagatttggtgtatttgaatgtgaaaataatgagtttaagagattaacaattgaagcaggatatgaacatgaactacaagaaagatccaagcttgaaacttggtctgagagaaaagattatttagtaaaggagacaaagtaatggaatttataagtgtagaagaatttttggaacaagatgaaaaagtacaaaaagcatttttggattggtggagaccatcaaaaggtgatttagtaagtcatattgataatgcaaatgacaataacttaaatataacaattattgtagattatttttcatatggtgaaaactggaaaaaatatcccataaaaggatataacatagaaactaatgtaacaatggatatttcgaaaaattttattccattactaacggaaggacaattgagaagatatattgaggataaaacaaactgccatattgaaataattgtaggcattagtggatatgtttttgtattacgctccaaagaaacattaaaagaagagaaaagaatatcggttttaaaacgtgatttattacaagcctattggaaagtagcaattcagattgcagaacagttgtagttaaaattgattttaaaggctcatacagaggattaaattattaatgataaattacattacataatgtttaatcgttctgtatgaagctaataaaaaggaaataggaggtattaaatgagtattgatatgttagaagtaaaaaaggacaggctaaaagaagttaagaaacaaatagttaagtacagtaagaagaaaaactggtcaatggtttatcctttaatgaaagagcagagagaacttaaggaacaaattaaagagattcttgccaatagatttaaagtaagcaaatcctaacttgcctataggaaatcaataaatccattctgaaagtcattcgacataatttattaaaactattttaatttaatcataatgcaaatattaaacaaaatatgttataaaatcattgcattaactagacaagtcataccaacgctttacagattcgacaaaaaacgaatgtttgcaaaatgtttgcattgattatcggcgtggttgagccattcgacactactatatatatactaataacatattattataaatatatattatatatatacatgaaagaaatatactatatattttatataatatagggcataggttcgcaaaaatatgttattttggtacaatatactttaaagctagttatatcaacggtttacagtgtcctaaaaactttgaaaaatatgttataaaatatgttatttttgttgcatgggaattgttatcaattaaaaacactaaaatatataaaaaataagacaaactatggaggaattatatgagcaaaaaattaaattgtgatgataaactttatagagcagttgaatctactctttataattataaaaatgtaaaggcacaaataaaaaatattgaacttgatatagaagaaaaacttaatagttattcaacattgaatgcagttcaatatgatagagatagtttgagtaagacttataaatttaattcggaagtagaaaataaagttatagaactagatattaatgatccagaacttaaaaataatattatgatgcttaaagttaaaaaaagaagtaaggaaatacaaatagaacgtattgataatatattaagtgttctacaggaagaagaatataagctaattgaattaagatattttaaaggtatgcaatttaaagatatagcagatgtattacttaaatcagatttatacttacagcaacttagaagaaagataataatagaaaagattattcctttatttaataattaaaatattaactaagtaaaaacatagataaaacgctgaaattacttagttttagcatattttataactatgttgtaaaggcttataatagtattgttgaaagagttaattaagagctcctaaacataattcttgccccttttaaattaccacctaatatatttgaagcagctaagtattaatttatttagctgctttttgttataagtgtatttaaaggcgattagagagtattttttcattaatgaataatttatcattaaatggattaagtcttgtctatgggacaaataagaataaaataatggcatatatgtgttgacattaaataaaacattctgccatactgacaattaattatttaagtaaagaaggtgataaacttgattgataaacagaaaagtgaagctattaattatttagttgaaggccttaaaactagggaagaaatagcaaaaataataggtgttggtgaaagaacattatatagatggttaaaggatactgaatttaaggctgagtgtcagaaacgtgcagagctttttgaaaatgatttattaagagaatcacaaagtcttcttaagcataagcttggcagtgctatagataatatcgttgagatagctaacaaccctaagataaaggaagagacacgcttaaaggctaatcagtacttggttgatagagtgcttggtaatactacaactaagatagagcagaacaataaaggagataataaagacaagcaaccagtagatatagataaggtgcttgaaaacattaaagaacagaccaaagataattaatatttatgcattaaataatactaatttaagtgttataaatatacaatttgttttgcgaaattataaaatcaacttaaagctagtcaataagccaaagttgtatttaaaccatttacactaaatttatgtttagcgaaataactttgtataatttaataaatgtattaatattttatgcatataatatacattgttgattagataggcgggtaggttctattttagaaaattggcaagccctagcgatggaccatataaaaattttttatattttttaaaacaaggcacttactaaatagtaggtgtttttattatgccagtagaaaggaagtgaggtaattgatttattatgacattttagagtttagcagtgatgttgaatatgaagtttatatattaaataagtatttaactaagcattatgatagtaaatcagctaaggaacttcttagaagctataatgataatttagatggacttgctaagagtcttggtcataaagatattggattctattgtgagtactttttaagagaaatatttgttccaagtgatgataatactgccagggaattatgcagcagccattatgaattatgggatatggctgataggatgcttatacaggatgaatttgacaaaaccaatatagtttgtcctagaggatttgcgaagactacaatatatgattttgcggttattagctggtgtatatgttacaaggaatctatatttactattcttatcggtaagaaagataaagatgcaactcaattcatggatgatatattgcagttatttgaaaaaaataagcgcattattgataacttcggtcagcttattgatagaaaaaagaatacagttaatgcaaatgagattgaattttctaatggatgcgatctgcaggctgtaggttctggtacttctattagaggtcgtaaatatggaaatgtcagaccaactttagtaattggtgatgatgctcaggatgataatgatgttcttactgctgaagctagacagaaaaaatatgatacttggtgtaaacaagttgaaaatgttggtgatactgcagtttatagaaaaggaaagaagattaaaaaggctacaaagatagtctctataggaacagtattacatttagagtgcttaattagtaggttgagtaaaaatcctgattataagactatattaaagcgtgcaattatattaaaagatggtcaaacagtagatgatatctttgaatctgatttatggcaacagtgtcatgacatatattttgatgaaaaattcaatgaaaatcaaagatatgaaaatgctaaaaagttttatttaaaccattatgatgaaatgcagtttcctgttttatggccagaaaaatgggattgttttgaagacttggctgttgattattggaagaatagaaaaacatttatgtctgaaaaaatgaatgatggcagttctataggtgaaaaatggtttaaatcaataaggactcaaataagtgaagaaattgaaaatcataggtttattaagactatgcttactgtggatcctgcatctactacaaaaaagaaatcagatagtactaatattatggtaggaagtaaggctgtcaatgattttacttatgtaagagatgtagttcacaaaaaaatgggattcaagcaatattgtgaaaaagttgttgagttgcttagaaagtatttagatataacacatataaatattgaaaaaaatacatttcaaggagcagatgttttaaaaattcaagaactaattaaagaagatcctattctgagacctaaaaaatatatttggattaatgaaatgcagaaaaaaaataaagatgaaaaaataagtactattactgattctgtaaataatggtgctattattatggtttctgataaagaagatagtaaaaaagctattgatgaaatattggagttccaaggacaaaaatatagtccacatgatgatgcccctgataatctttcagaattagaaaataaacttaaagaaataaaaccaaaggctagttttagtattatctacagatagaaaagaggtgagagtatggatttaaaagaaattgaatttttacaaaagtgttatgcagattatcttgtgaaactaggccactatgatgatattaatagatattattatggaaatacagatagtttagcagcttttgttcctagagaaggtagaagcaatcttaaagtaaatacaaattttatacagaaactagttgatgaagaagcacaatatagttttggaaatgatattacttatacaagtgttgaaggcaatgatcaagttgtaaaagatattaattaccatctaaagaataataaatctgatcatgatattaatttaggaattgaattgattaaatatgggatggtttttgaaattaattatcttgaagaatatgaagctgagaaatttaaatttaaaaataaaattgtaagtccacttgaaggatatatgtatttagaaaatgatattccaaagtattttttacatatgtttcataagcagcttgaaccagaaaagacttatattgatgtttatactgataaagctatatatcattttgatgaaacttggaaggaagtaagttctaagactgaacattattttggaatagttccagtaggtataggaataataggtggcaaggcatatagcattgatagaggttatgaagagggtgacaagactgtttataacactatcaagaatatacaggatgcacttgagacaaatttatctgacattgtaagtgaaatatcagattttagaaatgctattatgaaaatatatggtgttgaagctgaaaacgaaaaagataaagatggaaatgatattattgatgaatctacaggaaagcctaagaaaaaagagcctgtagtaagaaataattgtatattattgtttggagataagacaagtcaagatgcagaatggttaataaaaaatgtaaatgatacatttattaaaaatactcgtgatgatctattaaatttaatttatacacttacaagccatatagacaataatgaaaagatgcaaagtaatttatcaggaatggctttaagaagcaagctccagtgtcttgaagccaagtgtaaaatgaatgaaaaagctatgattaatattatatgcataaggatttcgtgtttatttaaatttttatttttaacacaaagtaagtcttatgatgttaatactataaagattcaatttacacctaatattcctgtagatgaaactggaatagctgatatgataagtaaattatctgcatctagtgtagttagtaaggaaactatgagaagttggttgcctagaattgaaaatccagttgcggaaggtgaaaaaataaaaaaagaattagaagacgaacttccaggtagcaatttatctaatattcaacatacaactgatcctataggtggtgatggtgatgagttatagtgaaaaagaagtaaaagagtttgttgaaaatctgtttaaaaatagcagcagtgaactaaaagacttatataaacaccaatattctattgaaagtggtattaaagatgagatacaaaacataatgtatatttatactatagaaaatgatgttatgaatatgagtagagctgaacaacaaaaggaaattaaaaagcttgataaaatgattgatgatttctataaagctgatgctgaaatgcaaatagaaatattatacaagttattggaaggaacaactactgaagtttttagattttatagttataatgctgataaaaaggagattactgatatagttaaacagacttataagggcagacacttttcagaaaatgtatggaatgatgaaactgaaactgctaagtatatgaaaaagcagttatttgattttattaaaggcaaagttaatgttaatcagattactaaaggtgtagaaaagttatttggtaatacacattatgaatctagaagattagcggaaacagaagtcgctagatgccaaagtgctgcttttgatagatttgctagtgaagtaggagttgaaaaagttaaatatcgtgcaacattatgtaatacatgtgacaaatgcaaggcagatgatggtaaggtttttgattttaataagaaaatcgagttgcctcgacattgtttttgccagtgctattatgatgtcgttgaataagaaagggtatggtgatctaattatttcgtacaagtctaacgttataggcttatttttattttaggaggaatttaaagatgaaatttgaagaagtattaccacaaattaaagaaggaaagaaagcatttagaactggttggaatggtaaaggaatgtttgttgtaagacaaaaaggatatcctcaaggtattccatgtaataagcaaactgctgaagtatggggattgaatgaaggagatttatttaagtgtgaaccatatttacaaattaagaatgctaatggaagtcatagtatgtgggttccaagtacaggagatatatttgctgaggactgggaggtaattagataatgaagtatagaaagaaaccagttgaaattgaagctttccaatatgatggagattttttaaatagagaaggaaatttttatattcccacatggggaattaaagcttatagagaagggatattattttttgatggtccaactcttaaagtaaaaactcttgagggggatatggttgcaagtgtgaatgattttataattcaaggggttaatggagaaatttatccatgtaagccagatatatttgagaaaacatatgaattagctgaataagtcttagaaataaggctttttattttgcctataggaggaaaagcaatgccaaggttaagaagaaaaatagatacaattaaagttaaagatggtaatattgcagatattataataaatgctttagccgaaagaggatttgatattgatgtaactaatgatgatagtaattttagaaataatattactatagatatttatagaactgaagaaagagaacaatctgatattgaaagacctaaatattattaattaactgactttaagcaatagtcattaaacaggcttattttttatgtgaaaatttatacttacagggacataggacttgtagggattggaggaatatatagaatgaaaaaagtagatttattaaaaataattgaaacaatagcagatgatggggacattaatgaaacaattctaggacatgaagaatttaaatcattaaaggacttatctaagctaagtgtagaagacattactggaatattaggtagtgaagttggaaaggcttatatgacttcacatgacgattcaattaggtcaaaagcagttgaaacatttaaaactggcaaaatgcaagatgaaattaaaaaagcaattgaagaagctaaaaacggaaagaaaagtcctgaagctgaagcacttgaaaaacttcaaaaggagtttgaagcgagtcaagctgaacttacaaaagaaagaactatgaacaaactttcagctactctaaaggaaaagaaattacctatagaacttgcaaattttgcttatggtgatggacaggaagaaacaattaataaaaatattgaaactttacaaaatgtattaaatagtgcagttgatagtggtgttaaggctaaattaggtataagtgcttatactccaccagcagatgcacaaacaaatgctgctaatgcagaaatagcccaagccatgggtgtacaataattaatttataaggagatgatattttatggcagtaaatacaattgcaacagctactttatttcaaaagaatttagataaggcagcagcacaacaagcacttacaggatggatggaaggtaatgcaggacaagtaatatatactggtggttcagaagttaaaattcctaaattagatatggatggtctagctgactatgatagaaataatgggtttacagatggcggaattcaatttgaatatgaaacaagaaaaatgaaacatgacagaggtagatcatttagctttgatgaactttatgttgatgaaacatcttttgttgttacagctgcaacaacaatgggagaattccaaaggttaaaagttgtaccagaaattgatgcaactagaattgcagaaattgcaactattgctatgggcgtggaaaatgatactcaagttgaatatggatatacaccagctaaaactactatagtagataaaataaaagctggtatccaaaaaattagagaagctcaatttactggtaatttaatttgttatgttacttatgatgttcaggctttagtatctcaatattatggtgaaaaattagcagctgctacatttgcagttaatggagttgatacaagagttccagcgattgatggagtgcctttagttccagtagtttcatcatgcatgtacacaaaattaaaattcaatgatggtaaaacttcaggacaagaaaaaggtggttatgaaaaagctactgatggattagatattaactttgaaattgtagctacggaagcacctattgcagtccaaaaaactgataatatgagaatatttagtcctgaaattaaccaaaaagctagagcatgggctatggattatagaaaattccatgatatatgggtacttgataataagaaaaaaggattatttgtaagtattaaagattctaagccagcagtatcagaaggctagaagtgaggtgatctagatggcttttactgaaagtgaattaaatgagatggcagtactagccatctttaattattatgatgaaaagtattctaaggaatatattagtgaaaacttcacattagcattaaaagtattaattgagaatgttagagcaagtgttacaaaacctataggcattaagagtgtatctcaaaatggtactagcgttacttataatgaaggtactggatttaatgcatatttgactacagaagtattatcattactccctaagaaaagtaattttaaagtatggtaggtgaacaggatggtattatttccaaacagtgatataacaatatatcacttagattctaaaacacaaaaatattctcgaattaatcttgaaaatgttaattggagtggtaaaagaaactctactgtaagtgataaaggtgttaatattgcatatacagtaatgataagtgccgaaataggcgattataaggtttatacaggtgataaggttgttaaaggtaatattacactagacataactagattaagcgatttaaatgcttatgaggttgttactgttattggtacacaagagagtgatttattccactctattaatattgaatgcaagtaggtgattttataggtgtaaaaattaagttagattctacaaataaaatacttgctaagagaagacttaatggtaaaggttctgaagcacagatattttttactaaacagtgtgcaaagtggatgaataattatgttcctttcaaaactggtagattaaaagacgtaagtgttactattggggctgattacgttaaatatagtactccatatgcaaagaaacaatattataaaaatactggtggaggtattaaaaatagaagtggcttgcgtggtaagttatgggataaaagaatgtggcctgataaaaagggtgtaattattaaaagtatggctgattttgttggaggtaggagtaaatgataattgaatcaataaaaaattatatatcaggttttgagtgtatgagcacttttgaaaatgctataaatgctaattatttggctggtgaagctgataattttagtattgaagagatgccttgcgaacctgtaattaaaaattatcttgatggttctactaaaagacaatttcagtttgctttttgtagcagagaaccttatggagttgaagtaatacaaaatattgataattcaggattttatgaggacttcagtaatgagattgaggataaaaatagtaaaggtattttacctataggtgatagtaatgttgaatctataagtataaaagttacaagtagtgcttatgtagtatctactgaagaagatacagcaatgtatcagataaatttagtatttaaatatttaaagaaaagaggatgataattaatgagtattcgacaaagaagaattgaagctgattatttaaaagttgctggtaaatttgaattaatgaatgttggctttgatgctattgatgaaaaaccaaatgcacaaacaagagaaaaaagatatgtgggtgattctagcagtacacaaagcataacttcatataaatggcaaagtgatttcagtggtgatcaaattgaaaatcaaaaggtaattgaatatttaacttctattggtaaagagttaaaaactggttctgatgctgaaacagaatatataaaagttgatatggataagaaaggtactgcagaacatagttattatgctagaaaatttaatgtggcagttagcattagcgattttcctaacaatgatggtgagcttggtttgagtggttcatttttaggcttaggagatccaattatagggacggtaactataaatccagcaacaaaggaaataacatttgaagaaggatttaatgaaaaaatgttagaagtttcatatactgctactggtacagtaagtgaaatttctattgatggtgtaacttatgacaacgtaaatcataaatttaaaaatattccagctaatactgaaaaatttacttttaaagatgatggaacttctaaaacagcaactcttggtagctcttggagtatagcttaatagtttgatattgaaaggtggtaatttaattgaagattaataatgtagaaatagaagatttagacttaatggatgctgatgtagcagagaaatttgaaaaagctactaatgatttgcaggaaaaagaaaaatcacaagatttcactggtaaaggtcttgcggaaattataagaattcaatgtacattaatttttgatttctttaatgatgtatggggagaaggtactgataaaaagatatttggaaataagacaaactatagaatttgtgaaaaggcttttaaagatgtagttgagtatgctatgaagcagaaaaatgaagtattaaaagtagctaaggttaaaaagaaataatgaatatcttaactaataagttacccgtagaagtgaatattgatggagttctgtataagattaattctgactacagaacttctattatttttagtaagttaattgaagataacgaggttactgaggacttgattttagaaattcttaatctttattatccagtaattccacaaaacattgagcaggctattgataaaataagctggttttatgaatgtggaaaatctaaagatgataattctaataactctacaggtagctataaaaaagtatttgattatgatgaagattcacagtatatttatagtgcatttttaagccagtatagaatagatttacaagaagttgaatatttacactggtggaaatttaaagccttatttgaagccttagacgataataacgagataataaaaataatgaagtatagaagcatagacttaagcaaaattcaagataaagaacaacgtaacttttataagaaaatgcaagaaaattataagcttaaagagaaagtgaatgaagcagatttacaggcattagatgaaatgagaaaacttctagtacaataatttgtataaatagtgtataatttaccaataaaagaaattattttgaggtggtaaattatgcaatgtccaaagtgtggaagtaataatgtaaatgtacaggcggtttcaattgttaaaaataaaaaacatggttgtttatactggttgattataggttggtggctagagatttttatgtggatttttttgacattgccatggttgattattaagatttttaaacctaataaaattaatacaaaagtaaaaagttatgccgtttgccaagaatgtggttataaatggaaggcataatttaaatacataattttagtaagcactttttaaagggtgcttatttttttgcatttttttatagaaaggagggttaatatggctgatggaagcattattattgatactaaaatagatggtagtggtgccgaaaaaggaataggatctcttgggaaattgggaaacatggcgggaaatgctttaggagttgctacaaaagcagcagcaggtatggcagtgggaattactgctgctacaggtgcagttgttgctttaactaaagctagtgttgaacagtatgcacaatatgaacaacttacaggtggagttgaaacgttatttaataaaacagaattaagccttgaagattttgcagctaaacaaggaaaaacaactcaggaagctttcgcagaatggggagaattaacagcaggttcaagaatagtatttaataatgcggaacaagcttataaaactgctggtttaagtgccaatgcctatatggaaactataacgggatttagtgcttcacttttacaaggacttggtggagacactaaaaaagctgctgatataggtaatatggcagttgttgatatgtctgataatgctaataaaatgggtacagctatggaaagtattcagaatgcatatcaaggatttgcaaagcaaaattatacaatgctagacaacttgaagcttggctatggtggtactaaaagtgaaatggaaaggcttttaacagatgctgaaaagataagtggagttcattatgatattagtaattttagtgatattatttctgcaatacatactattcaagagcagatgggaataacaggtactacagcaaaagaagctatgtctaccattgaaggtagtttaaacatgactaaagcagcatggactaatatgcttgctggtatggcagatgataatgcagattttgatacactagtaaataacttagttgaaagtttaagtgcattaggtgaaaatcttatgcctcgtataggcatagcattaaatggagtaggacaattaattgatgcattgttgcctatagttattgataaaatacctgaaataatacaaaattctttgcctagtatattagattctgctacaggaattgtatctgctttaggaagtgctgttcttgaatcattacctacacttactggattagctgtagaagtagttacaactttaattggaggattacaagagaatataccgtctattgctatttgtgctacagaagtagttgcaacattgctagatggaatattacaaatgttacctatgcttttagatgctggcttaaaagctataggttatttagtagaaggcataggacaacaattaccagaacttataccactagcggcagagtgtataattcaattagttcaagggctggttgataatgcaccacttatattaaatgcgggttttgatttattagataatttagcaacaggaatagtaaattcaataccaataattatagatgcccttccacaaatcatagatggtattttaaattatttttcaagttattctaacaactttttaactattggttttgatattattattcagttagtaaatggaattgtagatgctattccaaacttaattgcaatgttaccacagataatagatagcatgattaacttttttgtttctaatatgccacaaatagcacaaaatggtgtacaggttataataagcttgatacaaggtttaacagaagctttaccaactttaataagctatttaccacaaataataatggctattgcaactggtataataaataatttacctcaaattttagcggcaggcgtccaaattaatgttgcattggtaaatggaatgctatcggctattggtcaattgataggggcagttccaagtataataggcgctttagttagtgcgtttggtagtatgctaggacaatttgtttctataggtggaaatataattgctggtattggcagtggtatcttgaatggggtaactggtttggttggcactgcaattgaagcctgtaaaagcttaacagataaagttaaagacttctttggaatacattcaccttctcacttaatgagagatgaagttggagtaatgcttataaaaggtattgaagttggtatggaacaggaatctgataatttaataaatactgctactaatatatgtacacaacttacaaaccaatttggaaatatattaaatgaagaatctgctgaagatatggtaaatagatttaagtctgtaacaggagtattgggtagtcttacgaatgaattaaataatgctcaatcaagagttgactgggcaaaaggtcttactttagatgataataagtggtactatgatgcaaaaacaagacttgaagatgttaaatatcaattagaggaactaagtgatcagattagtgatacagaagataaaaatacaaagaaaaatttacaagaacagcagaaagctttacagaagaaacaaaagttaattcagaaggaatacgattattacaaagaagcagcacagaatgaaattaacgaaagaaaagaagctactaagaaagagttggaaatagcaaaagaaaaatattcaagactagaggatttatctaaagcgttaactacagctataaaagaacagttaaatcaacaaaaagatgctgctataagctctattgaatctgaaatggataaagctgaaaaagcatataataaagcttgtgatcttattgataaacagaccgataggaaaaaaacttcaattcaaaagaaaattgatgcattggatgaagaaaaagaagctgaaagcagattacaagaaattcaagaatctaataataatattgctattctacaggcaaaattaaataacacagcatctgaagctgataaaaaagctttagaattaaaaataaaaaattctaaagcagcattagaacagaagaaaaaggaatgggatagagaagatgaaaaagctgctttaaaggaacaacaggatgaattagaagaaaaagctaaaaagaaaaaggataatcttaaggcagattatgaagcaattaaagaaaattatgaaaatcaaaagaaagcagcagaagattattataataagttgttagaaacagatagtattaatgctcaggctcgatatatgattttaaccagaagtaatgatgaacttgtacagttattgcaatcctataatcctttatggcaagatgcaggacagtctcttgcagatagtcttataaatggtcttaatagtaaaaagcaagatatggcaagtgcagttgcagaaatgacttcttttagaaatggaataagtattgatggatatgaaactggtacagcttataataggattgcaggagcctatacagttgatgaaaaaggttttgaattatctacaaataataacccagttgcttatgtttctaaaggtgctggtattcttaatcatatgcaaagcttagcagcaattaaagaagaagttaaagcgcaggttggaacattaggtaataaactgaagagtgctgttatggcagaacaatacaaaatgggacaacttgcaatggcaactactaataatagttatggtggcaatgttgataatagcactagttatggaggacatcttcttaatgttgaacatatggaaattagaaatgaaagtgatatagaaagtttagcacacgaacttgaatcttataaacagaaaaagaaaagataggaggaaaaggaatgaataatactttaatatggaacaatgtaagagcagaagatatgggaattaaggttatttctttaccacctataggattaagtgtagaaaatctagaagaaaaagatcgtgtaggtgctgatggtactcttacatacaaatatggatatacaagcgatgaaaaagaagttgaagctgattatataggaaataatccaatgaaagttgctaactggcttaaaggaagtggaaaagttattttcggtaatcttccagatagatattacaaggctagaattaataatattatacctttagaagaagtaataaaaaatggtttatataattttactattaagttcaagtgccaaccttttggttatttacttgagggggaatatcctatagagataactaaaagcggtacggtattatgcaatctaaaagccacttataaaagcttgcctataattactgtctatggcactgggaggggcgttttaacagtaaattcgataaactatacatttacgaatataaatggttctataagcctagatagtgagatacaagaggtattaaataagcaaggtgaatattttgagagtgatgattttccagaattaaaagttggagaaaatacaataacttttagcggtggaataacaaaggtagttattatacctagatggaggtgtttatagttgaaaggtttaattagattatttgatagtaacgaaacaaattttaaacacaataaaaatgtacttagtgaatttacaagtgcttatattactgaggatattgacggaactttagagtttgacggtgaatatcctctttttgataagaagagtttaagcaaagaattaaatataggtaagattataaaaagtcccatttatgatagtcgaccagatcagctttttaaaataaggaaacctaatactagtacatctaataaaacagtaagtgtttatgcacaagctataggctatacagacttaggaagtaatattattctaggttgccatattccagctggtaagactcgtaaagaagctataggaatgttacttaatgcaagacaacagaaagtaagagattatcatgttggaaatttagatacatctacaaacactaatattaatttaggacttgaagaagaaacaggtaatgtaattaactacttagatatagattataaagcacctttaaaaggcttacttgatgattctgaaaatagtatttataaagcttataagggcgaaataatatggaacaactttgagattaacatggtagataaaagaggaaatgataataaatttactattagaagtggtaagaatctacaagattttgaaaaagaaatttcggatatgaatgatgactttgctacagctcttataatgtgttcgagtgatggtttatatcttcctaataatgaaataatttattctagcttggctgataaatatgatagatatcattacaaagttattaaatgtgatgatgtatcgcttgaggaccttataacagaaaattctactgatgctgatgttgaaaaagctaagcagatagtatatgaacagttaagagaaagagctgaaaattattttaaagaaggtatggcagaattacttggaagttatactataaattttattgaacttgctaaaagtgaagaatacaagaattatgtagaactaactaattgttctataggtaatgaagtaacaacgatttatcctgaattaaatctaaaagttaccactagagttactaaaattaaatacaatattctaaaggatgaaattgaagaaattacagttgggaatattaaaaaggatattaccgattctataaacaatactgaaaatactgctaatagtgcaaagcaagaagcaacagacacaaagttttcattaaagaaaaatactaaacaaatcaatgctaatattgatattctagataaaaagatacaattaaaaatcagctctgatgatatgtggtcacttatagaaatgtatcctgggaaaattttattagcagtaaatgatgaaaaaaataaaacagatgtaataatagatacaagcggactgagtgttcataatggaaaatttaaaatttacaatgaatctgatgaactatgtttttgggtttctaaaaacggacaactttttacaagtagaagtttagatatacagaatagttcaggtgacgatttaatgagcttaaatgatagtagattatatttttatacgtctaagggaatacgtggaatagaagcaaatacaaaaggaattgatgtaaaaggtaatctatatataaatggggagagtttagaatcaataattcaggaagtaataaataataagtaggaggtgagtgtaattgggattgactgattttaaggctttaaacatagatgttaaacaggatacttatatctaccctgttaaattaaagcagaatgatacaccaactcttaattttagtatctgggatgataatatagcagctgatttgacaggatatagatgtatattgaaagcaaataaaaacaatggaaaaggctatgagataagagatgccattattagtggtaataatgtaagagtagagtgtacaagtagtttatcgcagtttgcaggagaagtattatctgagttatgttttatagattccactaataataagcagaagacaagctttaatataattatagaggtacagaaacaagttctttccattaatgatagtggcgatattccagaatgtattattacatcccttgaacatttagatgaaagccttagcaaggtagaaagtgccatacaaaaagctgaagacgaaaacctaaaattaaataatacaataactacagctaataatactgattcaaatttgaataattctataaagacaggaaatgagattaaacttgaattagatgaatctattgcaaatggtaaaaaaacaatagaagatttgaaaaatgaaaataaaaaatatacagatcatataaatgatttagatattcatgttactcttgaagataaacaaaaatggaatagaattgatgaagttattaatcttattgatatattaactagcaatgttgctgttactgatgatgataatgaaaatgtcattgatgataatggtaacgtaataactatgtaaggagatgattaaatggcaaaactacctgattttataaccgcagaaaatgaattagatggacaagagcatgtttatattgctcaaggtggtaaaacacgaaaaacattattgcaaaaaatcaaagaatttgtaataggaacaaatacaatgggaacaactgcgacagatgttactggagctatagcagaacatacttcgcacttgaacgatattgtgaagtaccctaaaatgcaatatacaagtaatattacaacaacaattttaaaaagtgtacttgggggaagtgttaattggacttcacctcaatggaatgtaaaaaaatatgatacaaattattttatagagaatgataatactttaataacaataaagcaatcaggcttatatatgattaatttggcaatacatatacctgtaacaaatgcaaatgtttcaataaaattaataaaaaattatggagatacaggagcagaggaaattgcatatgaaaataaaggagcttcaaataattcaactagaataaatttatatactatttgttatataaatcaaaatgaaacattaaaagcattaatttatcatgaaggacaatctgatgttaatttagtatgtggatatggcttcccaatgataagtgtaactaaagttggtgaaataggatgaacttaaaagcaaaagaaagactatatactccaacacaaataactaaaataggagaaaattattttataattgattgttaccatcatagaattatatacacaaatgatttagaaaatagtatttcagaatggaaaacaatagattacgaatttagtggtgggcatagtataacaagtaatggagatatatatgtagctgaaagcactggaaagaatgaagtagttatatttgataacaatttacagtttaagcagaagtttttaaatataaattttagaccacataaaactatatatgataaagacactgatgctttttatgtaatatctagtggtacacaagaaatatactgttttaaggtagacgaaaataaaaaattatatattaactataccaaaaagttggattttctaaacgatgcttatacaagaggaataaaaattattgatggttatatgtactttttaagtagcataggatatataactgtagcagactataaaaacaattatacagttattaataattactcacttccggatgaacttttcagcttaaatgatatagaaaagattggtagttactattacatcacatctacacagaataaaaattgggaagtaatacctaaaataatacgtgttaaagatttgaacaatgcaaataactatgaggatttatatgatttgtttgggtttaaagcgactccttatttcatttcgagttttgatgataaatattttatgaccgaaataggaactcaatataatggtgtcaaaagtttcgagattaaggatgacaacataataaatataaaaaacatctattattttgatgaagtaatacaaaactctatagaaagaagagatacttatccattataaaattgcattaaatttctaattacagtataattatgttaaatgtcacaggaaaggaatatatcacaatgctaaaaagaccagaattatattagttgtaatacttattttttttattactcccacttacggttgtaatgctaaaacgtatagtaaatgggaagatacactatatactccaacacaaataactaaaataggagaaaaattattttataattgattgttatcataacagaattatttataataataatataaaagatgatatctctaaatggaagacacttacagataatattaatggaggacatagtattgctagtgatggtgagttatatgtacatgacgatactgaaaatagttcattgaaggtatttagaaaagaaaatgaaacatttgtccaaacacagattattgaagatgtatcgggaagaccacattatgtgttatatgataataaaacacaacgtttttatgtaataagttctgaagaaggtaagatatgggttctggaaaacaataatggaactataaaaattgataaaactataattattaacgacatatcaaattcgtacgttcgctcatttaacataatagatggttttttatatttaatatctggaaatggatatatatataaggtgaaatatgacgatatgagttttgatataattgataaatatgaagtacctaataaccttactggaatgaattttattactaaaatagaagattatttttatatatcgactacacaaaacagcgatggggaagtaataccagattttttaagagttaaagatttaaatgatttagctaaaggaaattatgaagacctataccaaaaattcaattttaaagcaactccatattttatttcaaattttgatgataaatattatataactgaaattggaatccaatataacggagttaagagttttgaggtaaaaataatgaaataacaaatataaaagatatttatcattaatagtgaaacaattaaaagagaatagaatttattttagcacatcttttggtgtgcttttattacacaataggaattaaatgcgaaataaaaattaaatactatacaagcaaagtaagagatctgtaaaggtcttttttctttgcttatttttatattaaaatatccaagcgtttggaaatatgaaaaggaaggtgacacatgaatgagcaggagactatacaagaaattaaagaaaggttagtgagaattgaaatactgttagaaaaaaatacagaaaactgggatgaaaaaattaaagtagcaaattacagaattgcagacttagaggatacaattaagtggatttctagaactgcaataggtggagtaataacaggattaataggcataatgtttgccttaataaaataatagaaatgaggaatgtaaaatggaaatgaatttaatggagtatgtgccaagtcacttagcaattttaattgcatgtatttatgttgtaggagtatttcttaagaatttaaatagtgtaccagataagtatattactataattcttatgctttttggaattacatttgctgtgttactaagtataataaatgctcaatataaagtagctttagatgtaattgttaatggcatattacaggggatatgctgttggggtatatctgtaggaattaaccagacagctaagcagctaactaaagaagaataatcatggcagccttatggctgtcttttatattttgaaaattaattaatgaaagaggatgttattaatgaagttaatatttagtgatggccatactccaagtggaactgctgggtgtggagctgttgatataatagatgaaagcatatgcacaagggaggttggtcctttatgtgttaaatatgcatctcaggaaggacataatgcatgcgaattagttgttaatcatgaaaattcatataattgtgaagattgttatacaagagtagatcaagcaaataatataggttctgatttgtttacagaaatacattttaattctggaagtggaaatcctagtggagttgaagttttagtaaacagtatgaatagtagtgctgttaaatatgctgaaagagtatgtgaaaaaatatcttctgcttttaatataccaaatagaggagttaaggttcaaagattaattgtcttaagtagaactaatatgccggctatgttagttgaatgccactttgtacaagaacatgatgggattctatatgatgctgataaacttgcaagatgtatagttggaggaatattaaataaagacatattatcaaattggaatttaggttggaatggtgtgctaggttcatggtggtactgtactagcgtagaagacaaaacatattataaatcagagtggaagttaatagataacaaatggtatctatttgattcagaaggatggtgcagggttggatgggttaagtatataactaattctaacaataaagttgtatggtattatttagattctgataattgtgatatggctattggatggcataagatagatggagactggttcttctttgataataatggtgaaatggctacaggctggattgttgacaatggaaaagactattatttatacagcacaggtcagatggctcacgactgcgaaatgtatggatataaatttgattcagaaggtattgctactaaaatagaataattagataatatgtaaggctagattgcacaatatagctttaacaccagtaaagacagcatgtaagattaatttcttatgtgctgtcttatttttttggttacaaaattaatgtaactcttataacttagattctaaaagcctttagaggtgttttaattaggttacacttttagaaatataatgtgcttaactttatagtacacgtatatatccttatatataatatatatattataatattatgtaactatgtaacttatatatataaaagctagtggcagagccatttatcaaggttacattttagttacaaattaggttacagttacataattaattatgagatattttttaaaaaactatggataagtacttagacctattggaaatagtgatctggagatggttttaatattatttattcaataaatcataaaatatttttagcatatccatcttattgttttgatttaactttcttctccagttctttcattgatttttctagtaattctgcccctaactgtttctctaaaatatcaatcataactgttcctaaacttcttttgtatagttctaaatcttctattgggtacactataccagtaatatgagttttgtttctttttcttttattcataagatcactccttaaaagtttttgccgtcaaaaattcgtcaaaaatttatttcaattggcttcaatttatatcattaaattaatttttaaattagacatagatatagatatatcaaggttttaataactttcttttaattttatacaataaaagatttatacgtgatagagagcatgacataataggggctaaagaaaataacataaaatctattggtgttctttatggatacggagatgttgtggaactaacacaagcacgagcttcctatgttgtggagacacctaagggtttgttagaaatattagtttaataaactttctgattttgattcggcaaaaattttagtagagagaatagaaattgatttaaaatagatgtatgtattttagtgtatacatctatttttatttgctataaaaaatagtgttactttgaaatgtgtgacaaagtcacaaaaaaatattaatactacatttataataatgttatacaatgataataaatgtagtggaggcaagtaagatgaataaattttataaaaaatatggatactttttattattattttttctaataatatccctatttgatatgcgttttgcaatagcagcaataatatgtatggcagcaccagtattgtttgcggtaataggaaaagggcgctattggtgtggaaattattgtccaaggggaaacttttatgataatatactaattaaaatttctcccaaaagaaaagttccaaaattttttaagaatactatatttagaatatttatggtattattcataataactaatttttctataggtgtatataagaatttgggaaatttatacggaataggatttgtgttttataaaataatagtaataacaacaatagtagctatggttttaggtgctatttataatgagcgaacatggtgcaatttctgtcccatggggacaatttcttatgctattgcaaaatatagaggaagaaaaacaaatttatatgtatcagatacttgtgtaggttgtaatttatgcagcaaacagtgtcctatgggaatatcaccaaaagaatataaagatggaaaggttacagattctgattgtatattatgtcagaaatgtgtttataaatgtcctaaaaattcaataataattaaaaaataaattataatactgttatagaaggagcatgtaattctgtaacagtattttatattatagttatagaaaagccaaagtaattttaaaatatgacatacttatgtcagtaatggtatgatttaatttaagtataaggttagtaaaatgtttaagaaaggaataattaaaagtgaaatatatagaagcaaaaagcatagtatcatcatatcaagggaataattcttggtttggaattaactataatatgaacatatataagggatgtccacatggatgtatttactgtgattcaagaagcgagtgctatggaatagaagaatttgatgctgtacgggcaaaattaaattcaacagcaataataagaaaagatttgaaaagtaaacgtaaaaaaggcgttgtaggaactggggctatgagtgatccatataatgtatttgaaaggaaatatgaatataccagagaggcattgaaacttgttgatgagtttgggtttggaataggaattgcaacgaaaagttcattaattacacgtgatattgatattttaaagagaattaaaactcattccccggtaattataaaaattacaattacaacatatgatgataaactttgcggtaaaatagaacctaatgtaagtctaagttcaaaaagattccaagcgttaaaaatgctaagtgatgaaggcatttatgcaggaatcttattaatgcctatccttccttttataaatgatactgaggagaatatcgtaaatatagtgagaaaagcctatgataatggtgcgaaatttatttttgcttatggtatggggcttacacttagaggaaatcaaagagattattattatgaaaaactaattaagttatttccagaaaagaaattagttgaacaatatatgaatggatatggtaatagttatgaatgttcatctcaaaatagcagaaagctttggagcatttttacaaaagagtgcaagaaatatggaatagcttataagatgaatgatattattaatgagtataaaagaggatattatgaagagcagataaagtggttctaaataatccagttaaaaaataaaacttcatgcctaaaattaaatattttagacatgaagttaatattatctagaaaaataataattgaatcatatttcccataattgatattccaattaacaatctacaataatttgctttatttgatttaaaaaatatagatgaaattgcacatagtgcaaaaagaattccgaagagtttattaattaaatagtttgaaggtgctgcagtaaagttaataaaggataataaaagacaatatataacaagtgatataaatatccatttttgtttaataaatacccattttttaaaactacaaagaaaatgcctataattgataaaaatataaataaaagaaataaaattcttaaaagacctaatgccataatatgagtacctccttacgtttgtttagataattatattatgacattaaaaaaatgtatatatatttttgaaaaacataataaatgtatacatttttttaacatatatttatattttgacatataaattggtttaataataaaaatatagatgttataatgtggtcatatgacattatataaaaattataaaatatttataaggagatctatttaaaatgacatcatatattgcagaaatgacttcggataagaaatttttaagaaaagcagtagcaattactattcccgtagcagctcaggctatgttaaatacaattttaaatctagtagatactatgatgattggtcagcttggtcaaacagaaattgcagctgttggacttgctaataaagtattttttgtatttactcttctgctttttggaatagtaagcggttcttcaatattaacagcacaatattggggaaaaaaagatattaaaagcatacataaagttttaggaatgtctattgccatatcattaattggttctatagtatttgttttggcaggaatttttgcaccagaaggtgttatgaggatatttaccccaagtgataatacagtagctattggagcctcatatttatgcatagcagcactaagttatccaatgacagcagttacaaattgttatatatcacttttaagaggtgtaaataaggtaaaagctccagttataataagtattgtatctataggaattaatattatattgaattatacattgatttttggacattttggagcacctcaattaggtgttaaaggagcagctatagcaacactaatagcaagaatagtagaatgtttatgtttgattgcatacgtgtattctcatgataatcctgctgctgctaaaataaaggaattgtttgattttaataaggactttataaaaatatactttaaaactgtatctcctgttatagcaaatgaatttatgtgggggcttggagttacaatgtattctcttgtttatggacgaatgggagatgaggctgttgcttcaattacaataactcaaaatgtagagcaactttgtattgttttctttcaaggtataagtgcagcaacagctgtaattttaggtaatgagttgggcgcaaataaacttaaagaagctgaaaagcatgcaacttattttatttttattcaatttatactgacaatgataatggcggtaatgttcttctttttaagaagcccaataattaatatgtttatggtgacagaatctacagctatagatataagaaaatgtttaatagtctttataatttatcttccatttagaatgtttaatttagtaaatataactggaattctacgaagtggaggagataccacagcagcgcttttgcttgatcttacaggagtttggtgtgttggtataccattagcatttttaggtggtattatatttgatctgccaatatattatgtgtatgcaatggttacatttgaagaagcatataagtttgttattggattcaaaagatataaacaaaagaaatggttgagaaaccttgttgatatggaatgtgattgcattggtgaacaagtacaataattgtatctgatactgaaaaaataataaatatacagcgaatgtgttagaaattaatgcactaatgttaaatgtaattttgagtttaactctatatttcacatagaattaatatttatttgcttttatataataaaagtgagttaactacaatgttatattaaaattttaatagaagatattctatataaaattttaatattattttaactggattttgatagttaagtagagataataaatgtagaatgcatttgtaatgattaaatattaatttggaggtgtgatatgagaactagaattacagcccattctggagccgatgatactgtggaaaattcacttgaatttatttattactgtataggaacaggagcaaatgcacttgaggttgatgttaggagagataagcatggggagttggttttaagccatgatattttagatgctgaaaattatgattttactaaaataagattaaaagatgtatttgaaatattggagaaagataattctataaaaattaactgtgatttgaaagaatatgatttagaacttcaaataattatgcttttagaaaaatataaaggattaaaaggaaggatcatattttcaggatctgttcggttagaaaatcttaaaaaatacaaagaaataaaagaaaaagcagtaatttattttaatattgaagaatttatagataaccataagaaacttcctattaaagaactttcaagggaaatagtagcattttgcatagaaaatagtacaaatattgtaaatatgaattataaattatgcacaaattatttagtaaggctattaaaagaaaataatatttatatatcagtttggactgttgataatcaagaggagataaaaagattagcttcattaggaatacttaatattacaacaagagaaataactaaatcattagaaacattgcagacatatagagttagaaagattgtataaaagggaaaaagagtaagaaataagagatgaaaattgttttagacattatatttattgaatgagacttggaacataaataggaattccaagtctctttttatcttattataaatttttaatatcatctttattccatatgaataattgttctgaatttgttagtgcaccgaataaattatttttgaatccagggattctgccattcagttcaaaaatgagatttttcatatcctctcttcgtgtttttttatcaacaggacaagggttatgtataacgggaaaattgtatttattaactatattctttatggatgcttcttcaatataaaccattggacgaattaatgtgatattttccttatccatgaatgtttttggagaaaaacaattaatacgtccttcgtatgataaagaaagcattaatgtttcaattgcatcatctttatggtggcccaaagcaactttattacatcctagttcttttgcgttgttatgaagagcgcctcgtctaagttttgcacataaagaacaaggattattttcttttctaatttcgaaaacaattttttgtatgtctgtctggatttcatgaaaaggaatttcaagatctttgcataacttatgtaaaggagtattatcaactccgccaggatttaatgttattgcaattaattcaaatttttgtggtgaaaattttttatatgagtttaaaaggtgaagaagagtaagactatcttttccccctgaaagtccaactgcgattttatctccatcttctattaaattataatcatttattgcctgtctcattttgcttagaagtttctgcataaatagatatctccttttaaaatttaatttcataatattatatcattaaatttgtgatttttagtatttcaattgagtttatatatgaaaacaatggctacactttatataaaatataaatatgctacataagtgtgatataattaatggtataaatggaattatttacgaaatatggagtttgagttatgcgatattatgttgaaaatcatgatgaggtaatgacagatattaatagtgaaattgagaagaaatataatggaagtatcatgattagcagaaaagaaagaaataagagaaaaaaatctattagatttaaaggcggaagaagatataaaaagagtgaaactggtttaaaaaaaatattattagaaaattgtaatagtaaatatttcactgtaatagtactagtatctggtatgacatatatttgttctaacatgtattttaaatatcatttttatactggaaccactataaattgtattaatgtttcttttaaaagtattgaagatgcagaaaaatatataggtgatagtatagataattataaacttattctaaaaggtcgtggaggagttataaatgtaatagatggaaaggacattgcattaggatacaattatgaaattaactcaataaaagaaaaacaaaatgagatttcatggataaaaagcttctttgataaagatacacaagaagggaataatatcttaataacatatgatgaaaaattattaaacaatgcaatagagtgtttagatatatttaaagaagataatataataacgcctgaaaatcctaaatttatttatagtaataacgaatttgtaatagaagatgaaatttatggaagtaagatagataaagatatacttattgaaaaaataaagaaatccatattagatggacaagaagttttagatcttgaaaaagaaggatgctatgaaaatcctgaatatactaaatcctcagaaaaagctttaagaataaaagatatattaaatcaatataaagattcaaaagtaatatatgatcttggaaatttagaaaaagaaattaatatgagtactatggaaaagtggataaatattgataatagttataatgtgacaataaatagagatgaagtaatggactttgtaaatgaatttgctgataaatatgatacagttggaatatcacgaactatgaacagtacaagtggaagaattgtaactgttgcaggtggggattatggatttaagataaatagagtggcagaaacagaagaacttattaataatttgaaggaaaaaaatactgttaaaagagaaccaatatatgatcaaaaaggaataaatactataataaatgatgttgataaaacatgtgtggagatagatcttagcaatcagcatttatggttttataaagacggaattatttttgtggaaggtgatgttgtatctggaagtatagcaaatggaacaataacaccagaagggacttatagtctaaagtataaagataaggattccgttcttgttggtgaaggatatagatctccagttgatttttggatgccgtttaatggaaacataggaatgcatgatgctggttggaggtataattttggtgggaagatttatttaacaaatggttcacatggatgcataaatcttccccattcattagcaaagaatattttttacaatatagaagaaggaacaccagtagtatgctattattaagaatcagtgaaaatattatagattaattagatgatatattaaaatttaccattataattttaatattaacatataattattaaataattgtcatataagcaatttgaaatatgattcttaagcataaatttacaaaaatagaataaaatagttttaaactggtcagtataatgataaaatatataaaaggcctttattaattatgggggtggtattatgtcatacagatatttattagacatagcacttatattattaagtacaaaatgtttatcattacttacaagaaggtttaatcttccacaagtggtaggagcattgcttgctggtttgatactaggtcctgcaatgtttaatattttaaatgaaactgaatttataagtcagatggctgaattaggtgtaattgtactcatgttcactgcgggtttggaaagcaatattgatgaacttaaagaaagtggaaaagcatcattaataattgcttcattaggagttataatacccctttttggaggatttgcagtagctgaaatgtttaaaaatgaagaaatagtaaatgtgagtagtactgtgcagagtatatttattggaatagttttaactgctacttctgtgagtatcacagttgaaactttaaaagaacttggaaaattatctactcgttctggaaatgcaatattgggtgcagcaattatagatgatatattaggaattctagcattaactgtaataacaagcatatcggatccacaagttaatttaaaaaccgtaatattaaaagtgataggattttttatttttgcactaataagcggtcttattattgcagtcctttttgataaatggactcataagtataatgtagataagagaagatttgttatttttgcatttgtaatatgtttactaatgtcattttcagctgaagaattttttggagtagcagatataacaggtgcttttatagcaggcttaattttatctaaaaataatgagcgtgactatattaaaaatagatttgaaactgtttcatatatgcttttatcacctatgttttttgcaagcataggaatatgcataacattaccgaaaatggatttgagaattttatcattaactctacttttaacaattgtagctatttttactaaaattattggatgtggagtaggagcaaaaatatgcagatacacaaataaagaatcagtccagataggtattggaatgatatctagaggagaagtagcattaatagttgcaagtaagggaatggcacttgggcttatgagtgattattttgtaggaccaatcataataatggttcttattacgacaatcattacacctgtatttctaaaaatggtttttaaaaatggtaaagttgataattatattgaaccaacaataaaataattaactatgtcaggataaaattagtatattaatatctagggacctttgttttttataaaacaaggtcctttttaaaattaatacataaaataaaatctggctctgaaagtaaaatattgtaaaaaattaaaaggcatattataatatgaatatatgttgtttaaaaataaagatggtttatgaaagggtgagtttatatgattaatgagaatgggaagataatacagagtggtaattacatgaaacgtgataatattggagaggatctatttttaaaaaatcaagttataataaatgtagatacagaagaatggcttaaattagcatttaagagcaatgtattttataaactgcttctttcagaaagacatctttatcatcctggtaaatttataaattttcaggtggttaatttttaaaaatttatttaagtaaagtaaatataacagggatctataggtaaatgaaagaattttactgatagatccttttcatttttattaagttgaatatatctatatattaatttggttatatagatacatttaaatgtatgggtatatataaatagggagataatatatttgataacataaaaataatattagtataagtttataattaaagaatatttaatgttaaaaatcaattaacattagagaaaacgattatatatttataaaagtatatatttgaaatatatttttttattgactaaaatatatgggaaatgtatacttttatatagatatatatctatataaggggtgaacaaatgaattacgaagaaaacgccagattattaaaagcacttagtgattctaatagactgagaataataaggttattatcttgtggagaaaaatgtgcatgtgagatattaaaaagttttgattttacccaacccacactatcacaccatatgaaagttcttattgactgtgggcttgtggaatgtagaaaagaaggaacttggaattattatgggttgaacattacaaatgccaataagttagttttgtttttactaacaataattactaaaagtgatgataatatttgtggaaaaattaaaaatacacaaaatgattaataggatttttagtatttaaaaaggaatcatataattaatagtatatataattggactaaaagtaaaaagaaagaagttgtaatgagtaatttattttatatattatgtcgttaatataggaggtaaaatgttagaaaaaattaaagaaatatgctcaccttatgaattactaagaggtaattatggaatagaaagagaaacattaagaatatataaagatggaagtctttctcagacttttcatccagaagtgtttggatcaaaaagtgataatccatatataactacggattttgcagaatgtcaagttgaaatgataacaccaccactaaatactccgcaacaggtgtatgactttacaaatgcactttatgatatatctgtttcggaaataggaaatgaatatttatggccacaatctatgccaagtatagtacctaatgatgatgaaataagaattgcaagatatgataataatgaaaaaggcaatattgcctatgaatatagaaagaatttaattaaaaaatatggaggaaaaagacagcttatttgtggtattcattataatttttcatttgatgaaaatctgataagaaaactttataagtatgaaataaatgttgcagattctaaggaaaatgtaagttataagaattttaagaatacaatatatcttaaaatagcaagaaattatttaagatatagatggcttatagtatatcttttaggtgcaagcaatattgttcataaaacttatggatgtagatgctgtatgaatataagcaaagagatagcaagagaaacctttacgaatgaaggtgccgtatcatatagaaatagtgactgtggttatagaaacaagattgaacttataccagattatagcagtgtagaaaattatataggaagtttgaagtcatttataaatgatgaactaatagatagtcataaagaattatatagtgctgtaaggcttaaacccaaaaatgttgatgaatttatgaaatcactattaaatgatggaatacagtatttagaatatagaagcattgatattaatccttttgaaaaaggtggaataagcctagaggatcttaattttcttcaaatttttaatttgtatcttcttataaaagatgaatctgattatgaaaattggcagagtgaggctaccgagaatcaaaataatatagcgaaatatgggcttgataatattgatttaataaaagatggaattaaagtatctaaaaaaacatggtcacttgaaatattaaatgaaattagaaacataagtacattcctcaatcttggaaaagaaaaaacaatagatgctatgattgaaagagctaaagattcaaaacttacatatgcttataaacttgctgatgttgtaaaaaagaaaggatatattgacgctcatttggaactttctaaaaaatataaagaagattcatataaaaatagatttaagcttcaaggatttgaagatttagaattatctactcagatacttatgaaggagtcaataaaaagaggtataaaaactgaagttatagatagaagtgaaaattttatatgtcttaaaaaagataataagacagagtatgtaagacaggctactaaaacttctaaagatacttatataagcgtgcttattatggaaaataaaagtgtcactaaaaaggtattaagagataataatataaaagtacctgatggtatagaagtatgctctattgaagaaggcataaatgcagcattgttttatgaaaataaaccaattgtaattaaacctaaatcaactaattttggaactggaataagtatatttagtgagggtacaagtaaagagcgtattattgaagcattgaagattgcatttaagtatgataatacggttttattagaagaattcataaaaggaaaagaatacagatttcttgttattgatgataaagtagagggaattcttcatagagtacctgctaatgtggtaggagatggagaaaaaacaatacgtgaacttacagaaatcaaaaataaagatcctttaagaggttatcattatgttacacctcttgaaaaaattaatctcgacgaaaatgcagaattgtttctaaaagttcagaaaaaaacatttgattatgtaccagtaaaagatgaggtagtatatttaagagaaaactctaatataagcactggtggagacagcatagattatacagataaaataccagaaaagtttaaaaatattgctgttcagtgtgcaaaagcagtaaatgcaaaaatatgtggtgtcgacatgatgcttgaagattatatggatgaaaatacacagtatgggataatagaattgaattttaatcctgcaattcatattcattgttatccatataaaggaacagaaagaaaaattggagaagatgtacttaaattattaggttttataaactgataatttaaaattcagcttatgctattatatatcataagctgaatttttttattcttttagaagttataatgcagtcaaatttatagagttatacataaattataaaatttttggtatcaattattaactgaaaatgtgatgcagctacttttttattttaagatttgtgttaaatatgaatatagtatgttgaattatgggaaaatactagcaaagtatttttaagatgcgcaggtgtatattgtatgaaattaacagttaaaaatataagattaatagttttagtaatatttttcacccttattagcaattatacaaaagtatcagcatatgtccctacggttgagggtaagaacatattagttataggatcatatagttttcaaaatgagtgggaagaatctgtattaagcggttttgaaagtatacttggtgataaaaataatataaaaagcgagtatcttgattcgtattctaaaaacactttttcatatcatgaatcatttttaaattatttagatgctaagtatgagaatcaaaatattgattatatttttacaatggatgatgaagcacttaaagttataagagatcatatgtttgaaaaacatcgggttttttataaaaaacccgttttttttgttggagtaaatagtattataaatttaaatgacgaagaaaagaagtatttatctggagttgttaatattgagacctgtttagagtgtgtagatttaatagaaaaaatgcatggtgatatgaagaagctatatgttttatgtgataacagtttatattctcagagcataatgacaaatatttcagctgcatatcatgaaaataatgataaactaaaaactgaagtaataaaaactaataagataggatatatgaaaaaagaacttgcagaaaaggattttaaagattctgtaatattaatttgtggagcgtatataaatgaaacaaccaattcaaaggtttcatcgtcagaagttattgaaagtataaagaatataacagatgcacctatatacactacattatacaattatgtagaatcaggtgcagttggaggcgttgtaaatgatggagaaaagactggtcgtttaggtgctattttattaaattcagtagtaaatggagattcagttgaacagtttccatacattatgacgccatcatataattctataaatacatctttatttaattataaggtaattcgagaatataatataaatccattaaatattcctgaaggaagtagctttataaataagaaaccatacaatcttctattgcctaaatggagtgtgtttttaatatacatatcatttagtattgtagtttttctaattatttatttagcagtaatagcattttatcataaaagaaaaataaaagaagccaatctagaagctgtggccgctattgaaagagaaaaaataaagacagattacataatattaatgtcacatgaattcagaacaccattaaatataataataaattcaacaaagtttttaaagagagagtgtattaataataattatgataaagagtactttattacaagacttaacaatataataaaaaattctaatcgtcttaataaggcagtaaataattctattgatgtagctaaaattgaagcaggaataatgagcattgattttaaaatgtataatatagttaaggttgttgaagatataactgaaacaataatagattttgcagcatcaaataatatagaagttatttttgatactgaaaatgaagaaatctatacagctattgataaaacaagtatagagagaattatgcttaatttattgtctaattcaataaaaagtataaataatagtggtaggatagttgttcactgtaaaaatgataatgacaatgtttatatatttgttaaggatacaggttctggaatgagtaatgatgtaaagaagcacattttcgataaattttttcaaggttctgactatactttaaatcgcaaaaatgagggaaacggacttggattattcatagtaaatgcattagtgaaaatgcataatggaaaaatttttgtggaaagtgaagaaggaaaaggtagtacatttaaagttgtaattccaatcactatagttgataatgcaggaaatgagagtactatcagtgaagaattgagatatatggctaatatagaattatcagatatccaatagataaaatatataaataaaaagctataatttacataaaacatacttttatataatggtagaatattttatagaattgtagctttttattaagggttaaattaataatttatatataataatcatggggaattatatataaatgttctattagcaataagacctacagaattatcaaaacctatgttatagtaaaaattatttgtttttggggtttgtattggagtattagaattaggttttaataattgtacatcaccttcaggttcaggaataaatacatattgaagctgtgttaatgaaaactgaagtgatagtatcaatttatttacatatcctgagtccgtatattgaatattatcttgaattagctctataaattccatattgcaattaataggttcatcacttttctcgtagtaaaattcagtgtttttttcgtttttaacaggaaattgatcaaaagttatattaacatgttcttctatttgaatatccatattaagagttttggtaccagagaatttacttgtattattactattagttttgtaagaaagtgatttttcaatgtgtcctgttaatataagtttattatctgatgctaagagaggtttctttataaagattttgttttgagttgtcttaacatttaagcaattttttgataagtttatatttgtataaactgggatatttactttaaggtatgaaagtactacaggagcctgtattataagtgatccagcttttcctaaggggacatagtattcgcatgatatgttcttagaaagattatttttttcattcatagaattcctcctacttctatacattagctttagaaagaaaatatttaaccatttgtaattaaattgttaaatttatatattaattattcatatgcaaagttttttttctatatgatattgataaatttaaatacttgtataataacaaaattcatagtcatattagaagtgtcaacttagacaaattatcttcatattataattaaatgaaatattaaaataataggagataacatggatattaagtgtagaaagagcaaagagcttctgtcaaggcttgagaaagaaggatgtgttattgactttgatgatacttctaagatagtgtttataagtgatgttcaccgtgggaatggaggatatgaagattcattaaggcttaatgagaacatatataaagcagctttaagatattattataataatggatatacgttgattgaaattggagatggggatgaactatggaaaaataaaaatattttaaatattgcgtataactataaggatgtatttaagatgttaaataaatttaatcataaaaaaagattgtatcttctatatggaaatcatgatattataaaatccaacccagagtttattttaaagcaaaaaaaagtatataataatattggagataattttccatctcaaatgatagatctgtattcaaaagtgaaattttatgaatgtgcagttcttaattatcttccgttaaataaaaatatactagcatttcatggacatcaagttgacactataaattgtgaattttggaaggtgagtagatttcttgtgagatatgtatggagatttctagaaggggtaggtggaatgaaagcaccaacaagtcctgctacaaattatgataaaggtgataaaatagataaagttttagaaaaactagctaaaaaagaaaatagaatgataatatgtggacatacccataatgataaactaccaaaaccatctgaaggtttatattgtaatgatggatgttgtgtttttccatcagcaataacaactatagaaataactaatggtaagatatgtcttgtaaaatggaaaatagaagtagatgatcaaaatagtctttatataaaaaaatcaattacagcaggtcctgagaaaataggcgattatttagaatataattgaaaggaagaaaatttaagtgaaatttatagatttacattgtgacacagctggtagaatgttttatgaaaaactcaacttaaatgaaaatatatgcaaggtagatttgaagaagcttaaaaaaggaaactgtctaggtcaggtattcgcaatatttgttgatcaaaaattgaattttaatccttatgatgaattccaaaaaatatatgataattttataaaggaaatcaaactaaatagtgattatataacagttgtgagaaatattgatgaattaaataaggcagaaaatgagaataaaataggagcttttttatctattgaagaaggcgaagttataaggggaagtataaaaaaacttcatgaagtttatgataagggaataagaattattacaataacttggaattataaaaataagcttgggtaccctaattttcaatttaaatataaaaataaaggacttactgaaaaagggaaaaatattgtttgtgaatgtgagtctcttggaattttaccagatgcttctcatttatctgataaaggattttatgatttgattgaaatttgcagtaagccatttattgcatctcattctaatgcaagagcagtaacaaaccatcccagaaatttaactgatgatatgataaaagccttaagcaataaaggtggtgtgatggggttgaatttttgtttggattttttggaaaataatacaaaaccaattgcctctcttgaagcaattggagcacatgcagaacatataaaaaatgtgggtggaatagatgttttatgtattggaagtgattttgatggaatacttaatgaagtagaaatagaggattcatctaattttaataaattatgttataccttagagaaacgtggatttacagaaagtgaaattgaaaaagttttttataataacgtaaaaagagtatttaaagaaactcttaaataatgaaaggtggtgggtgtattatatagacaaaagtgtctgtatatacacattagatatggggagattaagtggaaagattgcacttgtaacaggtgcttcaagaggaattggaagagctattgcaattgaacttgcaaaagaaggagctagtatagtaataaattattctaaagatcatgatggagcagaaaagactttagaagaaataaaaagggtaaatggttatggagttctcataaaagaagatataagttcgtatgaaaatactaaaataatggttgatgaaattataagtacaatggggaagattgatattctggttaataatgcaggtataagtaaaattggattattcatggattctgacaaggaaaatattgatcacataatgaatgttaacttattaggaccgatatatctaacaaagcatgttattaattatatgattcctagaaaaagtggaaatatagttaatatatcttcaatgtggggagaaacaggtgcttcatgtgaagtgctttattctgcaactaagggtggaataaacttatttacaaggtctcttgcaaaagaacttgcgccttctaatataagagtgaatgctattgcaccaggtgttattgatacccctatgaattcatttcttacagaaaatgaaaaatttgaacttgaagaagaaattccactaggacgatttggaaagccagaagaagttgggagattgacagcatttttatgtagtgatgactcatcttatattactggacaggtgataaggactgatggtggttttatataaattacaataatttagtttgttgataagaaagagtaggtgcttatgtatttcgtacatgggcacctactcttgttaatttagatttcatcatcgctaattactattttttctaaataaaaatagaattctacgcctccatcaatatttcttatattaaattggctattatgaagtcttaaaatattttttacaattgataacccaaggccagtgctattacgctgagttctttcacgtgatttatcaattctgtaaaatttttcgaaaagtttatcaatttcaggttctggtatacttgttcccatattttgaacagatagcctaaacttatgaagtccttcatcaatatttatatttatgtcatttccaggaggtgtatattttattgcattagtaattagatttgtaaaaacttgctccatttggaaagcatctgcataaacataactatagggacttgaagaattaaagtttacattaaatttatgagcttcaaattcaggttcatgttttctaattaccttagcaataagcctatttatattaaagtcttcgaaatttggtttcgaagcaccggattcaagttttgagagttcaagcatatttgtaacaagaacactcattttctttgattcatcaataatggtttccaggtataaagctgcatcttcaccttttactattccatctttcaatccttcagcatagccttcaattattccaattggagttttaagttcatgacttacattagcagtaaactctttccgcatggtttcaatctgccgctcacgttcgatatcattttcaagttttttatttttatcctgaagatcaattaatgcgttatggaggttattagacagcatattaagtgaatgggcaaggcttccaatttcatcctccctctctgttgaacatactactgaaaaatccatcttagccattttatctgcaacatatgtcaatgttacaagaggctttgaaatcatatttgaataaataagtgcaagtatggatgcaacggctattaaagctaaaaataagtaaaagaaaaattcatttataacttctgatgcttcttcaataggctgtattgaagcaacgcagaatataagactatcattattgttttttaatgacataggacttacaacacctattttttgcatgtcattacttgagctatagaaatttgtatatctaatttttgaatttttaataacatcattaattaaatctctatcatttatgagttcagcacaaaaatttgcaagagtatctgaaacaatactttcaccattaaattcgctagaaatatagattatatcaccatctaatgaagttattgcaatttgcgcactattatcttcttcaaacttctttagtgctttatataaacttttatcttttgcagaataactatcaatatgtagagaatataaatcatgaaatttacttacttcattaacaagtgaaagagtttttttataagaataaaatttttcaaaaaacattgcctgagtaaaatagacaagaatcattatgcctaatataagtgataatgttatagcaaaaagcctttttgataaactatgcttcatttcgaatataacacatccttactgtttgctctcaaatttataaccactaccacgaacagttacaattaagttagatctatcgagaagtttttcacgaagtctttttacattcgtgtcaacggttcttatatcgccataataatctaagccccatacattatctaatatattatctctgctcaatgcaataccttcattagttacaagataaataagaagttcatattctttaggtgataatgttatttcttttccatttactcttacttcatgtgaaagcttatttatagtaagaccattaaattcctgagaacttgaatcgatgtcttcacgacttctttttagtaatgcttttacttttgcaattaatacttttggactgaatggtttcgtaatataatcatcagctccataatcatatccttggagtttatcatcttcttcgcttttagctgttagaagtattactggtacagtagaaacttctcttaatttttcaagcattgtcatgccatccataacaggcatcataatatctaaaattactaaatctattttttgtgtactaaaaacaaataatccttcctcaccattggaggcttcaaaaacattgaaatcatccttggttaaataatctctaagtaaaaatcttattctaagttcatcttcaactattaaaatagattttttcataaatatcatctcctaacgtttctataaaattaatgataaaactataaatcataattaattataatgttaccacagaaataagtcagttttattacataatgtatagtaatcatatcataaatttatataatatattgtatcattttcattggaaataatgaatattattaattcatattagactacaacctattatttagcactatatttttatctcaatataaagtattattaatagtagaagaatgaaacgtatttgggagaataaatagaatgataaaattaaattttgatgttaaaagacatattcttaaaaatggactagaagtgataacaattaataagaatacacagatagcttcaattaatataggtattaaagtaggagccttacatgaaaaaatcaatgaaaagggcataagtcattttattgaacatgcattatttaaaggcactaaaaaaagaaatgatgaagaacttaatgaagagttagaagcattagggggagaatacaatgcatatactgattatgattcaactgtatatacaataagctgtcttgcagaagagtttgaaaatgcagtagatcttttaggtgatatgataacaaatcctgaatttgatgaaaatgaaattgaaaaagaaagaggagttatattatcagaaataaggatgagtaaagatgatattgaagatttgagctttaaaaatgtaaataggatagcatttgataagagttcgttgaaatatgaagttacaggtattgaaaaaaatgtgtctgaatttacaagaaaagaaataaaagattattataaaaagcattacacacctaaaaatgctcttattacaatggtatcttcattgagtcatgaagatgctttaaatcttatagaaaagcattttggtatgtggaatggtgagaaaccagaaaatatagaaataataaaagaaaagaataaaaaagttacagaaataaattataaaaaggatattgaacaaagcacaattgtatatttatatactttctatgatcttaataaagaagatgaactacccttaagaatattgaatcataggcttggagaaagctctaattcacttctatttagggaagtacgtgaaaagagaggtctagcttatgatatatacacacatttagagataacaaacaatataaaaacactatatatatacactgcagttggagaagaaaatataaatgaagctaaagattcaattgatgaaaccctagaaaatattgttcaggggaaaattgtaattggtgaaagagatcttgaaataatgaagaaggttcataaaacagcagtgatttcaacattagaagatagctcagaattatgtaattatatgcttcatcaagcattagaagatgaagatatatatgaatttttaaaggatatggatagacttaatacgttgaatatggataaaatcaataaaataagcaggaaagtgttaaaggatccgactattcatattttaaaatcaggaaattagttaaaaggtgatacgatggcaattataactaaaatagaaatccaaaagaaaaataaagaaagagttaatatatatttagatgaagaatatgctttttcaataagtgctgaactggtttataaagaaaatctaaaagtaaaagatgtagttgatattgaaaaattaaaatctgtagcagataaagaatcatatcttagatgtaagaattcagcattaaaaatcattgaaagatcatataagactgagaaagaagttatagaaaaactacagatgaaaggttatgagcaaaatcacattgaagctagtatagaatttttaaaagaatataaatttttaaatgacgattattatgcggaagcttttataaaggataagctcaattccaaaggaagtcaacgtataaaacaggacttgataaaaaaagggatacctagggataaaatagaagaaaaactagaaggaatagataaaagtgctgaaaaaaatacagcaagagttcttgcaaataaaaagctgagaattatacagaaaagtgaaaatgatacatacaaaataagtggaaaactttatagatttttaatatcaaagggatatacttatgatgtagtaaaagaagttgttaaagatgtaatgtctattgatgaatttgaataaaatatatagatctatatattaaaactattggataaaaaaatattagttagaagttaatggaggaaaaaataattgagtgcaaaaaagttttttcttattttaattggtataatatcaggtactgcacaagtaggtatattaatatttttattaatattaccttctatatcagttgatactattcctgatgcatcatccttcaaaagcagtattgaggaactgattgataagtttaattataaatctaatggttttattaatgagataataatctataatggtactacaataaatgaaggaataaaatctaatgataatattaataaaaaggcaatacaattaactaaagatgcatctagtgatagagaacgagcggaaattatatatgagtgggtaggaagcaatatagaatatgatgatgaaaaggctgaaatagttttaagtggtgtagatagaaaagaaatgcctaaaagtggtgccatatgtgcctttgatacaggtaaaggaatatgttttgataaagcttgtctttatgtagctatggcaagagcatctggattaaaagtaagacttttaagtggagaagcatttgatggagaaaaatatgtaggtcatgcatggaatcaggtttacttgaaagatgaaaatatttggattaatgttgatacaactttttatgatgcaggtaattattttgattctaatttatttaatgaacataagatagaaaatattgcaggggaatggtagaagcattcccctttattattatactttttgcaattttgatattattagattaacagctttttcacattcatcatcatcagggtctattgaccatgcaagattaaaatgacatagcgctttatcaaggcagtttttcatgctgtagcaataaccgagattaaaaaagtacttactttctttttgaagggagatagctttctttaacatgtcgattgcatcatcaaacttttttagcttaataaagcaaactcctatgttataataagaacatgctatgttgatgttttgaattattgccttcatatagcagtcaattgctttttcataatctttgccattataaaatttatttccttcgttaaaataattcattaagccttccctccgtaaatttttatattaaaataaatcatttaaattattgacgaaaattatacttaatattcagatatctgcatattaatttcatagtagattttaaataggaatcctattaaataacaaaaatgatagaaaaaacaaaaatgctatgttataattttgaaagaatatagaaaaaaatttactgtgaaacttatgtgagaataagtatgaatgaaaacagagtaggtgaaaattaaaacatgataaagtataaaattggtgtagatgtaggatcaactactgtaaaattagcagttttagatgatagtaataaattaatttacagtaaatatgaaagacatttttcagatataaaaagtactattataacattaataaacgaatgctatgaagccctaggtgatattggttgtaccatttgtataaccggttctgggggtctttctgtttctaagtggcttaattttaattttgaacaggaagttatatcttgttcaaagacagttgaagaaataattccagaaacagatgttgtaatagaacttggaggtgaagatgcaaaaataacatattttaaaggcggtatagaacaaagaatgaatggaagctgcgcagggggtactggtgcatttatagatcagatggctgttttattaaatacagatgctggtggtcttaatgaactcgctaaagagcataaaattatttataatattgcatcaagatgtggcgtattcgcaaaaacagatgttcagcctttaattaatgaaggtgcaaataaggcagatattgctgcttctatatttcaagcagttgtaaatcaaacaataagtggacttgcgtgtggaaagccaataagaggaaaagttgcattgcttggaggtccgttatatttcttgtcagagcttagacaaagatttatagaaactttaaatcttacaggtgaaaatgtgattattcctgaaaattcacaattatttgtatcaataggagcggcattactatcagaaaaagaaagtaaaatttcattgaaagagatagtagagagagtttcaaagatatctgatataaaagaggatggagctgaaagacttgaaccactatttaataataaagaagaatatgatgagtttaagcttagacatgataaaagtattgttaaaagaagagatataagaagttataaaggaaaagcatttttaggaatagatgctggttcaactacaacaaaagttacacttatgagtgatgagtgtgagcttctttatagttattatggtagcaatgaaggaaatccactttataaggttataaatataattaaagacttaaataacaaacttccaaaagaagttgaaattgtaaatagtgcagtgacaggatatggtgaagcgttgataaaggctgcacttcatatcgatattggtgaaattgaaacgatagcccattataaagcagctgatttctttttgccaggagttgatttcattttagatataggcggccaagatatgaaatgcctaaaaataaaaaatggagcaatcgatagtatattattaaatgaagcatgttcatctggatgtggttcatttattgaaagttttgcaaaatctctaagtatgaaagttgaagactttgcaaaagaagctttattttcaaaagcaccagttgaccttggatcaagatgtacagtttttatgaattcaagagtaaaacagtctcaaaaagaaggtgctgaagtttcagatatttctgctggactttcatattcagttattaaaaatgctttatacaaagttattaaattacgagatgaaagtgatattggagaaaaagttattgttcagggtggaactttttacaatgaagcagttttaagaagttttgagaaaatatcagggaaagatgcagtaagacctgatatagctggtcttatgggagcttttggttgttctttgattgccaaggaaagatatagtgaaaattataaaactactcttatttctaaaaatggaattgaagactttaaaatagaatccatgtttagaagatgtggtaagtgtggaaataattgtcttttaactataaataaattttcaacaggagaagaatttatttctggaaacagatgtgaaagaggaagtggaattgaaaaaacagatagtaaaaaacttcctaacctgtatgattataaatataagagaacctttggatataaaccattaaaagatgatgaggctgtgaggggaacaataggtattcctagagttttaaatatgtatgaaaactatccattctggtttactttattgacaaaactaggatttagtgtaatgttatcagctccttcgagtaaaaaaatatatgaacttggaattgaaacaataccatcagaatcagcttgttatccagcaaaattgactcatgggcatattataaacttaattaatagggggataaataatattttttatccatgtgtagtctatgagaaaaaggaatttagagaagcagataacaattacaattgtccaatggtaatttcttatccagaagccataagaaataatattgatgaactgaaagataaaaatataaactttatgcagccatttttatctcttgataatccaagagaattgattaaaagaatacatgaagaatttaaaatgttcaatgtatcattagaagaggcgaaaaatgcagtagaatgcgctgtggcagaacaggaaaattataaaaatgatataagaaaaaaaggtgaagaagtaatacaatacttaaaacagaataatgagagaggtattgtgctttgtggaagaccgtatcatatagatcctgaaataaatcatggtataccaggaattattaactcatatggtatggctgttcttacagaagatagtgtcagtcatttaggggaaattaaggggaaacttcgagtagttgaccaatgggtatatcattcaaggttatatagagcagcatcattagttgctgaagaaccgtatttagatataattcaattaaattcattcggatgtggacttgatgcagtcacaacagatcaagtatcagagattatttctgcaaaaggaaagatatatactgtacttaaaatagatgaaggaaataatttgggtgctgcaagaataagaataagatcacttaaagctgcaatggatgaacgattacgtaaaaactatataccagttgaagaaaagatagaatataagaatagaatatttactgaagaaatgagaaaaaatcacactatattgtgtcctcaaatgtctccaattcattttgatataattcaggaggctgtaagagcatcaggatataaacttgaagtacttccatctatagatagaaatgctattgaggaaggtctgaaatatgtaaataatgacgcatgttatccatcaataattgtggttgggcagattattgaagcattgaaatcaggaagatatgatattaataatacatctgtaataataagtcagactggtggaggatgtagagcaacaaattatattggctttttaaagcttgcacttaaagaagcaggatttgaacaagttccggttatttcattaaatgctgttgggcttggtgatcaacctggatttaaaataggaataaaaatgataaatagagcattgatggctattgtttatggggatttgttaatgcgagtattatataaaacaagaccatatgaaaaagttgaaaattccgctaacaagctatatgagaaatggaatgaagctgcaaaggaaaatgtacgtaatggaagtaagcgtgagttttcgagaaatgtaaaaagtataataaaagaatttgatgaacttgaacttcttaatataaagaagcctaaagtgggaatcgtaggagaaatattagttaaatttcatcctactgcaaataatgatattataggtacattagaacgagaaggggcagaagttgtagtgcctgatttccttgactttttcttttattcagctttggatgaagactttaaggcaaaatatttaggtggaaaaaaaattacgaagaatatatataattgcgcaataatgtatatggagacatatagaagtacaatgaaaaaatatcttgataggagtaatagattttcaagtcctaaacatataaaagaacttgcaaaaatggcatcaccaatactttctcttgggaatcaaacaggagaagggtggttccttacagctgaaatgattgaacttatagagagtggaactaagaatattgcatgtttacaaccttttgcatgtttacctaatcatgttacaggaaaaggaatgataaaaactcttaaggaaaaatattctgattctaatatagtagctatagattatgatccaggtgcatccaacgtaaatcaactcaacagaattaaactgatgctttcagttgcatttaaaaatattgatagtgatgttaatgttgattataaagaagcagaagttgaagttccagatgttcaaggagaaataggtataaatcatgtataaaaatacttattataattaagatgatatgttaaaaattaatgtgactttataaaataaacaaattaaagctgtactatgaagtacagctttaatttgtttagaaatttctatattaataaaaaatattaattattattaataaatctatatacaatatcttatggataagctataatttattgatatttgaataataaaaatacaatactatatgttttttaattatggtataatattaaattgaagtttatattagattaataaaatggaaaaattaactattattttatgttggaggaatctagagtgacgagaaagaagaagagtgacgaagaaaatagaaaaggatttagacctttagttttttttatgtcaatcatttatatagttatttttttaggaataactacaccacttgtgttaatatttggtccatatgaaaatacgagaagagcacttataaatactattttagctacaagacatgcatattggattacagataacatgtctcaagaaacaataaataatcttcttggaataaaggaaacagcggctgaagtaaaaaatgataatgaagtaaaacaggacattgataaggtaaacgtaaaatatactagtggaactgagattacacaatataatataaatactgatagatatactgcctatatacttgaaattaaaaacccatgcagtattaaggtttctatgactaaatatcttggaaagcttggacaaaaaacaagtgatatggcagaagaacataatgcaatagcggcaataaatggaggtgcatttgttgacgaatcaagtgatggaactgtgtatgcaggaacaggggcaagaccaggaggttttgtaatttctaatggaaaagtagtatatccaactgaaaatgttgataaagataatgttgaaaatgttgttgcatttactaaaagcggaaaactaattgtaggagaccattcattgcgagaacttgaaaagcttaatgttcaggaagcaatgtgttttagaaaacctaatattataataaatggagaaagacaagtaaaagacaagatggcagaaggtcttaatccacgaactgctgttggacaaaaagaagatggtactgtaatattccttgttattgatgggcgaaagataactgcaccaggggcaagcctttatgatgttcaggaaataatgatggaaagaggtgctgttaacgcaggtgcactcgatggaggatattcttcaacaatgtattacaaaggagaggttataaattctcctaatgcatggaatggagagagaagtgttgctacagcattttatgttgaataacatagcttttcagaagtaacatagataatttaaatatttatatcttaagatgattaagtggaaaattactatgaaaggattagttaaatgaaaaatttagtgagaatagtagcttggacattagtggcactagttatacaacagagtacattttggtatttggaaaatgtatatttagctactgactacgaaataaaagctgaagtggttgaagaaaaagaagaaaaaccacaagaagagaaggaagaaattcaaattaaaagtggaatagaaaatttgtcagtatctcatgacggtagatttgttgcatatatggataatggagaactaaagatttttgattcaaaggaaaacaaggaaaatgattttacacctgaacataaaggacaggttgtattttataaatggcttacagaaggcaatagtatgatagttattcaaaagattaaagaaaaaggtgatgtgtattatgaacctgtatcttataacgctaaaaagtcatctgttacaagtattgtagattttaattataatgaagtacgtattccagtagataatgatgaagataaggtagagaatgttgaattttctactgcaactaatgttttctacataaaaataaagaagcgtaatgaaaagagtgatttatattcattaaatgtaatgaatcagatgactcttgttagggaaaacaagaatataggagatattatcgtaccaactacaaatgcaaattgtgttatggaaatgggggattttgtaaccattttaaatagtcctgataatatagaagtgccagctaatggtaaagttagaatattaggaactgatattaatgattatgtttattttggagatgagatagatgggaaaatcactaaaatatactatactacattaaataatgaaactttaaaatggaatgtactctcactttctaaagctgttctcaaggatgatatattcattgattattccggaaaaatatatataaatgatagtgatgaaaaagcagttacagaacttacaacaagaaaaacaattagttatgaaggagagtttgtacaaatttattcagaaggtattatttataaatcaggaaataagcttataaaaattcagcttgaacctaaaaaagcatcagaacataatgagaaaactagctaactataataaataattagtataaaaaattattagatgagcattctaattttgaggtgatattattggataataataaaaatagaatgcatgatagaccaaagtccaacgcagaaagaagaaagatggagccaaaagataattctgatttaggcgttatagatgggaaaaaaataggagcaccaccacataaagaaaaagatcatttttaaaatggatgccataagtatgttgatttatatttaacatacttatggcgttttattatatatggttgaagaagatgtttatatagactagcaatatatgtaaatgtagtggtataataagttgtatttcacgttaacaaattttattaataaaattatgtgaaaataaaatggggaagagggctttaacaatgttcataagaaagaacgtattaaatctggcattgcctataatgattgaacagacatttgttatgcttttaggcgtatgcaatactatgatggcaggacatattggagaagaagctgtttcagcaattggaatggtagacacaattaatatgctttttatatcattttttgctgcattatcagtaggagcaacagttattgttgctcaggaagttggaaaaggagaacataaagaagcaaatgaaatagctagacaagctcttgtttcaggcatgattgtatcattaattataacaatatttttatggatttttagacaggatattattaattttttatacggtactgctgatgaaaatgttaaaattgatgcaaaactctatatagaatttactcttatgacatatccattcatagcaatagaacaaattgctaatggaattttacgaggttgtggggacacaaagacaccaatgtacataactatatttatgaatgttataaatataatattaggatacatattgatatatggtataaattttttgaatatatcctcttttggaataaaaggagcagctattgctatagctattgcaagagtaataggaactatactaattggattcgtattatacagaggaagtaaaataattaagatacaatcactatatcccttcaaatttaacttgaagatacaaagaggtatttttaatataggacttccagcaggaatggagcaagttatttttaatgcaggaaaattaatagttcaagtatttattgttaccatgggaacagcatctatagctgcaaattcaattgcaatgtcaatatctcaaataataaatgtacccggaaatgcactatgtattgcagccactactttagttggacaatctataggaagagatgatattaaaggtgcaaaaagcactcttatatatcttgttaaatttgctacagtttgtctgggaacaataggccttttatttgtaccaatatctgaatggcttgcatctctttatactaattcagaagaagtaatacatttgactgctgtacttattaaggcgaatagtatggctatttttgtatggccactttcttttgttctttcaggaggacttaaaggagcaggagatacacgatttacaatgataacagcttttataggaatgtggatatttagaatatgcattgggtatatacttggaatagttttaggatttggagttcttggaatatggataggaatgttcatagactgggcagtgagaggaataatgtattcttgtagattaaagggtataaaatggttaaaatataaaatttaaaaaatttttgttttttaggaagattattcaatagtagaaacaaataaagaattttagtttataaaaatagtataaattaatttgtaagtgtacaatctaatgatgaggtgatgttcatgggtaagaaaatgaaagctgataatgaaagaaaaaagaaacatgtaagtcataatccccaagcagaaagtgtaaaggctgtatttggagaacctaaagcaaaaacatatgatcctactgactttaagatttaataatgttgattaaatcttaagtatgtaaaaagaaaatatttaagcagctttaaaaagcagattgtcctttttgacagtctgcttttgtgggtaaattattaagttgtaattgttaataagacggttattgtattataatagtataaaaagcttataaagttactcgggagatggaattatgaaattagaattaacaataaatgaattaggtgaagttttaaaaaaagtatcaaaagaaaataatttgaatgtacttataaaatctgctttaagtggaggatggatgactgttactggaacagcacaaattactaaagttcctgaaaatcatgttaatagttgtaaaggtaagaaagacaatataattcatataaaaattaatgaagatatggaaaatgaaacattattaaaactaacaggagttaataataagaaatttaatgttgatatttcagcgggaaagtatagagaattaggggcgaataatttaaccattaatatggtaaaaacaaatgaaaatgaaacaaagataaaaatagatgaaaatataatttttactgtgaaaaataatgtaaataatattttaaatataataaaataatatatatgtatcagggttagaaaatgtttacatatattagattatagtttataatagtaataaaatgtttgggaatatattaatgataattccttaaaaaatagctcatatcttttttatatacttgtggctctcttttatttaagagggctatttttatgtatttaattaatgaaatatgagaaaaataaataaaaatattttattattaggagaaaattatgaagataagacttggctatgttgctatttcaatgaaattaggcaaaaaggttactagctctagttcggttacttttaaaaattatacaagattaaattcagaagaagaacgaattaataagctgaagaaagtagctttatcaaatttaaatgatttagagaaaatactgaattataatgttgaaaatagtatacatttttatagaataacatctgcattaatacctttagtcacacatcctgaagtgggatattggggacatagacagatatttaaaaaggattttgaagccattggtagaataataaaaaaaaataatatgagagttgatacccatccagatgaatttaatgtattaaatagtacaaatccaagagttgtagcaaatactaagataaatttaatatgccagactgagtggtttgaagatatgaattataatgatggaaagatggttttgcatgtaggaggtgcaactggtgggaaaggagaaggaattcatagatttattaataatttttatgaatttccagaagaaataacatctagacttattattgaaaacgatgataaaacatatacagcaggagaagttttgaatttgtgtaaaacattgaatgttccaatggtattagatgtacatcatcataattgtaacaataacggtgaattaattgaaaaattaatagaagcaatttttaatacatggaataatgaaagtcttccacctaaaatacatttttcttctccaagagaatatgaaaatgatagaaaacatgctgattatattgatgtaaaggagtttgttaaatttattgaaagtgctaaaagcattgaccgagattttgatgttatgcttgaatgtaagcaaaaagatgaagcactatataaactgtcagaagacattaaattaataagaccagattataagtggatagatgaaagtacatttatagtctaaaaataatttttggttgttaagataactggtattttttcgataattaactaagatgtatatagtaatgatgttataaaatattgttaaataaagcattattaacatattttatatgatacgtggaggatgagtaaaatgaaaaaattaaaggtttttacttttgtgctatctgcattgatgctacaaagtatttgtgctaatgcagcaagttcgaagaaaagtgatgagtacactagggaagaaattgaaaatagaagaccaggattttatgctagtgatatagccaaaagtgttcaatatgtaaattcagggaagaacacattttctgcaaaagaagcaccaagcattgatgatgaagatgattatgaacaaatagaaaattatacttataatcaagtgggacctataagtgctagtgatattgtcactattaatgcaattccaggaagcagtgctaaatggggaagagctaataatggaaattggatatatcttgagaataatcagcctggtactggatggaagcttgttaatggagaatggtactatatggatagtaatggcgttatgcagacaggttgggtaaattataaaggaaattggtattatttatattcaagtggtcagatggctgcaaatacttgggttgaaggatattatgtaaactcctctggtataatggtataaaaacatttaatccaattaatctataaagggtagattaattggattattttttgctattaataatatgataattattattaaatagtatttacttttttataatatagatatagaatataaataaggatattgattatttattaacaatgtttattaataaaaagtgtttggaggaatatagatgaaagttttagtagtaggatgtacacatgcaggtacagcagcagttgtaaatttaaaggaattatatccagaaagtgaaatcactatatatgaaaaaaatgataacatctcatttctatcatgtggaatagcattaaacgtaggaaaagtaatagaaagtactgaaagtttgttttataattcacctgaaaacttagctaaaagtggtgttaatactaaaatgaaacatgaagtattagatataaattttgatgaaaaaagagtagaagtaaaaaatttagttacacaagaagtattttatgatgattatgataaattagtattaacattaggatcttggcctattgtaccagaatttgaaggaggaaacttagataatatagttttatgtaaaaactatgaccatgcattaaatattattaataaaggagaaaaagctgagaatgtagttattataggtgcaggatacattggtgttgaactagttgaagcttttgaaatgcaaggaaagaaagttactcttatagatgctgaaaatagaataatggcaaaatatttagataaagaattcacagatatagcagaaaaggaatttagtgatagaggtgtgaatttagttttaggtgaaaaagttgaaaaatttaatggtgaaaatggaaaagtaaatgaagttgtaactgataaaggaacatacaaaggtgatttagttgttttatgtattggatttgcaccgaatacaaagctcattaatggaaaattagatacattgaagaatggtgctataatcattgatgaatatatgagaactagcagagaagatgtgtttgcagctggagactgttgtgttgtgaaatttaacccagctaaagaagaaagatatataccattagcaacaaatgcagttagaatgggtacattagttgctaagaatcttgttaagccaacacttaagtatatgggaacacaaggaacttcaggaattaaaatatatgataaatgtatagcttcaacaggattaacagaagaaggggctaaaataacaacaaatataaatgcaggaagtgttactataactgataattatagaccagaatttatgcctacttttgaacctgcaactataaagttagtatttgataaggatagtagaaaagtaataggaggacaaatatgttcaaatgttgatttgactcagtatatgaatactctatctgtagtaatacaaaatgaaatgacagttgaagaattagcaatgacagatttcttcttccaacctcactttaacaagccttggagtttattaaatactgtagcattaaaagctatctaacttaaaataacctgtaaattgcatacaatacataggttgcacacatgaattgtatgcaatatttatatatctgcaatatataaatattgtagatatataaatataatacaaaataattaaagttgttgacaagtatttacttagatgatatattaatattcataaaacgtatacatgaaattgaaaatagaaaaattaaattattaaaattggattgttactgattatgcaggcaaaacctaagaagattataagagccaatattactatgtaagttcttataatctacttgggtttttttatttaaacaaattaatttatcatgtatataaattatattaagggagaggtaatttatatgaaaagatatttggtattagatatagggggtagttctattaaatattcaataatgactgaaaatgctgagtttttagaaaagggtaatgttacgacacctaaagaaaaactagaagaatttgttgaaactattggatgtttatatgataagtataaagaagaaatatctgggatagctataagtatgcctgggattattgatagcgagaaaggatacgcatatactggaggaagcttattatataacaataataaagaaatagtgaaaattcttcaaaaaagatgtcctgttaatataactattgaaaacgatggtaaatgtgcagctttagcagaagtatggaaagggacattaaaagattgtaatgatggcattgttatagttattggaacaggtgttggtggaggtgttataaaagctaaaagaatacataaaggaaaaaatttctttgcaggagaatttagctttataaggactaatgtagatgattcagaaaatattgataatatgtgggcaatgaagagtggttcatcggcattgataaaatctgtagctgaagttaaaggtttagatgaaaaagatgtaaatggttataaggtatttgagtatgttaataatggggatgaagatgtgttaaaagtatttgatgattttacgaaaatacttgcagtacaaataataaatctttgctgtgttttagatcctgacaaagttgcaattggcggtggaataagcgatcagcccttattaattgattatataaataaaaatttaaataataactatgataaatacactatgtttggagaacttccaagaatacaagttgaaaaatgtacatttggaaatgattctaatcttataggagctttatataattatcttacattaaaaaataatttagccatataatatctaaaaaactcttgaatatttttcaagagttttttattattacttattaatgaaattaaataaatatgtactaaattttagtgtcataaaatatatatatatcatataatacattaagattatagaaaatctatattatatgattttattataaattggattgataaaaaaataacaaacaataatttaatatatatattttaagggggcggtgtatttgctagaaaatcttagaattaagttggtaaaaatagctcaagaagcagagaagtatggattgtgtaaagagaaaacaggaagttttagtattaaagattctactacaggatatattttaattacaccttctcaagttagcagaagtgacttgaaacctgaaaacatttgtatagtagatatggacggaaaaacaatagaagttgaaaataataaaaagccaagtagtgaaattcttctgcatcttgaaatatacaatcaaaaaaaggacgtaaaagctgttatgtatgcacattctttatatgcaactatatttgcagttgcaaacaaagttattcctccaatagttgcagattcaagacactatggaggttatatatatgttgcaccttacgaaaaagctcagactatagatttagctaaaagtgtaataggaccattaagtaaaaatgatgtatgtcttctagaaaggcatggtgttgtaataacaagtaaaaaaattgatgaaattttaacaaaggctagatatgtagaagatgttgcagaaatatactataaagtattacttttgaacaattttagagaaccaaatagattagatattgaggaaattaaatcatgaaataaaagtcaatggtaagggcgcaataatcacatataaagtatatttaaaagtttatagtagaatagattaattaaataaaaatcaatgatagagtattagagaaaatcaatgattagtgtaaaaacacatatcattgatttttattttataaaaaattattagagataataaagatatgttaaaaatagtattaattataaaagagggataaaaatgataaagtttattgattgtaaagaagctgtattattattaaaaaataatgatgttgttgctgtttctggttttgcgggactggcagttccagaaagtttacttaaaacattagaagaaagatatattgaagaagggtatcccaataatctcacactaatgtttgctgctgcacaaggagatggtaaaagtaaaggtttaaatcatttagctcataaaggacttgtcaaaagagttatagggggacattttaatcttgcaccaaagcttgcagaaatgatgaataataatattattgaaggttataatctgccacagggagttatgtgtaatatatttagagacatatctagaaagtctggatttaccctaagtaaggttggtcttggaacttttgttgatccaagaatagaagggggaaaagttaattctataagtaaagaaaaaatagttgagctatttaaatttaatggagaagaatttttattatatcatcatcaaaagatagatattgcactaataaaaggaagttattgtgatgaaaatggaaatatttcattagataatgaggcaacatattcagaagcatttttaatagcacaggcagttaaaaattctggaggaattgtaatagttcaagttgataaagtagtgtctaaaagtgaaatgaagtgtaaaagtgttaaaattcctaaaatctatgttgattatattgtggaagttttagataaagataataaagaacaggtattaggattggaatacaatccttttttgacagcagaatatgagaagaataaaaaagattttgcttttgaagaaagagaggaaaatagaaaaagtcaattaaaaagtgaaaaaaacactttagatgctagaaaaataattggaaggcgagctgctatggagcttagtaaaggtgatattgtaaatataggaataggcataccagaagaagtttcaagtatagcttatgagaatggcttttctaagatgattactttaacagtggagccaggaccaataggaggaataccacaaagtggcaagggttttggagcatctttaaaagcagaatgtatattagaccaaataagtcaatttgatttttatgatggaggtggtcttgatattgcttttttaggaatggcagaatgtgataaaatgggtaatataaatgtaagtaaatttggcactagactagctggatgtggaggttttataaacataactcaaaatacaaaaaaaattattttttgtgggacttttacagctaaaggtcttgaaataaatataagacatggaaagatgtttatagaaaatgaaggtaaaaataagaagtttaagacaaaagttcagcagattactttcagcggggaaaaggcaaaaaaatatgggcaagaagtaatttatattacagaaagagctgtattcaaactaaaagaggatggtatatatttaacagaagctgcaccaggtatagatattgagaaagatataatcaatcaaatggattttaaaccttttgtagataagaattttaaggttatggatgaaaagatttttttataataataatagtaatgataagttataaaaacaataaagataaaatgaaggagaataaacatggcaatattatcaataggagatactgtagcaatagtagcttgttctaatggactagatgaaaaaatgaaacctaagattgaagaactagtaattattttaaatgaaataggtttaaaaacaataattagtgataaagtttataagaaatattcagcctttaatggtacagggaaagaaagagctgatgtacttttaaaatattatagacataatgaggttaaggcaatatttgatgtttcaggaggagatttatctaacgaaattttagaatatctagattttaatgatataaataaaaattataaaccatattttggatatagcgatttgacagttgtagtaaatgctttatattcaaagacaaatcaaaaaaactatttatatcaaataagaaacttggtagatagtaataaaatagaacaaatcaaaaattttaaagatacttttattgatgataacaggtcaatattgaattttgaatatgaatggattcagggaaattttatgagtggtatagtcgttggaggaaatataagatgttttctaaaacttgcgggaacagaatatatgcctgattttaaggataaacttttattcttggaaagttttagtggtgatgtacctaaaatggtttcttatcttacacaatataaacatatgggaatttttaaaaaggtcaatggtataatactaggaagctatactgaaatggaaagagaaaattattcaccaacaatagttgatattattaaaaggatagtagatgacagtagtatgcctattgtaaagactaatgaaattggtcatggaacagattctaagtgtattattataggcgaaaatttaacattgagactttcatgtaattaattaaataataatatagaaaagacgagagaatttttaaaaagtatcctcgtctttttcaatttgcactatttctgcatctgtattgttttctacaaatgttattatatgttccatgatagaatcagcctgtgcgctgtttccagccagacctgtaataccaatatctattgtggaatgaatatcttgattttcaacttcagctactgaaatgttaaatttgttttttagtttctgaattaagctttttacaatcattctcttttcttttaatgaatgaacccaaggtgcacgaagtgttattttcataattaatattttcatttagtcacatccttctaaagttttttacaattatgttataatgaaactgcaatattattatacgatataaggtgagaaattatataaattattgacaaaatacaatgattaatatatcataaaaatgaaaataaattattaatataaaagcaatgataaagaggagtagaaatttataagcattataagagagagggaggagctgaaaacccttatgtggagaattttgaaggtagcttttgagcttctttagtgaatgtaagtagctaaagacggttatctaaatcgttatttgaattaagagtccattagaacatatttattttatatgtttacgtggaaataaaggtggtaacgcgagtcttcgtcctttttaggattagggctctttttttatatatagatatattaataaaggtaaaaaagattccataggaattttaataatagaattacttcaatttacatatgataatagacaatgaacagtgaacaataaaaattaaagatatttcaaagaaatatcatcaacaactgtcaattgtcaattgtcaattgtcaattgaataagtttggaggaaataaaaatgtcagaaattaaaaacatatcaactacatatgatccaaaagaatttgaagacagaatttataagacatgggaagaaaaaaaatattttacaccagaagtagataagagtaaaaaaccatttacaatagtaatgccgccaccaaatataacaggtcaacttcacttaggtcatgcatttgatgatacacttcaagatatacttataagatttaagagaatgcaaggttactgtacattatggttaccaggtgaagatcatgcttctattgcaacagaagttaaggttgctaatatgctttctgagcaaggttatgataaaaaagaaatgggaagagaagcattccttgaaaaagtgtgggaatggagtgataaatacagagctacaataagaaatcaagttaagaaacttggagtttctgctgattttacaagagaagcttttacaatggatgaaaacttaagcgctgctgtaaaacatgtatttgtaaaattatataatgaaggcttaatttatcaaggaaatagaattactaactggtgtacacactgtcagactgctttatctgatgcagaaattgaatatgaagaacaagcaggtcatttctggcatataaactatccattagctgatggatcaggatatcttgaaattgctacaacaagacctgaaacattactaggagatagtggtgttgctgttaaccctaatgatgaaagatataaacatttaataggaaaaactgtaatattacctcttgttaatcgtgaaattcctatagttggagatgattatgtagacttagaattcggaacaggtgccgttaaaatgactccagctcacgatcctaatgactttgaagtaggaaagagacacaaccttgaaataatcagagttatggatgataagggaataattaacgaaaagggcggaaaatataaaggtcttgatagatatgaagctagaaaagctattgttaaggacttagaagacgctgggcttttagttaagattaaagatcatgctcataatgttggtacacatgatagatgtggtactacagtagaaccaataatatctaaacaatggtatgttaaaatggatcaattagctaaaccagctgtagaagttgttaaaaatggtgaaactaagtttgttccagaaagatttgataaaacttattttaactggatggaaaacattcaagattggtgtatttctagacaattatggtggggacacagaattccagtttactactgtcaggattgtggtgaaatgatggttcttgaagatgctccatcaaaatgtactaaatgtggtagtacaaatgttgagcaagataatgacgttcttgatacatggttctcttcagcattatggcctttctcaacattaggttggccaaacaagacagaagacttagattatttctatccaaacagtgtattagttactggacatgatataatattcttctgggttgctagaatgatattctcaggattacactgtatgggagaaactccattccacactgtattaatccatggacttatcagagattctcaaggaagaaagatgagtaaatctttaggaaatggtgttgatcctcttgaagttatagatcagtatggtgccgatgcattaagattcatgattgcaactggaaatgctccaggaaatgatatgagatactatccagaaagagttgaatcatcaagaaactttgctaacaagatatggaatgcttcaagatttgttatgatgaatcttgataaagaaatcatgaacaaatataaagactgcaaagaatattcattagctgataagtggatattatcagaaatgaatacattagttaaagaagttactgaaaatatggaaaaatatgaacttggaattgcaatgtcaaaagtttatgatttcatgtggacagaattctgtgactggtatatagaacttataaaaccagtattctatggtgaagatgaaaaagctaagggcgtagcttataatgtattaaatactgttttagtaacaggattaaaattattacatccagcaatgccattcataacagaagaaatatatactcatttaactgaagaagaaacaatagtaaatgctgcatggccagaatttgatgaagctttagttaataaagaagcagaagataatatggcatatgttatagaagcaattaaaggattaagaaatgtaagagctgaaatgaatgtaccaccttcaagaaaagctaaggttatagcttatatagcagaagatgctaaagaagcatttacaaatggtgcagcatacatggaaaaattagcttcagcttcagaagttgaatttattacggataaatcatctgttccagcaaatgctgtatctctagttgttaagggtggagaattgtttatgccacttcttgatttagtagataaagaaaaggaacttgatagattaaataaagaagttaagaaattagaaggtgaaatcgaaagaattgataagaagcttggaaatcaaggattcgtagctaaagcacctgaatctgtagttaatgcagaaaaagaaaagagagttaaatatgttgaaatgctagaagctgttaaggttagaatagaagcattaaactaaaaatataaatattacaaatcccaatatccatttttataggtattgggatttttatattaaaattttttaatataaaggatattacagaataaatattaatatatatgtattatgttaataaattctggaggtatatgagaagtgaaagctaaaaagcattttttaaatctgatattttggattactttatcaatattatttaacatttatatattttatagtcgtggagaaacatgtgcagtggaatatttcggaggatacatagttgaaatgtcactgagtctagacaatttatttttgtttttaatgattttttctaattttcatattaaagaagagtatcaagaaagagtcctattatatggagttttgggggctatggttttaagacttatatttatacttttaggagttagtattataagtcaatttcattctatattatctttttttggaatagtattattatatagtggaataaaaatgctttttaatcataataatgataatattgaatttcacaataattttgcaataaagatgttaaaaaaatttattccagttacagaaaactttgagggcagtaaattttttgtgagaaaaaacaagattttatatgctactccactattagctgttcttgtagtaattgaattttcagatgtactatttgctattgattcaatacctgcaatattttcaataacaacggatacatttatagtttatacatcaaatatatttgctatattaggccttagaagtatgtattatattttagagagaatgaatgatatgtttaaatttatgaaatatggagttggaattattttgatgttcacaggatggaagcttgtagcattattttttggaattgagatttcagttactaattcagtattgataataattataattttactattaagtattttagcatctcttgtttttgataatactaatagagctaaaagaagtacattatatcgtggaaataaatagttattggatataatgaaatttggagttttacttgctagtttagaaagtttatatattatatataactttataattataatttgtataacatatatcacatgaataatttgactttaaaggagtcatttattataaagtttagtatttataaaatactagactttatttttacaatccttctttctataattgtaagtactctaaaagttaattaatattaagaaatttaagggtaattctgctataataatagtattattgaagtatatactaataaatatagaatttacttagcaaataagagaagaagaggtaaatcaaatgaaaatgacgtatgaagaagcaatggaatatataagcaatgttggaatgtttggctcgaattatggattagaacgaacacacaggttattagaactgcttggtagtcctcaaaataaattgaaattaatacatatagcaggaactaatgggaaaggttctacaacatcaatgataagcaaagttttaattggaatgggattcaaagtaggaatgtatacatctccatatcttgaagtgtttgaagaaagaatacagattaatggtgtcaatattcctaaagataagcttatagataatttagaaaatgttaaatatgctgtaagcaaagtaattgaagaaggatatgaacatcctactgaatttgaaattataactgcattaatgtttttatatttttataatgaaaaaatagattatggagtaatagaagtagggcttggtggaaggcttgattctacaaatgtaataatacctaaagttagtgtaataacatcaataagtatggatcatataaatattctaggaaatacaattgaagaaatagcaaaagaaaagtcaggtataattaaagaggatgtaccagttatattatatcctcaaaaaaaagaagcagaagatgtaattttaaaagctgcacataataataatagtaaggtttattatgtgaaaacagatgatggaaatcttaagggaattgattatgataatataactcaaaatgtacaggtcaatggattaaatgggatttataatgttgatcttcctttacttggagaacatcagattcttaatttatgcgtagcaataaaagcagtggaagttttatgccaagtagaaaaaattcaatataataaagaaattatagaagagtcattaaaagatgtaaaatggataggaagacttgaaacgttaaatagaaatccattaatagtaatagatggagcacataatattgatggaataagagtattgaaaaacaatatcagaaaatactttaaatacaataagatgtatcttcttcttggtatattagcagataaacaggttgatgagatgattaaagaaataacacctatggctgaaaaaatatttgcattaacacctcatagtgatagagcggagctcagtgaagatttaaagagggaaatagagaaagtaaaccaaaatgttgaagcttttgatgattataatgaggcaattaatgaagcactaaaagtggcagaagatgatgatttgatacttgtaagtggttcactatatatgattggtgatatgagaaaaataattaataaaataataaattaatatggtaatatatagatatagtcttgtgagaaaaggggttggggagttatatggttaaagattttgaagatagatgtatatttgatgaacttaaagaattttattataacaataatggtgaactctatagctatcaggactttgaaaaatctggggttaaagaatttaatatgtcatcacacaaaattaatgatttaaaagtttatgaaaaaaataggcttgcagatgattttataaggatatttttagatattgcacaagataaagaagaaattacggttcttgagggatatgtaactttaaatcctgtaataaattattatgaaaatttagaaaagttatttaagtgtatttacgaatatgaaaacaataaaatatatattgagaatttaatatataaaattataactaaaagtaattccaaagaattaataaagggagcgcttataggagcatatataattaaaatcaataatattgaagaaatactaaaaatatatgaaattcataacgaatatttattctatgttttgaatggttacgagcatattggattatctaataatgaattttttgaaatagcaaaaaaatcaaaaggttatggaaaattcttttctattttgcacttgaaacctgtaaattatgaaatttctgactggatgattgaagaaggatgcaacaataatgttgctataactgaattagtatgcttaagtatgctttctatagacattcttgattatatgaataagactactttttctaaagaaaaaattgaaaacttatcaaaatcatttagtatcatgttttcagattatggtgttaaggaaataagagatgaagtaagtgtttgtgagaaacttttagaagaaataaatgaaaatgcagatgatatttattcattgtatgtaacaatctcaatattatattcattggaagcagatttaattgattattataaagaaaagaaaataaaccttcaaatatctttgtataataaatataagaatattatagacatgtgcaaaaagatatgtaaaaaagaacattggaagactgtagttgaaaatgaactaacaaacatagaattagagactagcattttaataacatgtgcagaaaaaataggatataaaattaaaaagaaagattttgaaattttgttcaggcgagattatgaaaatgcattactatataaatatgctttttcagttggaaataaaaatattaaaaaatgtgcatataacattgcaatgaaaaatttaagtgtaagtgaacttagttcaggaccaggggaatttacaatagataaattaaaatatgaagatattcaacatgtatgcttttttataatgagtaagtatatgaattatgaagattttgcagatgaatataaggaatttaatctaagagcaataaaatctccattaattgaaacaagaattcaagcttcttcaaaccttgagaagtttaaaggaaaatttgatttaaaggaaatagaatatataaaaaattcaattatctctgaatctgtaagcagtgtgcgaagagctttgaattcattattagctgatgattataaaagagagaaaaagatagtgaatgtggataatttcagtgatatgacaattcatgttaaagatatatatttaatatcagtcaatattgagaataataatacttacgatcgctcagagttatttaacaagcttaaagaagacgatatggtctacttaataagagattctgataacttggataattcgaatgtaatattggttacaacagataaaggtcttgttattggaacgatacctataaatttaggggaaataataaaaaatttaattgataatggtaaatatttttatggaatagtagaaaaaatcagtgataactatgaagaaatttctataggtgtggtaatgagttatagagatgtggtagatgaaataggagatactttaatgctgttatcagatgatgtaaatgaatttattcaatagtatattataaaatattagagctttaaaataagtgaaatacctattttaaagctctaattttagtgattttctttccaagcagtcaatgccttagataattgatcaggacatgaagttcctctgtttctgcagtcaataccatgtaatttagctattacttcatctacagtcattcctttaacaaggctacctatacctaaaaggtttcctgcgcatcctccaacgaactctacacttttaactatgttatcttctatatctatattaatagttgaagaacatacaccagacgttttatatgaatacatcatattactcctttcacttaggcactataaaaaataaaaagccaataggtctgcattatagttagacttattatttcttattatatttcctaagacgcaaattaggctattataagctttatgtattatattatagtagaaatttgtcaataaataaagagattcagtgcaattacttgtaccattaattaaaaggaagaatatattaataatacaataggattatttttatgtggaggcaaagagatgagttatattattctttgtaatactgggtctgatataataagcaagattgaaacagaatcattagaaatagaaaattatattttatctggtaatgagagaaattttggacctcatgaaataactttatataatgacaatattattacagcaaataattataataatactatttcaattattcctaaattacaatttgaagaaaagaagaaaagtaacaagttgaatggtattgataagaataaaagaaagttcattactaaagggaaaaatttatatataggtgctcatccaaatgatgttattcaatataataataatgcttttgtaacatgtggtgaatccaattctgttattatgtatgatttggaagaggaaaaaattaatattaatattcctgtaggaagatttccccataatattgaattatatgaaaatgaaagatctgcttttgtaagcaatatgggagatgatagtatttctgtaattgatatagaaagcaataaagagataaaaagaatttctttggaaaacactcctataaagataaaattgtcaaagaataatcattacttatatgtatgcatgagttatcttggatatgacaaggatggttatgtaggcataatatccttagaatcattagaacttgtttacaaaatcagagtaggattttcaccagtggatttatttgaagataatgattatttatatgtgtctaatttttgtggacaatcaataagcattgttaatttaaaaatcttaaaggaagaaaaaagagtagatattactggtatgccacgtggaataattaaatttaacgaaaagatatttgtggcagactacctaaatggagttgtaaatgtaataaatctaaaaacaaaacaagcaaaagccatagccgttgggaaagagccaaatgccatgactttagttgattaactgttattttcagacattattcatcaatttgaaaaatatcagattttacacatattaatttataaatgtatttataattgtattatatatatcggaaggattatccttccatttattgcatatagctacagcttgatttttagatggtacagatagttttaactccattaataaagcttggttttcaacagcttttaaatcgacaataaagctgtcattatcacctaaagtataatcagcatgaatagttaattctttttttatagactcaattttgttttttatgtattgatcaataattgctattttagctggtgataatctagatttgaacaaggatagaacggtatcaccatgttttgttaatatcaatagatttttgtcattagccttatgatattcaacaaattttgcttcctctagctcagataaatattgttgaaatgtaaagtaatttataaaattattttcaagaattatttctgtaagctgagtatttgatattggttcttttattgccttcaatacatataacatgagtagtttattttctgctaattctgatgaactttcgtacataattacctccatgactaatgaaactctaatttcattatagcataaattaacgattagtgaatatagttaataataaaacagtaacgtaatatttactgaagtgaactaggggaggtattattttggcatggagatttagaaaaatagctatagatataggtttaatcattgcagtaataatattatcatttaccataaatgataatattcattctgttatgggagacataaaggaagaacagcctatttattctgtagatacagcagaaaaaactgtaagtcttacatttgatattaactgggcagaaaaagataatttagaaagcatattgaacatattagataagtataatgtaaaaggaacattcttcataatgggagggtgggtcaattatagtgaggacaacataaataaattaattgaaattaataaaagggggaatgaaataggaaatcatagttatatgcatcctggttttactaaaataacctttgagaaaatgaaggaggaattaaaaaagacagacgatattatagaaaaatatactggaaagaaaccagaactttttagatttccaagtggcgaatataataaagattgttttgaaaaggtcaggggattgggatatacctgtatacagtgggatacagattcagttgactggaaggaacttggtgcagatgtggagtataacagggttatgaagaaggttaaacctggttcaattatgttatttcataataatgcaaaatatactccagaaaatttagaaaaaataattaatgagcttcaaaaacagggatatgtatttaaacctgttggggagatgatatataaaaacgattacactatagatgaacaaggtattcaacataaaaatatctaaaattattgaaaataaactagtttctgtattataatggtaatatatgctagtgggtgcatatattatatgaattaataataatttccgatggagagagggataacaatggataatttaatgctaaataacaagatttacctagaaggtaaagtaacgtctgaattagagtttagccacgagatgtatggggaggggttttatacttttaatttagatgtaatgagattaagtgactcagtagatactttaaatattactgtatcagaaagattgttaagcgatatgcaactaataataggcagtgatgtaattgtcgaaggtcagcttagatcgtataacaagtttattgatgggtcaaacaagcttatacttacagtttttgcgagaaatattgaaccatgcatggaacgtagcaaaaatcctaatgaaatattcttagatggatatatctgtaaagaacctatttataggacaacaccttttggtcgtgagattgcagatgtattacttgcagtaaacagagcatacaataaatcagattatattccaacaattgcatggggtagaaattcgagattttgtcagacattagaagtcggtgataatattaaagtatggggtagactacaaagtagagaatatcaaaagaaagtttcagaaaatgaagttataaagaaaatagcttatgaagtatcaatatccaagatggaaaaggctcaaaaagaagaaaatgaatctaatattgatggcacagaaggagctgtatagctttctgtagtactaatgattaattataatagagatacttatgaaaaggctatagaattatcaatggtcaataattaatcaaaaatatacacgaaatcaaatctgtgttaaataaaaggatttcttttggaaatataactgaaagaaatccttttgttattctttattaattttaatagagttaactttataattatgtgatataacatagtggctttggagatttttttatattaaacttgataaaaatacgtttacataatatacttaataagtaaagaatttatgcaggagggttaatatgggaaaaataaaaaaatcattagcactaatattagtagtattaataagcttatttttggtaccgataccagaaaaatgtgcaaaagcggcagaggaatctaataaggtatacgtaaagataagatattgtaaaaaagattctgattataataattggaatctttgggtatgggagaaaaacaaggagggaaagcaagtaaatttttctggagaagatgatgaaggaaagtttgcagtggttgaaacaacaaaagaatcagaatccttgaattttataattcgtaaaggtgattggcaggaaaaggccacagaagatgaaaaagtagatttgcaaaatggaaatgttgagattaccattagtgaaaaggattctggaataaatagagaagataaagtattgaatacagattttgctaaagttaatttaaaactacactattacagatataaaggtgattatgaagcatcttcaacagaaggttgggttaatgaaggagacaagcaagattacgattttaaagatacagatgactatggaaaagtagttgatattactaaagaaaatattaatggatctaaggatatatcttttattataaaaaatgatatagctaatgaaagaaaaattaatttagcatatgcaagcaataaaggagaaattaatgcttatattcttcaaaatgatcccaatgtatattattataaggatcaaccaataagaaatcctaaaataacatattttaaattagattcattgaatgaaatgacatttaaagttaattctgaaattaaagattataatgatatagtattaaaagaaaatggtgtaagtatttcaggaagtagatataagataggattaaatagtgataatcttggtggaaaaatatttatgagagattgtataaatttaaatagtacttatacattagaaatacctaattatgaaagtttaaattctagttatggaaatatacttggaactaaaacatttgaagagttgtataagtataatggagatcttggagcaatatattctccatataaaacgaagtttatattatgggcaccaacagcaatggatgtaaaggttatcttatacggtaaagatggtaaggattatttaagtgcacctcaaaaaataattgatatggctaaaggaaatcaaggagaatggacatatgaagaagctggaaatttggatggggtatattacaattatttagttagtgttgatggtcaagaaaaagaagttgtagatccttatgcaaaagcagttggggtaaatggaaatagaggaatggttataaatttaagtactacaaatcctgaaggctggaatgaagataagagaccagtacttaattcaccaacagatgcagttatatatgaaatgcatattagggatttttcaatagatgaaaatagtggtgcttcattagaatatagaggtaaatataatggtgtgtggcaaaaaaatacagtgttgcctggaagtgatattaaaacaggaattgatcatttaaaggaacttggagtaaatacagtgcaaattttacctatgtatgattatgcaactgtagatgaaacaaaagaaaataatagtcaatacaattgggggtatgatcctaagaactataatgtaccagaaggatcatattcaacaaatccttatgatggaaaaattagaatacaagaattgaaaaaaatgataaatgaattgcataagaatggaatcaaagttattatggatgtggtttataatcatactttttctgcagaagattcatctttccaaaaagctgttcctgattactattatagacatgatagtgatggaaattttacaaatggatcaggttgtggaaatgaggttgcaacagagagatatatggtaagaaagtttattgtagattcattgaagtactgggtaactgaatatcacatggatggttttagatttgatttgatgggtgtatatgatatagaaactatgaacaaaataagatctgaactagataagattgatccagctatattaatgtatggagaaggatggacaggtggaacatcagagcttccagatgaacaaaaagcaataaaagcaaattgcaaggactttggaacatcacaaattggaatgtttagcgatgatttaagagatggattaaaaggtcatgtttttactgaaaatgcaccaggatttataaatggacaagaagggtttgaagatacaattaaatttggaatagttgcatctacagagcatggtgatattgattatgacaaagtgaattattcaaaggaaccttgggctaatgagccatatcaaacaataacttatgttacatgtcatgataattatacactttatgatagattgcaaaaagttgaacctaatgctagtgaaggcgaaaaattagatatgtataaacttgcagcagctattgtgtatacatctcaaggaataccttttatgcaggcaggagaagaatttgcaagaagtaaatgtgatgaacatggtaatttaattgataatagctataactcttcagatacagtgaataaattagattggaatagattaaaaagttataataatttatatgaatattataaaggtctgttaaatttaagaaataatcacaaagcatttagaatgaattctgaagaagatattcaaaataatttgaaatttttagaaaatggtaaagattttaatggaaataatgtagtagcatatattttaaatggtgctgcggtaggtgataattggggtaatattgcagtaatgtttaatgcaagtgataaagatgttgacgtaactttaccaatggatgattggacattaattgtaaataaagataaagcaggggtagatgaaatagagaaagttaaaggaaataaaataactttacctgctaatacttcatatatattagtagatactataagttatgaaaagaataagtgatgtgaaatttaattattatttaaattaaaaagtcattatataaaaaaggggctgtatcaaaacaattttgatactagccgataaaaaaagagaattcataaatttgaattctcttttttgcgcataatattaatatgaacactaataatattatacctatgcatcaaataggtttcccaataaatatagaaaatattatatctgatagtgattcagtaagagtgctttatgatgttatggagggattagattattcagaattaaatagaacttactctactattggtagaaatccagcacttttacctaaaactatgtttgcaattatagtttatggatatatggaaggaatatattcaagtcgtgctcttgaaaaggcatgcaaaagagatataaatttcaaatggcttttacaaggtcaactaccaccaggacacaattctatagatagatttagacgtgaacgattagctggttgtatagaaaatttatttaatcaacttgtgaaaaaacttagagaacttaatgaaattcaatttaaaaatatttttattgatggaactaaaatcgaagcatctgcaaatcgatatacttttgtttggaaaaaatctattgataaatttgaagatagactacaaaagaaaataaaagaaagcttaataaaaatgaatcatgatttgaatttatgtcttattattactaatgctaaaatatcagttcaagatgctaattatattttagatagtatcagaattatgattgaagccaataatattgaatttgtttatggaaaaggtaaaagaaaaagtaaattccaaagatatactgaacaacttaatgaatttattgaaaagcaaaataaatataatgaatacaatagcatttttaatggacgaaacagtttttcaaaaacagatcatgacgcaactttcatgcatatgaaagaagatcatatgaaaaacggtcaattaaaaccagcatataatatccaaataggggtagaaggtgaatatattgtaggagtagacatttcaagtgaaagatctgaccagcttacttttataccatttttagatagattagaaaagaatttaaatcaaaaatatgaatccgtaactgctgacgcaggatacgaaagtgaagaaaattatgcatatcttgaatctaagaaacaagaagcttttattaaacctgcaaattatgaaaagtcaaagacaaagaaattcaagagtgatattagtaagaaagaaaatatgtactataacacagatgaagattactacatttgtgcatctggtaaaaaaatgcttctaaaaggaacaaaaaagaaaaaaacaaaatctggatatgaaactactgttagcatctatgaatgtgaagactgtgatggctgtgaatataagagtaaatgtacgaaagcaaaaggtaataaacaaatacatgtggctaaaaattttatgcgtctaagaacaaattcacttaaaaacatcactacacctaaaggaatacttttaagaatgaacagatcaattcaagtcgaaggagcatttggagttattaaacaagattatggttttagaagattttttatgcgtggaaatattaaagttcgtactgaatttttgttaatggcgtttggttataatgttaataaattgtaccataaaaccattcaaaatcgtaacggtgagctgcttcataagcagcaagcttcgtaattttaaatatatagttaaaatatggataataatgtttatcctttatttgtgttatttcaaaataaaatatttggaaatatatacatgaataaaatttacgtttataagaataggctgtatcaaattgaatttaaaaaatttcaatttgatacagccccttttatatgtaaaaattagaatactatttgatatagaaattactttcttaaatcatctaaaagttgagttttgtcttttgtcttgtcatcaacttgtttgattatctttgctggtgaacctgcaacaacaactccatctggaacatcttcagttactacagagcctgcagcaacaactgaaccttttccaattttaacaccttcaagtattacagagttagctccaattagagcattatctccaatttgacatggctctttgcttggtggctctaaaacacctgcaacaactgcacctgcacctaagtgaacattttttccaagctgacctcttgcaccaactacagcgttcatatcaaccatagttccatcaccgatttctgcaccaatgttgattacagctcccatcattacaacagcatttttgccaattgtaaccttgtctcttataatagcacctggctcaattcttgcatctacttcaagtagatctaacataggaattgcagagtttcttctatcattttctattctgaagtgttttataagatgtttattatctaatactattttagttatagaatcggattctcccattaataagtagaaaccattagatccataccattctacatcattcatttcagcgctgcttaaatctccattaacatatacctttactggagtagatttttttgattccttaataaatcttgctatttcataaggatctgttaaattatatgacattatatcatcctttctctatacatttgtaatctatttaattataataaaaaacatcaacaattgaaagagcaaaaatagaaagttttacaaaatatatgtacatttttgtatatggataaaatagttcaatatgaacaatttgatgtaatcaaaattatattgtaaaatagagttcatacaatataacaagctttaaataaattagtggcatatttaaaaaataaaattgttaactgttaaccgttaactgttaactgaaaaagttgggggttcatatatatgaataaaagagtagaaaaaattcaaatttcaggaataagaagatttgcagaaaaagtaaagaaagttgaaggtgcaatttctcttacaataggccagcctgattttaatgtaccaattgctgttgcaagtggaatgataaatgcagttgaaacaaataaaacatcatatacttcaaatgcaggaattgacgagttaagagaagaaatatgtacatatttaagaaattttaatataaagtataataaagacgaggtatgtattactgttggtggaagtgaaggactattttctgtattttttgcattaatgaatacaggagataaaattttgataccaggtccagcttatccagcttatgaaaatatatctacaatgataggtgcagatgttgtccattatagattaaatgatgatttcacaattaatattgatgaaataaaaaataaattagatactgaagatattagatacttaatgttatcttttccttcaaatcctacaggagcaatactaacaaaggatcagcgagatgaacttatagaaataataaaagaaagagaaataactgtgataactgatgaaatgtatgcttctattatttttgatgaatattattcagttgctcagtgtgatagtataagagataaagttatttttgtaggtggtttttcaaaaatgttttcaatgacaggtttaagaatagggtatgttgcatgctcagatatatatatgaaagaaataatgaaggtacaccaatatggagtatcatgtgcaccttcaattgctcagtacggtgctcttgaaggtttgaaaaaagcaatgaaagatgttgaaaagatgaaagagtcatttgaaagaagaaagaattattgtataaaaagattaaaagaattaaatattgatgttgtagatccgaaaggtgccttttatatttttccgagtattaaaaagtttaatatatcttcagaagaattttgcgaaaggcttttgaacgaaggaaaagttggatttgttccaggaaatgcttttggagattttggagaaggttatatgagaatatcatattgctattctgatgaaattttaaaagaagcttttgataggttagaaaaatttataggagataattttaaaaactaaaagtagaatgaagtttaatagtaacaattgtatattaaatataaataaagagaattcaaatttgaattctctttatttattagtttttttataaagtgtaaaatattagtatttcattaaaaatattaaaaagataaagttttaataaaaaatatctcatattaatattaaaaaagcaattataatgctttttgtatgaaaaattaatattttatataaaaagttaaaactttaaaataggaatttaaagaaaaataaacaataaactaattataactgataagtgttttctctaggaagacagatgtatttttaaaaaagatactattttttaagtgtaaacaattacaaaatgaggaaaataaaataaaatggaaatacactagtataaaattaataaaatgttaaaaataaagctataaagtaatagcttgaaattttataataaattgacaataaattatattcttatataatgatttaataagtataccttgttgataaatatcgaaatataagtgagggagattgaaatgattaaatacataggaaagagacttgttgcaagtttgctaactatatgggtagttattacactgacattttttctaatgagattaatgccaggtggaccatttgatagtgataagcttacaccacaagtaaaagctaatatggaagctaagtatggaatggacaaaccacttagtgaacaatattttatgtacatgaagaatttagttcatggtgatttaggtgagtcaatgatatttaagggaagaggagtaagtgaaactataaagacttcatttccagcatctgcaaaagtagggatgtgtagtgttgctacatcaatagttgtaggtatatctttaggaattgtagcggctttaaaaagaaatacttgggcagatactacaatagtgtttgttgtaacactaggtattacaattccaagttttgttattagtgcagtacttatctacttcttagccgtaaagtttggattgttgcctccaacgggatttagtggatggaagaattatataatgccggtaattgcattatcaatgtcttctatggcatttataactagacttacaagaaataagcttttagatgtacttaaatctgattatataagaacagctaaggcaaaagggttaagtaaaggaaagatagttttcaaacatgctcttagaaattcattaattccaatagtaacatatgttggaccactaattgcaagtatacttacaggaagctttatagtagaacagatttttgctattccaggtcttggaaatgaatttgtacaatctgttactaatagagattattcaatgcttcttggagttacagtattctactgtacaatgcttatcacatttaacttcttagtagatgtattatatgttgttattgatccaagaataaaattagaaaatgctgaaagttagggggagcggaaaatggaagaaaatttaagtattgatagagaactatttactcctctaactgatgaagaaaagaaaatagatgtagtcgtaagaccaagcatcagttattggaaagatgcatggatgagattaaaaagtaataaggttgctttaggatcgttgttcatggttataataattatcttatctgctataattgtaccaatgttttctcagtatgattatgcagcaaataatttaagtatgactaatttaaaaccaagtgcagaacatttatttggaactgatcagcttggaagagatatttttgtaagagtattctatggagcacgatattctcttacaattgcaattgtagctgcatttattaatcttgttatcggagttttatatggtggaattgcaggatattttggtggaaaagtcgatgcaatattaatgagaatagttgatgtaatctattcaattccattaactatatacgtaataatattcatggctatattgagaaaacctggaagctctggaagcggtctcgcaactataattttagcactttcaatttcgtattggattggaatggcgagaattgtaagaggtgatgttcttcaattaaaacaacaggaatttgtacttgcatctaaagctttaggagcatcgaattttagaatattaataagacatttaataccaaactgtatggggtcaataatggttactttaacattgttaataccagaagcagtatttacagaagcattcctaagcttcataggacttggtcttgtaccgcctaaagcatcacttggaacacttgcaaatgaagctatgaaagctatttacacatatccatggcaattattattcccagcagtaatgatttgtctaattatattatcattcaacctttttggtgatggattaaacgatgctttagatcctaagaataagagataggagaaaaggaaaatggaaaagttattagaggtaaaagatttaaaaacttcatttaaaactaatgttggggaagtacaagcggtaagaggagtatcttttcatttagataaaggtgaagctttagggattgttggagagtcaggatgcggtaaaagtgttaccatgatgtcaataatgagacttttagctgataatggtaaattaacaggcggagaaatacattttgatggaaaagatatttctaatgttaaagaatctgtaatggaaggcataagaggaaatgatatcgggatgatattccaagatccaatgacatcattaaatccagtttatacaattggagaccagcttatggaaccaatacttaaacataaaaaaataagcagagcagaagctaaaaaggaagcaatagaaatgctttctcttgtaggaataccaagtcctgaaaaaagaatgaaacaatatcctcatgaattttcaggtggtatgagacagagagcaatgatagctatgagtttaatatgtaaaccaaaacttattattgcagatgaacctacaacagctttagatgttacaatacaagcacaaattcttgatcttatgaaggatttaaaagaaaagcttaatacatcaataatacttataactcatgatttaggtgttgttgctgacctttgtagtagaattaatgtaatgtacggtgggacaataattgaaacaggtactacagaagatatattctatagaggaagacatccatatacatggggacttttaagaagcgtaccaaatccaaaggaaaatacaaaagaaaagttaaaaccaattgaaggacagccaccagacttactaaagcctccgacaggatgtgcatttgcagcaagatgtgaacatgcaatgaaaatatgtctacaaaaacagccaccattatttgaaaatggtgaaaatcataaaactgcatgctggctatgtcataaggatgcaccaaaggttgaatcacctataaggagggataagtagtggaagataagaaaaatgacattattttagaagtaaaagatctatgtaaatacttccctgcaaaaaaaggattatttaaaaataatagttatgtaaaagcagtagataaagtttcttttacattaaaaagaggagaaactttaggtcttgtaggtgaatcgggttgtgggaagactactacaggtagaaccatattaaagctttatgaaccaacaagtggacaaataatctttaatgggaaggatatcacaaaatattcaagtaaggaaatggtatcattaagaaaaaaaatgcagatgatatttcaagatccgtatgcttcattagatcctagaatgacagttggagatattataggagaagctattgatgtacataaacttcttacaggtgaagaaagaacacaaaggataagaagtctgttatctaaagtaggtcttatgagtgatcatataaatagatatcctcatgaattttcaggtggtcagagacagagaattggtattgcaagagcattagctgttgagccagatttcatagtatgtgatgaacctatttctgcacttgatgtttcgattcaggcacaagttataaacatgcttgaagaattgcaagaagaacttggattaacttatctgtttattgctcatgacctttctatggttaagcatatatctactcatattggggttatgtatcttggtcagatggttgaaaagggtggaagtaatgaagtttacagcaatcctaaacatccatatacacaagcacttttatcagctgtacctattcctgatccagaaattgcaaaaaacagtgagagaatagtacttgaaggagacattccatcgcctatagatcctccaccaggatgtagatttaaaggaagatgtaaatgtgcaaaaccaatttgctctgaagtagatcctgtgcttaaggaagttgaagatggacattttgttgcctgtcacttatatgattaagaagtaaaattccaatgggattttaaataaaaaatcagctatatgatttaaaagtatactaaaaactgttaactgttaaatgataactgttaactaaataaatagggggaatatattatgaaaacaagcaaaatcaaaaagatttgctcagttgttatggcagctatgcttggagtttcagtcctaactggatgtggttcttcaaatagcggttcatcaacggtagcaagcggacaagaattaacatttaatttaggatcagatgtgaagactttggatccagcattaaatcaagcagttgatggtgctatattacttgtaaacatgtttgaaggtctttataagttagacgaaaatcaaaaagctattccaggtattgcagaaaaatgtgatatttctgaagatggaaaagtttatacattccatttaagaagtgatgctaaatggacaaatggtgatcctgttaaagcaggagattttgaatatgcatggaaaagagtaatggatccaaacactgctgctgaatatgcatatcaaatggaatacattaagggtgctaaagaatatacagcaggaacaggatcagttgatgaagttggagtaaaagctatagacgactcaacactagaagtaactttagtatcaccatgtgcttacttcttagaattaacatcattcccatgctatttcccagtagacaaaaaagttgttgaaggaaatgatcaatggtcaacaagtgctgcaacttatgtaagtaatggaccttttaaacttacagattataaaataaaagaccaagtagtattagaaaagaatgatacttattatggaaaagattcagtaaaacttgataagatcaatgttaaaatggttgctgatgaaacttcagcttgggctagttataaggcaggacaatttgatatggtttattcagtgccacaatcagatgttgatgcagcagtgcaagatggaagtgctacaacattcccattattaagcagttattacttatcagttaatatgacagattcattaaattcaattgatccagaagcagcaaaagctttgagtaaccctaaggtaagaaaagcgttaactcttgctattgacagagagtctttaactgcaaatgttgttaaatcaggatcagtagcagcatttagtttagttccaacaggaattaaagatagcaatggaaaagatttttcagataaaaaatactttgatactaaagcaaatgtggaagaagctaaaaagttattagcagaagcaggatatcctgatggtgaaggattcccagcagcaacacttctttataacccagaaggtggtaacggaacagtaatgcaagcagttcaagatatgtggaaaactaatcttggaatagacattcaattacaaagccaagaatggaaagtatttattgcaacaagaaatgctaaggattatgaacttgcaagagatggatggaatgctgactatgttgatccaatgacattcttagatatgttccaaagtacgtcaggtcaaaataattcaggatacaacaatccagaatatgacaaacttattaatcaagtaaaatcagaaacagatcctgctaagagacttgaaatatttagacaggcagaagatttattaatgactgatttaccaattataccattatactataaaaaccaaactatgggtgttaagagttacatcaaagatttagtggcatcaccacttggatatatatactttgataaagcttatattgaaggaaaatagaatttagtaagtaaattaatgttataagaaagtgctatacgttctaagataggatgtatagcactttttatatataaagaaaaaaatttttcatgaatatagacataattatataaaaaaagtacaataactatatataggataacattaccatactactatataaaattaatctgcgtgtatattttagaggaagaggggatttttataaagggcgaagatttaactataacatcaaatcaattaataaaagtattaaataaaacaataaattctattgatggaagatttatagaacatgggaatagagtttcctatataatatttaatcttttaaaagtgtcagggaaatatacagatgaagaaattttgaaaatttctgtcatctcaatctttcatgatataggagcatataaagtaactgaaagagataagttactaaatgcagatatggaatctccagtgaatcatgcagtatatggagctttatttataaagaatttttcaccattagctgaatattatgatgttgtgttaagtcatcattttacaatggattattatagaaaacgcaatatggaagtactttcttatgaaggtcttatgttgagttttgcagattatttggatagattaactttaaataatataaaaattgattacaataaaattaaaaagtattatctaaaagagcattttgaattgtttaaaaaggcagatgaaaaatataattttttaagtaagttatctgatggaacgtacataaatgaactcgatgatttttttaagaatagattcattaatgaggaaaaagttatgagctatagtaaaatgatatcttatgcgattgattttagaagtgaagcaacagtaatacatacaataacagttgaagcaataagtgagcaacttgcaagattgtgcaaactttctgaagaaaggatatcactgataaaaatatgtgctattcttcatgatataggaaaaatagcaattccagtagagattttggagaaaccaggaaaacttacggaagaagagtttgaaattatgaaaaaacattctcaaataggatatgatattctaagtgaattgagtatgagtgaaataagggatatagcaacactacatcatgaaaaacttgatggaagcggatatccatttggtttaaaagaagagaaaataacaaaagaaatgagaatagtatctataggagatattattagtgcattaataggtagcagaagttataaacaaagttttagtaaaacaaaaatagtttgcatattaactgaaatggttgaaaataataaaatagataggaatattgtggatttatttatacataattatgattatataatagatgaggctatgaagcagtgtagagacacaatggacaagtacttaaatataaaaaatcaatatagagagctaatagaaatatatacatagtaccaatagtaaataagatatttgtaaatttaaaaaatgtacaaatatctttaatttttatatctgaatattattataatttatctaaaaaggtttgttcttaataatgaaaagaaccgaaaagcaggttctagaacattttgtattgacagaatgaagaaaattatctaaaattaatgataataaatatcagttgaatataatttgcgatataagcagtgcgaacgaggtaaaagatgaaaaaagaattttcaatttgtggattgactctaaaaaactatggaaaaatacaggactatgtaaagattttagatacagaaacaaaaattccggttactataattaatggtaaaaatgaaggtaaaacagtactaataacagcaggtatacatggaggagagtatccttgtataagaacagctatagaacttgcaagggatataaatccggaaattgtgaatggacagataataataattcatccagtaaatatgcaagcatttaaagataaaagtgcaggaattgtaccggaggatggtaaaaacatcaatagggtatttcctggtgataaaaatggaactataagtgataaaattgcatatgttattactcatgagtttcaagataaagctgatttttattttgatatgcatggtggcgatcttcatgaagaacttcatccatatgtatattatccaggaatttgtgaagatgaaatatgcaatagatcaaaagaaattgcaaagatttttaatgtagactacatggtaaaatcaaatgcaacaagcggagcttataattctgctgccataagaggaattccaagtattcttattgagcgtgggggatgtggcatatgtagaagagaagatgtggaaaagtataaaaaagatatgataatagcattaagaggattaggtgttttagaaggtgatgtacttagaagtgaacagtcaccaattgaaataactaatgtgaaatatatagattcattaaaaaatggatgtcttgaaatgtttgtaaaagctggtgaaagaatagtgcaagggcagaaattatatgaggtaattgatttgtttggaaatgttattgatacatattatgctgagtttcaaggcatagttttatataatacagtatctcttgcaataaataaaggagagtccatcattgcatatggcgagctaaatctataaaactatataagtatggaaatagattttgtaattaacaagtaacatctaataaatgcttacaactttttattagagttaaaatttataagtaaatagatagtatatattaagaaatcgctgagactatatttttatcagcgattttttctttattattgacataagaataagtattatttatacttataaagaaaatgcaaaccatttgcaattaaaaataaagtgagaaatgagtgaataattataggaaaatttataataaacaggtttttaagagctatattaataataatagcagtatcttttatatcattttctttaatgtatttatccccaagtgatccagctgaaatgatgttaaatagtcaggggatatcagtaagtacagaagtactagaaactacaagagaggaacttggtctgaataagtcttttacagaacagtatgcatattgggtttctaatatacttaaaggagatatgggaaaatcatattcaacacaaagaagtgtcgtaacagagttaaaagaacatatgccatacacaataatgctaactttatcatctatgataataactttattgatatccattccactaggaatattatgcgcacttaaaaaaaatagtcttacagattatattatcagagtatgtacatttataggaaattcaattcctggcttttttgttgggttaatattattatttgtttttgcattaaaattaagaattttacccgttttaagtgaaagtggaataaaaagtattatattgccatctgttaccttggcaatatcaatgtctagcagatatataagacagataagagaagttgttatggaagagttagataagggctatgtaaaaggtgcttattcaagaggtgtgccacaatggaaaataatttatagacatgtatttagaaatattcttattacagttataacattaataggactttcagtaggatcccttttaggtggttctgcaatagttgagaatatatttgtatggccaggccttggaagtcttgcattaaatgcagttaaagctagagattaccctcttgttcagggatatgttatgtggactgcaataatatttgtaataataaatttaatagttgattttatatatggtattttagacccaagaactattaaaaataggagaaattaatatgttagcaaaggataaaaaaatatctgtagagttaagatttaagttaataataattattttagtattaataattattgtgggtattatgtctccagttatagcacctaatgatccgtataagactgatttgtttaatacactcaagtcaccatcaatagagttctggtttggaacagatgctcttggaaggtgtatattttcaagagtactctatggaatttccaattctattatatcggcaatgactatagttttaattactttttcaggaggtactataataggtgtaataagcggattttatggaggaattgtagatgaaataatcatggggattgtagatgtttttctatcttttccgggaattattatagcggttgctgttgcaggaattcttggaggaggacttaaaaatgcgatgatagcaattggtcttatttcatggcccaaatattcaagacttgcaaggtgtgaagtaatggcaataaatagtgaaacttttatattagctgcaaaattaagtggaaacggaaatctgaaaattattttaaagcatataattcctaatattataggagcactagtaataacagcatcagcagatgttggaattatgataatggaacttgcaggattatcatttttaggattgagttcaccacttccaataccagagtggggatctatgatgaatgaggggaaaagcatgctgcaatctgcaccatggattacattatttcctggaacagctattcttatagttgtcattttatttaatcttttaggcgatacaatatgtgaacttcttaaaaatggacaaaggagataagtaaaatgagaattagaatacgtatgtatatcataagtatattgataattttagtgtttaccatattttgcggatgttccaatgctttgtggaaatcaagtgatgaactagtatttggaacaactttagcaactaaaagtctagatcctgctaaagaatataatggatggtttactgtacgatatggtatagcagaaactttatttaaactcgataagtttatgaatatcattccaaatctagcagaggattatgaaaatatagatggtgagacatggctgattaaaataagaagagatataaaatttcataatggtgaaatgatgactccagagaaggttaaaaaatcattggaaagaagtttagctttgaataaaagagcagaggatacattgaaaatagaaaatatagaatatagaagtaaaggattgggaacttgtaattactacaaaagaagttaatccaacttttataaatgatttgtgtgatccctttgcatctattattaatgtggacgcaactgaagactttgataataatcctataggaacgggacctttcaagattggaagttttaatttgaaaaatactagttatttagataaatataatgattattggaagggtgagccaaagctaaataatataaagataattcatgtatcagatgcagatacacttacaatggctatgcagactggtgaaattgatgttgcacaaggagttccttattcttcagtgagtctgtttgaagatgaatcactatataaaataagtagtattgatacatcacgtatgatattgatgtactataattatgagaataaatttttaaatgataaaaacctaagaaaagctattagtatgtctattaataagcctgaatatacatcagtgcttttgaaagattcagcatcttatgcaaaaggaccatttccagaaggaatgaaatgtggaggaaatagtattaatgtagatgattataatgcagatgaggctagaagaattctaaaagatgctggttatgaagataatgataatgatggaatactagaaaaagattcagaaaaattggaactaaaacttattacatattcttcaagagcagaactgcctattttagcacaggcaattcagagtgatttaaaggatataggaataaatgtttcagtagaagtaagtgataatattatggatatattaaacaatagtaagtttgatatttgtctatattcaaatgtaactgcacctacaggagattcgtatgcgtatttaaataatcttataagaagcagtggtgcatcaaattatggacagtataaaaatgaagagtctgaaaaatttttagatttaatggaaagtgaattggataaggagatgagagattatcttgctataaagattatacaaaatagcattgatgataatggatttgattttattgctcatctgaaaatgaagtttataatgaaaagtaatgtagttaattttgatattcatcagacagattattatcaaattaactgggaaacaaatgttgaataattattgtccatggagaaatatatgagtatgttatttgaagtaagaaatttaaatgtgacaaacagtaatgtaaaaatacttaagaatataagttttgaagttgatgaaggtgaagtacttgggattataggtgaaagtggatgtggaaagagtacactacttagagctattacaaaaatgactggagaaactgaaaaaataactcatggagatgtgaaatttaaccacatgagtatatcagatttatcagaagaaaaaattcaaaaaataaggggtagggatattggttttgtttttcaaaatccggcatcaactatgaatcctttaataaaaataggaaaacaatttgtagaagcgataaatgtccataaaaaaatgaataagaaagagtgtcttagatatgctgaagaattattaaaaaaattaaatctaaatgatgctaaatgcattttggatagctatacatttgaactcagtggaggtatgaatcaaagagttgctattgcattggcaatgataatgaaaccaaaacttcttatttgtgatgaacctacaagtgctcttgatgtgactgttcaggcacaagttgtcagggaactgatatcacttaaaaatgagtttaatacagggatgatagttgtgactcatagtatgggagttgtatcttgcatggcagataaaatagctgttatgtatgcaggtgaaattgtagagtatggaacatgctatgaaattttaaataaccctttccatccatatactaaagcccttataaattcagtacctaaaatgaatggagtactacctgaaccaataagaggaaacatgcattcttttgaagtatatacagaaggatgcagatttgaaaaaagatgtgatttttgtaatgagaagtgcaaaagagaaagaatagaattaattgagttaaaaaagaatcattttgtaagatgtagtattttacaaaatggtagttctagtttagaaataaaatagttaagaaataaacaaataaaatatagatactaaaaagagagtattttaaaatgaatgatattatattagaatgtagaaacttgagaaaagaatttaagaaaaaaggtcatgtacatatagcagctgataatataagtcttgaactttataaaggtgaatgttttggaattgtcggagaaagtggaagtgggaagagtactcttgctagaatgatcatgaagcttgaaagtagtgattctggagatatactaatcgaaggaaaaaatatatcaaagtttaaaggaagaaaaaatagagattattatagtaaaatacagatggtatttcaagatgccaaaggttcatttaatccaaaaatgacaataggaaattccatattggaatatgtatgcaatttatgttatatagataaaaaacaaagaagaaaaaaggttgttgaacttttagaacaggttggattaagagaagaacattatgatagatatccatatgaattaagtggaggccaatgccaaagagctgctattgctagagcactatcggttcatccacaagtgataatttttgatgaggctacaagtggactggatgtttctgttcaggctcaggtgatagaacttttaaaaagaacaatggaaaaaagagaaataacatatttgttcatatcccatgatttaaaacttgtaagtagcttctgtcagagaatgggagtaatatataaaggaaaacttgtagaagaaggaaaatcttacgaagtaactaataatcctaaaagtgattatacgaggcttttgatagaatcagcattataacgaaaaatatagtaaataaaaagtttcctattcatacttaatttaaaatggatcctgtgtcaaggacactataaaaaaagtgttatgaagctaataaaagatgatttctatattgtttaggagtcatcttttttagattccactgatatctgtaattattataatagtcgatgtagtcatcaatcatatcaataagttcttcaagtgtattacatgattgaaagtctatttcatctttcatatgcccgaagaaggattcttgaggcgcattgtcccaacagttgccacgacgagacattgattgaccaagattattatcctttagaagtttttggaattttggactagtataatggaatccttgatctgaatgaacaaatgcactttcatgtaagtcatctttatggtgcgttattaatttatttatagtagttatagcaatatcaagttttatagaatctgaaacatgataagatagaatatcgttgctactaccatctttgatggtagacaaataagccatatgattatttccatatggcaagtatgtaatatccgtcaataatacctttcccggcactccttgcttaaaattacgttctaataagtttggaactactgtatgttctttggttgcttttgccattcggcggtacgggttggcttttctaataggacatttaatattatattttctcataatacgttgaattttctttctactataaattatagaaagctcattttctaaaaccatttttatagaacgggatcctttgctataacctttgtaattataagccataagaatattgtctctagcttccaaatctttattttccattaatatttgattatcaagtgtatttagataattataatatcccgagcgtgaaacatttaaaagatcacagaaatatgaaaccatatttttatagctattattagtgatagtttcatatattaacttaaatatctccttaccttctagatttacgctgctgtttaccagcctcctttctgtcacgtctaatttttttaacagttctaattgctcctctaataacttaattttagcttcttgtttttgaataatatcatctttagataattgcttttcacttggtcgtccagagttttctttcctagtatctcttaatcctacaataccctcttttctataagatcttatccatctagctgccgcttgttcgtatcttctttgtccaaggatttgtgtatcaaaaccagcgtcattaaaaataattttaggtgtttttccttttaaatattcttctataaataatcgcttaaactcgtcagagtaagttatagatttttcacttactttaactacataaggattttcattcagtaattcaatagtttctttatcaaatgttatcttactcatgtttttcctccaatatagatattattattatacaaaaaagtacctataaacgagacactttttttcaaagtgtcctgttcataggtaccattttaattattgtatgaactaggaaactttttattttatatagtaagcttttcactttttgaaatttaaaatatatgactgttaattagtcattaagtccaataacatcatccatattatataaacctggttctgttatagaagccatgaattcacatgcttttaatgcaccaacagcaaaaacttctcttgatatggctttatgagtaagttcaattatttcaccacttccagcaaaaataacatcgtgatcaccaactatagagccacctctaattgcatgaattccaatttcgttttcttctctttttgcatgaccttctcgtccataaacatattttgtttcatcctttagagaatctcttattgtgtctgcaagtaaaagtgcagtaccacttggagaatctaccttttggttatggtgtttttcgataatttcaatatcatagttaccataaagaagaggtgcaactttttttaataaagaatttaataagtttattcctagtgacatgttagcagatctaaaaagaggaagggttttgctcttttcatcgattaaagctaattgttcatcagaaaatccagttgaacagataacaagtggttttctagttttttctgttaaagctagaaggctgtttaaagcatctgctcttgagaagtctaataatacatcatattcaatgtttaattcttcaggactactgaaaacaggatatgatatatcacttgggaatctatcaattccagcaacaatttttacatttttaaattttgtgcagcattcggtaatcattttacccattttaccacaacatccatttaacactacttttaccatactatctcaccttacattaatttatttgcctttaaagttgtttttaaaacatcttcattattaggttccatttcacaaagtggaagtcttaatgaaccaacttctaatcccattaaattcattgcagttttaactgggataggatttgtttcaataaataaagagtttgctaaagatagagtatcaagctgaatatctaaagcacctttaaaatcatttttaagacatttttctgccatttcatgaactttatcgggaattatatttgcaagaacagatataacaccttttccgcccaaagacattatagaaacaacctggtcatcattaccagaatatatatctattttatctctgcataattcttttatttttacaatctggctgatatcgccactagcttcttttactgcttttacattgcttagttcagtaagttttaacaatgtatctggtttaatatttacgcctgttcttgatggaacattataaagaataataggtgtgtttacttcatcattaatggccttaaagtgttttattaaacctttttgagtagtcttattataatatggggttattacaagaagtccatcaacaccaacactttcagcatacttactcatagaaatagccgtagttgtgttgttagagccagttccagcaataacagggattcttttgttgaccacatcaacagtaaattttattgtgtcctttttttccttttctgtcattgtggtagcttcaccagttgtaccacagattatgactgcatcagtacctttttcaatatgccattcaagcagagttcttagcttttcaaaattaactccttcatcattaaaaggtgtaataatggccaccccagaaccttcaaatattgacattataattcctccaattaaattactaaaactatttatcattctttatcattagtacttataatgataatttacaggcatttttcttatgttttagacattaaatttttataacaacaagatatttttatgatattaatattttttttcttcttatataatatcatatacatttatgccttttgtgtttcaaatttaatttcaatgaataatcactttatagaataaatacttcataaaaagtaataaagaattgctgataaaatcatgtaaattactaaagacatatattttttacatattctaagttatgtttcagatatataaatagaagttttagtatactgtttattattttatacatatttagtataacctatttttaaggaagacgtctatataattgaataggcttaaatgcatttaattatatagaaataacacttctaatttattaaatatattaataaattgatttacctttacacaataaaactaatgattatttaataaaaaatatacaaataaataaatatatatacaaatactatagataaatatttaaaaaatagcaagtatataaaggaaataagttgaaaaaagaaaatgattttattaaagtgtatatttatggtcttatgaaatttagaatatgaaaatgatatttggagataataaaaatatgtaagaaaaaatagaggaaatgcggtgatattttgagtaatactccattaaaaaaaataattaaatcgaagcttaagggaaataaggaattaactgaagcagagaagatgagagaaaaaataaaatatgagattgctgaagaacttggacttagtgataaggtaaaaagtgaaggctggggaggactttcagcagaagagactggacgtataggaggtcttatgacaaaacgtaaaaaagtattaaatatgccatcaaatgatgaaatattaggaagacgcaaaaataaatcataaaattttacgttacgtcactgtattactatgtttttcatactcggatgtttgactaacttaaaaattaagatataatatattagatgatgtatagacttacttaagggcgtgataaatgtggcgtacaatgaatttgcaaatatttatgatgaattaatatatgaagatattaactatgataaagttgcagaaaagattttggaaatatgtaaagataataatattaaatttgaagattatttagatttagcatgtgggacaggtaatgttgcagtgaaagtatgcaaagaatttaaaaatacttttgccgtagatctttcagatgatatgttaaatgtggcttttgaaaaatttaaagcaaataaggtaaaagcaaaagtaatatgccaggatatgtgtgaactgagtttaaatcataagtttgatcttataagttgtgttctggattctacaaattatataactgaagatgaagatttatacgattattttagcagcgtatatgatcatcttaaagaggatggattatttatatttgatataaattcatattataaattaagtgaagtattaggaaataatatttacacatatagcagtgaagatattttttatacatgggagaatgcttttgaaaatgatgtgttaaatatgtttttaaccttttttgtaaaaaataatgaaggtttatatgaaagatttgaagaagaacacattgaaagagcgtatgcagatgaatatatagaacaagtcttgaataaatgtaaatttaaattaataggaaagtttgatggatatagtaatgataaagttcatgaaaacagtgaacgaatactttacattttaaaaaagtagaagtaaataagaattatacagggagatgaaaaaatgcaagataaaatagttaaggctacagccaaaaatgatatggttagaataattgcaggtattacaacaaatttagtaaatgaaggaactaaaattcatgatacagcacctgtagcatcagctgcttttggaagaatgcttacagcaggggcacttattggatcaacattaaaaagtgaaaaagaaattactactttaaagataaatggtggcggagaaattaatggaattactgtaacagcgcatagtgactgcacggttaaaggggttataggaaatccatacgtggacagacctcttaatgaaaaaggtaagcttgatgttggcggagcaattggaacaaatggtatgctttatgttattaaggatttaggtcttaaagatccatatgttggtcaagtaaaaattcagactggagaaatagcagaggattttgcatattattttactgtgtcagaacagacaccatcagcagtttcccttggagttttagttgataaagatttatctattaaagcagcaggaggatttatagtacagatgcttccaggtgctgatgaactgttagcagatttaataacatatagattacaagaaataccgccaataactacattaataagtgaaggaaagactattgaagaaatattagaatttatatttgaaggaatggatttaaaaattcttgaagatgtagaaccagaatataaatgtgactgttcaagagaaagagttgagaaagcattaatatcgatagggagggatgatttacaggaactttatgatgaaggcaagtctgaagagatagtttgtaacttctgtaataaaaaatatgaatttactcatgagcatattggagatttgttaaacagtaaaaattaatttttatgaatgcatatgctatgattataggataatagaaaaatggctgatagttaagatttaactatcagtcattttttataaagaaatatttgtataaaatttaagtggtaaaagataatatcaattatatttaatggatggttaaacagtatgtatatattggcaaatattttgtatatcaattaagtgaattatgtaaattttaaacattaattataaattaattattttagaatatatattaataaaattgtcacaattacaaaaaggaaaatatagaatattatggtatcatatattggggatgaatttataggactaatattgtttttataaattaattaatactagaatagaggtatagtgatgattaacaaaatatcagaaaatgaacttatggaatcattttataatttaattccatattttgaacatttttttgggacggatttggtttttacaatttctaatactgaaagatttcttttggttaaagataatgacaaattaaggatggttgctaaaacaggtgatattattcctaaaggatgtgcggcagatgtctgtttaaaagaaaagagtaaggtttatgtaatggttccggacaatgtatttggtgttcctctaaagactatggcagtacctgtaatggtagataataaaatagagggaactatagtaataggaatgagtgttgaaaataaagaaaaaatgtcaaatatggctaaaacactgtcagaatctttatctcaaatgagtttaaatgcagtagatatggcatcaagatttcaggagataagtgagacaaatttgggtataggagattttataagtaagacaaacgagtattctaaaaagacagatgaagtattgtcttttgttgaagatatagctaaacagactaatttattaggattgaatgcagctatagaatcagcgagagctggtgaatatggaaaaggatttagtgtagtatcaaatgaaataagaaagctttcaaaatcaacaaaagaatctatagaacaaattaatacaacattgagaaatattcaaaattccattggtgagatagagagaagatttgaaaattcaaataatctactagaaaatcagactgctggactagaagaaataacagcaacaatacaggaattaacttctaatgctgctcttttaaatgaatttgcaagtacaatatagaggatggtgggtataatgaaaataacaacattaatagaaaattcacaagatgaaaaaggtttgttaaaaaatgaacatggattatcaatttttattgagagttcatatggaaacatattgtttgatactggaaaatcaggtgatttcgtagagaatgctaaaaagatgaatattgacttaggaacgataaaaacattagttttaagtcatgctcactatgatcattgtggtggggttaaaaggcttttagatacatataatgtagctccaaatgttattgttggaaatacattttttaaaaatagtgacagatatcattattctgatggtggcttaaaaacagatttttccggagaagttggatataaatatgttggtatagattttggagaagaatatttaaaagaaaagaatataagtattaattatataaaggagaatatgtataaggtaaatgatgaagtttatatatttactaatttcaaaaagattcatagtatagaaaaagaaaataaaaatatgcttattaaagtagacaaggatcaatatataacagattcttttgatgatgaagtttccattgggcttaagacaaaagatggtattgttatattattgggatgtgcacatccgggctttttaaatataattgatagtattaaggaatttacaggagaaaaaatctgtggtgtcataggaggaactcatcttgtagagggagatgatgagagaataaataaaagtgcggattatttagagcatatgggattaaaaagtataggactttctcattgtacgggagaaaaagcagtaaagatatttgaagaaaaatgtaaaaatacatttactaatagaacaggtacagttattgaattttaaatggataataagaagcagtctgaatttagactgcttttttagtcttacaacaaattgtgaattttatatttagaatatttggtatgtttatactataagtatagttattgaaaagatgtaacttaattaaagatgattttagtgttcatatgaatcagtttataaaaaagtagtcatattattttggctaatccaaatgtaccaacaggctttattgtatatatatctgagatataaagaagaatagtaagtgatttagaaaaattatttataattgatgaagcatatattgattttgataattattaaattataagtttaagtgaaaggaagatatatgaatatgtttgttaaaaatggaactggagtattaaagagagtactattgtcaaaaccagagtacttaaaagctgctaaaataaatgagatagctaaaaagtgggatttggatttaaatttgaaaaagatgaaaatagaacatgagttattagttaaagcatatgaagataatggagttaaagttgagtatttagaagctgataaaaatagacctaattcagtctttgcaagagattttggagggtgtgtaaaagaaggatatattttagggagatttaagcttcccataagatataaggaacatgtagattatgaggaaaaaatgaaagaactcaaaatacctgtgatagcaagagttgagaaggggatttttgaaggtggggattttatgtttcttaatgaaaaaacaatagctgttggtatggctgatagaagtaatgaagaaggtgtggaagaaatacgaaagcagctatcacaatatggatatgaggttattggtgtaaagcttaagaaagaatatcttcatttagatatgtgttttaatttagttgatgataatatagcagtatcatataaagaaggtcttccagaggattttgttaaactgatagaagagattggaatagatatagtatctgtaccagaagaaagtatatttgaacatggatgcaatcttcaggcaataggaaatcatagagtattgtctttaaagaaaaatgtaaaagtaaatgaggaacttaaaaaaagggggatgcatgttatagaacttgatataacagaaatcttaaaggcaggtggtggtcctcactgcatgacatttccattggaaagaatttaataaatgtattgtatggaataaaactatagattataataaaataaagatgtctttaaaatataagaaaggcatctttattttttataatttgggtgcattatagtgcacaataatttagtgtgctatattttgatttgaggaggaaaaatggattatataaatagaaatgtatcaattaatttaaagaatatacgaaaaagtaaaaaaatgagtcttgatgtagtttccgagcaaactggtgtgagtaaaagtatgctagggcaaattgaaagaggagaatctaatcctacagtagcaatattaggcaagatagtaagcggacttagagtgtcttttaatgatattgtatgtatgcctaaagaggaaatatatatagtaaaaaaggaatcgttagaaccatctaaggaatcaactgatcaatatagtgtttatacatattttccttacgaggaagaccgtaattttgaaatatatatgattgaaataaaacctggaggtgtctatacaactggttctcatggggaaaaaacttgtgaatacataaatgttattaaaggtgaactcactttagaaattgatgaaaaaaaatatgttataaaaagcggggatgctgtaagatttaatacggataaagatcatgtttatattaatgatactaatgaattattaagttttaatgcggttttttattggaaataatatgaaaatattatttaaagaaaaaaatgtaaaaaatattgacactataacgcataaatggtatagtatgggtatagttaatgaatcgaatattgttataacaaatttgaacaaaggcgttctggattttatatctggagcgcttttttatttgaaaacaaaggggtttccaaataactactactaactaaagtaatttttaaattagggggaattattatggaagattcaaaatttgaaagagttttaagtaaaaaagatatatttgctatagcatttggtgcgatgattggctggggttgggtagtcatggcaggagattggattaaaggtgcaggaacactgggttctattatggcttttataatcggtggaataatggtactttttgttggacttacttatgcagaacttacggctgctatgccacagtgtggaggagagcatgtttttagtttaagagctcttggaaaaaatgggtcctttgtatgtacttgggctattattttaggttatgttggagtcgttgcatttgaggcgtgtgcattcccaactgttatacagtatatttgtccagggtttttaaaaggttatatgtacacaattgcaggatttgatatttatgcatcatgggttgcagttggggttgttgcatcaataattattacaattattaattattttggtgctaaatcagcagcaaaattacagacaattttaactatttctattgcagctatcggagttgctttagttgcagcttctggattttcaggaaatattgaaaatacaaagcctttatttactgatggagttggaggtatattgacagttgcagtaatgacaccgtttatgtttgttggatttgatgttatacctcaggcggcagaagaaataaatgttccgtttaaaaagataggtaaaataatgatactttcaattgtaatggcagtaatatggtatattatgattattattgcagtatcgatggttatgacaaaatctcaattagatacttcaacattagttacagcagatgcaatgaaaaatgcattttttggtagtgaaatggctgcaaaagttgtaataataggtggcatggctggtatagttacaagttggaactcattttttatgggaggaagcagagccatttattcccttgcagaatcaaaaatgcttccaggatttttagcgaaacttcatcctaaatataaaacaccaacaaacgcaattttactaataggtgtaatttcagtagtagctccattctttggaagagctatgatggtatggctcactgatgcaggaagttttggagttgtagtagcatatgtacttgtttctatgtcatttttagtattaagatttagggaaccagatatgataagaccttataaagttaaatgtgggaaaattataggaggtatagctgttttattaagtggatttatgatgttattatatttaccagggatgccctcaggtttagttaaagaggagttaataatggttggtgcatggactgttcttggaattatattttattcaatagcaaaattgaaatattcagattttggagttcatgaaataataaatattgaaggacatgaagaagaggaatcaagaggagtaaaggcatttccacaaatttaagctatgaataaagataagaagagatgttaattttaaatacatctcttcttttatttttatctagaaagttaaagattgtgatctatattaagtatctctcgtatatgaaaagcaagaaggtaattaaaattttcttcgctattatcaagttggttattgagtatttctttgatttttttaattctataatttattgtatttctatgagtatatgttttttttgaaacagcttgtatactgcaattgttttttagatatatttcaagaatattttcatagtcagttttgtgagttttatcataatcatgaataatgcctaaatatttcttatataagtcccacaaaatttgggggtcatttacatttaaaagaagtttatcaatccccatgttttcataataaataataaaagtatcgtcttttatggatgtatattttgcgttagatgattggatataggctttgttcaaattttctattgcagttattgatgagcttactccaatatgtttgatttcacaatagttttttaaatgtctgacaacatagctatctatataatttaatggattttgtgatgaggaaaaatttatgattatgtttaattctccgttttgagataatatactatatttaaaagaaaatgagttaagagtattttctattctcataataaagtttttaagctttatttcagtattttttttgtaaagtgaagaatctaaatctaaagatataatgataaattcgccatgcaagtcaaaggatgcttgtttgagacatggaatatataaatctttttgcattggagaaaatatagcattaaagaaggcagagcatatattggatttctgctgttccgcattgataataccgttgcaatagtcctgcattatatctactaggtgtacttcccatgggattgtaaatagtgggaaactattgtcattacaaaattttatagtatggtcagggatttttgaaatatactgacctatatttaccattagtccagaagcatgtctgttaataagaccttttattaagttatcaagccattcagcattttttgaaccaagtcctgtagtaacgataagttcgtttccacgtatgaaatctattgttgattcatcttccataaagtgaaaccaacttactacattatctaatgcattttctccagctagtagttttaatttgtattttgactttgattcggtatatagctttttcaaggttatggacatataataaattacctcctaatttttaattacataaatgtgagtaaaggttaattataagatataaaatcatttatgtgctaatagcactaaaaaatatgaataatttaggctcaataccattgtttgtgagaaaaaatggtgttaagatgattataacaagaaaaaacgaatatagtaaatacatattattatatcaattgaacaaaggcgttctggattttaatctaggacgcttttattattgaaagttttgtggattaacagatactactaatatgagattagctataagtaaataaaaatagaatttataggagatgtttacaatgttaagagatgaattaccaaaaattattacagaaatactaccaggaccaaaggctaaggaagttataaaaagacgtgaggaagcaataccaaaggcaataaaatgtgtatatccagttgtaattgagcgtggtgaaggtgctatgattgaagatgttgatggaaatagatttttagattggattggaggagtgggggtactcaatgttggatttagtcatcctgaaattatagaagaagttaaaaagcaaagtgaaaagtattttcatggaatgtttaatatagtaacacatgaaggatatgttaaacttgcagaaaaattaaatgatatagttcctgtaaaaggcgataaaaagaaaacttactttgcaaatagtggtgcagaagcagatgaaaatgcagtaaaagtagcaaaggcatttacaaaaagacctaatataatttgtttttcaggagcttttcatggaagaactaatcttacgatggcaatgacatctaaaaaagcatatgcaaaggggcttggaccattccccgaaggtatatatagagctgaatatccatacctttatagaaaaccaaaaggaatgaatgaagaagaagcaattaagtattatataaattctatttataaagtatttgaagagtgttcttcagcagattatatagctgcaatagttgttgaaccacttcaaggtgaaggtggatttattccagcgcctattgaatgggttaaggcagttagaaaaatatgtgatgaaaatggaataatgcttattgcagatgaagttcaaagtggtttttgtcgtactggaaaaatgtttgcaagtgaatattggaaagaagcgggggttatgccagacattttagcaactgcaaaatcaattggtgctggtctaccaataagtgcgatagtagcgagggaagaaataatggaatctgttttaccaggaactattggaggtacttattgtggaaatccattagcatgtgcagctgctattaaaacaatagaaattatggaaagggataatttagcaaagcgctctttagaaattggagagaaggttcaagctgtatataaaaaatggatggacaaatatgaagtaattggtgatgtaagaggtcttggtggtatgattggaattgaatttgtaactgacaaacaatcaaagactccaaatggtgagattgtatctaaaatagtgaagaatgcagttgaaaaaggacttatgcttgaaaattcaggaacatacggacaagttattagatttttagcgccccttgtaatgactgatgaacagctaaaagcagggcttgaaatatttgaagaagcaattaaaaaagcgttgaattaattcaataatcaataataaccgcagcatttttgcagcggttattatttataaaaaattaaaaaatagttgaagtgtttggacaagataacgtattttaaaaatgtgaaatatataaattaaacaatatatatctgattatttaaggatattatagaacgattatatacgtttttgaaaaaatatttcgaaattattgacattataacgcacaagtgatatattaaatatatacaagacaataataaatttttatagagaacaacggcgttctggatgttaatccagaacgccattttattttaaataacgaactataaattttaatcaatggagatttaaattatttaagaattaaggagattttatttatgaattttaattacaatttaccagttaatattatatttgggagaggtagagttagtgaaattggaagtgaagttttaaagtatggtaaaacagcacttattgtaactggaaaaaatagtacaaagaaaacaggacttcttgatagaactataaaattattaaatgaatcagatataaaaactatagtttttgataaggttgaacaaaatccattaactacaacagcttatgatggagcggagcttgctaaaaaagaaaagtgcgatgttgtagtaggtcttggtggaggaagcattatggatgcagctaaagctattgcatttattacattaaatgaaggagatgtttcggattacatatttggaaaaaaaaccagtgatgaggcacttccaataatattagttccaacaacatgtggtacaggcagtgaaggaaatggatttgcggtgttaacaaacccagataataatgataaaaaatcattaagatgtaatgcgatagtggctaaagcttccataatagatccagaattaatgactacaatgccaaagcacattttggcaagtgttggatttgatgctttatgccacaacatggaggcttacctatctaaaaatgaacaaccacttacaacaattatggcccttcaaggtattgaattaataggaaaaaatttagttaaagtctataacaataaagatgatatggaagcttttgaaaaaataacatgggcaagtaccttaggaggaatggttataaatacagctggtgttacagcaccacatggaatggaacatcctgcaagtggactaaaaaatatagtacatgggagaggtcttgcagctcttacaccagttatttatgaagaatcaataagtgcagcacctgaaaaatttgcaatgatttcaaggttattaggtggaagtgatgaaaatgattgtgtgcaggtaataagaaatcttttaaaagatatagatttagaaacaacactaggagaacaagggattaatgaagcagatatagattggatggcagaaaattgtttgaaagtttcagctgcaggtatgaaaagtcatcctaaagaatttaatttagaagatataaagagaatttttagaaaagctctttaatgttttatttgtaaagttgttatggttataaggaggaatttattatgaaattaaaagatactaaattatcaaaggaagaattaaaagagttagtaagcaaatatatgattgatacgtatgaaagatttgactttgttgcagagacagctaaagatatgtatctatatgatgaaaagggcgaaagttatttagacttttatgggggaattgcagtaaacagtgcaggaaattgtaatgaaaaagtagtagaagcaataaaggaacaggttaatgatataatccatacatttaattatccatatactatacctcaagctcttcttgcaaaattaatatgtgagacaattggtatggacaaaatcttttatcaaagtacaggaacagaagctaatgaagctatgattaaaatggctagaaagtatggagttgagaaatatggtcctaataaatataacattgtaacagctaagaatggatttcatggaagaacttatggttcaatgtctgcaacaggacaacctgataatgggtgtcagattggattcaaaccgatggttccagggtttacttatgctgaatacaatgatttacaatcattcaaggatgcatgcacagaaaatacaatagcaattatgattgaaccaatacaaggtgaaggtggagtacatccagctacgcaagaatttatggaaggtcttagaaaattttgtgatgaaaaaggaatgcttttattactagatgaagttcagacaggttggtgtagaactgggaaagttatggcttatatgcattatgatataaaaccagatattgtatctatggcaaaagccatgggagggggaatgcctatagctgctatatgtgctaacgaggaagtgtcaaaagcatttacaccaggatctcatgggacaacctatggaggaaatccagtgtgctgtgcagcatcatatgctcagattaatgaattattagatagagatttagcatcaaatgcagatacaatgggagaatattttaaatgtaaactaaaagatttgccacatgtaaaagaagttcgtggaaaaggacttttagttggtgttgaatttgattgcgatatagctttagatgttaaacataagtgttttgatagaaaattattgattacagctataggaaagaatgttattcgtatggttcctcctttaattttaaatgagaaagattgtgataaagcctttgaaataataaaagcagctgtagaaatcatcgtacaataatatatagaattatgaagattcaaagtaatgcacactattactttgagtctttttaaactttatagaaatatatagtaaaataaatagaaaaatatattaaaatgaagtaatataaagaaatttttgtttatattgtaaaaaataatagttatggtaaaatagttatgaataagtataaattttcatattgggcaaagcagttgaaaagctgtgacgcaaagctagagggcctttcttatagaatggcagccagttgcataaataataaggtaccttgttgataaaatgtgctttattaaactttgcctatgtaaaataggaggagaaatatgagtaaaaaaattttagtctgcgatgatacaatgttcatgcggaaactgcttaaggagatattggtagataacggctatgaagttattggagaagcagaaaatggaatagctgccattgaaaagtacaatttattaaaaccagatttaatattaatggatattactatgccagaaatggatggaatagctgcacttaataaaatcattgaaattgactcgaaagctaaagttataatgtgttcagcaatgggacaagaacagactgttctatcagcaataaaaggcggagctaaagactttattgtaaagccatttgataatgaaagggtaatacaagcagtagctaaagttgttggaagttaaataatgaattatttataaattatgtaaagactgatttttttaggaaatcagtcttttatatattaaaattcaattgaatactttaaacataattagtttgtcttatattaaagtatagaaaagtttattgtttataatttttaattgtaacaataagagtattataattaatgtaataatagtttgattttataatgatgaatttcctttatactacagttggtataaatataatgctaaacaatatgacttaaacatatcagaagcgcttgttacaattcttcatttgtccgaagtagggcaagaaaagcctgaaacaatatcatggttaaagaagcaagttgaaaaaggcactttatacagaaaatattctgttttaggaaatgttatagacggatatcaatatgaatcgacagcagcttatgcactggcagctttgataggaatagaagtgaatgactgtgaacttattaataatgcagttataagaatggaaaaaatgaaaattgatgattctgaaaatttatattatggtgcttttggaaatatggatggaagtggaatatattcatttgatcagtgcatggctcttttagcttatgctaagttggaaaaataaaagtaaaaaataaaaagtccgcaggcgagagaaatctcaagtctacgggcctttttacttttaaaattagtatttgttgattaaagttttggaggcaccacccagatttgaactggggaataaaggttttgcagacctctgccttaccacttggctatagtgccattgaacatttaaaatcatctacacattatatatatgtagtaagctaaaaaaaatgcttaatttttagaattatttttttaataaaatttttacagtattaagttaaaaagtaacataaaaaacaaaaaaacatattatatagtgacacaattaaaggactataagacttcctctatctataagtttgcctttttttaagtaaacaggagtaattccataatgagataaaaatttttttatttcatttccgtatttgtaatgttctaattcaccaaagaaagctattttgtcagaagaaatcattcctccagtacctcctatgaacccatagtttaaagaaggaagaaggatgtcgcctggtggaagaagtagaatgtcaaaattaaaattttttaattttttgtatatacctttatcacttgtaattaatgctttttcgtttattggtagaacagaacattttgtatatccttgtggtacatcaatatttatttttgatttttgggaattgaaaagattttcatctgtatatgctaaagtatgaataaaatgatctttaagtattaaagcattcaaaataatgtcagatggatatgaatttttcaaagatttctttgaaacaatatattttatgtgattttcttctaaaatatttctaaaatcttcagaaatatctttttgaacaattaattgagtagcactattgttttttagtatatttagttgaatatctggatgtccattaatggcttcataaacttgggtgcatttgggaactttgattacttctatatttaattttaaaagattttggatttcttcatcagtaattctataatcagcaaaagcgtacatcttaatctcctttttattttaaaataaaatttttattaagaaaattataaatattttaaatttgcttgtaaataacacattgtaaatttttaagcgtattatacaaatacatacattagaatattaaaaatagaaaactgtaatgctcatagtatttattgaaaagaaatagatgtaagagttatgtccatataaaaaaattaaaattcatataaaaatagaacttgtatatgagtatatctaatattttttcatacatactaatataaagaagggagtgaaatccatgcttattttaaaattagcttataatgaagagcttacattttcgcatgacttgcaggagctaaaagaatcacttaagaaaaaagatataacaataggtttggttgaaagtattgaaggaaagacacatataattaaaataatgtgtgataaggattcgtataacaataagatagaagaaattattaacttatatgttagtaatattttatatagaatagttattgattattataggaaaagagaaatgtttgaatttataacagacaattatttctttttaaagcaaagtgaaattttagaggtagaaaataagatactaaaagtgctaaactgtgaagcagcttgtaaggatgaagattctatttattgtttaaatagaataaataacattattgaaaaaataagacagtgtattggtgaaaaacaagagattaacgtggatggttttataacctttagattacgtatgttacgtgaagatatagagaagatagtagataaagtagtagaaaagtacatggttgaaaaagaatatgaagaatttgttcggttgttaaaatattttgttgatattcaagaatgtaaaattgaaaaaataataatttcaattgaagcaggaggtcactatattataaaggatgaatacggcaaggatttatacaaggactttttaaaagaacttactggtgatgaaaatgattttgatataaatatagaagatatactgataagtggtcttataacaagttcgcctaaaaatataataatttacggaaaacgaaattgtaataataaagagtttttagagacaattaaaaatgtctttggtgatagggtaacttgttttgatgagtgtatagaatatctacctaaaaaaatattgagtaaaaatgttgacatgttttagatatggtgatatactaagttttgttaagaagaaacagccgtttctcaccttgcagtgtcatatgattgctagttaggtttatggatgtctatacagttgtattgataatatgagacggctaagtgaggccgtctttttattatgtatagaatttttcggaggtgaaaaatattagtaaagatttttcgatgaatgaaggaataagagaaaaagaagtcagattgataggtaaagatggagaacaacttggtgttgtttcgacaaatgaagcaagaagacttgctgatgaaaatgaactagatttagttatgatttccccaaatgcaaaaccaccagtttgtaaggttatggactacggtaaatttgtatatgagcaatcaaagaaggaaaaagaagctaaaaagaaacaaaaagtaatcagtataaaagaaataagagtaagtctaactattgaggaacatgatattgatatcaaagcaaaaaatgcaagaaagttcctattagatggagataaagttaaaatcactgttagatttagaggtagagaaatggagttaggtcacattggtgaaagaattcttaataattttacagctaaattagaagatgtttctattatagagaaaagacctaaaagagaaggtagaagcatgacattggttttagggcctaaaaaggcataacttgagaggaggattttatcatgccaaaaatgaagagtcatagaggtgcagcaaaaagatttagaaagacaggaacaggaaagcttaaaagagctaaagcttttaagagccatatcttaactaagaagagctcaaagactaagagaaatcttagaaaagctggatacgtttgtaaagcacaagaaaaagtaatgaagaaattattaccatacctataagatagagtatttggtacaggaggtttaagtaatggcaagagtaaagagagcaaagaattctcgtaaaaatcataaaaaagttttaaaacttgcaaaaggatactacggtggaaagagtaagttatttaaaactgctaatgaatcagtaataagagcattaagaaatgcttacgttggaagaaagaataagaagagagactacagaagcttatggatcgcaagaatcaatgctgctgctagaatgaacgaaatgtcttattcaaaattcatgaatggaatcaaattagctggaatcgaaattaacagaaaaatgttatcagaaatagctatcaatgatccaaaagcatttgctgaattagttgaaactgctaaaaaagcattagcttaatattacatataaaatgcggtctttgggccgcattttatttttatataaaaaagaatatattattaacctttgaggtgaagaatatggaaaaagtcattacgaaaaaaaataggcttagcgaagtaagaatattagcacttggctttgcagtagtaattttacttggcggagttatacttagtctgcctatttcatcaaaaagtggtagatatacaagtcttgtagattcgatttttacagcgacatcagctgtatgtgtaactgggctcgtgacactagatacaggaacctattggaatacttttggtcaatgcataataatgatacttatagaaattggtggattaggtttcatgtcagttacaacatttattgcaatgattcttggaagaaagattacactacgtgatagattgattatgcaggaagctatgaatacatttaatattcaaggattggtaaaaatgcttagatatgttcttggactcacttttacagtacagattgcaggtgcatttcttttgagttttgtatttgtgccaaagtttggtatttcgactggtgtgttttatagtatatttcattcggtgtctgcattttgcaatgctggctttgatttatttggtgatttttccagtctaacgagtttttcgggaaattatcttgtaataatagtaataagtctattaattataatcggtggtattggatttactgttttaatagaaatattaaattataaaaaaatgaaaaagttatcagttcattctaagattgtaatatgcattactgcaagtttaatatttggaggagctgcttttatttttcttgttgaatataaaaatacggcgaccttgggtaatttaaatttaggtgaaaagattctaaattctatgttttcatcaattactccaagaactgcaggatttaacagtatatcaacaggtgatatgacaatgagtggtaagcttatgactataattttaatgtttataggtggttctccaggatctactgctggtggattgaaaacagccacgtttggagttcttgtactaactgttatatctgtgttacgaggaagaaatgatacagaagcttttggaagaagattttcaaaagaaactgtatacaaagcatttactgtgtttgcacttggtatggcaatagtattagttgttacaacaatacttagtattgcagagcccaatcaacagttcatagatcttctttacgaagcttcatctgcatttggaacagcagggcttactactggtgtgacacaagaaataggaactttaagtaaaattgttcttatgtttacaatgtattgtggaagggttggaccaattacagtctttcttgccttgataaaaagaaataataagtcgggaattaagtatccagaaggtaaaatattgattggataaaataagtacttgtatttaaattataaaatttttattataatattagtatatacgagaaaatataatagtatctaagttttatagtggtaaggggattaggaggagattaatatggcgaaaaaacagtttgttgtaataggacttgggcgattcggtgaatcgcttgcaagaacagtttataacttaggtcatgatgtacttgttatagatatggatgaagaaaaaattgctgatattgcagattatgtaactcatgccgtacagatggatgccactgatgaaaatgcattgagaaaattaggtctaagaaattttgatgtggcggttgtaacaataggatctgatattcaagcaagtgttatggttactttacttgtaagagaaataggtgtgaaatatataattgcaaaagggcatagtgacttgcatgcaaaagttctttataaaattggagcagataaggtggtgcttccagaaaaggatatggggcagagagtggcacataatcttgtttcatcaaatatactggattacattgaattatcatcagaatacagtataatggagattgaagcacttgattcttggattaataaatctttgaaagatctggagttaagaaaaaaatatggaataaatgtggttgccattaaggatgggaatgatgtgaatgtttctccgggaccagatgaaataataatgaaaaatgatattatagtagcactgggaactactaaagatttaggaaagcttgaaggtgctattggaaaaagctgaaaattttgaggtgaaaactttgacttttattgaaagtaaagataataatttatttaaagaaactaagaagcttaaagaaagaaaaaatagaacaaaaagtaataaatatattatagaaggttttagacttgttcaagaagcatttaaagctggtttgaatatagaatgcttaatagtaacatgtgacggaaaagataaaattgattcctatttaagagaatatataaataaagatattaagatatatgagatggtaaattctttatttaaagaaattatttcaacagaaaagccacaaggaatagttgccattgtacatatgaatgagaaaaccttagatttgaatggaagtttttatttgctatgtgataaagttcaagatccaggtaatttaggaacaataataagaacagcacatgcagttaaagctgatggaattattttaacaaaagggacagtagatatatacaatgaaaagacaataagatcaactatgggatcattgttttatgttccagttcattatgatgatgaaaatatgacacttgtgaaatctttaaaggataagaagtttaagatagttgttacatctcttgatacagataaagatttcttccaggaaagccttaagggaaaagttctcttaacagttggaaatgagggaaatggagtaagtgatgaggtatatgaattggcagatacgaaagttaagatacctatgccaggaaatgctgaatctttaaatgttgctatagctacttcagttataatgtatgaaaagatacgacaagatttatacgattagaacaattccaaattagtataattttttaaattatagaatagtatatttattattttatgaaaagcatgctctataaatatgagcatgttttttagttttatgatagaatttactttaaattgttataaagagttttaaatacaaattttttgtgagaatgaaaaattatgaataatttattatggataataaaattttatttattatgctataatcataaaagaacaaatgaaataatagtgaggtgtatttatggcaaatgttattgttgttggtgcaggtccggctgggattatggctgcacttagtagtgcaaagaataacgaagttgttttaatagagagaaatagtaatattggtgaaaaacttaagcttactggtggtggaagatgtaatattacaaataacagagatattgaggagttttttgaaaaaatagttacaaataataaatttttatatagtgctctttatactttttcaaattattctttacttgaatactttagtgaacaggggctagaatataaagaagaacttgatcaaaaagtatatactaaaagtgataaagcagatgaagttatagaagtattaaaaaatgatttgaaaaataataatgttaaaattatgtttaatacaaagatagaggatcttatagtggaagataatactgtgaagggtgttatatctgagggtggaaaaagaatatatggagataaagttattgttacaactggaggaaagagctttccaaatacaggatcagatggatctatgtatgatgttataaaaaaatacggtcatacaataactcctatttacccagcattaataccactagttattaaagaagaatttgtaaaatcacttcaaggtgtttcaatgaaggatgtggttatttctgcaaaggttaagaagagaaaaatagaaaaaataggcgatatgatatttacacattttggagtgtccggtccaggagtgctaaaactatcatcatatataaataaagctttaaatgatggtgaagtagaaataaaacttgattttatgagtgacaagtctaaagaagaactatcagaaataataagaagtaatcctaataagactgcattaaataatttgaagggaatattaccacagaatttcttgaaagaaatattttctattataggaattactgaagttaaagcaagtgacttaaaaaaggaagatgaaaataagattcttgaatacataaaagaaatgagacttacagcaagagaaacattaactataaaagcggcacaggttacatctggaggagttagtgttaaagaaataaatgcttccaatatggaatcaaaaataattaaaaatctgtactttgcaggagaagtgattgatatcgatgctgaaactggaggatacaatcttcagatggcattttcaactggataccttgcaggaagtgatttttagtaaattcatagtttagggaatatatgtatgttaaagatcaataagaagtcaatttgaaataattatttttacagtgtagcttaaatttttcagtatattgaaataagtgtgttatatttggattaattttaaaattgagggttgaaatttctattctttatttgtataattagttgtattaattaaataaattaaaaattgtgattgagagagtagcttttatgaagttttcagggagaaaagatcattggactggaagtctttttaaatgaagtaattgtgaagttcactcaggagttccagctgtgaagtaatagtagcatctggcggcatatatatgtcgttattaaaattaagctgggtagccttttaggtaccaatcagggtggtaacgcggataattcgtccctttttatgggggacgatttttttatgtctaaaagtataagttgatagttaattatagcagaataggtttttaaatttaaaattactgataactgttacttgttaactgttaactaaataaacggcataagttattgaaaggagaaaaatcatgaaagaaaaacttaaagaattacaagaacttgctttacaacaaattgatgttgcaacaaatagttcacaattagaagaagtgagagtaaagtttttaggtaaaaaaggagaacttactacaatattaagagggatgggatcagtatccccagaggaaagacctttagtaggtaaaatggttaatgaagctaaagcagcagttgaggaaaaattagaagctgcaatgaaagctataaaaaataaagaaaaggtagcaagacttgcaagtgaaactatagacatatcacttccagggaagaaaaaagttataggaaagagacatcctttagaattaacacttcagactatggaagatatatttgtttcaatgggatttacaatagaagaaggtccagaagttgaatatgatcattataattttgaagcattaaatattcctaagaatcatccagcaagaagtgagcaggacacattatatataaatgataatatcgttcttagaactcaaacttcaccagttcaagttagaactatggaaaatcaaaagcctccaattaagatgatatcaccaggtaaggtttatagatcagattcagttgatgctacacattcacctatattttatcaaatggaaggtcttgttatagacaaaggagttacttttgcagatttaaaaggaactttagaactatttgctaaaaagatgtttggagataaggttcaaactaaattcagaccacatcacttcccatttacagaaccatcagcagaaatggatgcaacttgtttcgtatgtggtggagaaggatgtagagtatgtaaaaatagtggatggatagaacttttagggtgtggtatggttcatccaaacgtattaagaaactgtggaatagatcctgaagtatatagtggatttgcatttggatttggtgtagatagaatggttatgcttaagtatggtattgatgatataagattgttatatgaaagtgatatgagattcttaaaccaattttaatcaattgacgattaacaattatggataagaattatgactgatttttaaaaattataatattaagtgattattttttaaaaattaagtttatctgagaaaatataagaattgattgagaaaaatattaatattttattattataatatgaagaattatagaagtaaaaaataaagaaattccagaggaatttcaacatttaattgtcaattgtcaattattctttgtcaattgactctgaggaggagaataatatgaaggtaccatttaattggttacaagattatgttgaaataaatgtaagtcctaaagaattaggagataaattaactttaactggatcacagcttgaagaattaatagttcaaggtgatacaatagataaagtagtaacaggaaaaataactcaaatagtaaagcatccagatgctgaaaagcttagtatttgtcaagttgatattggaactgaaagtattcaaatagttacagcagcaaataacatgaaagaacaggatattgttccagttgcccttcatgggtctactttagctgatggaactaaaattaaaaaaggtaaattaagaggagaagtatctaatggtatgttctgctctgaagaagaacttggaattgctggagatgaaccagttcatggtttaatgatcatgcctcaagatacaccattaggtgcagatattaaagaggtattgaaattaaataaagccatattagactttgaaataacttcaaacagaccagattgcttaagtattgttggtatggcaagagaaactgcagctgcacttagaacatcttataagatgccgaacttagaatataaaacaataggtgaaggaaatgtaaatgatgaattgaaagtagaagttaaagatgacttatgcttaagatatatggcaagaaaagttaagaatgttaaagttcaatcatcaccaggttggatgcaggaaagacttcttgaagctggtataagacctatcgataatatagtagacataacaaattttgtcatgcttgaattaggtcagccaatgcacgcttatgatgcaagagaaataactactaataaaatagtagttgaaagagcaaaagctgatgaaaaattcacaacattagatgaagctgaaagaattctagatgattctatgttatgcattaaagacagcgatacaatagtaggtcttgctggaattatgggtggattaaattctgaaataaaagaagatactaaagaagttatatttgaatctgcaaattttgatggaactaatataagagtaaattctaagaaattaaacttaagaagcgaagcttcaagtagatttgaaaaagatatagatctaaacttagcagaacttgctatagatagagcatgtgcattaatctgtgaattaggtgctggtgaagtattagatggaactattgatgtatacaacaaaaagaaggaagctgggaaagtagtagttgatgcaaattggattaacaaattcttaggaactgacctttcaaaagaagaaatgaagagatgcttagatagtgttgatttatttacagaaatagatggagataatttagttgtaacagcttcaacttttagaattgatatcgcaataagagaagatattgccgaagaaattgctagaattcatggatatgatgttattcctgctacaatattctcagtttctacttctagagaaccaaaatacagaaagagattattagatgataaaatggtaatgcttgctactggaagtggattaaatcaatctataagttattcgtttgtatctccaaaggtatttgataaaatatgtgtaccagaagatagtgaattaagaaatgtagtaaaaattaaaaatccattaggtgaagattatagtgtaatgagaacttcaactttaccatcaatgatggaatgtttaggaagaaactactcaagaaataactcatatgcaagattatttgaaatgggtaaagtttacatcaagaatgaagatgaaaataagcttccaattgaaagaaatattttaactataggtatgtatggagattgtgattacttagaccttaagggtgcagttgaaaatatagttgaaggtcttggaataaagaatgccaaatatgaaagagaaagtgaaaatgtaagttaccatccaggtaagactgctaaacttgttataggcaagaatatagtaggtactttaggtgaagttcacttagatgttactgaaaactatggaatagatgaatcatgctatgttgcagaacttaatttagatgtattatatgaagctgctgacatggatagaaagtataaagcattacctaaattcccagcagtaacaagagatatagctttacttgtagatgatgctgttttagttcaagagatcgaagactgtataagaaaagctggtggaaatatagtagaaaaagttcaattatttgatatctataaaggaaaacaaataccagaaggtaagaagagcatagcttatgcaattgcttatagagatgaaaataaaactctacaagataaagatgtaaataaagtacatgataaaattttaagatctttagaatataaacttggagctacattaagagattagtgtagtaaggtttaatatttattatagctaaatatttaataaaatgcagatactaatgtatggtatctgcatttttaattttttcttataatttatatgttttagatgtataaaatatataaattatgcaagatataaaaacaagaattatatattaacataaagagtatagtattaaatgctattattactattcttaatgaattaaataaatattacaaaatatattataaagatgcaaactagtatagagattcactttaagagacgtttgaatttataaaataaattcagtataataatggtgtaagcatagaagaaagggatgaaagctatgaaggttgaattttgccttttagacagtggagatgttgtatttacaaaagattctaaagatttaactgatgttttgaatgtcattactaaagttgggactgaaatacaccttttgtttagcaaagatgacttcatccatggatatgttcaaaatgttatgtacatggttgatgcagaaaacagtagtgaaagtcttagggtgtatttttctaatgactattcaaaatctaaacatcatccaagattgtcaccagaacacttagaaacagtaaagataagtgacagaaaaatcaaatagaagaataatacatggtgagtatagatgctatttatgctcactgttttattgagtggaaaaataatatgatttgtaattttgtttaggagaagatatggataataaaaagaagtgcaagaatactttgtcaaagcgtttgaaaaaaaatcgtaggagaaaaaaactagtaagaagtttagtgcttgttatattaatagggataggagtaaatatttataatcataaagcatctataaaagtggatagcaatcaatatgaagcaagtaatgaatataattatgaaactgaaaaatttgaggataaaataaattcagagaatatatcaaattctccagtagagaatctgaaaacggatgtggataaatttgaaaaggttgatattactaatgagaataaaggtgttccagtattgtgttatcattcaattgggtacgatgaaagtggaaaaagtccacttatagtatctccacaaaaatttaaggaacatatgaaggcgttgaaagataatggatatacagcgcttactatatcagaacttgaagattaccttgtaaatgataaaccgattcctgtgaaaagtattttaataacatttgatgatggatataaggacaactatacaaatgcatttcctatattaaaagaacttaatatgaatgctacaatttttgtagtatcaagcttaataaatggtgaaactagtatgacttcgcagcagattaaggaaatgagcgattatggaattgatatagaatcacatacagtttcacataaaaggcttagtgaaatgtcttataatgaacaattagaggaactatcaaaatcaaagaaagaaatagaagaaataacaggtaaatcagttattgcagcagcatatcctgaaggaatgtataatgatgatactaagagtgcagtagaaaatgcaggatataaaatgggatttactattgagcatggatacgctgatagagatgataattttagcatgttaaatagaatatgtatagattatacatttaattggaataacattaattatattataaataacataaagaagtaatagtaagtaaactgtacagaattggaatagattatatttgaattttgtacagtttttttatatttaagctcaattttatttataagtatttttgatttcttcttgaagattgaagagatctttttcactttgaagaactttatgtgttataaattttaagtctttagatatgagaagaagtttttttgatgaatcttcattcatatcagttaaaagttctgaattgtttgaaacaatattctttaatgaatttatattttcgttaacatctgggttatcattattatcaaatgacaaattggcgtttttatataagttatcaagagttttatctattttatcaataatcagattattattttcaattcttttattgagggtagagattgtagatttcatggaatttatttcaaaatgaattccatcaaatttactgcatatttcagcggataatttatttaataactctaatatttcataatctgattccaaaataccaccctcccgtacaagtatatgttttttatggattatatagaataatacattttaatttgtgtaatatatttaaaacttattcaaatagcctattggatatatttcaataaattgaataaaattcaatataaaccagtaaaatcttgaattgacttaagtgtttaaagaaaaactaaaaatatatattaataaaatttatctataaagatatgttctttaagaaaggattgaatgagagtggctacaataattaaatatttaaaaagatttactggcataattttactcattatagtactgcttattatacaagcacttactgatttagcccttccacaatatacatctgatattgtagatataggaattcagcaaaatggcataaaagaaattgcaccaaaagtcataagagaaagtgaattaaacaaattaatactttttatggatgatgaagataaaaattatgttgatgataactatacacttattgtaaaggagaatttacctgaaatagattatgaaaaatatttaaaggtttatcctgaattaaaaaatactccattatataaggaaaatttaataaatgatagagaaagtcaggaaaggcttgacgaaatttttacaaaaccaataactattgtagaaaatattgaaaataatagagaaatgtctgaaggacttgaaaaagttattgtagaaaacatgccagaaggtatggttggagataatatgaatgtatttcaacttcttggtatacttccaaaagatgtgcgtaataacatagttgaaaaaataaatggcaactttaataatatgccacaaacattattatcccaagctggaatttcatatgtgaaaaatgaatataaggcggttgggatagatacagacaaagaacagattaactacatatttaattcaggaataaaaatgataggtcttgcacttataggtggaatatctatagtgttagtttctttttttgcatcaagggttgcagcaagtcttgcaaaaatattgaggaaagacgtatttgaaaaagtattaagtttttcaaatgttgaatttgataaattttcaactgcatcgcttataacaagaacaacaaatgatattgtacagatccagacctttgtcgttatgatgttaagaatgattttttatgctccaatactgggatgtggaggaataataaaagtattaggaaccaataaatctatgacatggataatagctgttgcagtaggaacaatactaatagtaataagcattttatttggtttggctatgcctagatttaaaagaatacaaacacttatagataaggtgaatcagatagctagagaaattctcacaggacttccagtaataagagcctttactacagaaaaacatgaagaaaacagatttgatgatgctaataaagatcttactaaaacaaatctttttgtaagcagaattatgacatgtatgatgccatcaatgatgttaataatgaacgcaatttcagttcttatcgtatggattggtgcaggacagattaatgatggtaatatgcaggtcggggatcttatggcgtttatacaatacacaatgcagatagtaatgtcatttttaatgatttcaatggtttcaatgatactcccaagagcacttgtttcagcaaagcgtatagaagaagtactgaaaacagaacttacaataattgatccaagttcatcccaaaacataaatgtcagcaaaaaggggtatgtagaatatcagaatgtgtactttaagtatcctgatggtgaagaagttttaagtgatatatcatttacggcaaagccaggaaaagtaacagcgataatagggagtacaggaagtggtaagtcaacacttgtaaaccttcttccacgattttttgatgttacatcaggaaagatacttattgatggtgttgatgtaagaaatttgactcagcatgaactaagagaaaaaataggatttgtgccacaaaagggagtattgttttcaggaacaataaagtcaaatataaaatatggtaagaaaaatgcaaaagatagtgaaatgaaaagggctgctaaaattgcgcaagcatctcagtttattgaaagtaaggatgaagcatatgatacagaaatttctcagggaggaacaaatgtatcaggaggacaaaagcagagaatatctatagcaagagctgttataaagaatcctgaaatacttgtatttgatgatagtttttctgctcttgattataaaactgatgtggcattaaggagagcactgagagaggaaacaaaaaatacaacaaagatattagttgctcaaagaataagcactgtgcttgatgcatatgaaatacttgttttagataaaggtaaaattgtaggacgtggaactcataaggatcttatggaaaattgtgatacatatagacagattgcattttcacaactttcaaaggaggagcttgcaaatgagtaatgaagatagaaaaatgagacctaccatgggcggcatgggacaaatgagagttatgggtggaggaaaagtaaaggcaaagaattttaagggaagcatgaaaaagctctttaattatctattcaaatataaattttcagttattttggttatattatttgcaataggaagtactgcgttttcaataataggtcctaaaattttaggtaatgctactacagaaatatttaatggaataatgagcaaactttctggtggaagtggaatagattttactaaaataagtagaatcttaattacattactagtcatatatttaataagtgcagtattttcatttattcagggatttataatgacaggagtttctcaaaagcttacatatagattaagaaaagaaatgatagaaaaaatagatagaatgcctatgaactatttcgataggagaacacatggtgaagttttatcgagaataacaaatgatatagatacattaaatcagagtcttaatcagagtatgactcagataataacatcaataacaacaataattggaattgtatttatgatgtgcacaataaatgtgataatgacttgtaccatagtattgatagttccaatatcccttatatttataacttttatagcaaaaaaatcacaaaaatattttaaggaacagcaggattatttgggtcatgtaaatgggcaggttgaagaagtttatggtgggcataatattgtaaaagtatttaatggagaggaggatgcaataaatagattcaatactgacaatgaaacactttataaaagtgcatggaaatcacaatttttatctggtcttatgcagcctataatgatgtttataagtaatattggttatgttgcagttgcaattctcggaggtttttttgcaatacaaaataaaataagtgttggagatatacagtcatttatccaatatacaagaagttttactcagccacttgctcagattgctcaaatatcaaatatgcttcagtctatagcagcatcttctgaaagggtttttgaattcttagaagaagaagaagaggttcaatttgcagataatccagaaagtattgaaaatattgaaggaaacgtagaatttagaaatgttaaatttggatattatccagataaaacaataatcaataattttagtcttaaagtaaatgaaggtaaaaaagtggctattgtaggacctactggag

SEQ ID NO: 28 - DNA, 4717687 bp, Clostridium butyricum (residues 1,572,564-3,145,126 of 4,717,687)
  misc_feature (3536924)..(3536925): ">" designating noncontiguous sequence of whole genome
  misc_feature (3555028)..(3555029): ">" designating noncontiguous sequence of whole genome
  misc_feature (3939428)..(3939429): ">" designating noncontiguous sequence of whole genome
  misc_feature (3947488)..(3947489): ">" designating noncontiguous sequence of whole genome
ctggtaagagtacaattataaagatacttatgagattttatgatataaataatggtgatatacttattgatgggaaaagtatatacaattttaatagaagagatcttaggaaactttttggaatggtccttcaagaaacatggctatttaatggatcaataaaggaaaatataagatatggaaatcttgatgcatctgatgaagaagtacataatgcagctgaaagtgcagaagcagatgaatttataagtacatttcatgaaggctacgatatgattttaaatgaagaagtaagcaatgtatctcagggacaaaagcagcttttaacaattgcacgtgcaatacttaaagatcctaaaatattgatacttgatgaagcaacaagttcagtagatacaagaacagaattgaaaattcaaaaagccatggatacacttatggaaggaagaacaagttttataatagcacatagactttcaacaataaaaaatgcagatataattcttgttttaaaggatggagatattattgagcagggtaatcatgaagagctcatggctatgaatggattttatactaatttatataattctcagtttgaaaaaacagcagcaaattaattttaatatataaggcggagtattcttcgctttattttaatgcttataaatatatttatgatataataatattaattaaaaaattacattaaattatatattttggaataattaagggagaaggtattttaaaggcaagtaactaaaaaatctgaattttaagatgaggaattaacgtgataaaaagaagagataggaataaattaaacaaaggacaaattgtggatatattaagaagtgtcactatgctcaatcttttattgtgtataatgactattactttaattttatatgaggccattaaacataaaagtatgattttgtatttattagtaggcttaattgtatgtataatattaagtgacaaagttagatatatgttaaaggagaatcatgaatctactaaaattaaaaacatgaattcaattattgaaaaagaaaatatagataattgggaatttgaattatataattgcaaagacaatattagtgggctatataatagtgtatttttagaaaatatattaggaaaaattaataaagaaaaatttataccaacaacaatagctgttttttatataaaaggattatcgtgcttaatggaagaagaagaaaaaaagaaagctatttttaaagcagccgatatagttataaagaataagcttaaaaataatatagcatgtttatcaaaaagtagtagtattattttgttttttataaattacaataaaaataattcagttagtattatagagaaaatatgccatgagtttaacgagttgtatgcagaaaatgatcttacaatgatatatggttttgaagagattagcagtaaagatgaaattatatataaaatgtatggagaaatattacaaaatatacatttatcaatctttaaataaaagttatatagaatgtattttaattaaatgatttatattgggagttgtattaaaaattgacaaaatataatataaattatattataaatataatatctacattgaattttaaaaaaataatgtagatataagttataatgatattatttctttaaaataacatgatgattatggccaatttatttgacatattatttcgttttttttggaatttatctagatattataacttgatgtttgttgataaagatttgttcagatttaagtaaacttaaactgtacattttatataaatataaacatgaatggagtagataagcatgaaagcaatattaacagtaattgggcaggataaagtggggattatagcgcgtgtaagtgctaaaatgttagaatttaatattaatattttagatgttaaccagactataatgcaggatttttttacaatgatgatgatgttagactgcacaaacatgaaaggaaattttgatgaagtgagatcggcattaacagaagagggtaaaaaacttggagttgatataaagattcaaagagaagaaattttcaagtcaatgcattcactataatcaggaggggcaatatgaatactaataatatacttgagacaataaagatgattgaagaagaaaaacttgatgttagaactataacaatgggaatttctttacttgactgtatagatccagatggagataaagcaagaattaaaatatatgataaaataacaagaagtgcagaaaaattggttgaagttgggagacaaatagaatctgaatttggtattccaatagttaataaaagagtttctgttacaccaatgtctatgatttgtggagcaacggatgaaacaagttatgttaaatttgcacaaacattagatagagcagcagaaacattaggaatagacttcttaggaggtttttcagcattagtacataaaggttgcactaaaggagatagaattttaataaattctattccagaagcattggcaataacaaaaaaagtttgtgcatcagtaaatgttggatgtactaaatctggtattaacatgaatgctgtaagggatttaggacatattgtaaagcaaactgctgaattgactaaagacactcatggatttgggtgtgctaagttggttatatttgcaaatgcagtagaagataatccatttatggctggagcattccatggagttggtgaagctgaaagaattataaatgtaggagtaagtggacctggagttgttaagagagctcttgaaaaggtacgaggagagtcatttgatactgttgcggaaacaattaaacaaactgcatttaaagttacaagaatgggtgaattagttgcaaaagaagcatcaagaagattagatgtaccatttggtatagttgacttatctcttgcacctacaccagcagttggagattcagttgcagaaatattagaggaaattggattagaacaagttggaacacacggaactatagcagcccttgcgatgctaaatgacgcagttaaaaaaggcggagtaatggcatgtagccatgttggaggattaagtggagctttcattccagtatcagaagatgcaggaatgatagatgctgtaattagtggttcattaaatttagaaaaattagaaggaatgacatgtgtatgttcagttggacttgacatgattgcaattccaggagatactccagcatcaacaatttcaggtatgattgctgatgaagctgcaattggagtaattaataataaaacaacagcagtaagaataattccagcaccaggatgtaacattggtgatatggttgaatttggagggcttcttggaagagctccagttatgaaggttaatgggaaatcttcagagttatttgcaaacagaggcggaagaattccagcaccaatacattcatttaaaaattaataatattaaagattaaactgagtacttatatagtattcagtttttttgtgtttaaaattatgattgtaaagaaaaatattttgtatatataggtaaaagtaaaaaaataatcataagcttattcataaaagtataataatctttttatgaataagctttattaattagtaaaataattttaatcaataggctaagaaaaaagaattacaagaattttacggttattaggtgtgcttacaggaagtggtccaattttaaataaatagtatgatcctaatttagacactgttatatttgtaaagggtattcctgataaatatgcattaaaatacttagaatattgaggtggcatatatttataagtaaaagttaaagagttaatagtacctctattttctatatatacaaacatgccatcaggagatttatctataaccagcttctgctgtgataaataaatgtatgaataatttgtattctgtaaagatggagtttttgttgtattatatgcagaaagaggattgttaataaatgattctgtattactgtcaggtagtggcatcaaatagtaattaagattaagaattgaattaggtgcaattgattcagtgatacaataattagattttaagtttgtgcaagggtaatatattccagtactactgttcataagcgtaccgcttacatatgttaaattaccacttgtagttaggtttatattaaaatcttcaattattgaggatgattcattttttataaagacattaaatttaatttgatcctgccatttagtattgtatatttcagcaggtgatagaatgaatgaaatattcggagaaggaattatttcaatattgattggagttccagggacagttggaactgttgaatagctatagtttattttatatgaataaccatatttgtataaaatctcttctgtactcatcttacactccttataaattgattatagtatataatatgtaaaacatattaaaaggtgaaaaatatacacacacaatgcactagaatattcataatatatgttagaaaagtatagcaaggagtgatgcaacattggtttttgataataaaaaagttattcatgaagatttaacaaatgagatgttaaggcctgtaatgcttaatagattaatagattctctggattttaccatatcagagtcaagtgtagttgaaaatatgagatttgatctttcggatttaggtataatttatgtagataaaggggaaatctgtataagtgatatgtggtatagctatgattatataggaataaataataatcctatcaaaggaaaaatcggatgtgaagatattaacctttatggaaaagatgggatgatagttaatgatagtttaaatggatacaagatatatacagagtatttaggacatgcaaatatgaattgctgtgaatattataataaaataaaattttgtgaaacaaatattaagtttgaaataaaaaatcttgtaataactgttcagggaacaattggagatgaaccttttataggaacatacacatatagtggatcaattgtttgatgagttatgattatatgtatgttcaattgttgatagattttatcaatggaataattttaagacttataggttaaatattataaagtttatattttaagaaaggaggggatatgataatggctgacttaagtgcaattaataatgtaattacaagttcagtagataatggtgattatagtgtggagatcaatttatctgattatacaaatattttaggaactacagcattgattattctgccagtattgctagaaaaaatttcatttttatctatagatccaacagagcaatataattttagtattgtagtagctgctggaagaacaaaagatattgaaatatatctttctaatgcatttattaactctggggataatataggcattgatcttaggggagattctaaaaataattcatatataaataggatacgtttttctcttgaaaacacaatcaaaagtagcaacagtattggcattctagtaatgaatggacaatctttagaagtaataggagaagaaaaaggaagtatactaaatgttcatggaggggcagggaattgtgctgtaggaaatagtaatgtatttaattctggaggtcaaattgttttttcaggtcaaggaactgtaagtgcacatggaggagatgcaatagatcaacctgcttataatgttgcaatggatggtggtgctggagtaggctttgtagaaagtacatctggaaattcatctgttttaataaaatgcaatgccatagttaatgtatttggaggaaatggtcaggaatgtgatgtgagcaatcctaatagtatgactgtaggaaatggtggaccgggaataagtcttggaaaatcaggaattcttatagttgaaagatgtccggatatttcaacgagcttaactgtatttggaggaaatggtggactaataattgattcaagcaattctggagctatgactgatttgaggataggaggaaatggaggtagtgcagttatacttccaagcggtactgttgatcttttaggtagtgtgcaattaagaggtggagatggaacaacagttgaatcacatggaaatctccctatagtaggtggagatggaggatcagctgtaaaatttattggaactactacagcaaggaatacttttttatctagtaatgaagctgtattatctggaggcaatggaggaacaagtggcgtatatgttgattttgatacgtcgtcaataagaattatatcttctaaaggagggcgtggaggacattcactttttttaggaagtaattcagcaaatgtacagattgatggatcaatattagcatctggagaggggggacaaggtggaagtcctaaagcttatttagataataataatcttgacctagatacactaaaaaacacaaatggtgctaatgagccaggtagtggaggtagtaatggatcatcgattagtggaacaggagcagtaaatttaaatatgtctgaatcaacaattttaaatgcaggtacaataggtagcggtggattcggaattgaaagtgatggaagtttagttgaaggagaaagtggaacaacatctaagccggttgatattataacgaacccatcaccacattttggctatataaatataaatagaattatggatttttcattaaattataacaataatttagttgacgataaagaatatgataaagctttaataaatattaaaaatttatttatttctcagacagttgatagttgtttaaatatagatagtatgaaaattcaatcttattacaaagtagatacacctaatgaaatattaggaaatgcatttatggatcttatagttaattttaaagtaaatgcatatgtaagggaaattattcctataatatgtaaaaaaagtgatgagtgagaataaggaaaccttaaaggtttccttaaaagttaattaattttagtatatagattttaaaacaatattagtagattagattccacttaaatttccagtaacataaacagatacaggtgtttttaaagtcccagtacttcctgttgcagtaaataccttatcataaacagttcctgtaggcatagctaaagttattgtattaccaacaatagtaacaccttgaccagtagtattgctaaggtctattttaacagttccagtaccacttgcagcatctgtatctagagctgctacattagcaggtgctgttagtgtagttacataaaggaagccagatgctattgaaatagcatttggtatatctaattcaacagaaattgttgaaacgtgtttataataatctgctgtatttgttgtaagagctgtctgaagtgctatagcatcatttctgtaataagatgtttttgcagttgttaaattagttggatcgtatgcagtcataacagaagttacttgtgcagagtaagatgttatagaaagagcagctgaagtatcagttgtctgacttacagatcctattaaaacaggtgtaccagtactagtattatcagtttcataaaattcaactatataagttacattgtcaccaggtgtattattagatgcaatatagctaacatctacagaaatatctagattaccagaagcagcataagctattgtactatcagaccaaatagtatttgcaagggaaactggtgctgttgatgctgaaataacaattggagcatcagtagaaaatgcagaatctgctgcaaatttaaatttacttgcattagcatcacttgcaagtacagaaacaagtcttacaccgatatattgagcagtttgatttaatgttgattttgcaatagaaatatctattgaaccatcaataacgttagctggaataccagtagatagtaaatagttagcttcttttaataggtcattagcttgtccgttaacagtaacagtaatatcagtatcagcattggattcatatccattagaaggtaagttgttaatgagtatacctaaggtactggctgcagttgtatttaaagttgccataaaaatttctcctttaatttacaaatttatttattgagtaaagcaatataataatttagcacataatatgagttaacttcccttcaatataatacttaagaagttaaactttaattgcataatatataatattcaaagtaacataacttgacacataattttataaaaaactaacttttaaatatcttgactgtatcagtgaaacaatatacactaatatgagtatttaaagaatttgtaaaattataattgaaaatatagaagattaagaatataaaaattgatatcttatttaagatataatttagataaaacattatagttaattatatattttcaagttaacatagagtaggtgaaaagatgacaaatgaaaagaagtttttaccaataagcaagagagatatgatagatcgaggctgggaccagtgcgattttataattgtaaccggtgatgcatacattgatcatcatagctttggtactgcaattatatcaagagttcttgaagcacaagggtataaagtgggaattattccacagcctgattggaagaatatttatgactttcaaagacttggacgtccaaagtatgcgtttttagttaatggtggaaacatggattctatggtaaatcattatactgtaagtaaaaaaagaagagaaaaggatatgtattctccaggtggaaaaatgggacttagacctgattatgctaccattgtttattgtaataaaataagagaagcatataagaatatagatattgtaattggaggtgttgaagcaagccttagaagatttgctcattatgattactgggaaaataaagttagaaaatcaatacttttagatagtagtgcagatcttttaatttatgggatgggtgaaaagcctatagtggaaattgctgaaggacttaaaaatggtgtaaaagctaaagatataaattatgtaaggggaacgtgttatctagcagagaatttagattatgtacaggattatatagagattccttcttataaagaagtagttagtgacaagaaaaaatatgcagaatctagcaggatagagtatcaagaacaagattctgtaagaggaaaagtacttgttcaaaaacatggaaatatatacatggttcaaaatataccacagcctccactaaacagagaggagcttgacaaagtttatgatcttccatatatgaaaaattatcatcctatttatgaaaagcatggaggaatcgcagcaattgaagaagttaaatttagtacagtaagttctagaggatgttttggggattgtaagttctgtgctattactcttcatcagggaagagttgttcaaagtagaagtaaggaatctatcttaaaggaaattgaaggaattactcacttaccagactttaaaggttatatacatgatgttggaggtccaacagccaatttcaggaagcctgcatgtgatagacagttggcttttggtgcatgtaagggtaaggaatgtctttctccaagtgtatgtagcaatatggatgtagatcacacggaatatttggatcttcttagaagtattagaaaagttccaggggttaaaaaagcttttgtacgttctggtcttagatatgattatataatggctgataaggacgataccttctttaaagaacttgtagaacatcatgttagtgggcagcttaaagtagcaccagaacatgtttcagctcaagttttaaagtatatgggtaaaccaagcggagatacttatgataaatttgtatctaaatttgaaaagataactaagaaaataggaaaaaaacaatatatagtaccatacttaatgtcatctcatcctggaagtacgttagaatgtgcaatagagcttgcagaatatttacgtgacattaattatcatcctgaacaggtccaggatttttatcctacgccaggaacaccttcaacaacaatatactatacaggaatagatccaattacaatgaaagaagtttatgttccaaagagtaagcacgaaaaagcaatgcaaagagctcttcttcaacatagaaatcctaaatattacaatcttgtttatgaagcacttgtagaggcaggaagaactgatttaataggagatggaccaaagtgtttaataagagataagaaaagatgcaatggaaatggaaaccaaaatagtttcttacatgataaatctaaagttgtatctggaaaatcaaagaattctaaaaagattagtagaaataataacagaaattcagataagaattcaaaattaggaagtgctaaagctaaagataattctggaaacaaaaattatattggaaagaaaaagacaaataagagtaaaacttcaggaagaaaaggaagataaaataaaaattattaaaaattgtgcttagatattataatttaggcacaattttttattacaattttctttaatttattttatagtattgcgcctgtttgtataaatgtgacataataattatatatgagtgttttataataaaattataaaatttttatacgaaaaaaattagagtttgccaaagttatggagaagaagggttactaattagtttcataaatataagaaaacttatggcatcataattattacatttaaggaaggtataaatatgtttggaattagtggtttaggtaaagagaacattactagaaagagtattacaagaaagtataagaatgcaagaataacaattcttgatgctaaatataaaaaagttgatggtaaagatgtacttcttgatgaagaaaaggtagacaagctgtttagtgatgtgaataaggcgtgtgaaattaacagctcaaggcataatccaagcagcaagagaattcttattgcaaatgatgaaagtaaaattgaagaattattaaataaagaagataaagaagagcttaaagaaacagtttttaatgatgaattcatggatgtttatgagccaagatatagtatggaagatgtttatcttgaagatagagaaaagaaacagataataactactttaaatattaaaaagcatgaaaatataatatatagacaatggggatttaagaatagttacaatggaaacagaccagttatatttaatttttttggagctcctggtactggaaagagtatggcagctgaagctgtggcaaagtatcttaataagaaaatttattcaataaattatgctaatcttgaatcaaaatatgtaggacaaacacctaaaaatattaaaaaagcatttgaaaaggctagaactgatgatgctgttttagtttttgaagaagcagattcatttttaggaaaacgtcttaccaatataagccaatcggcagattatggtgtaaatataactagaagtgttatgctattagaattagaaaaattctctggagtcgtaatttttactacgaatcttttagagaattatgatgaggcatttaagagaagaatacttgcaagtgtcgaatttaaaataccggatgaaaaaggaagaaaagcaatatttgatgttcatatgccagaaaaacttcctcttgcagaagatgttaattcagaagtgcttgcacaggaatttacaaaagtatcaggtgctgatattaaggacataatatttatggcagcaataaatgcaattgaaagaaaagaaaaagagaataatgaaaaacaagaaaaattaataaaatcagttgtatatgatgaagagaaaaaagcagaaaatgaatgtatatcaggtttaacaactgatgaagaagatcataataaatctgaagataatatacagcctaaattaatagttataaatgctgaaaaggaaattgctgcggactgtgaagataatgaagaatatatcgaatcatcagatgatgtctttgatgaaattagtgaagaaaaagaagaatctaaaatgacagagcaagaaagtgcttttacaaaagcagaagaaccagaacaaaatagtacggatgctgttgtgactatggatgattttagagaagcatatagaaatattaaaaatagatatatttataattaatctttacaaatgattttagcaaggagaatgatgactttgaaaaaattaatatcttggaatgtaaatggattaagagcttgtgtaaaaaaaggatttttagattattttaatgaaatggatgcagatattttctgtgttcaagaaacaaagcttcaagaaggtcagatagatcttgaacttgaaggttattatgattactggaattatgctgagaaaaagggatattcggggactgctgtatttacaaaagaaaaacctataagtgtaaaaatgggcctaggaatagaagagcatgataatgagggaagagtaattacattagaatatgataaattctttcttgttaatgtgtacactccaaactcacaacagaaacttgcacgattagaatatagaatgatctgggaagatgtatttagaaattatctcaaggatcttgaaaaaaataagcctgtaattttatgtggagacttaaatgttgctcataaagaaatagatttaaaaaatccatctagcaatagaaaaaatgcaggatttagtgatgaagaaagaagcaagatgtcagaacttttaaattcaggttttacagatacatttagatatttttatccagatattgaaggtgtatattcatggtggtcttacagatttaatgcaagagcgaataatgcaggatggagaattgattactttattgtatcacaatcattaaatgataagcttgaagatgcaaagatacatacatcaattgagggttctgatcattgtccagtagaacttgaaataaacttataaaaataatttcaagttaaaataaatcaatatctaaaagtaaatctatcagttaagagtataacttggttttaaaattatatttatcacaaaaataatagtactagaaactaaaagaaaataatatatcttgagagataactttgataatttacttttttcattgaaatgtgaataaaaatcaaaaaattttcacattgacaaaaaatgaaactaatataaaataaaagcaaggcattatatttatttttaaatataattgtaaaataaaatttattatattatttttcgaattaaataggtatgttatacatataattaatatacttataatatttgtaaagaaaatggggaaggtaaatgaaaaaagcacttttagttattgatgctcaagatgattttattggggagcagcggagtaagaaaaagtttgattatgaaaatgacattgatgaactgattgacaatattaataatgctataacatgttatgatgatggcaattgtgaagttatctatgttgcacatgtacttccaagcagctatataaataaaaaatttataggttatggaatttcaggaagtgaaggggcaaagattaatgaaaaaataaaaatagtatcagaaaattattttgaaaaacaaacaccaaatgcttttaaaaataataatctaagaagatttataaaagaaaatgacataaatgaagttaagatagtagggtgtgatgcttgtaatgcagtttctgctacagcaaaaggtgcagtagaacttggacttaaagtaagtgtaatgcgcagtgcaacagcaacagtaaacgaagaaagattcattaagttaagcagcaaattaaagggatttggagtagcttatatataaaataagacactttataatcaagatttaccttggttgtaaagtgttttatatttaaataaattttatatgaacatttagcctcatgatgaatagaataaattataagtaaaaggttcttcaggaggaagtataatgaatccatatcaattgatagttaaggttcagcaaaaaatacagaatgaccctaattttgctaataaatttaatgaagcagttggaaagctaaataaagttcccggacttcaaaataaggttttacaaatagcacagataagtaacgatgtacagaggcagagagaattagataaacttcctaaagaagtaaaaaaatctgtggaagaaattctaaaacttttagaagaataagaatttttaattaacatatttaataaagaagagatatacagcaaataaaataatatgctgtatatctctttttgctaaagaaaagaatgttttagagttatattaattaaaatccatttttcttagcaatcactccactttcattgatgccaggttcttcaatacttgtattaaagctgcttttggcatattgtccttgagatttatttccgttacgtaaaaagttttcctttgagtaatttcttttgctgttattttgcatggatatatcatctccttaaaggttagaagtaaaaataggtacatatatagtatgtcctgtgagttattaaatacttataataaatatagttaattaaagttaattataaaaatttataatataaaagaaattatattgtaattaatacattttttatatatgaatgaaattataataaatgacatttataaataatggtgttatgagtaatttatatgtgcgtgtaaaattaagttgataatcatttttaataaatatataatatttattaaaaatgataaaaataattgaggagcgagtattatgataatagtattatcaccagcgaaaacattagaaataaataagaattttagcaatcttccaatgacagagccacaatttttagagaaatctgaaattttaataaaggaattaaaaaagtatgatgaatattcattagctagtcttatgaaaacaagtccaaaacttacagccttgaacaaggataggattgaacagtggagtaaaagtctagataatgcgtttatatcaattggagcatttaagggagaagcttacagaggtcttgatacgggcagttattcaattgaagaattattctatgctaatgatcatttgagaatacttagtggtttatatggggttttaagaccatttgacggtataaatttttatagattggaaatgggaacaaaacttaaatttaaaacatataaagatttatatgattattggggagaagaaatacaagaaaatatttataaagaacttataaatgatgataaaatattagttaatctggcatcaaatgaatattttaaaagtattgaatgtattaaaaaatatgatgatgttactgttataacaccaacatttaaagagaatagaaatggagaatataaagtagtaacaaccaaggctaaaagagcaaggggtcttatggcaacatttataataagaaataagataacagaaattcatgaacttaaaaaatttaattatgaaggatatgagtatgatgaagagttatcaaatgaaaatgaaatgatttttacaagagagaatggatgggaagaaagaattttacataatgtggaatgatagatataattttataagagcttaaaggaggttaggtaatatgattgatattttgttattaggatgtggtggtggtatgccaatgccaggaaggtttttatcagcatctttattaatgtataaaggacgtaagattttaattgattgtggtgaaggaactcaagtatcaatgcgtatgtgtaatgctggttttaaaactattgatgtaatatgcataagtcatatacatggagatcatattgttggacttccaggtcttcttggaactataggcaatagtggaagaagtgaaaaacttactattattggtccagaagggattacaaaagcagtaaatggtttacgaactattgttgaatggcttccgtatgaaatagatattattgaaaatcctaaggagagtattgatattatgaacgaggaagtaaaagtttctttttttgaagcagatcattcagcaccatgtcttggatatagtttttatataaaaagaactccgaaatttgatttagatagtgctatgaaaaacaatgtacctaaaaatttatggaatatacttcagaaaaaatcagaatttgttgaagttgacggagttatatatgaaagaaatatggttatgggagaagagagaaaaggaataaagattagttttattacggactcaaggccaagtatagaaattccagacttcattgataatagtgatttgtttatatgtgaaggaacatatggaagtgatgatgatatagaaaaagcagttaaaaataaacacatgacttttagagaagcagcacagcttgcttgtgagggaaaagttaaaaatatgattttaactcattttggaacagctatgtcagatcctgttttatatgagaacaatgcaaaagaagtttttaaagatacaataataggttatgatagattaaaatttagtatggattttgataaataataaaatatggtataatcgtatagagaatcatacaaaattgctgtaatcgtttgatgaaaatttaaaatacgttgtagcataaagggggaaggtaagtggatttattaacaataattggattaattgtaatattaggtataagcggaatgttatttttaaaagaaagaaaacataaacttatttattgtggacgaaaccagaattattatttagttccattaatcatcattatttttataggagttacatttttctctggaagaagtatcaagccagcagatattatggttgtaattgttattattccagtggcatttgtaggtaataaatgtggaattacagagaatggaattcttttaagcagttatcttacaacgtgggataaaattagttcttattctataacagaagaaaagaataggtatacattatattatgaaggtaatggtgtaagaagaagaattaatttttcaaagtctgttggagaagaagttgataattatttatctaaaaatagaaagataagacatagaaaaaaatagcatacactaaaaaagatattaaatgactataaagttgtttaatgtcttttgttttatactataatttattttgtgataattatataatatgaattttagcaaaggatgttattttatatacacaatttactaggcaaccttgattataataaattcatcatttataatgaattaggttatgtttatttaatatgagtacattaaattaacaatcaattaaaaaagcataagataaaaatataatatctttacatatgatggaggaataataatgaataatggaaaattaactattaaaacaatagttgctattggtatagggtctgctgtattcatgatattaggaagatttgcagctattccaacaggaattcctaatacagaaatacaaacagcttacgcctttttagcattaatggcaataatttatggaccagtagcaggagtatcaataggatttataggtcatacgttaaaggatcttactgcatatggatcaccttggtttagctggataattgcttcagcagtagtgggacttgttataggacttgcatggaagaaaataaaaattgatgaaggtaattttggaaaaagaaaaattataatgtttaaccttactcaaattattgctaatatagttgcatggtattttgttgcacctactttagatattttcatttatgctgaaccttcaaataaagtttatattcaaggtgctgtagctggaatttctaatatgattactataggagttcttggaagtatacttttatatttatactctaagacaagagtaaaaaaaggaagccttatggctgaagaataaattttaagaaaaccatgtaaaggaagatatatattcaatccttacatggttttttgtttgaataaataaaaaattagattatattgaagaagtgcatcaaactatgttaaaattaaaatacttgtgtcgaaaagtaaaagatatataatattattgtatgtaataattatttagataaatgaaaaggaagcggaatatgaaaaaacctgtaatagaatttaaggattttagttttaaatataaagcacaaagcaaaccaaccttaaaaaatattaatttaaccatatatgagggggaaaaggttcttattgtaggtccatctggaagtggaaaaagtacactttcaaatgcaataaatggacttgttccattcaaatatgaaggagatataactggaagcctaaagataaatgataaagaaacaaaagagttgagtatagctgaattatctaatatggtaggaactgttcttcaggatccagatgggcagtttattggacttacagttggtgaggatattgcttttaaattagaaaatgattgtgttgaattaagaacaatgaaggaaaaggtaataaatgcggctaagatggtaaatattgaagattatttaacatcttctccacatagattatcaggagggcagaaacagagagtatcattaggaggtgttattgcagctgaatccaatatactattgtttgatgagcctctggcaagtcttgacccagcaactggaaatatggctatagagttaattgaaaaaataaaaaatgagtcacaaaaaacagttataataatagagcatagacttgaagaagtacttcattgtgatgtagatagaataatagtagttaatgatggagaaatagtgagcgacttatctccatgtaaattactaagttcagaaatattaaaagaaaacggaataagagaacctttatatttaactgcattaaaatatgctggatgtattatagatgaaactttaaatcctgaaagtattgaaaagctgtgttatgaaaaatgtagtgaaaatataaaacagtggtatgataatattgatgaacctgaagagtataatacaggtaattcaatactcgaattaaaaaatgtatcatttgattataacagtaatagacagacattaaaaaatgtatcctttaaaattaataaaggtgaaatggtaagcatagtaggaagaaatggtgcaggaaagtcaactatttcaaaacttatatgtggattttatcagccatctgaaggtagcatattatttgaaggaaaggacatgagggactcaacaataaaggaacgtgcagaaaaaataggaatggttatgcaaaatcctaatcagatgatatgtcagacaatgatatttgatgaagttgcttttggtcttagaataagaaattatagcgaggaagaaatcaataaaatagtattaaatacattaaaaatttgtggtctatatgaatttaggaattggccaatttcagcattgagttttggacagaaaaaaagagttacgatagcctcaatacttgcaataaaccccgacgttataatacttgatgaacctacagctgggcaggattttaagcattacactgaaataatggaattcttgaaggaattaaatgaaagaggagtaacaataataatgattactcatgatatgcatttaatgcttgagtatacagatagagcaattgtattatctaatggaaagatgcttaaggatgatacaacagcagatattcttactgatgaggaagttataagagaggctaaccttagagaaacatcgttatataccttagcattaaaatgtggcattaaagatcctaagaattttgttgaaaaatttataaaagaggataggaggattagagaataatgaatgaagcaatgcttgaatataaatcaatagattctccaatacatagattaactggtgcaacaaagttaatatgtcttattttatggtctcttgtttctatgcttacatataatacgtatatattattgtttatggttatgtttagtttcataatatttaaaatatcaaaaataaaatttaagcagatatcttttgttttttattttattcttatatttttgattataaataatatagcaatatttattttttcgccatatgagggtgttaaaatatataatagcagaacagatttatttcatataataggtccatattcacttacagcagagcagctgttttaccaatttaatgttacattgaagtatttttcaataataccgatagctttaatttttatggtagcaacagatccaagtgaatttgcagcatcacttaataaaataggtgttaattataaaattgcatattcagtgtctattgctttaagatatattcctgatattcagcacgaatatagtgatatatcatttgctcagcaagcaagaggaatagatatgtcaaagaaagcaaagcttagccaaagaataaaaaactcaacagctatcttaatgcctcttatattctcaagccttgaaagaatagagactataagtagtgctatggaacttagggcatttggaaataagaaaaagagaacatggtatagtgagagagattttaagaaaagtgattatgtgtctattgggatattattaatattgcttttagtatcagtagttatttctataaaaactggaagtagattttacaatccgtttatatagagtttaattgggtattatcatagtttaaatataagtttcacatatggttttaaaaaattatatatagatataatttgattttattaaaaagctgcttactgataagcagcttttttaataaaaaaaattataattatggaaaattatgaaataataagttataataaaagtagaatttatgaaatcgattaataaactatattcactaatattatctaattaagtgtaaacattataaggtaaaggtgggagttatatgaaaaaacagaataaaaatagaacgggatttatgagtgttaagggcaaaattgtaacaagttatataattatgttgatttttttaggtacaattgcaagcgtttgcatcaaatcgttgcatattgtaacgaatcaattgttaaatatgcagacaataatagataatgcagcagttcaagcaatgacaaagcagagtatgagacaatcaattacagaagtgcagagtcttgtatctaaatgtactaatatttctttatggatatcaattactggggctattatagcaattatattatcgttttatattataagaggaattattaaaccactaaaagatcttaataaacttgcatattctttaaaaaatggcgatcttacagcaaaacttgagggaaagtatgataaggaaattgctcatgtagttaataatttaaatgatgcaataagtgcaaatagagaaatggtcgaaaatatatttaagtattcagaaaaacttgttacatctaataataatttgaatactgttgttaaagtaattgttgagagaatagatagagttaatgatgctactagtataatagtacatgaagtagagaatttaagtacaatatcagaagaagtaaattcatcaacaggagaaatagaacttacagttaaggagcttaataataatgctgaaaaagacagtacatcagcatttgaaatacgtgataaagcaatgagtgttaagggacaaggagaatttgcagtaaaaaatgcaaaagatgtttatagtaaaataatagaaaatgtaaagtgtgcaattgagcaggggaaagtagttgaagatgtaagaatcatggcagattcaattgcagaaatatcagaacaaactaatttgcttgcattaaatgcagctatagaagcagcaagagcaggtgaaaatggaaaaggatttgcagtagttgcagaggaagttaaacatctggctgagcagacaagagatactgttgaacagataaaaaaagttataaaagatgttaaaacggcgtttgataatttgagtaatgaaagtcaaactgtattagatttccttcaaaatgatgtaaacaaggattatgaacttttaattgaaacagcaacaaattatgttgaagattcacaacttataagttctatgtctgatgaagttagaaagacgagcagcgtaattacagagataataaatcagattgcatcaggaattaatactgtaagtttaacatctcttgatacagcaggtaaatcacaggagataaaatctagtatggatgaagctgcatgtgaagttgaaaatatattaaaatcaataaacgaacaaaatgatattgcaaatgaacttacacgagttattgaagtgtatacagtataaaatttatgttatacttgttttgatcgattatgggatggtattaaaaatatcatcctataatttagtataaaacttgttaatgaggtagcgcatttatgaagaagactataggaattcttgctcatgttgatgccggtaaaacgacattttcggagcatatattatatcatacaaacagtataagaaaatgtggaagagttgaccacaaggatacatttttagataatcatgatattgaaagagaaagaggaataacaatattctcagaacaaggtgtatttgaatttaataattcaacatattatattgtagatactccaggacatgtggatttttcaactgaaatggaaagatctataatgataatggattatgcagttattttagtaagtgcagcagaaggtgtgcaggggcatacaaaaacagtttggaatcttttaagaaaatacaatataccaacatttttctttataaacaagctggatagggtaggtgcggataaaaaaagagtaataggagaaatgaaaaaggaactggcagaaaatatatttgaaattgatgtcattatgtcagacagtaagggacatgtgaattttaatgatgaacttatagaatttataactgaacaagatgatgaacttcttgaacaatatttcgatggaaattactgtgaagaaatatggaagagaaaatttaaaacattgataaaagaatgtaaggtattcccatgttttggaggatgtgctcttcaggatgaaggaatagtggaattcctttttggatttgatgaattaacatatacaacatatgattgtgttgaaaatgaaaatttcattggaaaggtatttaaagttagacatgatgataatggaacaagaataacctttttaaaatgcataaagggatcattaaatgtgagagatgaggttacttatgggaagaatgaagaagaagcaacaactcaaaaaataagtagcataagaatatataatggaagtaagtttagaacgtgcgataaagtaacatcgggagatatatttggtgttttagggctttctaaagcttctgcatttgatacaattggggaaataagagaaaaagatacatgtgaaatggtgcctacacttatgtcgaaagttatttttgataaatcatacaatgtaaaagatgttcttgggtattttaaaatacttgaaagtgaggatccatcactgaatgttatatggaatgaaagtcttaaagaattacatgtacacataatggggaaaatacagctagaaattcttaaagaaatagtatcagaaagatttaatattaatgtggaatttggtccatgtgaaattttatataaagaaacaataaaaaaagaaacaattggatgtggacattttgaacctttaaggcattatgcggaagtgattataaagattgaaccaatggaaaggaatagtggaatatcttttgaaacatgctgtcatgtagatgatttgagtataaactttcaaaaacttataaaaagccatatatttgaaagagaacatcatggacttttgacaggctctagtattacagatataaaaattacattattaaatggaagatctcatttaaagcatacatgtggaggcgattttagagaagcaacatacagggctattcgtcagggatttgaaaaagttgaaaatattttacttgaaccatattataaatttacaatagaagtttttcaagaacatataggaagagttttaacagatattcaaagacttcatggaacttttgaagatccagtaaataatgaaggaaaggtaataataattggtaagggccctgtttcaacattcatggattatactatggaaatagctgcatttacaagagggaaaggtatagtaaaccttgtttatgatggatatgatttatgtcataatagtgatgaagtaattaaaagaagagattataataaaaatgctgatattgagtatacttctaattcggttttttgttcccatggaagtggatatattgtagaatggcaagattcagaccaaaagatgcattgttttaaataatataaatgttcaagattgatctaataataaatatattataagagaataaacccgctgaaagtgggttattctccttgctattacaaacttatgtgcgcattttattatcagcgtaagctgtgtgttttgtagtcatcatatatactgtaatcaaacttagggttcttatattctacaaaaagtaaaggtggtttttccgaacatgaggaagcaaattttactaaggaagaataaaaattaccggattctatggtgattccataattatcatcatttttaatccagctgtttacgaatgaagttatatttattttcatgtaatttccgatttcacttgatgcaatattaaggtgaataacattgtcagtttcaggagttgtattccaagtaacgactttagggtcataatttgatagatttttgtaaacagataatgtgttattactgtaatagcttgtatcagagttgatatcctttacataaaggcataaatatgcatattcaagtggacgtgattcaaggttgtataagtcaaattgaataagtgatttaaacattacggaagaacacgaagttttatggaagcttcctgcatatatatttttacattcatagaagttattattagaatgtccgctgtcaacataagttgtgcttagagaattaatttttaaaatagaacccaaagtaatcagctccttttttatattaattatagaagagtattttaaattcccttaatttaaatatatattaagaaatcaataatattcatgtaaaataatttattatgatatttttatttttagttatataattaaacaaagttaatgaaattttaacaatttatgtaaaaataatttgaaaacattatatagaatgtatatgggagatgtatagatatgataaaatcaataaatttaaataatataaaggaagtcacagaattatttatagaatgtttcaataatcctccatggaatgataagtgggattatttgacagctagcagaaggcttactgacattgcaaatacaccaggttattttggaatgtcatattatcaagaagaaaaacttgttggaattataatgggaagatcagaacaatattatgatggagagcattttcaaatattagagttttgtataagtacagatgtgcaaggaaaaggttatggaagaaaacttctaaatgaatttatcaatgagcttagaaatagaaatataaccaatatatatttacttacacttcatgggaaaagtacagaaggattctataggaggaatggatttatttcaagtgaagacatggttctcatgtcaaaagaattaaataatagtaaataataattaatataataaagtttatgtagaagatacataagaatgggatgtggggtactgtgattaaaatattgattgtagatgatgaaggaattgaaagaagaggaataaaatttttattaaaacaaattaaagttgattttcatatctgtgaggcagcaaatggaatggatgcattggaatatttaaagacacaagatattgatattttatttacagatattaaaatgccttttatggatggaatggatcttataaaagaagttaaaaataatgatataaagtgtaaaattgtaatatttagtggttatgaagaatttgaatatgctaaatttgcaactaaaatgggagttataaattatattttaaaaccagtagatccagatgaatttaaatctactataataagaattctaaaagaaataaaagacgaaaaggttaaggaagaaaaaaatattagaaatatgagttttttaagagaacatattctttattccttagttaatggtacatcacctaaagaactagaaattaaatttaatgatgttattgatttatcatttattaaagaatatagaagaatgattttaatagaatttgcagaagacttttttggagtaaaagaatacgatatagaaaaaataataaaggataatactaatattcagtttaaatatttgaatttaaatcagaggcaatcattgttgtttataaataatataggtttagaatatagagatattaaagaggctgcttattcaatatataatacaataagaatgaattgcatgagtgaatgttttgtatcagcaggaaagaaaattgaaaaagcagaagatatactaggcgcttatggaaaaattgaattacttatagaaaaaagattttataataatagtgatgaacatatatttatagatgatgaggttaatgaaaaggttatatcatctaagaatgacacagatattatattaaaaaaaataaaacaggatatgagcataaaagatactgagtcattaaaagataattttaaaaaattatgtgatttatatgagaatgataatgatatttctaatatgtatgtgaagtttattttttctaatgtacttaaggatttatatgaaaatcttaatgaggttagtgaaaaaggttttaaagaagatattaataagatttataagagctctgattttgcaagtgtagtaagaataattaatgaatatatagttagatttgaggaatctatttcagataatccattacttgttcataaggagattgaaaccataaaaaaatatatttacgaaaattatgataaagatattggagtagaagttcttgcagcgcaagtatgttttgcaccaagttatttaagttatatatttaagaaagaaacgggtcagaatttaagtaaatttataaagtcatataggatgataaaagccaaagaaatgcttgaaactacttatgaaaagatagtaaatgtcagttatgctgtaggttatagaaatgtatcttatttttgtcagagtttcagagaatattttggtgtaagtccacaaaaattcagaaatgaaggtgaataaattaatgaaagtatataagaccttcaaaaatatgaaattcaggcataaaataatgtcaacatatattatagttgcaataataccaattacaattatggggttattatggtataaccatactagaaaaactttacttgataaggaaaatataaatataaaaaattatcttggtcaagcagtttcaaatatggacaatcagttgcgaatatatgataatttatcagattatatagcatttaatcagactattggggatgtggtgggacataagtatgatagttattatgatatgtataatcaatacacaaaaatacttgatcctatgctttcctcattaaagtattttcataatgatataaatcaagttactatatatgcaaacagtgaaatagtccagcatgatactacaatagctccattaactgatataaaaaatgaagaatggtatggtcttttaaatgaaaacagtaatattcattggcttatttcaaaagaagaagaaagtgctttttcagttagaaatatgccatcgctacaatcggattcatctcttggcgcattatatataaatgttgattataaaaagttatttgaaccatttagaaatatgaaggattctaattatggaatttttataattgatcaaaatggaacagatatatttgaatatagtgtcttcgataagaaaaataatttaatggaaataacttatgatacttatcttaaggagaaaaattctacacttaagaataaatatgcagtggtagaatgcaaatcggagacagaagcatggacagtagttttatataagcctgtaagtcttatttataataatattacgccaatgctttatagatcaattatgataattggacttgttgtaataatatcatttgttatatcatcagttttggcagcacatatggtgagtgatcttgaaaaattacgagaaaatatggaacagatagaaagtggaaatatgaggataactgtaaagagtacaagtgaagatgaagtcggaactcttgtgcgtggttttggaaaaatgataaatcaaattaattcacttatagaagatgtatataagagcagaattatacaaaaggattatgaaatgaaggcacttcaagctcagataaatcctcactttttatataatagtttatcacttataaattggatggctatcgaagcggatcaaaaagacataagtggtattactttaagcttatcttcattttatcgtacagctctaaataaaggaaaaaatattcttttagtaaaagatgaaattttaaacatgaagtcttatcttgatattcagcttatgatgcatgattatgaatttgatgccgaaataaatattgacgatgaaatattggaatataaaatattaaatcttcttcttcagcctttaattgaaaacgctattgatcatggtatagatttaaaaagaagtggaagaggaaaaattactataagtggctatatggataatggtaatgtagtattgagtgtatgtgataatggaattggtatggaacaggataaagttgatacaatacttactgaaaattccaagggatatggagtaagaaatgtaaatgaaagaattaaattgtactatggctcagagtatgaaataaaaattaatagtaaaattggagaaggaacaactatgatagttagaattccagctcagaaataaatttatatctaaaaggggctgtatcaaaacaattttgatactagccgataaaaaaagagaattcataaatttgaattctcttttttgcgcataatattaatatgaacactaataatattatacctatgcatcaaataggtttcccaataaatatagaaaatattatatctgatagtgattcagtaagagtgctttatgatgttatggagggattagattattcagaattaaatagaacttactctactattggtagaaatccagcacttttacctaaaactatgtttgcaattatagtttatggatatatggaaggaatatattcaagtcgtgctcttgaaaaggcatgcaaaagagatataaatttcaaatggcttttacaaggtcaactaccaccaggacacaattctatagatagatttagacgtgaacgattagctggttgtatagaaaatttatttaatcaacttgtgaaaaaacttagagaacttaatgaaattcaatttaaaaatatttttattgatggaactaaaatcgaagcatctgcaaatcgatatacttttgtttggaaaaaatctattgataaatttgaagatagactacaaaagaaaataaaagaaagcttaataaaaatgaatcatgatttgaatttatgtcttattattactaatgctaaaatatcagttcaagatgctaattatattttagatagtatcagaattatgattgaagccaataatattgaatttgtttatggaaaaggtaaaagaaaaagtaaattccaaagatatactgaacaacttaatgaatttattgaaaagcaaaataaatataatgaatacaatagcatttttaatggacgaaacagtttttcaaaaacagatcatgacgcaactttcatgcatatgaaagaagatcatatgaaaaacggtcaattaaaaccagcatataatatccaaataggggtagaaggtgaatatattgtaggagtagacatttcaagtgaaagatctgaccagcttacttttataccatttttagatagattagaaaagaatttaaatcaaaaatatgaatccgtaactgctgacgcaggatacgaaagtgaagaaaattatgcatatcttgaatctaagaaacaagaagcttttattaaacctgcaaattatgaaaagtcaaagacaaagaaattcaagagtgatattagtaagaaagaaaatatgtactataacacagatgaagattactacatttgtgcatctggtaaaaaaatgcttctaaaaggaacaaaaaagaaaaaaacaaaatctggatatgaaactactgttagcatctatgaatgtgaagactgtgatggctgtgaatataagagtaaatgtacgaaagcaaaaggtaataaacaaatacatgtggctaaaaattttatgcgtctaagaacaaattcacttaaaaacatcactacacctaaaggaatacttttaagaatgaacagatcaattcaagtcgaaggagcatttggagttattaaacaagattatggttttagaagattttttatgcgtggaaatattaaagttcgtactgaatttttgttaatggcgtttggttataatgttaataaattgtaccataaaaccattcaaaatcgtaacggtgagctgcttcataagcagcaagcttcgtaattttaaatatatagttaaaatatggataataatgtttatcctttatttgtgttatttcaaaataaaatatttggaaatatatacatgaataaaatttacgtttataagaataggctgtatcaaattgaatttaaaaaatttcaatttgatacagcccctttgtttttttatgaatatgaactttttaagtatacgttttaattcaaattattaccataattaatataaaatttataagaaaattaaaaagtgatatatttctaagattttttatatttaccatatgatgaggaaaatataaaattaaattgtagtcaggaatacgatttcataaatattatatatatcatagggggaaacattatgaaaatgaaaaagatgttatcaattcttttaactgcatcaatagcagcaacatgcatgcttggatgtggagcagctaaggagacaagcagtaaggcttctggaggggatagcggatcttcaggaacaataactttaaaagtatgggcaccacaagaggatcaaaatccttcagataaatatccaaatggtattgttccatatttatgtgatcaatttaaagaggcacatccagagtgggatttaaaatttgattatggtgtaatgtcagaaggagatgcagcaaaagaagcgttaaaagatttagatcaagcagcagacgtttatatgtatgcaaatgaccaaataccaatgctagttgaagctggtggtgttgcaaaacttggtggaaaagttgttgatgatattaaggcaaacaacagtgattcaatggtaggttcagtaacttacaatgatggagtttatggagttccatatacaccaaatacttatttcttatattatgataagagcaagtttagtgatgaggaagtaaaaaatcttgatactatgatggcaaaagatttaggtgatggagttactaatttctcatgttcaataaataattcatggtatttaccagcattcttctatgcagcaggcggacaattatttggacctgatggtacagataacgatgcaggaactacttttggagatcatccagaagttacagaatatttagttaaattaaatagtagtcctaaattcttctgtgaagcaaatggagcttctttatctaaattcaaagaaggtaaattaggagcttacgtatcaggaagctgggatgcagcagctattaaagaagatttaggaaataactttggtgttactaagcttccaactataacattaaacggagaacaaaaacaaatgaaatcatttgctggaagcaaagctgttggtgttaatccaacatgtaagaacatggaacaagcagttgctttagcagcatacttaggtggagaagaatctcaaaagcttcactttacagtaagaggatatactccaacatggaaatcagtaacagaacttccagaagtaaaagcagatccagttgcatcagcacaaacattagaaattaatgaagcatctatgactcaaccaatggttaaaaagatgaatgatttctggtcaccagctgaagctttaggaaaaacaattactcaaggggatgtaactttagagaatgcagctgatgctacaaaacaaatgggcgattcaataaataaaaaataggaaagatttaaggagtctgtaatggactccttaaaatgaaaaggagggagtatagtggcagaaaaaaagcaaaattcaaaaatagaattttatacagaatatactgttaaaaatgctataaaaaatggagatgtatatacaaagctttctatgtttattttaggagctggaaattttgctagaaaagaattcgttaagggaactttatttttattaagtgagcttgtatttatttttgaaatgattgcaagcggttgcaatgcactttatatgttaaaatctttaggaacaaatgtgacaggtgaagtatttaatgaaaaaactcaggtgtatgaatatgttcagggtgacaattcaatgctgatacttttatatggtgttataactatatttgcaattatgggatttgtaattatatggagagctaatattaaatcagcttataaaagtcagcttaaaaaggaaaaaaatgaacatattcctacatttaaggaagaaatgacaacatatcttgatgaatgtcttcataaaacattattgttctttccagtaatgtcattaataatatttacagttatgccattagtatatatggcagcaatggcatttactaattatgatagagatcatcagccacctggaaatttattcggatgggttggcttaatgaatttcaaggaattacttagtttttcaggagaacttggtacaactttctggcatgtattaggatggactcttgtatgggcagtatttgctacctttacaaattatattttaggtattatccttgcaatggtaattaatcgtaaagcaacaaaattcaagtctttttggagatttagttttgtattatcagttgcagttcctcaattcgtatcattattagtaatgagtacaatgttacagcctgaaggtgcagttaatgtattattaaggaacatagggttaatagcgccaggtacatcacttcctttcttgactaatgtaacttgggctagagttgcagttataatagtaaatatatgggttggtgttccatttacacttctaacaatgacaggtatactgcaaaatattcctgaagaattatatgaagctgctaaagttgatggagcaaactcagttgtaagatttattcatataacattaccatatatgctatttgttacagcaccatctcttataagtgcatttattggaaatattaataactttaatgtaatttacttatttacaggaggacttcctgcaacacttgattactataaaatgtcagcaggtaagacagaccttcttgttacatggttatttaagcttacaattgaaaataaggattacaatttaggggcagtaatatctataataatattcttaatttcagcagtatcagcattatttgtatataaaagaactaattcttataaaaatgaggagggattccaataatgaaaataaaaaaatcattatcaaatattattgttcatacagtattagcgattttagcagttatttgggtgcttcctatagtatgggttgttcttatttcgtttagagctgaaaaaggagcatatacatcaacatttttaccacaatcatatactctcagcaactatattcgtttgtttactgagacagatacatttaattttccactatggtttggaaatacattagtagttgccatatttagttgtataatatctactttttatgtattatcggtatcatatgttatgtctagattaagatttaaacttagaaagaaatttatgaatattgccttaatacttgggatgttcccaggattcatggcaatgatagcagtatattatattctaaaaggtattggacttactactggtgcattaaaacttgtttcattagttcttgtatactcaggaggtgcaggactgacattctatgttgctaaaggtttctttgatacaataccaaaagctattgatgaagctgcaataattgatggatgtacaagatggcaggttttcactaaggttataataccattatcaaaaccaattattgtacaaacaatagtagcatcatttatggcaccatggatggatttcatatttgcaagggttatagcaggatctgaacctcaatattatacagtttcagtaggattatggaatatgcttactagagaaaatataacaaattactatacaagatttgcagctggagcagttctagtttcaataccaatagccattttgttctgttcagtacagaaatattacatggaaggcaatgcgggagctgtaaaaggttaatttaaagttgtttgaagtatctatttaggttatgataaaaatagaagaggatgtataaattaggaggaaaaacatgaaaaaagttataacaatgcttctaatagtaatatatttttgtcagggcttacttggatgctttgaatattctgaagttcaaaataataattcagatagagataatcaatatgaagaagcgtgcataactccatttggaaaatatccagaaacaataacatacacattaggaaagataattggagcaaacaattcaaatatgccaggcggagatacatatgaaaataatgcatatactagatatctaaaggaaaaaattaatgttcaaaataaagattcttttgaagcacaggatattaattataataatatggttgctatggctatatcagaagaaaatattcctgatatcatgtttgtagacaattatgattatcttaaattgcttgttgaaaaagatatgattgaagatcttacagatgtttatgaaaaatgtgcaagtgacagaataaaagatatatacaaaagctatggtgagggaatatttgaaagttcaacttttaatggaaagcttatggctcttcctgaaactagtattgattcagggcctaacatgatatggcttagaaaggattggatggatagattagggcttgatgctcctaaaacattagatgatgttgaaaaaataatatatgaatttataactaaagatccaggtggaaatggaccagggaatacaataggacttgcttgtgctccagaagttacaagtgataatggatacagttatatgtttcagactgatattattttttcaaaatataatgcatatccaaaacaatggattaaagatgaaaatggaaatatagtgtatggatctgtaacaaataatgctaaaaatgcattgagttatatgagtaagctatataataagggaattcttgataataagtttttagtgcgtactcaaagtaatattcaagatatgatcattaatggaaaatgtggctctttctttagcttatggtgggcacctaacaatccacttatggatagtatcaagaatgataaaagtgcagactgggagccatatatgatacctacagatgaagatggaagtacaagtttttgtatacaaaatcctaataaaaaatatgtggtagtaagaaaggggtatgagcatccagaggttgtaatgaaaataagtagtgtactatttgattatttcaatagtaataatgattcagcgcaagaaataaagcagtattatagggataatgtagatcctactgcacgtcctctaggaattaatattgattacaaggatgctgttataaaatcctatagaaacataaattcggtgttaaatggggaaatggatagtaatagtctgcagctcatagaatactcttattatgagcaggttaagagatatcttaatgatcctcaaaatgctacgccacaagactgggcggcatacacatcaagaatggatgctggtggtcttcttgatagatctaaggtgaaaattattaaaacttatttttataataaggaaacagagactatgtcgaaattatggtggaaactggaagatttagaaaagcaggcatatcttaaaataataactggtgaagagcctatagattattttgatgattttgttgacagatggtataaagaaggcggaagaaagataactgatgaagttcaaaatgaaataaataaaaacactgaaaaaattaaatagaaattatctaaatgtacgattaacagtaaacagtgtaaaaattagtgtgactttatatggagaaattcactaattaaaaatgtatttacacagcatatattaaaaaatgcatattgttggttgtgcattttaaattgatgaaaaatattatgaattgtgtagtttgatataagtataaaatagaaggggaatatattatgaagtttgtttatggaaaaaatgattggagcactatggaaagaggtatggaaaattgttatctacttacaaatggtctaggtggattttcatctcttactataacaggatcaagtgcaaggaatgatcatgctttttttatgtcatgtataaaagcaccgaataatagatataacatgattttaaatttgggagaaaaattagtcacaaatggtaatgtatacgatcttatgactcaagaatatgtaaattctaaaaagaatagaattggatatttgtatgaaagttcattttcctttgaggacataccacagtggttatatgatgcagacggagttcagataaataaaaaaatagcacttaagcaaaaagaaaacactattgctgtaatttatgaagtaagaaattgcactaaaaataaagttaaatttgaagtaacaccttatatggagtttgttccaaagggagagattttaaagaaaagtcaaacatttaatattgataataattctattataagtaataacattaaattaaattacaagactaatggagaaattgtaaattatgatactaaatatgaagatgatatattattttcacatgatgagcgtgatggaagagatgaaattggttgtgcagcacataatcataaaatagaatttaatctttcagctaaggaaaataaggaattttatattatttatagtatggaagaaataaatgaatgcgctgaaaaaataatagatgatgctgttatttatagaaagaatcttattgataaaagtaatattaaaagtgaaattggaaagatgcttgttaaaagtgcagatatgtttgttgtaaatcgtgattctacagatgggaagtctattattgcaggatatcctttttttggtgattggggaagagatactatgatatcccttggaggttgctgcatatatacaggtcagtttgaaaatgcaaaaagtatttttaggacatttacacactattgtaaaaaaggtcttatgcctaatctttttccagaaggaagtgaaaaagcatggtataacactgtggatgcatcacttttatttataaatgcattgtatgactattataagataacaagagatattgagtttataaaagaattatatccagttttagaagatataattttatggtatagaaaaggaaccgattttgggatttttatggatgatgatggacttatatgtgcaggaaaaggtttagaccaagtaacttggatggacgtaaggataaatgacatacttcctacgccaagacatggaaagccagttgaaataaatgcttattggtacaatgcacttaggattatggatgaattttcaactattactaaaaatgaacctaaagattatttagttttatcagaaaaggtaaaagaaagttttaatattaagttttggaatgaagaaaataattgccttaatgatatagtttcattatcacataatgtagaaacaatgtgtgaaaataatcatgataaacaaataagatgcaatcaaatatgggcactttcaatgaactatacaatgcttgataaagaaaaagaaataaaagttttagatactatatttgaaaaactgtatactccatacggattaagaacattagatatggaagatagcgaatttaaaggattttatggaggaaagcagtttaatagggatatggcataccatcaaggaacagtatgggtatttcctctaggcgcatattacgcagcatatctcaaggtgtatgactattcagaagatgcagttaaaaatgtagagttacagcttcaagttattgaagcatcattgagagaaggttgcgttggtcagcttccggaaatatatgatggaaagaatccaacaatttcaaaaggatgctttgcacaagcatggagtgtatcagaaatactaaaagtttattatcttttagaaaatagaggaggagctatataaaatgaaacctttagattataaaaaatactattcttcagaggagtttaaggaaaaatatctttatgataaggatgatttgggaataacatacacaaaagaaaaaactatatttaaaatatgggctccaacagctgaaagtgtagtgttaagattatacaaaacaggtagcgatgaagaaaaatatgctgaggatttgggaatcttttatatggagaaatgtgataaaggggtatggaagaaagaacttataggagatttaaataaagtatattatgactataaaattcaagtagatggaaaaaccaatgaaacagcggatatatatgccgtaggatgtggtgttaacggcaagagaagcatgattgtagacatgaatgagacaaatcccaaagggtttgaaaaagatgtttttggagttaagaattatgatgcaacaataatttatgaacttcatataaaagacttttcttatgatgagaatagtggaataagtcatgaacatagagggaaatatcttgcatttactgaaaaagggacaacattaaaaaatgatggaattcacaagactggaattgactatttaaaagagcttggagtaagccatgttcagcttatgccatgttttgattatggatctgtagatgaaagtggagatgatgaacaatttaattgggggtatgaccctttgaattataatgttccagaaggatcatatgctacagatccatatgatggtatggtaagaataaaggaattcaaggaaatgattttagcacttcataatgcaggtatacgtgttgttatggatgttgtttataatcacacatattcactagattcatggttccaaaaaacagtaccatattattattatagaattaatgatgatggaacattatgtaatggttctgcatgtggaaatgatactgccagtgaaagatacatgtttggacagtatattaagaagtctatactacattgggttaaagaatatcatattgatggatttagatttgatcttatggcacttcataatgtagatcttataaatgaaataagatctgaactagataaacttccagacggtaaaaatatattaatgtatggggaaccatggagagcatcttcatcaaatatggaaaatcgagaagttccagccttgaaagaaaatatacagtatcttgatgaaggagtaggaatattttgtgatgacacaagagatgctattaagggccatgtattctatggggaaattcctgggtttgtaaatggggccagtaatcttgaaaagaaaattcaaagcagtgtagtatgttattgcgataattcagaagaatataatcctaaatcaccatcacaaataatttcatatgtttcagcacatgataattttactttgtatgataaattaatagaaacaatgagggaaaataaggattactgcgtaaaggataaagaacttattgatattaataagttaacagcagctatagttttcacttgtatgggaaatatatttatacaagctggagaagaatttgcacgtacaaaaaagggagaagataacagttataatttatcggcagaccttaataagttagactggagcagagcttatgaatatcatgaacttgttgaatattataaagggcttattgaacttaggaaaaagataaaaaatttatatataaatacagctgattgtgttaaaaatgttaaattcatagaaaccaaaatggaaaatgtagttgcatttacaataaaaaatagtaataacaatgatggattatggaatgaactttatgttgtttataatagttctgaaaaagatgttaagctagatattccagatggaaaatggcagcttttaataaataaagatagttctgagatatttaaaactaaagtagactgcaaaaatgaaattaatgtactagaaaaaagtgcagttatactaggaagaaaaatataataagtatattttcaataagaaaactatgattattaaattagtcatagttttttgcttttaatatagttgggatatatattataatattatttatgtatattaagagtttaaaagaatataggtgaatttatgaatattgaatataaagatagagtcatagaatttgatataattaaaagaaaaagaaagactgcatgcattaaagtagacatagatggaaaagttacagtaataacgccatcaagagtgagtagtgaaacagtagagttgttcgtaaggaaaaaagctgattggataattgaaaaacaagatcacatgataaaaaagtatgaggggaaaattgtaagagaatttaaagatggaaatacatttatgtatcttggaaatgaatatccaattcatataatttatgatgaatcatttaaaagcataagaatttcttttggtggaaaaaccctaaaaagtccatatcctaaattgcattttataatatatacaaatacaaataatgaagaagaaatgaaagtggcaatggaaaaatggtatagagaaaaaaccatggaaattgtaaaagaaaaaatcaaaaaatatgaaaattattttgtggataaagtcagtgatattaaggttaaagaacaaaaaagaagatgggctagctgtactggaaaaaatgcaatactttttaactggagatgcagcatggcaagagaagatgttattgaatatatagtcgttcatgaaatgtgccactttgaacatagagatcattcaaagaacttttggaagagggtagagagtattcttccagattatcaaaaacaacatgaatacttaaaagtaaatggaattaacatgtatttataaaatattattaaagtaacttactagagtttattatgaagtaaaaattaaaaaagcagcgattctttgagaaaagctgctttttatataaaatattaactgaagattaattaaagtacagtatctatttttttgtgtgaacctaaattctttacagcaagagaactgtaaagaaaagcaacaatataaaatacaaatacaaattcagatgaataaagatttgttattgtggctaatgattcaagaacaagaggaagggttatagaatatatacttataatacaacacttaagatatcccaaattttctttagaatttttactgaaaattaaagtcattggtccaataataataaatattgcagccaaattatttataaatgcaagcatagggccaactattaaaagagaaagtgcaaaagctacttttaatagtgaaaaataagatgttagcatatccttatttaaagctatagaagtattttctgaaaagttaatacttgcaattatggaaccattctttttagagtgtatagatgttgaatttatgtatgtaccactgttatattcatctaaagatgaaacatcagttgtcccatttgtatcagcaataagtacatctcctaaagtgaaatctttaataagaatgtttaatattggtgaatcaccagtatatttataaattacaggttcttttgaatcaatagaaagaacaccgtttttaagttcgaattcaggggcttcttttacatatttattttctaatcttgtaacatcatcattaagtgtagctaaagtgcttatatttcccaaagttgagaatattgttgatacaataaataaatagaaaagagctttcaataatccttgagataaaaaatccttgtatgctttaaagttaaaaaaactgtaagcaaacttatgtacaattcctgttttgttttccaaaaaaagacctccttaatatgtttataatttgcacattaatgctaattataacacattaatattcattaagaaataatatattttaatggattttctatgacatatattgtaattcgcaattaagatgtgacaatgaatgcaattatggatactcatttttattaattaatgtggaaatagatgtgttatttataaattattttgttaagattgaaaaaaataagcaaatatgatatcatgtcaaagtaatttaataatggacagttcatttagaccatcctgtccttaaataaaactaggctattgatcttgaataaaatttttagattatacaggcctgtttattatggtaaaaataataaacaggttttttatgtgaattttaattgtagtattgcaaggtaaaagctgaagtttattaatttcagcttttatttttaaagatttatttttagattggcagcttaaacaaatttatatattaagaggagattatttatgtttaagttaaaaagtgaagttcaatttgatatggctcattatttgagtgggtataatggaaagtgctctaatatacacgggcacagatataggcttattgctaaaataggaagtgaaaccttacatgagtgtggtcagtgcagaggcatggtagatgatttttccaattttaaaaatgcactgaagaatattgaggaaacatttgatcataaacttgttatagaagataatgatgaaggaagagcattatcagaaaaattaaaagaacttccaaacaattttgatatttattttgttaactatagacctactgctgaagaaatgtcacgtgatatttttaatagacttaaagatatgggactttctgtatgtgaagtggaattgtttgaaactcctaataatagctgtatttatagtgaataaatatatgaaacataaaaatcatagagtattaaattaaatatttaaatttgtgaattatgttgcataggtagaatcaataaaaaatttattaattattatatggtgattatggaggataaaaatgtttaatataattgaaaaattcttatctgtagatggtgagggaccaagtagtggagaacttgcaacttttataaggtttcaaggatgtaatttaagatgttcatggtgtgatacagtttattcatggcagaaggaaaatattaatgagagattgaatgcacaagagatatatgattatataaagagtaacaaagttaataatgtaactttgactgggggagaacctcttattcaaaaaaatatagatgaattattaagactacttgatgatgattccaatttaaatatacatattgaaacaaatggaagtattgatattgaaccttttaaaaagaaatatacaagaggaaatataagttatattgttgattttaaacttccaagtagtaaaatgagttctcatatgaattataataatataaatatgattagtaaaaatgatgtttataagtttgtaattggaaatatggatgatttaaaaaaagcatatgaaattattcatgtatatgagttagcaagcaaatgtcaggtttatttaagtcctgtaacaggaagtattgaaatgagtgatatagttgaatttatgaaagataagaatatgaataaagtaaggcttcaggttcagcttcataaaattatatgggataaagatgcaagaggagtttaggtatttaactgttaaaagctaatagtttagttgacatatgaaagtttacaatagatagattttgataaaaaacataacaacttttaaccattaattttcaattcattaagtggtttatattattgacttaatgtgttacaatttaattgatttaataaggaataagcagagtgttaaggagttaattttatgagttgagtctattttaaatatttagaaaatcagcttatcattacttaaatatgtggatatttcctttccagatgttttgtacgacataagataaaattgcttgtaagaagaataggggtataaatatgaagaaaaaaatagatactgaaaagattcaggaatgcataagagaaattttaatagctcttggagataatccagatagagaagggcttaaagatacaccaaagagagtagctaaaatgtatgaagaggtatttgaaggcatgactcatacaaatgaagaaatagctgccatgtttggcacaacttttgaggaagaaagctgtgttgaggaagtacataataatatggttattgttagagatatacctatacatagctattgtgaacatcatcttgctctaatgtataatatgaaggtaagtgttgtttatattccaaataaaaaaataattggattaagtaaaatagcaagaatagctgatatggttggaaaaagacttcagcttcaagaacgcataggagcagatatagcagaaattgtatcaatgattacagaaacaaaagacgtaggtgttgttataacaggtgaacatagctgtatgactgcaagaggaataaagaagccaggaactttgacaacaacaactacctttattggtgattttgaagagaattctatgttaagacaagaagcacttcttttaataaaacaataatatttaacttgttttataaatcttcagatgtaaaagtaaatggtattaaattatagattattgaatgttttttatattgattaatatgtaagaatatgatattattacaaagtaaattgaatatggacagttcatttagaccatcctgtccttaaataaaactaggctatttaattgaaattatttatgtattttaaaaaatattataaagtttgaattataggtctgttttattatttttaataaaacagaccttttgttttttgactttttatttcagttgttatgcctgtttttctgcgggaataatctgtaaataaaaagtttttttattaaattttattcttataaatttcttagtaaatagtatggtctatataaagaaaaaattattatagaataggagcataaaaatatgaataaaaaggctgttgtcgtattttcaggaggacaagattctacaacttgtttgttttgggcacttgaacaatttgatgaagtaattgctgtaacttttaattataatcaaaagcataagcttgagatagaatgtgcaaaaagcattgcaaaggaacttggtgttgagcatcacattttagatatgggattacttaatcagcttgcaccaaatgcattaacaagagatgatattgaaattaaaatgggggaaaatggtgaacctccttcaacatttgtagaaggaagaaatatgcttttcctaacttttgctggtgttttagccaaagtaaagggtgcaaaacatattgttacaggtgtatgtgaaacagattttagtggatatccagattgtagggatgtatttgtaaaatctcttaatgtaactatgaatcttgcaatggattatgaatttgtagtacatactccattaatgtggatagataaagcagaaacatggaagatggcggacgatttcggaaaattagaatacgtaagagaaaaaacattaacttgctataatggaataattggagatggatgtggcaaatgtccagcttgtatccttagaaaaagaggattagacaattatttagaatctaagaaaaaaagataaatataaaagagcagttttttgagagggtttattataagacatatatttatggtataaatggtgtgctttagatataaaacaatgttaaaatcgaaaaaataaaaaagttaaataattattgtataagaggagacaaaacatgaatcaaagcggtcgaaaagataaagaattagaaggtttatcacttcttggaaatcaaggtacaaaatatgattatagttataatccagaggtgcttgaggtatttgaaaataaacatccagacaatgattattttgttaagtttaactgccctgaatttacaagtctatgtccaataacaggacagccagattttgcaactatatatataagctatataccaagtataaaaatggttgaaagcaaatctttaaagttatatttattcagctttagaaatcatggagattttcatgaagattgcatgaatataataatgaaagatttaataaaaattatggatcctaagtatatagaagtatgggggaaatttactccaagaggtgggataagtatagatccatactgtaattatggtaaaggtggaactaaatttgaagaaatggctaactatagaatgatgaatcatgatctttatccggaaaaagtagataatagataaaattaaattaaggtgtcttaaataatgcattatgcatatttaaggcaccttaaattttagaattttcatgaagattctaaaatatttatttctgattaatttattaattcaaaaataccaagtatgattagtaaaactcctgaaattagtggagcatatttaccgcatatggatcctaaaatgttatggccaattgatttacctaacataagtagagcaatacttaaaataaatgtacatattactgtaatagatacattgacgcctgtaatactagctgcaagtccagttcccaaattgtttaacattaaaccaagagatacaacaaatgcttctttaatatttaaagttccagaattatctgaatcagatttttctgcataatccattatttcatctacattttttaaagcaaggctattagagtaagatttaggaataagttttaatatgctttgtattaaaaaatacagacctaataacattatgattactgcgcctaacatatttgttaatgaggtaggtaaaaaacctgatatgaattttccgacagacatggatataagagttcctatagaagttacagtagcaattataagattagatattagtcctatttttatttttttaactccatatgctattcctataaccaaattatctaaattagaagataggctgtatagcagagctgagagaaatactgccatttaaattcctccttaaaattacaatttattatatgattcaaaatttatatggtgattaatagaaaattaagtgattatttgcataattattttaaatatagagtaatgaacatgaatactaaggaattaaattataaattaatgaatgaaaaataaaatttaggataattatttagatagatagtagaaaaattttagataaattaaatcagtattaaaaaaatgattcaacgattacataaatcaaagaaagtttgttaaaaaaacgacatttgttgacaaaaataataaaacaaattaaaatacattgtatgctatgtatttgtgttaaggggagatgataataatggatttatataaagaagaacctgttgtaggtgggatgattcagcacattgctcatgccatgtttaaagaaacaaatagggatttactacagtataatcttacgggagttcaagcaaatgttcttgtgtatttgttctttcatgagaaagatgaaaatatatttcaaaaagatattgaaaagcacttaaatcttacaaatccaacagttacaggaattgtaaaaagacttgagcaaaaagaaatgatacataggcattgtagaaaagaagatgcaagatataaatgtcatgtattaactgacaaaggtagagaatttgcaaagcttgcagtagattatatgaaaaatgaaaaagaaaaacagattttgaaaggattttcagatgatgaagctgattttttaataaggcttctaaacagaatattaaaaaatttaggggaataattcaacaaactatcataataagtgcaaattatgtatttattatagatatatatagtgtgctatgtgtttgcgatgataaagacacatgcagtatattttaaagtttagagaggtgaaacaaatgataaagaagttattttcctattcaggaaaatataaaaaatttttagggtttgcagcagtatgtgcagctcttgaagcaatgattgagttgcttattccacttgtaatggcaaaaattgtagatgaagcaataccatctcagaatatgtcatatacagttaaactaggagttataatggtatcaatggcacttgtatcatttacttttggaatattattatctaagtttgcagctactgcaggacagggattgggtgcaaatttaagacaagcagaatatgaaaaaattcaaacatattcatttagaaatatagaaaaatttagcacagcatcgttgataacacgtcttactacagatattacagcagtgcaaaattcagttactatgggagttaagcttcttgtaagagctccagtaatgcttatatttgcaattatattatcaattaatataagtggaaaattagcagttatatttgcagtaactttacctatactagtagtttctataggaattcttgttaaaaaagttggacctttatttggaataatgcaaaagagagtagacaacatgaatactcttgttcaagaaaatttaataggagtacgtgttgttaaatcttttgtaagggcagaaaaagaaaaggaaaaatttcaaaaaggtaatgaggagttaaaagaaacagcatctaaatcttttggattaatggttatttcaatgcctataatgcagataataatatttagttcaattattgcgattttatggtttggtggtcatatggtatatgaaggaagtttgactgttggtaagcttacaagctttattgcatattcaactcagatacttgtttcattaatgcttgtagctatggcacttatgatgatttctcgttcaattgcatcagctaaacgtattattgaagttttagaagaagaacctgatatagcagatggtaaagagaatgttttagaagttaagaatggtgatattgaattcaaagatgtaagctttaaatatgaagatgatagtgaagaatttaatcttgaaaccatatctattaatataaaaagtggtgagactataggtattataggtggaactggttctgcaaaaacaagtcttgtgcagcttatacctagactatatgattgcaataaaggtgaagttcttgttggaggagttaatgtaaaagactataatatagaaactttacgtaatgaagttgctatggttcttcaaaaaaatacactgttttcgggaagtattattgataatctaagatggggtaatgaagaggcatcaatggaagaaatagaagcagcttgtaaaattgcatgcgttgatgaatttatagatagacttccaggaagatatgatatggacttaggacaaggtggagtaaatgtatctgggggacagaaacaaagattatgtattgcaagagcaatactaaagaaacctaaggtgcttattttagatgatagtacaagtgctgtagatacagcaactgattcaaaaataagaaaagcatttaaggaagatttaaagaatacaacaaagataataattgctcagagaataaattcagtttctgatgcagataaaattattgttatggatgacggtaaaatttcagcaattggaacacatgatgaacttatgaacacaagtgaaatttataaggatgtgtataattctcaacaggaaggagttggtttcggtgaataattcaaaaaatggcgtgaaaagaagaggaccaaagcctaagaatgttaagaaaactttaggaagattgtttggatatataaaaaaatataagatcatgcttgcagctgtatgtatatttataattataagttcatgtgccatgattacagggtcatactttttaaaacctattgttaatgattatattattccaggagatttttctggattattaaaaatgttgataattcttggaggaatttatgcagcaggagcactatctacattagcatatggaaaaataatgatctatatatcacaaaatacaattaaggatattagaaatgaattatttaataaaatgcagcatctgcctgttaagttttttgatagtaaaacaaatggagacttaatgagtttatatactaatgatattgataatattaatgaagctttgaataatagtgttactaatattttatcatcaggacttacatttattggtgtaattgtaatgatgatagttttaagtccagttctaagtattattacattttgtacattaggcataatgtttttaataatgaaactagtaggggtaaagagtaagcattattttggtgagcagcagaaaaatatgggaaagttaaatggttatgtagaagaaatgatagaagggcaaaaagttataaaggttttttgtcatgaaagtaagtctattgatgactttacagatttaaatgaagaacttagaaatgcatctacaggggcacagacttttgctggttttatgatgccagctcttggaaatctttctcatataaattatgcaattacatgttgtgttggtggaattatgacaataggaggattgtttgatgttggttcattagttgcatatttgcaatatgtccgtcaaataacacagccagtacaacaggtttcacaacagttaaatgtaatacttgcagcacttgcaggtgcagagaggatatttaatgcattagatgaagaagatgaaattgatgaaggaaaggttactttgtcatcaacagtaaatgataaatctaatgattttgtatggaatattaatgagatttcaaagaaatcagtacctcttaaaggtgatgttgtatttgaaaatgtagtatttggatataatgaatctaaaacaatattaaagaatatatcattatatgcaaaggcagggcaaaagattgcatttgttggatctactggtgctggtaaaactacaataactaatctcataaatagattctatgaaataaattcaggaactataacttatgatggaataaaaataacagacataaaaaaagatgatttaagaaagtctataggtatagtacttcaagatacgcatttatttactggaacaattgaggaaaatataagatatggtaatttaaatgcaacaaaagaagacattatacaagcatctaagcttgctaatgcccatgaatttataaagcatcttccacatggatatgatactatactatcaggagatggagatggattatctcaagggcagaggcagcttcttgcaattgcaagagcagctgttgctaatccaccagtattaataatggatgaagcaacaagttcgattgatacaagaacagaaaaacttatatctcaaggtatggataagcttatggaaggaagaacggtatttgttattgctcatagattatctacaattaaaaatgctgatgcaataatggttcttgaacaaggcgaaataatcgaaagaggaaatcatgatgaattattagctaaaaagggaagatattatcagctttatactggaaaagctgaattagcataatattataaaacaaagaaaactctgagtataaaaatactttgagttttcttttttatagatattttattcttcttctgaatcagcagcttcttcagtgacatcatacatatgttcaattaatcttattatgtagcttaatgtgtgaaattccttgtctatttcaagttttatataatgcattccttcaataagagtattctcatcaaatttttcacttaaaatcataaatgaaagtccgtttaaatttccatccttagtatctaaaactcttgatttttttatgaattcattttccatagcactttgtgctactttttgtaattcttcactaatatttagttcaggcatagaatcaaatattttgatatttttgttatctagatttaagtttttggcagtactcaaatcacacccaacaaaaatagtatttttaaatttagcattactaaaatctgtactagttagattagcaccttcaaaaacagtatcttcaaatcttgcttctttaaatttgcttccttttaaatttgaacctataaactcagcacctttaagattggatctatagaaattacattttttaaaatgagcgcccctaaggcttgaaaattcaaaatgtgagtttgaaaaatcacagttatagcaattagctcttgtaagattactgtacataaagtttttattgcttttatcagcattattgtaaaagaagtttccatttttatttttatttatagccatgttatcctccggaaatatattttatgtatggttttattataaatactcactgatacagaataaagagatattattctacaaataagtcatatctgtaatagtatatttagtagggtaaaaagtcaatgatttatactaaatatatattggattggttaaagttactatattagatgaatgtatataaatttattttaacaatgtattagccattataaatgataaatgtgaaaataaaaagactgccacattgtggacagtcaagtgcctgaatgattaattttttactttgctaaaaattaatacttgtgattaagaattatttcttttaggtcattgatagtattattttttatagcattattttttatgtcatccagtaatgcaattattgaatctttacctaacataggattttgatctatgagtatttctaaacattctctttctaaagtttcactaattgtattcatataatcgcctcccatatgcaatatctcgattcttatccttattttacatcaatatctttaaaattggaatgatatagtttacacttaatcttaaaaaataaagaaatactataagtagaacttgtaaaataaggatttctttattttttgcaatatactaaattattatataattatttttaaattttattacacaaatttaaaggacttatgatgaactatttaggttctatagaatattgcttttgatcatttgaatctataattaaattataagataatccacaaactactatgattccaccaataagtttatttataggaagatgacctgaaacaatccagtctatgactattccagtaaatagctgtcctataaatattagaagtgttacataaaaagcagaaagtttaggtgtaacaacactatttagaattacaatgcttactcctaaaatacctcctaaatagccgtaaaaaggtacagtttttaatgaagaaagattgaaactttcaccaacaaataaaaataatattattgatgttacagcgcctgttagataattaaaataacttgattcaagaagtcctattttttctgaaagctttgtattaagaattcttgagacaactattataacacctgtaagaatagataaaaatataaaaatcattttttatgctccttaattttattatatgtagtttaataataaatattttgttataaaaatgtcataatgcacactccgataattattacaattatgccaataagtttctttttattaaattcaattttaggcattcctagaagaccataatgatcaaatacaattgatgttaatgattgacctaaaagaccaagtgcaacaggtagagatactccaattgaactgtaagtaatattattgataaggacagtagccacactaattgctcctgcactatagagccaaagtggaagagtcattttaaatggaattttaatttttttataaagcataagaaatactaatagtgcatatccaagaatgtgtataactataagggaagagtaatttcctatgccatttgataattctccattaaatgcaaccattattgcaatcagtattccgattagtaatgataaaaaattatacataagctctcctttaattattatttttctaaatatagtttaaattattaaatataaattattataggacatatgtcatgtttctatattttaataaaaattactatatgttaaaatataaaaagctaatattgaaggagaattgaaattggtaaagatagaagatgaaaagatattaaatgattatattgaaaaatatcatattgatgaactatttagtgaagatatgaaacagtacatggagcttgttcagtggaagaaaaatgaatttatatgtgaagaaagtgaaaagctcagcagtttatattttattgttgatggaaaagccaaagtgtgtaaaaatatggagaatggtaaagccttattaatttgcttttataaaccttttagaatgataggagatgtggaattcacacgtactaatactgcagattgcactgttcaagcaatagatgatacgtatggtataggaataaattttaatgttgttcgcactaagcttgtaaatgactgtaaatttcttttctatatatgtagatatcttggtgaaaagcttagtataagtagtactaatagttcaattaacattttatatagtttggaaaataaacttgcaagttatatttatgcttttgttgagggaactaataataaatcagtatttaagtttgaaggtagttactctgaaattgctgagttacttggaacaagctataggcatttgaacagggtattaaataagttttgtaaagaaggtatactagagaaaaaatcaaagtcatatttgataaaagatcttgaaaaattaaaattcctatcgggtgacttgtataaatagtattaaaaacatatataacaaaaacttacactaaaaaatgatattagtgtaagtttttgttatatatagataaatttatatggtttatattcgaaagaaatttaatattcaatgtgataatattttttcttatggtaacactaattttgaagggaggaaagaacatgaaaagaagattcaaaagaaatttaaaaagtattacagctttaactttgatatttatttgcacttttttattaataccaataagtgcttcagcatttgattcagatttaaatattgctttagaagatgaagttaaacaagaacctaaaaaagatgataaaaataaaggtgagaactcaaagcagaatcaatcaaaaactgaagagaaatcaaaggataagggttcatcaagtgaaagcaataagagtagttcaaaacctgaaaaaaccaatgaaaattcaaatgctgaaagtaatgaaatagaagcaagatcagcattattaatggaaccatgcactggaaaaattatttatgaaaaaaatgcagatgaaaaatttgctcctgcatctgttactaaaataatgactatgcttcttactattgaagctgtggacagtggaaagatagctttagatgataaagttacatgtagtgaaaatgctaaaaagatgggcggaagcactatgcttcttgatactggtgaaattagaacagtagaagagcttttaaaaggtgttgcaatagcatcaggaaatgatgctgctgttgctttagcagagtatctaggtggaactgaaaatgattttgttggtatgatgaataaaagagcagaagagcttggaatgaccaatactacatttaaaaactgtaatggtcttcctgctgatggacatttatcaacagctaatgacattgctaaaatgtcaaaggaacttttaaaacatccaacaattttaaaatacactggaacttatatggatacaataactgaaggacgtaaatctccaatagaacttgtaaatcataataagcttgttagattttttgatggatgtgatggattaaaaactggttttacaaatgaagcaaagtattgtataagtgctactgcaacaagaaacggagttcgtatgctttctgtaataatgggtgcaccaacatataaaataagaaatcgtgatgcatcaatattattgaactatggtttttcaaagtatgaaggtaaaaaaatcttctcaaaagatgaagaagtagataaagtatatatggatgaacagactgatagatactttatggcaaaagcacaggatgatttaacagctgtacttccaaaaggatgtaaagacgaagtagaaaagaaggttgtaatagacgaacttcaaaaggaatacaaagaaggcgatgttgtaggtaagtgtgaaatttaccttaataatgaaaaaatcggagaagttacaatttattgtgatagaaacataaagaagggtaacatattcgataatattaaatacaatattacacacttatttggagacaaagaagaaggtaacgaagaaaaaaagtaataaatagcattaataaagactgaggtaatctattatctcagtctttgttaatgcttaaaattttattgctaaaattagtggtaaatatttatggaagaacacttgtttacatattttcttgtgttgtggggtagaaattgttattatatatatgtatttatgaaataagtaatatggataataatattttattatatgaaataaaagacaaaactgttttagaaatattaagcaaaagaaaaatgctacaatctatgtagttagtgaaattggagacggaggtgagtggatggagcttccaaagattaaaattaatgattttgaaggaccgtttgatttattacttcatttaatacgaaaaaatcaaatgagcatatataatgtgagaatatatgaaattacaaatcaatatctgaattatcttaatgaaatgaaagaaatggatttggaaataacatcggaatttatagtagttgcagctacattaatagaaataaaatcaaaacacttattacctaagcctaaaaaggaagaggaaaatgaagaggatgtcgagaaaaatcttttagaaaagcttataatatataaaaaaattaaaggagtttcaaatttctttaaggatagatatataagttctggggaggtttatggaaagaagcctgagataattgaagaagtgaaacaaaaggaaaatcatgatgatattttgaaaaatcttgatttacttcaactatataatatatataacaatcttcttgaaatttataacaacaagcaaaacagagggaatataattcaaaagaaaatttatgtagataaatataaaattgaagataaattacaatatatagtaaatagaatgaagaatgaacaaataaattattttgaagaacttatagatacaagtgaatgtaaactagagacaattgtcacattcctagcattacttgaaatgataaaacaaaggatggtaaaggtatatcaaaacgatagttttacaaagataattattgaaaggagaaataacattgaaggagactaaaggactacagattcctttcatggatgacgcaaaaaagtctgaattaaaatcggcagtagaagcattattgtttgcaagtggagaacctttaagtatttatgaactttcaaatcatctggatgaaaaatctaagacaatcgagttaataattcaagagatgatggatgcttatgaaaaagttcaaacaagaggaataaagcttataagcattaaaggaaaatatcagcttgttacaaaaggtgaaaatgcagaatatatacagaaacttttaaagaaaaataaaaggcaatctttgtcacaagcatctatagaaagtcttgcgataatttcatataagcaacctataacaagaattgatatagacgaaataagaggagtaaagtcagaaagtgctcttcaaagactaattgaaaaagatctaataaaagaagtgggaagacttgaagtaccaggaagacctatcttatatggtactacggatgaattcttaagacaatttgatttaagagatttaaaggatcttccttcacttgatttatttggacaggatgatgatgaagttacaagtgttgaaattgagaataatgaaaaatattatgatgtagatgaagaaaagacaattaataatttagaataataaaattttatacaaaaaaatgatggaaatattatttaaatgctattttcatcattttttcttatggatttttatataaaaagataaaaagtaactaacatactgttaataaaaggtagatatataataatataataaagagcagtaataatatatctatgattatttataatgtattaatcattattagaacatgtatcagataaatcatctttttttattgaatcataacaatcagattttttatttttgttagaagagatatctttaatcagatttttgatcatatctaaaacctgagggatattatcagcaattctatcataagtattatcatgttcgataggcatcattctaaccatatcatcttttattacaagaaaagttattggttttactgaaactccagagccagcacccccaccaaatgggtaagaattttcttcaggattatttcgtggtgacataaattcacttccaccggatacaaaaccaaatgatagtcttgaaacaggaattatacatgtaccatcttttgtttcaattggttcaccaattactgtgtttgcatcaatcatatcacgtaaattttccattgtactacgcattaaattttccactggctgttcatttgacataataataatcactccttatttatattctcaaatttgtttttttattttgtgcaaaatatgtatgcaatattttaataaaacaaacatcatataaataatgtttgcaaatgatatgaaaattatacttttaatttcaaattttagtagtattgcattatcgaattttggtaatatgtcaaaattatattttttgggtttaaataaaatttttataaaaaaatatattaaagaaggaagagttgatagaattccataggacaaagctgttttagcagcatcattaaggctatattcaagctttgaattaaagtttaaaataggcttaaattttaaattaataaatttatttatgatttccataatattggaatatgttattatttctgatagtttagatttcattggaggattattttttttttggtctgttttctcttttttcttttttaacactgcattatcaaagagtataaagtcgtataatttaatatagtaattattattataatagtatatataaaatttaagcggaataggaaaaaacataaatataataaaaagagtaagtaaaagtttcataaatatcctccaaatctaatacatctaataagtattaccaaaaatataaataataaacatattatttgagtaattattaggattaaaaaataaatttcttgagataatagaattaagtagtaattttattgatttatatcaaaattagaagagatacaaaagaaatttaggggtggtaaattatgaagaaaggcattaaaataagttcaatcttattattatgttcgttatttgttcaaattttatctgtagatgcatatggatatataaattatgggaatatttcatactcatataacgaaaaaagtgaaaataaaaatcttagggttaatgcacgatgtgcaatagcattagataaagaaagtcatcaagttctttacgaacaaaatgcttatgaaattgttccaatggcaagtactacaaaaatattaacttctcttatagcaatagaacaagatgatttaaatgcacctgtaacaataagtaaaaaggcatccagtataagaggatcaaaagttggttataaagaaaatgaagttattactttaaaagaactaatttttggacttatgttcaaatcaggtaatgatgcagctattgcaattgctgaacatattggtggaagtgtggaaggttttgcagagataatgaatcattatgctaggggaataggaattttagattcacattttgaatctccccatggactagatagtagtcaacattattcttcagcatatgatttagcacttttaacttgcaaaggcatggattatgacttgttccgtgaagttgtagggagtaagtctatttcaaaagataaatacaactttactagggactacaacaatataaataaaatcttatggaaaatacctggagctaatggagttaaaacagggtatactggtcaggctggaaagtgccttgtatcatctgtgaataacaacaataaagacataataatagtagtattaaattgtccagatagatggaatgtcacagataagatatatcagcatgtgcaggaagcggttgcttttggaagtcataatgttaaagatttggtttatagatatgagtagtatataaagttattttataataataaaaaattaaatgaatatatttagtaataagatataatccaatagtcatatattggattatatctatttttattttaaaattattaatcaaatctattaaattaattaataggagagtgatagaatgaaaacagcctatgattatacaagagagtttatttctgttttagcagatattgatgaaaaattagagatgaaatccaacacaaaaaataaagaggaggaaaatagattagacaaagaaattgatgaattagaagaaaaaatgtttcaaattaaaaataaattaaagaatatgatttgattaatgaatattgttaggttgtattagtaatttaataaaaaaatcatataagcggcataagtttttaataacttatgccgcttattctcataaaatataacgaatatgttgatttatagatgaattaaatcataaaatataatttagaatggatttttttaatttagcttatagaagcattttgtgtaaataatctgttaaaataaatatttttacaaataattaataaaaagttatagtataaataacattgtacagctatcattaagttaagagttctaatatatatagtattaggaagtggatatgaatatattattaacttaagggagtggtttaattatgaaagtcagaacacattttcatttagcaaaattatcattaagaaatttaaagccgttttatcctaaaaatttttcaataaatatgttttattttggtacaatacttgcagactgttgttggcttgcatatacaaatcctcatttttataaaaaatctgataagtatgtagaagagaaattggatgatttattagaaacgaaggaatttaattggtataattctcttcagcttggaattataatacactatttatgtgatttttgctgttattcacatataactgatagtatcggaaatgttaatgagcatatggcttatgaaagaaagatacagaaataccttcttaacaatattaaaaacttaaaaactcccaaaagaaaaacaaataaaaaaacaattaaagagttgaaaagcagaattaagagtcagattttaaaatatagaaaaggaaaacattgctttagatgggatattcaaaactgtattgaaatgagtagtgatgtatgtgaagttatctttatgcaatttaaaaataaggaaggttttaagcagatggcaggatagaaaaggcagtttcaaatttatgaaactgcctttaatatatattatataattatacctttaggttgtcttttttcaaatgtaaatacatatttaaaaccaatatcttttaaaagattatatgtattttcaatattctcaccaactctattataattgtgagaatctgaacctacagttattatttctccttttagatccttatacatctgaagaatttctaattttggaaaaagaagattttctttcaatcctgaagtgtttacttcaatacctttaccattttggataatagttttcaaaatttcatgaattatatctttatatgtattaaagtcatatacaccataagttttaaaagcatacctttgtacaagatcaagatgccctaaaacatcaaaatctgaattggatgaaagctttaaaacttcattaaaataattttcataagtagaagacgagccaagttctcttaagtttgtattaagtcctcgtccatttatattatgtatagaacctatgataaaatctaagttattttcgctaaaaaatttattaaattcattattataaaggtgaatttcaccagcttcaagaccaatttttattttgataatatctttgtatttatgagaaagctcatttatttctttttcataatcagtgaaattgaaaaaattatagctttggtcatctggatcgaaactaatatgttcagttaaacatatttcgcttatattcatagaaattgctttttctattgcctgttcaatagtttgtactgcatcaaaagaatattttgaatgcatatgataatcaattaaatatttcatttttaataaacctttctttgtttaattttgaaaaacaaatttattatatcatataaaataatatatgagttttattgagaagagtaaattaacaaaactagacaataagtaatttagttatgtaatatttttattttgggaaatatgttataataagtgaaaagaaaaattaaaatactagaaaaatgggggcagtaagaatggcagtaaatttaagaggaagaagttttttaaaactattagattttacgcaagcagaaataagatacttaatagatttatctaaggatttaaaaaatttaaaaagggcaggtatacttcataataatcttaaggggaaaaacatagttttattatttgaaaaaacatcaacaagaacaagatgttcatttgaagttgctggaatggatttaggacttggagttacatatcttgatgcagctggttcacaaatgggcaagaaagaaagcattgcagatacagcaagggttcttggaagaatgtatgatggtattgaatatagaggatttagtcaggaaacagttgaagaccttgcaaaatattcaggtgttccagtatggaatggacttactgatgaatttcatccaactcagatgatagcagatcttcttacaatagaagaaaaacttggaagacttaaaggggtaaacttcgtatatatgggagatgcaagaaataatatggggaattccttaatggtggcttgtgcaaaaatggggcttaattttacagcatgtgcacctaaagaattatttccagctgaagaacttgttgaaatatgcaagaaaattgcagatgaaaatggatgtacaataactttaacagaagatgttaaagaaggcacaaaaaatgcagatgtaatttacacagatgtatgggtttccatgggagaaccagaagaagtatgggatagtagattgaaattattaagaccatatcaagttaatagtgaagtaatggctaacgctaataaagaagctatattcatgcattgtcttccagcttatcatgatttaaaaactaaagttggtaaggatgtaggagaaaagtacaaaatggattctattgaagtaactgatgaagtatttgaaggaaaacaatcagtagtttttgatgaggcagaaaatagaatgcattcaattaaagcaattatctatgctactttaggagtataataatataatagagtatatttaaaggagcaaagtgtgaagcattaaaaacatacttttgctcctttaattaaaagttttatatgattaaatatatttgttttaattattagtagattggagagtaatttatgatagaaaaaaatatgagcttaagagatggtcatattcattcacctttttgtcctcatggaacttcagattcccttgaatcttatgttgaagaagcattaaaaaataagattattgaaattagctttactgaacatatgccttttccatgttattttatcgaggacagaaagtttcaggatgaatgtgcaacacccaaagatcgtatgaatgactattttgaggcagtgataaaggttaaagaaaaatataaagataagataaaaataaatttaggaatggaagtagattttattgatggacttgaagaaaacacaataaatcttcttaatgaatatggtccaagcatggaggatggaatattatctgtacatttcattaaattaggtgatgaatatactgctattgattggaaagaaggttttgaaaaggcagtaacttattatggaactgttgaaaaggtatatgataagtattatgaaaccttattaaaagccgttaaatatgatttgggtcagtataagccaaaacgtataggtcatcctaatttaataagaatttttaataagctttatccaattgaatataaaaattataaactgttggaagaattagcaaaagcaataaagagcagagattatgaggtagatgtaaatactgctggtcttagaaagccttattgtggtgaaatttatgtaagtgatgtgtttaaagatttagtagataaatatgaaataagaaaagtttatggatctgactcacatacatcaaaggatgtgggaagagattttgataaagaatagtttattattgaatttttaatttataaaagcctattatgttttgggagaaataattatggaaaaaggaagagaatttattgaagaaattacatcatacatttttgttgaaggtaagattgagaagtctgacataatatttgttccaggaggattatacccagaacctatggagaaggcttgtgatctatatttacatggatatgcaccatatatacttccatcaggaaaatttagtatgaaatttaatggttttacaaaacctgaaagtaagaaggacaaatacaaaaaagattataaaactgaatttgaatttttaaaagatgtggcaattataaatggagtaccagaagaagttgtattaaaggaagattgtgcaacatggacaaaacaaaatgcttttaactcaaaaagagttacagacaaacttggacttaatgtgaaaaaagcaataatatgctgcaaatcatttcatgcaaaaaggtgtcttatgttttacagctgggcttatcaaaatacaaaatttatagtttgtccagttgatgttgatggaattaataaagaaaattggtttaagagtgaatatggaatacagcaggttatgggagaactttcaagatgcggtggacagtttaaaagtgcagtagaatcatggagaatagattaaacacagtttgaaataatgtgatactaaaagttattatattttaaaagagacagcttattataaacataaacaaactgtctcttttaatattgtatactttatttttaaatagctgaaaataaacttattaattagtttttactatattatatttaacattatctgataggtttgagcttccttgaagaacaacttcatcatctgtagttaatccatcagttattacgagataatcattttggttttcggaaacagtaacagattttttagataatctatcaccatttattatataaacatatggtgaatcactatctttattgaaaacacactgacttggaacaagtacagattcattttcattattggcattaaatgttacatttgcaaccattcctacctttaagttttcatcaggattagttatatttatttttacatcaaacattcctgtagatgtgtctgcagagggagagattgcatatacagttccactatatgaagctccagatgaaggaatgtagatatttgcatcaagcccttctttaatattttgtatatttgtttcagtaacttttatcgtagtttttaaagtattttcattagtaattatacatgaaggggtttgtgtagatgtatattctccaacacttatgttttttgcacttatttttccatcaacaggtgctttaattactgcattatcgaaagaatactgagctaaatctaaagaagctttagcactatccatggatgcttttgctgctgttatattatcaggatttgtaattgaacttgtaatagtagcatttgcacttgcgctattataacttgcatttgcattgctaagtcttgtttcagctgtagaaagtgccatggatgtattgtcttttgcaagatctaaagcagcttttgcagttgttaatttatcttgtgctgcttctaaatcaacttctgatgcgcctccagcagtgtagagtgtatttgtacgatcataatttaacttggctgaatcataagctgtttgtgctgaagttatgtttgtattattagaatattgatcttttgcaatatcataagctttttgagcatcttttagttcattttgtgctgcttctagtgctttttctgcatctatttgtgcttgttttgcacttccacttgcaactttatcgtaagatgcagatgcagaatcatagtttgcctttgcagcatttagtttatatgttaactctgtattatcaaggacaaagagaacatcatctttttttacttcttgtccaagttcaaaattgatactttgaacttttccaggactacttggaaatacagaaatatcatcttgactttcaatattagatgtataaactgtgtcgcttattgaatcagaacttttaactttagtcaatgtaacattggctatatcttctttagtgaatggagaacagcttgtaaaaaatgtgcttaaagatagtataagtaagattgctaagattttatttttcattatatttcactcctttcatagagtcattattttaattttatttttacgattgcattcatacctaaagtaagagggagattatcattattttctattgaaacttttacaggtacaagttgtgtgacttttgtataagttccgcttgtagaaaggcttgaagttcctgaaaaataagtttgtgtagtattatctatttctgtaactttgcctttaaatgttttatctggatatgcgtctaatgttatttttacatcttgtccaactaaaattttacgtatatctgtttcttcaatgtttacacctacatacatattatctgtatcagctacaattgcaaggggagtagcagcacttacagtttcatttttcacaacatcattttttactattgttccattgattggagaagttatataaggaaggacttgttgtcgtccaagaacttgatctttttttacaacatcaccaacatcaacattccattcaataaccttaccattagtcacaggagttattgtgtacattttggaagtgattttagcattatctgttttgaaatataagacattagtgctgtagaaataatacccgatactacagcttacaataacaagaactattaatacgggatatataattttttttggtattttcatattatttttcctccattaaaaagattattgttcacattcatcaaattgactgttatataaatgagcataaaatccatcagtttttaataattcatcatgacttccttgttctataatatcgccatctttcattacaaggataatatcagcatcttttattgttgataatctatgagctattataaagcttgtccttccattcataagatgatccatagctttttgaattaatacttcagttcgtgtatcaacagaacttgtggcttcatcaagtataagtattttaggatctgatagaatcgtacgtgctatggttaaaagttgcttttgtccttgtgatatattatttgcttcctcgtttaatattaagttatatccattaggaagcgcttttataaattcatcacaatgggcagcttttgcggcatttataacatcttctttagttgcatcgaaatttccgtattttatattatcaaaaatactggcattatatagccatgtatcttgaagtaccataccaaacatttctctaagatcatttcttgtataatcttttatgctgtgaccgtcaataagaatttcaccagaattaatatcataaaatctcattagaagttttataattgttgattttccagcaccagtaggaccgactattgcaattctctgaccagattttatatatgatgaaaaattatttattattattttatcttcagtatatccaaagtgcacatttttaaattcaacattaccgacaactgaatttaattttattggtgaagatgtgtcgggaacttcttcttcttcatttaaaaactcaaaaactcgttcagcagcagcggcagtagattgaagtgtatttgaaatatttgcaagctgtgctattggttgagtgaaagaacgcacatattgaataaatgactgtatatcaccaacgtctattgtcttttttacagcaagataacctcctaaaatacacacagcaacataacctaaattacctataaaactcataattggcatcatcattcctgataaaaattgtgatttccatgctgaagtgtagagatcgtcatttattttagtgaatgtttcaattgcctctttttcgccattaaaaacttggacaatattatgtcctgaatatatttcttcaatatgtccatttaatgaacctaaagatttttgttgttgcttaaagtatttttgagatttttttacaacacccataatgaggagacctgataatgggattactaaaaaagcaacaaaagtcataagaacactgatagaaagcatcataataagaacaccaattacagttgcagttgaagttattatttgagacaaactttggttaagtgtttggcttacagtatcaacatcgtttgttattcttgataggacttcaccatgtgttcgtgtatcaaagtatttcaagggcaatttattcattttatgtgaaatttcttttctgagtttatatgttacgttcatggaaacaccagacattatatatccctgtatgtatgcaaataatgctgatattaaataaaggactactaaagatataatacagtttcttatataggggaaatctgtaagtaaatttgttcctaaaaggtaagctataagaccttcaaataactttgttgttgctttacctaaaattttaggaccaactattgaaaaaagtgaagaaaatgctgctaaaataataactgctgttattttacctttataatcttctagataatgaattaaatccatcattgtttttttaaaatctttagcttttgctccaccgcccatttttccacccattcccatgggtccgcccataggagggccacttcttttttcactcatgataattcctcctgacttaactgagataaagcaatttctcggtagatattgcaagttttcataagattttcatgagtaccttttccagctatgtgaccattatcaagaactattatttgttcagcattcatgattgtacttattctttgagcaactagaagtacagttgaacttccagtttctttttttaatgcttttctaagtgcagcatctgttttaaaatctaatgctgaaaaactgtcatcaaaaatagctatctgtggctttgaaagtaaagctcttgcaattgacaaacgctgtttttgtcctcctgaaacattatttccaccttgtgctattatttcatcgaatctttcaggtttagaatcgataaattccattgcttgagcgatagaagcagctcttagaatattttcatcactagcatttttatcagcataagataaattactttttatagttcctgaaaataaaatacctttttgaggtacataccctatattttttctaagctcatgaagatcaatattttttatattaatgccatcaattaatacttcacctgaagaaggatcataaaatcttggaattaaatttatgatgcttgattttccacttcctgttgatccaataaatgcagttgtttcaccaggtcttgcagtaaagctgatgttatttagtacatcctcatcacctccaggatatctaaaacaaacatttttaaactctactaatccagtacaattgtcaattttagaggcaatattattattcttaattgatgttttagcttcaagtacatcagcaatacgatcaccagatacggaagctcttggaatcataataaacatcatagaaagcattagaaatgcaaagattatctgcattacatactgcatatatgccatcatttcaccaacatccattttgaagcctgatacttgattagcacctacccatacaattaacactgttactaagttcattattaaagtcataattggcatcattgataccataactctgttaacaaataaatttgtatctgtaagatccttatttgctttgtcaaatctgttttcttcaaattcctgagtattaaatgctcttattactaggattccatcaagattttcacgaacaacaagatttaatttatctataaggttttgaattattttaaatttaggcattgctattgtaaaaatagtaagtataagaccaagaagacatattatagctaatgcgattatccaggacatggatttactatttgcaagagcatgtacaaaaccaccaattgccattattggagcataaaaaatcattcttatactcataactataagcatttgaatttgtgttatatcatttgtagttcttgttattagagatgaagtcgaaaacttatcaaattctgcattagaaaatgtctctatatttgtaaacaggtcatttcttattgtcctacacattccagcggcaatcttggcagctaaaaaactaacaataatggtaaaaactgcacttagaagtgaaattccaagcatggtaaagcctgtttttataatgaaatttttatcgcctacagtaatacccttatttattatgtcagacatataatctggaagtgaaagatcacaaatagcctgaccaaataaaagaattatggcggcaatgattagcagaatataaggttcggcatatttaagcagcttaatcatattctaaaattctcctttgatacctaatatatgaaaattatgataccgcagtataataaaaatgtaaataggttattaaaaaaaatatactatagtaatttgtaatattgactatagtgttaaatattgctactatgaaaatatattacagggaggagaatttaatgatgcagtatgaaaatgcaacaaagaagaaaattagggaggttgcattaaatctaataaatgaaaagggatacgataatgtaacacttaaagaaatttgtgaagcaagtggtataaacaagcatacattttattattattttgattcaaaggatgaccttttaaataaatattataaaataccatgtcagcttacatctaatgatttggcaacaataatgacagctgattcaaatgtggaaaaattatggatgctaaataaaattttcattgatttcatagaaagttcaggagttaccatagtaaaacaaatagtcataaaaaatcttaatgactgcaatataggaacttttaaggttaataatgaccgtaagcagattttaaagattcaaattgatattgtaaaaaaagctcaagaaaatggagaaatattaaataaaacaagacctgatgtacttgtgacactattgtttcagcaattacacgctacagcagtcagatggtgctttagaaatggctcatttgattttgaatatatatcaagatatttttttgaagttattttagatgttccagaagcacagagaaaatgcaaagaaattgatgaggatatgctattttaaattaagtatttaagagttaattaaatcatatgaaaatagaaatattaatgatataattaactgactgaaaataaaatttatagcaaagtgagaaaatagtatgatttatgaaagtttagaaaaaaagattaacaaattagataatgatattgaagctttaagaagagctaaacattatttaagcaataaagatgaaataaatgaaattatggataatttaaataaggaaagacaagttcatgcagatgaaatatatcttgttgacagcatggcttatactgaatgtattgattatataagaaatattatgaacaaggaacttggtagagatgagcaaactgatcttcttgagtacataaaagaaatccatggaagaaagtgtccaaatgtaagtaaaaaaagttatggattaaatgcatggcttaaacatcttgatgttgaatgtgaatggattcaatacgatgataaagaatgggcaggtcttattataactggaattatccctagagttcaataaaaattaaatatattattaataaaaaaatcatatgtgtaattttagttttattacacatatgattttttattttgcaaataattagaaatgttaagaatggtacatgttatgtaaaagatgagttaaaatacgtaaaaagcctttaacaaacatttatctaccattaaatttctgtataataatttttgtggattaattgccactaatttcaaataatttcaaaagctataatcatatagtaagctaattttggaggagtaataatgataaaacgtgcaaaaaaattaatgactattttacttacattaacggttgttttaagtgcaagtgcaggggtatttgcagcagacaatgatggatggacagaggctagtaagacatcagcagcagacaatggagaatgggaaaaatggtgtgatgaatgggaacaaataaagaataatcctacacaggtttctttaacaccaggtaaagatgaaactgaacttaacttttcatggtattcaaaaaaatctaatgaaaaaccaagatttaagtttggaaaaagagctgatttaaaagatggaaaagaaattgaggtaactagtgaagaagctgtgagtggatatgtatctaataagtgtattgttacaggattaactgaaaatacaacatattattatagttatacagttgatggaaaatggagtgaaccagtttcttatagagcaagaagtactaaagaattcgatatattatttgtaggggacccacagattggttcttcaagtggaaacatagcaacaggatcagaaactgaacaaggacaggataaagcaactagaaatgatagttttaactggaataatactataaatacagcattaaaagataatcctaatataagttttatgatttcagctggagatcagatacaatcaagagataagaaaaatccaagtaagacatatgacaagaatgaaattgaatatgcaggatatttaagtgcagatgctcttaagtcgcttccggtggcaactactataggaaatcatgatgcaccaagtggaaattattcgtatcatttcaataacccaaatgcttcagaacttggggaaactgtagcaggtggagattattattatacatatggaaatactcttttcatggtattaaatacaaataattataatattgcagagcacaaagaatttattgaaaaagctgtaagtgaaaataaggatgcaagatggaaagttgttacactgcatcaagatatttatggttcaggtgaacattcaaatgagccagaaatagtatctttaaggtattcattagttcctatatttgaagataatgatattgatgttgtattaactggtcatgatcatgcatattcaagatctcacatattatctggtggatataaagaaaaggatgaatctaaattattatcagaagatgattttgaaaaatattttgatggtgaagttaaaagtgatgaaaaatatgaagaatatttaaaatatgttgaggataaaaaagctgttgagacaacaaaaggtgatattaataatgtagttgatccagaaggaattctttatatgactgcaaactcagcatcaggaagtaagtattatgatttagttactagaaaacaatcatatattgcatcaagatggcaagaagatgttccaacatattctacaatccatattagtgatacagaattttcaataagtacttatagaactgataatggagaaaaaatagacgatacatttaaaataactaaaacaaagtagaaaattcataagcagagatagtatatagattaaaacaaaagaagaattataatattgagaaagatgtttttagtaattgtgggagtaagtatagaaacttgctcctatggtttttttaggaggtcaagaatatgcttgcaaatttatttagtaataagaaagataatataagaagaggtataatattaacattaggaattggattttgtgtatttttattattttttaataattttcagagagttcagcttgtaaatagagaaggaacgagtttcgaaaaaggaattgttactgagattgtagatgaaaataaaaatacacaagaaagcaggcagaagataaaggtaaaagtactcagtggtgaattcaaagggagaactattgaggcaacaagtttttatggatatctttatggagctaaatgcaatgttaatacaaagattattttaaatttaagcacaagtggagataattattctgcatctgtatatagttattatagagaacctataatttatggatttgttggacttttcgtattaatgttatgggctattggaggcaagaagggattaaagtcagcaataggtttattttttacattcatgtgtatattatatctttttatacctatgctttacaaaggatattcaccattctggtctgctgttgtagttgttattttaactacaattgtaacaatgtatcttatagatgggtttacagtaaaatctgtaagtgcaactctcggaactataattggtgttataatagcaggcgcttttgcagcaggatttggatatttcagcagaatatcaggatacaatgtatcagatattgaagaacttatatttataggaaataatacaagtcttcaaataggaggaatattgtttgctggaattttaatagcttctcttggagctgttatggatgtaagtatgtcagtagcttctacaataaatgaaatttatgaaaagaataatgatcttagcagaaaagaattgtttaaatctggaataaatgttggtcgtgatatgatgggaactatgtcaaatacattaattcttgcatttactggagggtctattaatacattgattttatcatattcatattgcatgcagtataatcaagttatgaatatgtattctataggtattgaaataatgcaggggatatcaggaagtattgctgtaatattaacagtacctttagtgtcattaataacatcagaacttcttactaataaacgtatattaaataaggtgagaaaagaagcagtgtaaaattaatgttgactaaataaaaataaagatatatcattattgtaaggaattaaaatttaattccttacaataatataaaattaagtatagatttcaatatgaagtgagggaattttgtgagtgtctagtatcaataaataataaatttaatattaattcaaaaatagggttttatatacctttgtttgttgttgaattaattaaattgttgatactacaggtcatgaattttctttattaaagacagtattatatatttttaattgaaataatattatataattccagcaaatatgaaatgtgttaaaagaatttcataatgattgctagttgatttatataaattgttaaattatatgtattacttgctgttttatgttaatgataaattttaagctgtggaagtatccatagcttttttgcttacctatgaaatctatacagaattcatggcttgaatttaaatatataatgaaagaggaaatttaaactatgaataatatgacttttgaaaaattacattatgataaattaaaagaaattgtaaaatcttattgcatgagtggacttggaaagaagttaatagataaactatatccaagttgtaatataaaaaatgtaaatagaatgttagatgaaacaagtgaaggacgaagacttttagatgcaggatatcatattcccttagaaggaatttttgatatatgccctcttcttgataaaatagataaaggtggcgtgcttgaaccatcagaacttacatctatatgtgacttcttaagagggtgtaggaaaataaaaaattttattaaggataaagaaggatatgtagaaactttaagttcctatggtgagaatataacagaacttaaatatattgaggaagaaattgaaaatgcaataaggggcagtattgttgattctaatgctacaaaggatcttaaaaagataagaagacaaataagtatatgtgaagaaaagattaaagaaaagcttgaaaaatttattaagaatacatcaaatagagaatatcttcaagagttttttgtaagtcaaagaaatgggagatatactgttcccataaaagcagcttataagaatcatgtacagggaagtattgtagaagtgtcttcaaaaggaagtactgtatttatagagccaaatataatttcaaaatatactgttgaactcgtagctcttacagcagacgaaagcgttgaagaatataaaattttatctacaataagtgaaatgatttatgagaggatacaaagtcttaaagttaatattgacgtaatttcagaatatgatatgatacttgcaaaagcaaaatacagcagagaaataaatggaattaagccaaggcttaatgactgtggatatataaatataatccaaggaagatataatcttattgaaaattgtataccacttgattttcaaataggtgattcatatagaagtctcataattacaggaccaaatgctggaggaaagacagtagttcttaaaacagtaggacttatgactcttgcagtaatgagcggttttcatgtttcatgtagagaaggaagtgaaatgtctgtatttgataaggtgtttgtagatattggagacaatcagagtgttgaaaattctttaagtactttttcatctcatgttaagaatcttgcagaaattttaaaagacagcagaaaaaatacattacttttatttgatgaaataggaagtggaactgaacccaatgagggggcagctcttgctatagcaattttagaagagttttatcacaagggttgtataactgttgcatctacacattatggtgagataaagaatttttcagaaaatcatcctcactttgaaaatgcagcaatggaatttaaaaaggatacactcgaacctctatatagacttcatatagggaaaagtggtgatagtaatgctctatacatttctgaaaagatgggaatacctgagagtattctgaaaaagagtagaatgtatatgggaaataaaaattataactatgaaaaactaaaagatagtaaaataaaaagaaatagtgaagaaaaatcatttaatgctgaagtttcttttgaaaaaggtgataaggtaactatacttgatataaataagagcgggattgtatataaggaaattaatcagtttaataatgttatagtttttgtagatggagattttaaggaaattaattataaaagacttaaaattgaatttaaatctatagaattatatccagaaggatatgatttaaatcagttatttatttcatataaagagagaaagcttgaacatgatatagaaagaggttcaaagaaagcacttaagaagataaaaaaggaaagtaaagtataaaatatttcttgggaaatatttacaaataaaacttgtagatatttcccagtataattgttttacaatatgaaaaggtggggatatacatgaagtttaatgcaaaattaattaatacagcatatgaaatgtcaacaattttaagttttgcttttagtcttaattttattattattaataaggacatgactttaagtaatagattaatgcttatattgtggcttataataacagcaataggtgctttaaaaattgtaattaatagagttgtattaaataaaagcaaagaggaagcttttgaaaaggcacttgccgaaattaaggaaatttttaagggaaataactctgcaccaatcatatatattttaattggaatgggaagtttatttataaaaatagcaattccatttatgattgcattaatataaaaaagtagctacatcgttatttgaaagactaaattatagtctgaaaacagcgatgtagcttattttattattaataaaatataagttattataataaaaaagcataatgttaatcttaattattaggctttagaatgaaaaaaatgatttattatatcaaatattagcaaaagatatttgtagcaatctcaagtaaattaaataatctaatataggagaagcaattttatcaaaaggagagaacatgataaaagaagctgttgaatgcattgatttaggaacagagtactgcccttgtaaattagcagaacaagggcaatgtcttatttgttcacaatgtcagggagaatgtttctgtgattgtttgaattggaaaggtgtatgtgtttatcaagaactttataacaatggtaacaaagctaaggaaggacgtaaaacttatgattgtacagttactgaagtgactaattatgatgataaagtgatcatgattaattttaaggcaccacacaaattagttttggatcttgtaaagccaggaagttatatttttataaggactgatgaaaataattattttgatatacctatttctataatgaatagtgatattgataatgatattcttactgttgccgtagaaatgagaggtgttaagactaataggcttttaaatacaaaggaaaatgaaaacatagtaataagaggaccatactggaatggtgtatttggacttaaaaatattaaagctcagaataataaaaaagtacttgttttagctagaggaataggattagctccaatgatgccagtaataagaagacttatatcaaaaggaaataaagttactgcagcattagatatagagccatttagtgaaaactttgcagataagtttttacaagagtatgatttagatataaaagaaagggtacttattgaaaaaggaaaattaaccgagtatgcaaaagtaataataagggattcattaaatgatggtgcaaattatattcatatagcaggtgcagatattcttacttatgatgtaattgattatcttaaggaaataggaagagatgatgtaacactttcttgctgcaacaattttaaaatgtgctgcggagaaggtatatgcggagcttgtacagctagattttcaggacataaagtaaaaaggttttgtaaggagcaggctgatccaagagccatatttgaggggaggagatttatatgaaggttatcattgttggaggtggctggtcaggctgtgctgcagctattagcgccaaaaaagcaggcgcagatgttacagtaattgaaaaaacagatcttttacttggtcttggtaatgttggtggaataatgagaaataatggaaggtatacagcttcagaagaacttattgcacttggaggcggtgaactgataaagatgacagataaaatatctgttcatagaaatatagattttccaggtcataagcatgcaacactttataatgtaaatatgattgaaggtgaagtaagtaagtatttaaaagatattggtataaatcttatgatggaaagcagagtgaatgatgtcaattttaaggatggaaagattaaaggtgtatatttaagtgatggatcttatattgatggagatgtctttattgaaacaacaggaacaacaggacctatgggaaactgtttgagatatggaaatggatgttctatgtgtgttttaagatgtccagcatttggtccaagaataagtataagtcaaagatgcggtataaatgacattcagggagaaagaggcgatgatattttaggtgccatgtcaggttcgtgtaaacttgtaaaagaaagtttatctgatgaaataagaactgaactggaaactaagggtgttgttgtattgaaggttccagcagaagatgtaaattacggaaagcttgaaacaaaagtatgtcaacagtatgcattgaaggaatttgctgagaatatcgttcttcttgatacaggtcatgctaagttaatgacaacctactaccctctaccaaaattgagaaaaataaaaggattagaaaatgcaaaatatgttgatccatatgcaggtagtaaaggtaattcaataagatatctttctgtagcaccaaggactaatgatatgaaagtaaaaggagtagataatttattctgtgcaggtgaaaaaagtggtttatttgttggccatacagaagcaatatgtacaggaacactggcaggacacaatgcagtaagactaggcatgggaatgccattattaatacttccatcatcaatagctataggtgatataatagcatatgcaaatgaaaaggcagcaacaagggaaggacgtaaagatagatatacatttgcaggtgcaggttattttaagaggatgaaggctttaggtctttacacattggatattaaagatattgaggacagagtaaaaaaagtaaatcttgataatatatttgatgaaaagctatgttaaatttattaaattagattaattcttaatgttatagatagtattataaatgccagttaagagtcagaattaaatttaatcctgattctcttagctggcatttattgtttgaattttaaattataaatgttcaatataaaacatagatatggaatttataatatcttatgaatatgatttacctaaagcatcagcacctaagatagcagcataaaccatttcatcagttaccttaaatggcatattatgaatactttcaccttctgttgttgaagctttggctacggccattatatcttcagttttaggattttctatacccatatcagaaagtttaacaggtagtccaatttttttgcagaataagattatttgttcaatttcatcaattggtgaattttcaagaactaattgaacaattgtaccaaaggcaactttttcaccatgataaaggtgatgacattcttcaagtacagtaaatccattatgaatagcatgtgcaccagcaagtccaccactttcaaaacctattccacttaaaaaagtattagcttcgataatgttttccacagctttagtacataccttattttcaacagctagcttagcttttaatccatcagctaatagcgtatcataacataatttagctaagcccattgcagccaatgtaacagagccaccagcacatgtttgtgcgttagatttaaaacaagctcttgcttcaaaatatgtagccaatgcatcaccgataccggaaactaaaagtcttgcaggagcagcagcaacaatatcagtatcaactagtaccatattaggatttgtaggtaagaataagtattcttcaaaaactccttcatcgctgtatattactgataaagcactacatggtgcatcggttgaagcaatggttggaactattgaaataggagtttttgtatagtaggcaacagctttagatgtatctaatattttaccaccacctataccaattatgttatcacagttatgttcattaaatatttgtattattctgttaatttcatttttgctacattcaccattaaatgtttcaaaaaatatttctgtatccgtattagcaaagctatttttaactgtattttccactctctttaatcctgaaggacttactaagattaaagattttttacccaatttatttacatgaattcctaaattattgagttctcctttaccttgaatatatttacttggtgaaatgattatattagacatttataccatctccttttaaataatatattatatgtaatatattaacatgtatccagaaataagtaaacattttcaatggctatataattggaatttagactttttacaaagttaaatattaatatagtagttattaagaatacatttgttatatcttttttgtaaataacaaatacatgtttttattagcagcttagattataattcttaaaagttctaatacttcatgtataatatgtaagtgattatgtttatattacttttatggttattttagtaaaaaacatttaatgattctatgtagatattgttaataagatatttagaattttcataataaaaataactataaatataaataatattttatgagtattaattattatgagaaaggaaaggtatggttatatgaatattataaaagatagatttttgaataaggttatgataattacaggagcagcaggtggaattggaaaagaaattgctttaagaagtgctaaagaaggagcaaaattggttttagcagatatgaaagaggaaatgagtagagaaaccttaaatgaaattaaagaaattactactaatgtggaatttttaatagtggatctagctaaagcagagaattgtaaaaaggttgtagatacagcaataaagaagtttgggggaattgatatactaatcaataatgcaggtattacaggaacgcctgcaccagtacatgaaatgacagaggaaatgtttagaagagtatttgactgtaatgtcatgtcagtttttcatatgtctcactttgcaataaatgagatgataaataagaattgtggtggcgctattgttaatgtatcatctgttgcaggcttaataggatttccaggacatagcgcttatgtaacatctaaacatggactaaatggattaactagaaatatggcactggattatgctaaaaatggaattagagtaaatgctgtaaatccaggtacaacagatactcctatgtatcatgaagctttagagtttttgaaaaataaaagagagaaagcagctaaggaaggagttaaggcagaaagcaatatagtatcaggaaaaacagtatcaccacaaaatagagtggcaactgctcaagaggttgcaaatgtttgtttatttttagcctcagaagaagcaagtaatgttacaggaatatttatgccagtagatggtggatttacagcttattgataattaataatcatgcttttatgcacacccattggtgaattttcatcaatgggtgtgtattttatgggaagatttgtaaagagataaattttatttagagatttatagaatatattaattaatagcatcaaataagaataaaataaaaaatgaagaacgtatgtttgataagcctgtgcacttattgtataattatttggaaagaagggaggataataaaaaatcatagtacgattttatacatggttaataaccataaactttataataatactgatattgtataatttaagcttattaattctgtaatttagaagtgattaaagtgggattaaacaaaggaataaaggagaaaataataatgaaaaatttaaaaagattagtgagtatttttgtcgttatgataatttcatgtatgctcatttcatgtgggaatcagtctaagagtgatgatagtagttcgttgcttaaagtccactttattgatgttgggcaagctgactctatacttattcagtatggaaatgaaaatatgcttatagatgctggaaacaatgatgatgaaaacacattaaaaaattatataaatagtttagggataaaagaatttaaatatgttgtaggaactcatgctcatgaggatcatataggttctcttgattatataataaattcatttaaagtaggaaaagtatatttcccaaaagtaagtgcatcaacaaagacttttgaaaatcttttaaatgcagtaaataataagggaatgaaatttacaatacctacggtaggtgaatcttttaatttaggagatgcaaaatgcacaatcttaggacctaatggaagtacatacactgatgccaataattattctatagttataaaattagaatatggaagtaattcatttttatttacaggtgatgcagaagatgtttcggagaaggaaatgttaagtagtggtttaaatttaaagtctgatgtacttaaagcaggacaccatggaagcaaatcatcaacaactgaggaatttttaaatgcagttaatcctaaatatgcagttttaagtgtaggaaaggataatgattatggacatcctaataaggaaaccttagataaatttagtgaaagaaaaattaaagtttacagaactgatgaatctggaactattgttgctacaagtgatggaaagaatataacttttaattcatcttcatcaaaaagtaataaatcaagttcagaaaataaaagtgatcaattgaaagatgaaggtaataattcaaaagaaataattaataaaaattctggtaaagaacaagaaaatgataataaaactgtttgggtagcaggaaataatgcaaaggtttatcataatgataatacgtgcagtaatatgaagaatccaacacaatatactttagaagaggcagaggctaagggattaagaccttgttcaaagtgctacaaataggataataagctataatattaaaataccaagtgttaaaaataatcactttatagaaaaaatatacaataatgatataattaatcagtaaaaacaaaaaaaggaaatgcgttatttaaaaataaaatattattactaatacaataataatagattaattgtagttaaaatgatgcaatcttagatatttttgggggaaaatatgaataagtttagagtgattatcttaactttggtatctatagttagtgctttttggctatatagctacaatatttatgcttatgacaaagaacaagataaactaaatatactgtttattagttcatttaatttagattttattacttttaatgatcagttagaaggaataaagaagggtcttggtaataattgcaatataaatattgaatatatggactctaaaatatttaatagctatgaagcagaaacacatttttataatttaatcaagtataaattagaagcttatggaaatattggacttataatttctggtgatgatgatgcaactgaattttgtataaaatacagaaatgatttatttaaaaacattccaatttcatttttaggagttcaacaatctgaaagaagtaatcgagcactaaaatgtgattttatgtcaggggtttcagaagtagagtcaattagagaaaatattgagttgataaaaaagcttaatcctaatgtgaagacaattaattttttagatagttatggtataaagcgatatgaagaaatgactagagaatataaagacgaatacaattttaattggataattactaaagataaaacctctgaggagataaaaaatactttatctgggttagataaaaataatgctgtaatacaactttatgtaacagattttttggataacaattttcgtgatataagtgaaatcaataagtttattgatgaaagttgtaaaaatgctcctatgtataatattctattttatgatgtgggaaacggtagtattggaggaaaggttataaatcattttaatcaaggtgaagatgcaggaaagatagctgttgaattattaaatggacaagataaaaatgatatatatattggtgatgatagtgctaatgaatatgtttttgattataaagcattaagaaagtttgggattaaaaaatcagatttaccgttggggtcaaaaataattaatgatcctattgaagtagtcaaaaaatataaaaatataataataggtaatagtatacttgtaataggactactcattacaatttttgttttagtatgtaatattagatataaaagagtatatgaaaaagagatattaaaagcaaagaatgctgcagaagacatgaataaagcaaaatcacattttataactaatattagtcatgaattacgaacaccaattaatgtaatcatgtctgcaatacaattacttagagtcaattataaaaatgaagtagatgataacaaatacatgaataattttaatattataaatgataattgtaagaggttattaagattaatcaataatataattgatatacaaaaatcagatttagaagaagatttgaaatttgataatattaatgtagttgagttaatagaagaattggttatgtctgtaattccatatgcaaagagtaaaaatttaagtttgatttttgatacaactgaggaagaattaataatgccattagatattgacaaatttgagagaattattttaaatgtattatcaaatgctattaaattttctaaggagcatggggaaataagagttgatttagaagttaaagatcatttttatattataattacggatgatggaattggaatagatatggataatataaataatatttttgaagaatttgttcaacttgataatagtttatatagaaaaaatgagggtagtggaatagggttatctatagtaaaatcttttgtgaaattacataatggaactatttttgttgattcaaagataaatgtaggtagtaggtttattttaaaatttccaataaaaaagtatgaatcaacaagtgttgaatgctttaataaagatgatctgagtgaaaaagttaaaatggaattatcagatatatatatatagtcagtctaatattctaatataaacaataaaaatgcactgtaaagtgcatttttattgtttatatatttaaagtcaatagaatttctattagtatctaacgattacagaaaccccatcaggtattacagtaatattactattcttttttccttgcttttctagatattcatcagccattttaattgcttctggaacattttcagcataatccatatgcatagcatgtaccatatcttttggagcttttgttaccataatgaccttatatttaaggagtatacgacagagaatctgtgattcccattgatctggaacagtttcattacggcctgtagctaaaaatttctgcatgattttttcttcagatttttcattggcaaaagtatcatataaagattgtccaccatgaccatctatgcaatttgtaaccattatgataacaccaccaggattacatgttgcttctgcagcagtcattcctttaactgattgatatatgttttgatctaatggatatccgccattagttgagattactatatcagaaggaatagcgtctacaccagaaagcgtatctacaaattcacagcctttttcatgagccttaacataatcacctgcaaaagcttttataactcttttgttttcatctaagaccacgttgacaatgaaagctaaattggctttttttgcagcataaaccatatctttatgaattggattatcttttaaaactccagctctagcgtgttcatctgcaataaattctgagcagtgattagctaaaacagttgtacggcttgatactccaggaagaacactttttcttccacctgagaatccagcaaagaaatgaggttcaataaatccttctgaaattaaaagatcacaatttactgcatttttgtttatcaataattttcctccagatggaagagtacctaaatcaatcatgtcttcatttttactgctatcatgcactatgaatttaatttttttgttgtttacaatatcttcaccaaacttataaatcagctcatcttttgtagtaagtctatggaaaccagtagcaataaggacagtgagtgttgcatctggatttccatcttcaatttcttttaatagaacaggggtaataactttgcttggaacaggtcttgtatgatcacttgcaatcataactatattgtttttaccttttacaagttctttaagacgaatactatctattggattttctatagcatcccttactagagacatttcatcttctcgtgctgtataagaattagcttttgatactaacaatcctgcaagacgatcatcaggaatgttgatggataatttttcttttccatatggtaattttatatctgacatttaaaatatcctcctttagcaatataacaaaattaagttttaaattattttgaatatatgaacattacagtatatttatatgttaactaattgtgaaaatacgtattaaaaataatttaataaactaaatcatagaaatggcttttttttaatactttaaaaaatatatagatattttttacaaaaattcaaaaaaatattgacaaaatattttaagatgtatatactaaatattaattcctactaaatctataggaaaagtaaataaaatagaaatatgtacaaagtacatagaatgttgagaggagagtaaagatgaataaaagaaaattaatatcactcattttatcattaacgctaacagtaggtattttatctggatgtggaagtggaacaaatagtggtacttcaaaaagcgattctgttgaaataactaatgtatcttatgatccaacaagagaactttatgaagagtacaatgatgtatttgcagattattggaaagaaaaaactggacaagatgtagttgtaacacaatcacatggaggatcaggaaagcaggcacgttcagtaattgaaggaaatgaagcagatgttgtaacccttgcacttgctcatgatgttacagcaatagaaaatgcaggacttattgatagtggatggattaataaattagataataatagttgtccttacacttcaactatagtatttctagttcgtaaaggtaatgaaaagaatattaaagattgggatgatcttgttaaggataatgtcagtgtaataacacctaatcctaaatcttctggtggagcatgttggaattttcttgctgcatgggcatatgcagataatcaatatggtcatgataaagaaaaagataaagaatttgtgaaaaagctttatgataatgttgaagtattagattcaggagcaagaggagctacaacaacatttgttgaaaatggacaaggagatgtactaattgcatgggaaaatgaagcttacttatctgtaaaagaacatccagatcaatttgaaatagtaactccaagtataagtgtacttgcagaaccatctgtagcagtagttgatgatacagtaaaaaagagaggcactgaggaagttgctaaagcatatcttaaatatttatattcagatgaaggacaagaaatagcagcaaaaaattattatagaccttctaataaggatatattaaaaaaatattcagatgtatttaacctagatataaaaatggtatcaatagatgattttggtggctgggataatgcctacaaggatttcttccaggatggtgcagtatttgatgaaatatatactaagaaatagtatataaaattttttgaattcaaatcatagtaattctataagaataatatagataatagataaagaaaaattggcagaatcaaagaaaggagagtgtccaattggtaaatgatatattaaatactaagccaaaaagaagagtgatacctggatttggattatccattggaataacaattacattattaagcttaattgtaataataccaatggcatcaatagttgttacaagtacaggaataagctttaaagaatttatagaagtagttacatcaaaagaagttatgtcaagttataaggttagttttttatgtgcctttattgcagcagttattaactgtgtatttggaattattttagcatgggtattggtacgatatgatttcgttggaaaaagatttttagatggacttattgaacttccatttgcacttccaacagctgtagcaggtatatcactgactgctttatattcagatacaggatggattggaagtatattttcaaaatttggtataaaaatagcttatacgcagataggaattataattgcaatgatatttataggaataccttttgttgtaagatctatacaacctgttttggagaagatggataagcagtatgaagaagctgctgctatgcttggtgctgatggaaaaaggatattttttaaggttatacttccagaaatatttccagcaatgcttactggatttggattagcctttgcaagagggattggggagtatggaagtatagtttttattgcaggaaatataccatacgaaactcagattgcaccacttcttattatgacaaagcttgaacaatacaaatatgcagatgcaacttcaattgcacttgtaatgcttgcagtatcatttcttatactactctttattaatatgatacagggatatgtaaataaaatttcgggaaataattaattaatatattaaagcaataagcacatcttataaggagggcagaattatggggattaagaattgcacactaaaaaataaacaaaaaaataatattagtttagaaaaaaataatgagcttattgatcataagatagcttataaaaaaatagatgatacagttaaaaaaaatactataaaagaatctaaaaatagtaataacttaactaagaatgttctaataggcttaagtgtattgtttatcggaattatgctcgttatgcctatgatagttgtaatttcatacgcattgaagaatgggatacatgcatataaagatgctgtttttgacaggtacacaataaaagcttttaaacttactattatcacaactattacagcagtaggtataaacactttatttggtttatttgctgcatggtcagtatctaaattcagcttcaagggaaaacatcttttaactactttgattgatataccttttgcaatttcaccagtaatagcaggtcttatatttatattgacatttggaagaattgggtggaccaacagttttcttcaggctcacaatattaaaatagtttttgcagttccaggcattattctggcaacagtttttgttacttttccatttatattgagggaagtacttccagttttaaatgcacagggaaaagatgaagaagaagcagcagcacttatgggtgcaggagggtttatgatttttagaaagattacacttcctcacataaaatgggctctgctttatggaataatactttgtagtgcaagggcaatgggtgagtttggtgcagtatcagttatttcaggacatttaagaggaaaaacaaatacccttcctcttcatattgaaattttatataacgaatttaagcttacagatgcatttgcagtttcatcaatactggttgttttagcagttattgtactaattttaaaaaatatagttgaatacaaatcgaaaaaggctggtgttaaataatgtatgtggaattgaagaatataaataagaattttggcagttttaaagcatctgataatgttagttttggaattgaaaaaggaaaattaatagggcttttaggtccaagtggaagtggaaagacaacaatattaagaatgattgcaggacttgaaacacctgatagtggagatattttaattgatggaaagcgtattaatgatgtgcaagctagcaaaaggggaattggatttgtttttcaaagttatgctttatttcaatatatgaccgtctttgataatattgcatttggcctcaaggttcagaaaaaaagcaagagggaaattcatgaaaaagtaatggaacttgtaaaacttataggtcttgaaggacttgaaaacagatatccaagtcagttatctggaggccaaagacaaagagtagcttttgcaagagcacttgcaccaaatccacagctacttttacttgacgaaccatttgctgcaatagatgcaaaagtaaggcatgagcttagaagctggcttaaggatatgataaataaggttggagtaacaagcatttttgtaactcatgatcaggatgaagcaattgaagttgcggatgaaattataattacaaatcatggaactattgagcaaaagggttctccattagaaatttataaaaatccaaaaacttcttttgtagctcagtttataggacaatctactgttttagaaggttgtgggaatttaaaaggttttgatatgaaagacattggagaaaaagtcgtaataagacctgagtttattaaactttctaaaaagaatgaatataaacagtatgtaagcgtaacagaagaaggaaaggttacagatatatcatttagaggcagttatcttgagataaaggtaagtgtaggaaacttgattttaagtgcagtaaggtctcttgaagaacctccagttgaaattggagaagatgttgatgtgctcatttacagagtttatacctttgatgagaataaagcttacatgcttgaaaatagtgctatgaatgatagaaattcagtattcatctaaagttggtgactgtcacctcccagattttgtcggtaacacgacatattttgatggattatgtgtaaatattaaaggataaggtggttaggcttgattatgaaaaagaaattaaagattgaaaagatggaaactgatcttcttataataggagggggaactgcaggctgctatgctgcaataacagctgcagaatcttcagatctttcaatattaatattggaaaaagctaatattaaaagaagtggatgtcttgcagcaggagtaaatgcgataaatgcatacatcacaaagggaagaaaaccttctgattatgtggaatatgcaaaaaaggatgcagacaatattgtacgtgaggatttacttttaactatggcacaagggttaaataaagtcactgaaaatatggagaatatgggacttgtcattttaaaagatgaaaatggggaatatgtatcaaggggaaacagaaatataaaaatcaacggtgaaaatataaaagttattttatcacaaaaaataaaaaagctttccaatgtaagtgtaatgaatcatgtaaatgtaactgactatattgtgaaagacaataaaatatatggagcttttgccttcagcataaaagatgaagttttttatgagattaaagcaaaaaaagtaatatgtgcaacaggtggggcagcaggattgtacaagccaaacaacagtggattttcaagacacaaaatgtggtatcctccatttaatactggagctggatatgcaatgggaataaataatggtgcagaaatgacaacatttgaaatgagatttatagcattaagatgcaaggacaccattgcacctactggcacaatagctcaaggagcaggagcaaaacaggttaattcaaaaggtgagatctatgaaactaaatatggacttacaacatcagaaagagtttatgggactgtaatggaaaatttagaaggtagaggtccatgctatttgaaaacagaaggcataagcagtgagatgagtgaagaattaaagaaagcatatcttaatatggcaccaagccagactttaaagtggatagaatctggaaaaaatcctagtgaggagaatgttgaaattgaaggtactgaaccatatattgttggtggtcatacagcaagtggttactgggtagatactaagagagaaactacaataaaaggactttttgcagcaggagatgttgcaggcggatgcccacagaagtatgtgactggtgcacttgttgaaggagaaattgcagcacttgaggctgtaagacagattaaacaagaaaaaatcagtatatatgaattttcagaaaatgatgaatcatcccttttagataaaaaggtaatagaagcagaagattttttgaattttgataaacctttatttagcattgaggatttagaagaagctatgcagaagataatggatacatatgcaggaggcataagcagaaattatgcttacaatgaaaaacagcttaacattgcagatgaaaaaattgatgaagtaattaatctgacaaataagcttagagcagaagacatgcatgaattaatgtttgtttacgagctaaaggaaaggcttactgtgtgtaaatctgtaattgcacatcttagagaaagaaaggaaactagatggcatagttttgcagaaaatctggattatagagaaaaaagtgatgaatatttaaaatatgtaaactcaaaagttattgatggaaagcttacagtattattcagagatttagtgaaagagggggagacttatgagcatatcaattaataaagaaaagtgcatagggtgtaggaaatgcataaatgtatgtccaggaagtcttttaaaatcagatgaaaataataaggcatacattaaatatcaaaaagactgctggggatgttcatcatgtataaaggaatgcaatgaagaagctatttctctatatcttggagctgatattggaggacgtggaagcagattgtctgttaaatatgaaggagatataattcactggaatattgaaaatcctcaaggaaaaatcaaaaccattgatgttaatagtaaggattcaaataaatattaggatagtaataagttatagatagatagtgtaaagtacgttatgaaaaatgatatttaaaaaattaaatgactaaataatcaatataattttaaatttagtaaaaataattaagggggaaaaacaatgagtcaattatcacatttagataaattagaagcagaagcaatttatattattagagaagtagcagcagaatgtgaaaatcctgttatgctttattcaataggtaaagatagttcagtaatgctacaccttgcaatgaaggcattttatcctgaaaagccaccatttccatttatgcatattgatactacatggaagtttaaagaaatgatagagttccgtgataaaaaagcaaaggaactaggcattgatatgattgtatattcaaatgaggaaggaataaagcagggaataaatccatttgatcatggctcagcttatactgacataatgaaaacacaggcattaaagcagggattaaacaaatatggatttacagcagcctttggtggagggcgaagagatgaagaaaagtcacgtgcaaaggaaagaatattttcttttagaaatgaagcacatgcatgggatcctaaaaatcaaagacctgaactttggaaactttataatacaaaaataaataaaggcgagagtatgagggtttttcctatttcaaactggacagaaaaagatatatggcagtatataaagcgtgaaaatatagatattgtatctttatattttgcaaaagaaagaccagtagtttatcgtgatggcaatattattatggttgatgatgatagaatgaaacttcttccaggtgaaaaagtagaaaataagaaagttcgttttagaactcttggatgttatccacttacaggaggatgtgaatcagaagcggatactttagatgagattattgaagaaacattaagtgcagtttcatctgaaagaactactcgtgttattgatagtgaagctgcgggaagcatggaaagaagaaagagagaggggtatttctaaaatgaaggatttattaaaatttataacatgtggaagtgttgatgacggaaaatcaactttaataggacatatactatatgatgcaaaacttttgtatgcagatcaaaaaagagcattggaacttgacagtaaagtaggaagcagaggtggtgcaatagattattctttattgcttgatggccttatggcagaacgtgagcagggaattacaattgatgttgcgtatagatattttacaacagacaatagaagttttattgtagctgatacaccaggacatgaagaatatactagaaacatggctgtaggtgcatcctttgcagatctttcaataatattaattgatgcaaaacagggagtacttgttcagacaaagagacatgcaagaatatgtgaacttatggggataaagcattttgtgtttgcaataaataaaatggatcttgtaggatatagtgaagaaagatttatagaaatagaaaaagaagttttaaaacttcaggaagaactttcattagaaaatattgctacaataccattatgtgcaacagaaggagataatgtgacttctaagtctgaaaatacaccttggtataatggcatgcatcttttagaatatcttgaaaatgttgaagtggatgatatatcagaagaaggtttttacatgccagtacagagggtttgtagaccagatcatacatttagaggattccaaggacagattgaatccggaagcataaatgtaggtgatgaaattactgctcttccaagtaatgaaaaggtaaaagtaaagagtatacatgttacagataaaagtgtaagtgaggcatcaaaaggacaacctgtaacaatacaacttgataaggaagtagatgtatcaagaggatgcattttactaaaaggtacagagattaaacttagcaactcattcaccactgagatattgtggatggatgattctgaactgatatgtggtaaggaatatattattaaaataggtacaaagatgttaagtggaatagttacagaattaaaatataagatagacgttaacagtggtgaacatttaaatacacaagatttgaaaaagaatgaaattgcagtatgtaatattttactttcagaaaaagtagcagcagatgaatttacaagacacaagaatttaggagaatttatattaatagacagaattactaacatgacatcagcttgtggagtaataaaggaaatttcatctaataaagaaaataaggctgataatatagcttttaaatttaatgatttacaaggtagaggcgatatttttgaagaattttattataatacagaaagcctttcagtttataaatacagacctgtctcaaaggtatatacaataggagatgaaattccagttaagggtgaaagctacgagtatcctgaaagctttgacattcttatacttcgtgataaaattgcaatttcagtccgtaatagaaaaataagtactattaattcaattgatgagtataagtattcaaattataaagtgatcaatggaagaggctttgcaataaaggcaaattcacaggatcaaattgaaagactattagacgatagaaaaaatatgagtgaaggcgactttatggaaaaatggtttgattttgagacttatagaaaagtaaaatttcattaataaagaataaatagaatttcaaaatattatgaaagagctataacactatatgagtgatttagctcttttaaattacaaataaaatataaatcctaaactcagaaagattaggattcagaataagattgttattacataaaaaatttcaattattactgtatatattaattatgcatttatgagtttatgaattacacaatatgttcattaaacaaaattatgaatatgaaatttttagctgttatatatgcaaaattttttagttacagcaaaaatgtgatttaatactaatcatcaagtgtagagatgtcattttttaatgaagcattatactcttttagtatatatttaaaatcttcaggaatatcattaggcatttctaaattttgacgattatttatattatatatttttaaaattattgtggcatttatgggaaatggaccagctgcgaattgaccatttgaatcgggaataacataatctatacattttaaatcattagggtctgaatcaaagtattttggaccaggagtatatataaagacagctgcatcttctacaacctgtggattattatcatcattccaaatagttccatgaatcattttttcctttggtttgggtaaaacaaaatctaaattaatattttcagtatcatcgtttataactatatcatatcgagacgagtaatttggcaattttaaacctccagcaaatataaattgtttatatagtaattatattaaaaatatagggaagatatgaaatatagacaagaatatattgttaaataaaatcatacaagtcataaagctggggatacatagttattttattgaagcattaagagcataatcaataatagtgctaataacgcaggaatatttattcttaagattttatgctttttacacaaattcgtcaccaccttttattcctaattattagcataataaaatataatatacataactttccaatatagtataaagcatactaaaaaagtaaggtgatgttatataaaaataagaaaagaatgtagctttttatataaaatcactacattcttttcttattcttatttgcaaacatattaaatttgaatatatgattaaagtttaattatatctgatataagtgtttcaacatcttcttcctttgtagcccagctggtacaaaaacgtacagcagtatggtttttatcagttttttcccaaaaagaaaaagaatacttatcttttaatttttctaaatactcatctggaataattggaaattgttgatttgttattgaatcataacggaaagagcagcctttagatgaaaatgcatctcttatttttaatgccaaattatttgcatgtgatgctatttcaaaatataaattattttctaaaagagtagtaaattgaattccaagaagacgtcctttggctagcattccaccattttgttttataaaatatctgaagtccttctttaatgatgaattagttattactacagcttcaccaaataatgcacctacttttgtacctccaatataaaatacatcacataatcttgcaatatcctcaagagttacatcatttccatcagcagtaagaccgtaaccaagccttgcaccatcaaggaagagaggaagacttaatttatggcatacataacttatagcttcaagttccttctttgtataaagagttccattttctgttgggtgagatatatataccattcctggctgtaccatatgttcagctgtatcatcattaaagtgtgattcataagcattttgaatatccaatgcagttatttttccatcatcacttggaatagacataactttatgtccagtagcctctattgcaccagtttcatgtacatttatatgacctgtagatgcacataatactccttgatgaggacgtaagattgatgcaataacagttgtattagtctgagttccacctacaagaaaatgtacatcagattcttgtgaattgcatttttcttttattattgaacgtgctttttcacaatatgtatccattccatatcctggtgtctgttcaaagtttgttgtagttaaagcttctaaaattcttgggtgtgctccttctagatagtcgcattcaaatcgtatcataacataattctcctttgttataatgtaatagttttagtgttttacttaacatagtactctaaattaaattataccatatataaaaaaataaataacaaacagtactaagatgtgtgtgtggggatgaagcttagtactgtttgttattaagtatacattgtaagatgtgcatcatacaaaaaatagattattactcagaaattgcttttgtaaacattttcttaaatcaattatagtactgaaatagaaaaaaatcaatacatataattaataaaattatatataaatggaaaaactaatagtttttaaacttaataatgaaatatatagttagaattattaaatgtataaattatataacattatatctaagaaactaagtaattatagggtatatatttttatcctttctaatggtcataattagatatataattaaaagagtaaaaattgcaagtgatttttgcaatatattaaatgaaataatataattaggttcaggagatacagaattatgataaaaaacatgattggacattttaagacgataacgaatcataaaattcttgtaatgaaaacttgttttaaggtaggtctatataaacagggatttttacatgatctttcaaagtacaagcctgttgaatttgtagctggcataaaatattatcgaggggatgtcagtccaaatggaattcaaaaattagaagaaggtgtatcaacagcatggcttcatcacaaaggtagaaataaacatcactttgaatattggattgattatggaaataagctttctgatggacttcaaggaatgaagatgccatctaagtatgttatagaaatgtttattgatagaatgagtgcatctaaaaactatcttggagaaaaatatactgataaaagtgcacttgagtattatgaagaaagaaaagactattatgtaattcatcctgaaagtcgtaaatttttagaatttcttcttaaaatgctagcagaagatggagaagaaaaaacattaaaatacataaaaagtaatttacttatgaaaatctaaggttttaggtgaaaatttaaattttaacataaatatataacaagtatgattagattatgaacaaatcatatttcaatatatgtgttcagtttataaaaattaatattaaactttttattcggaaagattatccattatttgtagtataatttatataattattttgatataataagaattgaagatattgaatggaggtattgttatggcaactagaatgttacatacatgtataagagtaatggaccttgaaaaatcattagaattctataagaatgcattaggtcttgtagaaacaagaagaaaggattttcctgagcataaatttactttagtttatttaagcgatacaccagacggatatgaaattgaattaacttataattatgatccagaaaagccatatgatttaggaaatggatttagccatgttgcaattggagctgatgatattgtatcattaagagaaaaacatatggaaatgggatatgaagtaactgaccttaagggacttccaggggaaccaccaagatattactttgtaactgatccagatggatataaagttgaagttataataaatgattaatttcagattataagttattgtattgagtttaagtcctgagtaaattcagggcttaatttttatagttttttactttataaattataggtgagaaaatatttgaacaataatttataaaaattatagatgatttcaatatattttagagttaaaaataaagtaaatatattagactataaaacataatatagtatatatagtttaggctttatgtatgaatttttatatttgatagtgaatttttaatttaagccaataatctactgttaagtgtaataaacaattaaaaatattatgatttaccaagtttaaaaaatagatttacaataaaattgagaggaaagggatgcgaaatgaagccggtaatagggattacatcatatataagaaaagacgtatttagaaactattcacaagttggatatgagtatatagaaaaaatcgaaaaagcaaatggtatacctatgattttgccagtgcttcagaaatatgatgatcaagaacttaataaacttatagattgtgtaaatggaattatatttactggaggatgtaacgtagaatcacaatggtatggagaaaaacctttaggagaggaaacaaaagaagatgttttacgtaatggatttgaaagggatttatttttagcagcaaagaagaagaaaaaacctatgcttggtgtatgcagagggtgtcagctcattaatgtaatgcagggaggaactctagtacagaatattgatagtcagcttaatactgctgtatatcataaaggaactggctgcagaataagtgagaaacttcatagagttgtattagcagaagattcacgtcttaaaaatgcatataatgaacaggaagttccagtcaattcttttcatgagcaatgtattaaacaaattggaacagatcttaaaattacagctaagtgttgtgaggatggtgttattgaaggcgttgaatacgaaggagatttttatatggcaggagttcagtggcatccagaaggaatggaagatcaacttaaactttttgaggagtttgttgatatttgttccaaaactattgatgaattagcattgaagtaatattatataagattattaggattactgaaatttatagtaccattaatagatttaaaaattaaaattattttatattataaagcagataaagatatttagattagtatggttatctgctttttatcagtattaatttagagtataattgtaaaaaatggtgatttactcatttatgatttttacttttaccaggtaaaagtagataaaattgagaaaacatgttataattaatgtattcacaggcattatatatttatattgacgaacctgaaaaaggaattattgaatgtttaagaacttcaagacttgcaatgaagggatataaaggtgatttatttgtattaaatcttagttttattggatgggggatactatgtgcactaacattaggactacttgcattatatgtaacaccttattgtggaactacactagtaaacttctatacagatttaatggaagattatagaggaaaagaaataacactttagaatttatggcagcatgtttattgctgccattttttagtgtataataaatttataaatttcaactatgagaaaaaagtaattattaactaaaattaataaactatcaacttttgatttttaaaatttgttacgaggaatttatatttgtaggtagattggatgtgaaagagtgaaggattttttagaccttgtaaatagacgtcagagttgcaggaaatatttagataaacctgttgaaaaggaaaaaattataaaatgtatagaagctgcaagagtggcaccttcagcttgtaatagtcagccgtggcattttattgtcgtaaacaacaaggatctttcatcaaaagtggcagattgtttacaggattctataatgaataaatttacaagtgaatgtaagacatttattatagcagttgaagaaagtggaaatataacaagtagagcaggagaactcataaaaaagcaggattttagagcaactgatgtggctattgcatgtgaacatatatgccttatggctgaggaattagaacttggaacatgcattttagggtggtttaatgagaaatcattaaaaaagttattaaatgttcaaagtggtaaaagagttaggctagtaattgctatgggatatccagatagtaaagatgtgcgcaaaaaagtaagaaagaatttagatgatatttatacaatgtatgaataatttttttaaagagctgtgaagaaattcatggcttttttaacggaataaacgatagttaagcatagaaaataagcattactagataataaattaatacataaaaaatatatgaaaatatgtatatatttttgtaaaaggagtattgtgtgtatattgtaaaaaccctatcaaatttttaaaataaatgttgttataatttattcttttaagtgtaatttttactagtagtcaaccttctatttatagaaaaatgatgaatatattaaatttaataattttctagatggatgtgttttatatcattcatagatgaataaggacatacatataacaattcaaaaaaaatctctatataattaaaagttttatcaacaaatagtaaagaaaatagattgcagtaatgattaaggtattttgtagctacacctctgaagtctccaagccagttatttagatttacagatatattatgtgatttacctgtgcatttaatgttatccattgcataataggattttgcattaaaattaacgctttttcgtattttatagggaagtttcttattatgattaactatatgaaaatgaattggttttgaaaaggttggatctatatgaatgtatgaatttgtgtcacataaatcatatatattatcttcaaaattttttttccataatctatctaaaccaacattttcaacaattaaagaatcgttaacatcatatgaaattacggtgtatacatctctgcgcgcaatattataagttttataaaaatcacatttaaattcgaaatgtttatttctacttcctttataatttcgcctgctataatacatttccataaaaataagatccttaaattcttttggtttgtatattttttctataccatgaagagccttatgtctccaattaaaagcagtaactatagaaattttaagagttttagcacaatattcaagtgttttcttttctcctaatagttcaataaatttaaaccatttttcaggaggatgctttaagtatttccataatgaatttgtagtgtatgaaaatgtttttttgcatgatttacatctatatctttgaataccatcatattttccaaacttgataaattcaacatttttacaatgaggacaacatgaatattctttaatattttctttactgtatataattttctttaaagatttactctggtacaaacttattttatcaaatgtactatcttttagtatcaaaaaatcaccgcctaaaatttaatctataggttgatctgagattatagaattatacttaaattattgaatatattcaataattgttttgaaatagattaatagagcatatatatattattaactagattattatttaagaaataatgatctagtgtattttagtttattacattttgattattgacatattatctgtttagtaatcattaacaacatttaatttaaaaattttatataagttttatattacaacatatgcagactatattttagccatggttttctacagtttatatagaataattaaattcaataattataatacttaattattaaattataacgagaataatttgtaatgatttaaaataagaaaatattaatagtatatatgttttatatttaagatataaagcataaaattttcaagagtttaagaaaaattttaaattataaaattcattgcacaaagtcactgataagcttaaatatggaggcttgattttaaatgaaatcagaatatatggttctattaaaaaatattttataaataattatttatattattgaaaagtatgggataatatggtaaagtgtagttgtgaattggtagtaccaccgagatgcttttttattataaatctaagtattattaaaatggtatgtattggtatgaattaaaaaattgaattcatagtggttttatcaatggctcaactttataaaacaataatttgaaagggtaaaggagaggtaatctatgaatattctgttatgtgtaaaacaggttccggatgattcggttgaaatccatttggctgatagtgaaaaaaaacctaacttaaatggagttagcctagtagcaaatgcgtttgatacttatgctttagaaatggcagtacgctttatagaagctaatgaaggagcagtaagtgtattaacggttggagcagaggactgtctaaatacattaaaaaattgtctttctgttggagcaaaagaagcattttttgtaaaagatgatctatattcagatttagatgctatgggagcagcacaggctttagcagatgctattcataaaattgaaaaagataagggtgaaaaatttgatttaattctatgtggaaaagaatcaacagatgaaattactggacaagttggagcaattctttctgaaaagttagaagttgggtttgttagtagtgctgttgaaatcgatttaaaagatgataatattgaagttcatcaagaaacagaagaagggtataatttagtttcaatgaagtctccagctgtgataacagtgagtaagcctaattatgatccacgttatccaacaattaagagtaaaatgaagagtcgtaaggctgtaattccaacttatagtgcagaagagattggagaagtaaaaaaatctaaagtacattgcattaaatatgttgaacctcctaagaaagaagctggtattaagattcaagagaaggatgttaatgtagcaataagtgctgctatggatcaaatgaaaaaggataaggtaatttaataaaaggggggattgagtatatgaaagcattagtttttattgagacatgtggagaaaaggtgctaggtggaagccttgaactaatcagtacattaaaagagttaaatgcagaaggaacagcagttgtagcaggaaacagagaagctgctgatacggtagcttcttttggaattccagttatttttactgatacaaattcagattgtgatactttaacaaaagtattatcagaaataataaaagaacaaaaacctgatttagtacttttagcaaatacaacattagcaaaagatcttgcaccccgaatttcaggacgtatgaatttaggatgcgttagtgatgtaataaaaattgatataaatgatggaaaaactatatatactagaccagcttatggaggtacaattctagaaaacatagaagttgaaggtacagctatagttacagttagaaatggtagttacccaaaaccagaatctggtttgaagaaagatgtaacagtgaaatctatagaagttccatcagatactgttaaagcaaagattattgatgtggtaaaggaaatttctgaatctgttaatttagaagaggctaaggtaattgtttctggtggacgtggtatgggaactgcagagaattttaagttagttgaagaattggcagaggtacttggcggtgttgtgggggcatctagaccacctattgaaaatggatggatttctcgtgcacatcaagttggtcaatcaggaaagattgtagcaccaaaactttatattgcatgcggtatttctggagcaacacaacatacatctgggatgttaggatcagattatattgttgcaattaataaagatgaggatgctccaatttttgaaattgccaatgttggtattgttggaaatgtaaatgagattcttccttctatgattgaagaaatgaagaaagtaaaagccaaataacttgattttagatttaactgtatttaacaggctattgctattaaattggctatagcttgtttgaaaaaattttagtctttatccataaagttttatccaatagtattacaagaataatattatgtatcacgattatattaagtaatggtataaaagaaataaatttaatatttattgaaaagtagtattaaattaacatattttgaattgtagaatcataatataaatggtagtaccaataaatatatagtatcagataataacttaataagggggaagtggaatgctgtttcttaaatttttaatggcaatattaccaattctttggcttatcgttgcattgagtaaattaaaaatgcccggttataaagcctgcactattgcacttattcttacaatgggtttagctatgtttttgtggaaacttaatgtagcctgcactgtcacaggagtattggaaggaatactcaatgcactatggccaatttgtctagttattattgcagctttatttacgtataatttgattttgcgtacaggtgcgatggattctataaaaaagatgcttgctggagtttctattgataaaagagttttaatactaattattggatggggattcggaaattttatggaaggtatggctgggtttggaacagctgttgctattccagcatctatacttgcaggagtagggctaaatccatttgcagcagttatttcttgtcttgttgctaacactacaccaactgcatttggttcagtaggcatacctttggtaacgctttcagctgtaactggagttcaagctaacgtattagctacaaatacagcaataattcaatcggttctatgttttataagtccatttattatggtatgcattgtaggcggtggaataaaggcactaaagggagtatttccagttactttggttgctgcactatcatttacagtaccttcattttttactgcaacagtacttggtgtagaattacctgatatagtaggatcaatttgttgtatgatatgtacaattgctgctgcaaaagtatttaataaaaaacctcagaaagaatactgtattgaaatcaataatcataatgaagaaaaatctttatcatttaaagaatcagtacaagcatggtgtccatttattttaatattctttatgttaataatgacatcaacattgtgtgcaccaattcataatttgatttcaggtttcaaaactagtgtgtgtgtatatgccggtcagggaggaaacacattgactttcagctggattaatacaccaggtataattatttttattgctgccattattggaggctttattcaaaaggcaaaagtatcattgatgtttgagttattgattgatacattaaaagcaaattggaaaacaattgttacaatttgtgcagttatggcaacagcaaagactatgagttatagtgggatgattgcagatattgcaagctttttagttgtaattacaggtggagcatatccattaatatcaccactaattggagcaattggatcatttgtcacaggttctggaacctcaacaagtgtactctttggaggcttgcaagtagagacagcacaaaatcttggactttctggagcatggatggcagctgcaaatactcttggagcaggtattggaaaaatgatctgtcctcaaagcattgcaattggtgcaagtgcaattgataagtctggttctgaaagtaaaattttaagaagcgtatttaaatattttgtatgctacgtagttattgctggaattgtatgcttccttggaacttttatattataaaaatactaaaaattagagttaaaaaatttcagttattaagcagatataaattgtaacaaagcttataaattaaaattattgatatagattcaatttggcagatattttattagattaccaattgaaatatagattaataggaggaatgagtattatggctcagtacaacatattaacagaagatttaatattaaaattaaaggaggcagctccggggcatattttaagtggagatgatataaatgaagattattctcatgatgaaatgcctatttacggtaaatgtgctcctcaggtagtatttatggcacattccacagaagaggtaagcaaagtagttaagatatgtaatgaaaataaaataccagtgactccaaggggtgcaggaacaggacttgtaggtggtgcagttccagttttaggtggagttttaatagatataacaaagatgaataaaatattatcttatgatttagaaaattttgttgtaaatgtggaagcgggtgtcttattaaatgatcttgctgaggattgtgcaaaacagggattattatatgctccagatccaggtgagaagttagcatgtttaggtggaaacgtttcaacaaatgctggaggaatgagagctgttaaatatggtgcaacacgagattatgtacgttcaatgacagttgtacttccaacaggagaaattactaaatttggagcaacagtatctaagacaagttcaggatatagtcttttaaatttgatgattggatcagaaggtacacttggtataattacagaacttacattgaaggttatgccagcaccaaagatggttgcaagtcttattattccttttgaaaacttagatgactgtatttctactgttcctaaatttaaaatggcacatatgaatccacaagcattagaatttatggaaagagaaattgttctttctagtgaaagatatattggaaagagtgttttcccacaggttgtagatggaacaacagcaaatgcttatttacttgttactttagatgcatcaagtgaagatgaattaaatacacttattgaagaaacaagtgaaatggtattagaggaaggtgcaattgatgttcttgtagcagatacaccagcaaagatgaaggatgcatgggctgcacgttcaagcttcttggaggcaattatggcagaaacaaaattattggatgaatgtgatgtggtagttccagtaaataagatttcttcttatctttcattagtaaataaaacagctgaagactgtggaattacaattaagagttttggacatgctggagatggaaatcttcacatatatcaatgtagtaatgatctagaagaagaagaatttaagacaagagtagataaattctttaagattatttataaagaagcgacacaatgtggaggtcttgtttctggagaacatggaataggcagcggaaagatgaattatttagcagagagtgttggagacataaatatgaatttgatgaagggtattaaaaaggtatttgatccaaatttaattatgaatccgggtaaagtatgctgttcattggatgataataaataaaaatttatatataactaaagcctaaaggtttagattaataaaatgaaattaacttaaaatattctgcagtttaaaataaattggagatttttacaaattgattaaaagcatatttgaattttaaatcttatagatagttcaatgtttgatatacattagatataaaaaattttgaaagaatttaattgcaattttaatttttaattatagatagcttgttgcaaaaaaagaaaggtaggagtttaatatgaattttaaacaagatgaaaatcatacacaattacaggagatgtatcgtgagtttgcagaaaatgaagtaaagccaatagcaaaagaaattgatgagacaatgagatttccagaagaaaatgtagctaaaatggctgaaatgggattacttggaattccatttcctgaagaatatggtggagctggtatggatacattgagttatattcaatgcgtagaagaactttctaaatgttgtggaacaacaggagttatcgtttctgcacacacaagtctttgcgcaacaccaatttacacatatggtacagaagagcagaaaaataaatatctaaaaccacttgcctcaggagaaaaattaggtgcatttgcactaacagaaccagttgctggaactgatgcttcaatgcaaaagacaacagcagtacttgaaggagatcattatgtattaaacggtagtaagatatttattactaatgctggatatgcagatacttatattgtttttgctatgaccgataagagtaagggaacaaagggaatttcagctttcataattgaaaaagatttcccaggtttttcagttggaagtcatgaattaaagatgggaatacgtgcatcatctacatgtgaattattctttgataattgcatagttccaaaggaaaatttattaggagaagaaggtagaggattcaatattgcaatggcaacccttgatggaggacgtataggtattgcagcacaggctcttggaattgcagaaggagcaatagatgaaactgtaaaatatgttaaagaacgtgttcagtttggtcgtcctatatcaaaattccagaatactcagtttgaacttgcaaagatgcgtgcaaatacagaagcagcaaaacttttagtataccaagcagcatgtgcaaaagatgatcatgaaagattcacacatttagctgcaatggcaaaacttgtttctgcaaataatgctagtgatgtaacaagacgttgtttacaattatttggtggttatggatatacaagtgattatccaattgaaagaatgatgcgtgatgctaaaataacagaaatctatgaaggaacatcagaagtgcagatgatggttatttcaggatggatgggtgttaaatagttttataaacagatgttcaggagcaatgttttctgaacatctatttttgtgtgaagataattaacagtaaaatgactataatcatattgttaagaaataaggttaatattacatgaaacggagatgttttgttgcttatgctagtggtattatatataaaattaaatgaaaaacctttttataatgaaatgttgttatgtttaaaaaatgaataaattggcaatgatctaaataataaattgagtatgaactttaattaagtatagaactttatgatttgcaaattttaaagagatacatttataatatatccctatatcatgttaatgtttatgggtgttaaggagaatgatattgtgataaagactgattatgatttgaaaaaatttgaaaagtataaaaaattaatgcttaaagaaaaaatttatgataaacataatataaaggaatatgagagctgcccatattgtggctgtaaacacttcattaaatatggaaagtaccaaggtatacagagatataagtgcaaaaatgataaatgtagtaaaacattttcaaatacaacattttccgtatggaaatacttaaaatatgaaccagaaaaatggattgaatttattgagttaatgtgtgaggggatgactcttgaatgcagtgctagagttttaaaaattacaacaacaacagcattttactggagacataagattttacatgcagttgaaaatcattataaaccagaatcctttagaaagtgtgtatcagtgatggactattatgtaacaaaatgttctaaaggaagtagaaacaaacattatacatatgaagagaagattgagaataaaactgccaaaatatatggatacatgcctcgtgatgttgaaatattaatatctgcagaggatggtgaaataccacttattaatgtgaaagagaaaaatgaaacattgaaagatacttttaaacataatgtattagataacactgaaatgggatgttatgtgcatttggaacatattaataggaagacaattgaagaatgtactataaaacacaatagaaatttacataaggatataaagagaaagtatggatttaaagtacatataaattgggttggaatacgtcatataacagatgattttagggtatgtaaaagtatgaaaaattttataggtggtttaaattcttggctttggagatttaaaggaattgctacaaaatatattggacattattatagtttttattctttaataaattctgaagaaaactttgattatatgaaaatctttttcgatatattaaaaaatggttcatatgcttcagctgatgaaataataaatattcatatagagaactattaattgaaaattatatttaagtctcatcttgctctaagcattcatacggataggtattaaagatttttagatttttatgctgggatattttgatatgttaaaaagaaaggagaatcaaattagaatatattttaattcttaatagttattatgtattaggtgtaaatactaaaaagcttcctcattttaaacaaaactttcagagattattatttagatttttattatttaaataagtaggaatatacaagatgataatattgattttatattttaagaatatctaacaacatttaactataaaaaagttttcagcatagattcacatattagcagtatgtatataggccatttagattataaattgaaatactagcaactatataaatttttagagtatttattcacaatattgagaaagaaataaaatttcagcatataaagcttacaaatttattatttaatcataaaaaatgttgaccaatgtgaatataaagcttaaaatatcatgtattggaaaataagggataaagtaaaataaaagacatttagaaaaacatagaggaaatgacgatgaataaatcaatttcaaaaaatgcaatatttaagacaatacttaatttatttaatattgcacttccgattattataacaccaattgttcttggagctattaaagaaacatataatggatatatttcagttggtgaaacatgtaatacaatttttatgacatttgcatgttttggtgtatcacaatatgggttaagagaaataagcagggtacgtaatgataaagaaaagttgaataagacaataactagcctttttgttataaccaccacaacaacattacttacaacaatttcatatactgcctatataatatttaaatacaatggaaaggcacccttttatacatgcttgattatgggcggaaatgtattgtttaatattttttatgttgaatggataaatgaagctttagaaaattatgactttatagctataaagacaatggttacaagaataatatattctgtattagtaatattttgtgtaaaagatgaaagcaattacctgctttatctttatattcttgtaggatttaattttattaataatattttaagttttatttatataaggaagagaacaaaatttgattttagagatgttgagataaagaggcatttaaaacccatgtttcagactcttattttatcaaatacatatcttctatatacccagctagatagggttatgatagataattatataggttctactgaaacaggtttttatgcgatatcctttaaaataatgaacataattgatattttaatatttacaataatacaggtatcaatggcaagacttgtaaattaccttgctaataaatcaaaagaagtatatatggaacttttaaagaaagttataagcatatattttattttgttatttccagcatccataggattgttatgcgtatctaaacaggcagttataatatttggacgtggatacacatatattgcagctgttccaatacttatggtattttcaatatatcttatggcagtaggaatagacagaattatagaacagcagataatatatgtatttggatatgaaaaggcagacacaaagcttgccttatacgggggaatactaaatcttatattaaattacgcactagtattaggagggatttttactccaacaacagcggtcgttacaactcttattgcaaatatatttttgataagtttagaatatggttatcttgttaaaaaagttataaaaattgatataaaattattttcactgaataatatgaagtatttgttttattcattaatatttatacctgtatgtatgtttataaattcaaatgttgaaaatatattattttcatgtgctgcagatgtgatttgttgcgcaattatatatgtaggaattttatttattacacgtgataaaacatttaatgaattgtataatcttatattaaaaaaactttaaataagtttaaatttaatccttatcttttaacttaatcttcaaagataaggattaaattatttgttattgatacagtttcagtatcaataacaaatggaaattcgtcatttttaaaagaaaaccaattagagcatgattttatattactgcttgtatgtcatgattgatataatttaggtattaaaactaaattatattattagcttcctttaaaattttctctaatttatctaaagatgtaatttgattattgcatttttggctgtctagacatacagaaaatcctattgatttataatttccatacttagtatttgttttgcatactgttgaaacaaatgctatttcagcatcagaaccagcattattacaaaatgaacaaatatgagaagtatttgagttttggcttacaattctgcagctcatacctatatttttaccacccatattatgaataataaatagttttcgtgtagcttcatcaatccatccaagatatgaatttttagattctcttgcttctaatgatggaaatttaagctttttttcttttttgaataatttacttatctgagaatcagaaatctgtgccataccataaacatacttatctaaattctttatatatatgtcaatatgttgtggatcagttatatgctctatgcttagtatttctttttcatcttcagataaattactaaattgattcagaattttattctgaagataaattttatttgtttctacaattttattatcaatacatcctctaaaagtattatttaaattaaaaagacattgttttataaaattgtactcatgtttttttatgaacggttccataaattaaaacacctcttttctattttcctgtaatcataattttaataggacacaagacaaatgatatcatgctagaaaaggggtattcaatctattaaatagttctgtaataattatgagcatattttcttttgaagatttattatccttcgaatactcttttctgaaagataatattcgttagataaagcgtcaacactcataccatttttatatttaatataaatttctctatttcgaattttaagtatattttttataccagtgctctcaccccaggatttatgattatcatttcttctagggatataaagatagtttccatctatatatttttggattaattcaattaattcttcaggtaacacatcctgtgcttttacatatttcatattcttactcctttactaataaaaaatcatagtattgaagcaaagaatactaaaagccatgtgtcagaacctaaaattttaagttaatttaatgtaagattaggctccagacaaagcatagatggctttgttgtaatctttgcaaggagcttcctgataaatagttgaaagttttaacttctttcatacaaatacacctccattttgttataaattatagcatattcaatttactaatcaagggttagaagttgaataaggattattgttattattttcagaataacttaatgtcatatatgaagattgatttataactggatttataattttacaaattatttaaatattaagaaataatgtcatgtgttataattaatatattattacattaaatgaaagattttttgaaaggataagattatggagaacataaaggtatataacaaattagttagagataaaattccagaaataattgatatagattataaaatatgcgattttgaaatgattgatggcagaagaaagtttagattattacagaaaaaactccaagaagaagtaaatgaattccttgcagataatagaaatatagatgaacttgcagatataatggaagttgtttttgctattgcagatatcttgggtgtaagtgaagaagaacttcttaaagttagaactgagaaacgagaaaaacgtggcggatttgaacaagggatttttcttaaaacagtagaagagagaaaatagtaataaagaaggagagggaaaagtggctaaaatattagataaggacagatttatagatataattaaaaatggagcaaagattaatattattggagacagtatagccgcaggaaagggaagttcacaaagttatagcagcgataaagtgatttttgaagatgatataaagaaattttatagaataattgcaccaaacagctggggaacattatttgaaaattatataggtgaaaaatttcatggatgctcagttattaataatggaggctgtggagcttcttcttgtcagatatataataatataagaaatcttattaatgaagatgatgatattgtatttttaatgtttggagctaatgatagaaaaaatcataatggtatgaatgatttatatgaaaatttagtaagaattataaactttttaagagaaaaaaataagcctatgattctattttcaccaataccatcaacaatagaaaatgaaggacgtccaaataggctttatcatatggatgatgttacagcagtattaaaaaatgtagcagagaaagagaatattttacttgtagataattattcttttattcttgagtatttacatataaataatctttctattgaagaaataatgtttgaagagggatgtgaaaatgatggtttgcatccatcagattttgttcaaaagcttatgtttgaaaacttgaaaagagtattgaatatttaatttagtccataattaccgtatatatatatattggttgtaattaatagaaaatgatattgtaatatgtcataagtatgtatatagatatctatattggttgtaattttaacaaagtaataataggagataaaagattatggatatcaaataatgtcggttgtgttgtaattttaataaagtaacaataggaggaagggcaatggaagatgaaatcttgcagatagaaaagtcgattaattgtttaaatagtataggtgggtttttatcttctggaaatgagtataaagctaacacaatgtcaattacatggggaagtgttgggtacatgtggaaaaagaaaatcttctcagttgtaataagtgatataagatacactaaagaatttatagacaagggaaatacatttacaataagtattccatatggcagaagttttgataaagcaatagacttatgtggacacaattcaggaagagatgtgaacaaagaagaacttactggaattaaattcatttctggaaaagtagtcgaaagtcctgttatagatggatgcaatatgtactatgaatgtaaggttatattaaaacagaaagtagatgtaaacagtgtaaatccagaacttaatcttgatgaagaagaaaatggatatacaatgtactttggtgaaattgtggctcaatacttaagagaataaatgataaaaaatctactataaaacatggtgcagcttagataatttaaaaataaatatagtattacttacgtaagaacataagcctaaaagccctgacgaatattcagggctttttgcactttagagaaagctcttaaggaaaaaatatacaatatatgtggttattatatccatattatattataattattaatagatatagatatagatatagatatagatatagatatagatatactatatgttaaatataagctatgggggagatatgatgaaaacgaaacaaattagtaaaatgcttgcaccattatctggaattatgagctttatgtttgctatgggggtaatgactgtgccagtttcggcacaggagataaatatggcaaattcagcttatgaagaaagtgtaaaaactgactacacaacttatataaacagcacagtagaaaaaaatggatttaaggttacaataaataagttgacagcggcaaaaaataggatgaatgtaactactactatagaatttccaaatgagataacagatgaatccttaaacaattcaatatttatgtttacagtgaagaaatctaaacttgaatcagactgggggaatagaagaattattaatgataagacagtagaagtgaattttgatataacaggttttgaagaccttcctttaaatgctgacttaagatttgatgttatcataccagaatataatcttaatgcatgggttaatgttaatgcagacttatctaaaaacattgataagataatagaaaaagatattgatatatataatgataaggcaaaaataacatacaataaggttgaagctgatgttttaggaacttcagtttattttaaagaagatgagcatagtgatgattatgatcatgaaaacagctattcagattctgattccaagattttaataaaatgtgatgggaaattatatgaatgtagtgatagagattttaattattatggagaaggacgttacggtagatatacatgcaaagaattgacatatgatgatataaacaatgcaaaaagtataacattaatacctgtaacttgcactttaacaaacaaagaaaaagaagaaatatatgatactatgagatatgattctgaatacgttcctgaaacttttgataatgtaacttataaaaaagactttaagttcaatgatggaaaagatggagaagtttctaaagtagaaagagaagatgataaagttaaactatatataaatacagattctgaaaataagagcatacttatggcatgctcaatgcgtggatggattgaatctaataaaggtaattattatggtgatgctgaaaaatcaatgtataaagacccagatagcaacgatggttatattattgaattttcaggggtagataaagattccaatctacatgtttactgtaatgacgatatattaggttacagtgaaaaatttgaatttggcaaagacgttaaaattaaataagaacatggcagagccatatataaaggagtggagtttaatgataaacaagaaaataagtaaaattataggccctgcagcaggtattatggtatttatgatgtcaataggaataatacctgtacaagcatatgcagcagaaactaaaagtgtacaaaatgaagcatcattatcaaagagtggaaatgtgaattatgaaatagagcaaaatggtgtaaagtttacagtaactaatattattggaacaaagaataggataaagatgaatgcaactattacacgagaagatggatttgatgaaaagatccaggggcatagaagtatggaattaaatatgtataaggaaaaagaagaatttaatagtggtggttcatcgtggtcatatcctaatgaaaatacaattgaaataagtgcagaagaggaaagcgagaacggattttctgaaaaaggaaacataagagcggatttagtaattggagaatatgattttaatggaagtattgtaataccagtagattttactgaaagtttcaagcagtatatgaaacatgatcttgatgtaaatattgagaaaaattataatataacaggttttgaaagtgatgtaattggtacacgaattattgtaacaagacctgtagatgatatgatgtatggaaataatgacagtgtagttgattcatattttataataaaactaggaaataaaatgtatcgtgcaatggatattggaggaagtggttacagttcagacgatgaagtatacaaatgtgcttttgaagttgaaggacttacttacaatgatataaaggatgcagatagtataagtattataccagtaaaatgtactatgacatatgatgaaattgaagagaagtacaaagatagttcattatatgaaagattatcaaaagaagcagtaacagagaataatgtaaagtacaataaagaagtagaatttacagatggaacaaaaggtgaaataaaagttgaaagagcaaataataagatacgtgtatactgtagttcagattctgatataaaaagttttatgttagctgaaggtataagcagcatatttacagatggatcagatgattacagaaattctgtatatgaagatgataaagttatatgtaaagatgaaaatgcagaaaatcaatatatagctgaatttgaagattctcatcctgaaatgatgtttgaaacacatatagatacaattatgctaaatagcgataagtttgatataggtgatgaaataaaaattaaatagttatgttacttagagtattaaaaggtcctgaagaaattcagggctttctattatttttatggaaaatttagaataagaaaattttgctttgaataattttgaggattatttttaaaggataaggatataaggtataatcataacaaagtattaattaggagatagttgtatatgaatcaaaataaatacgaagaatctattaaaatgacttatgattatgtgtatagaatgctagttaagctgaaaaatataaaaagtaattttgagacttttgaaaatccagatgaaatcacaaaagaggtatatagagattcgatcataaaaaaatatgagatgcttgaagatcttacatggaaacttctatctaaaatatttaaagatagaggtcttgaaataaataatcctaagggatgttacaggcaggcatttaaagaaggatggataaaagatatagatatttggaatgaaattttaatctctagaaatacaacagcacatatttataatgaaaaagattatgaagaaataaaagatagaatagtagaagaatatattgatgctattgaagggctactttttaaaatttcagaagaagtgatgtgattattatgtatggtataaataagaaagtttatgaaaatcttttgaattatttcagtgagagccaatatattaaaagagtaatattgtttggttcaagagcaaaagagaatgcttgttataattctgatatagacttatgtgtagactgccatagaaaattcagaagtagagtaattgatagtattgatgacattgttggaatatattctgcggatatattattttttgattcattaaatttagaaattgaaaatgaaataaagaaatacggtaaaataatatatgattgtgaagagtcttgattaaattcaggactttttttgagtgatttgtttggaattcagaaaatgataaaattgtaacataagtataattatgttacaattttaactataattacaaaataaggggaataattatgtttcttatactagtattaatacttatatctataggactacttttaaaaaaagaacatattgttagaaaaaaatacacacaggaatctggtatttcttatgacaatgcatttaaagataaaggaatgtatggagagtatctaacctttagagaacttgaaaaaataaaaggtaatcatagaatcattactaacgtttatcttccatgtgataatggtaaaactacagagattgatttgatatatatacatgaaagtggtatttatgttatagaatcaaaaaactatagtgggtggatttttggtaatgaaaatgatcgatattggacacaggttttcaaaaataagaggaaagaaaaattttataatccaataaaacagaatgatactcatattaagagtctcattaatgtatgtgcaatagaaaataaatttgtaagatcaataattgtatttagtaaaagatgtacactaaaaaatataacagtgcattcagacaatgtttctgtaattaatagaaatgatttagtggagaacattaaatctcatattggaaaatcctctataaagctcagtgaagatagaattaatgttttatattatgtgctcagaaattatagtaatgtagatgagtcagttaaacaagctcatgttgaaaatataaataattataagaataggggaaaaagcagtacaaataaaagtacatataataaacaggatgataatgaaagtaataaggcagattatgttgagtataactttaaaactacatatactgatttttctaataatgaggataatcatgaaaatactattgaaaaagaacaacaagtattttcagcttctcttgaagaagagttaaagaagtacaggcttaacaaaagtaaagagcttggtattaaaccatatatgattttttcaaacaaagaaatgaatgatattatactaattaaaccaatggatattgattcactttgcaaaattaatggatttggagacgttaaatgcagtaagtatggagaggatattgttaagattgttagtggatgtttgtaggtgtttaatatggctttaggagagtctaatcgaaaggttaggctttttttgttttagaattaaattaaatagagtagtacggaattaaaatatgattgctttaacgtgtgtacaatttaaataaggttaatattttcaggatattttttactatttttatgaaaatacaaactaaattgtaattctatagtataattataaataatgaatacatatttgtggaaaatttaaaggagattatatggcaggaccaggaaaacatgacaatcgaatatactggaataaagtatatgaaggaattaatgaaattaagccagtttatgatttatggcttgataaatacaaagatatattagaaaaaagcagagatacaaaaattatagatcttggatgtggaagtgggaacaattctatttatttagatgaaagaaattataaggttatatcatgtgattattctaaagaaggtcttaatattgtaaaaagatatataagaaattttgaaatagttgaaatggatctgacagagaagtttccttttgaagatgaaagtacagaagtcattattgcagatttatcattacattattttgatgaaaatactacaaaaagcattttaaatgaaataaagagaattctcaaatatgatggctatcttatagcaagagttaatacaattaaggatgttaactttaatgcaggaaatggagaagagatagaaaagcatttttatttgactaaagaaggatataaaagattttttgatgaagaagatataaaaaaatttttcggtgtatttgaaattcataatattgaagaaacagttatgaatagatatggtgctgagaaaaaatgctttgaaatagtgtgtataaataaagggaagagataactatgagtaaaatagatttaaatgatataagtattaaagaaaatgagattagtgttaaggaaatacataaagaatcatatgcaaagtcaaatgccataacaggtgataaaaattatctgtattacagacttagagaaagttttaagaaagcagaaaaaatagatataatagtttcatttctaatggaatcaggtgttaagcttattttaaatgatataaaagaggcagtagacagaggtgtttctataaggattttaacaggaaattatctaagaattactcagccatcagcattatatttattaaaaaaagaatttaaggacaagattgaactaagattttataatgagccaaacagatcatttcatccaaagtcatatatgtttcacaataaaattgatagtgaaatatatgtgggatcttcaaatatttcaagaggtgcacttactaattctatagaatggaattatagatttttaaagtcacagaatccttatgattttgaagtattctataacacttttgaagatttattttataatcattcaataattgtggatgatgatgttttagaaagatattctaaatcatgggtaagacctaaggtttttaaggatatagaaaatagtgaagatgaatataagaaaaacagtaatagtgaaaataatgtgattgatttatttgagcctaaaggtgcacagatagaagctttgtatgctttgaacaatacaagggaagaaggatttgacaaagcattaatagttgcagcaacaggtataggaaagacatatcttgctgcctttgattcaaaagattcacaaagaatattgtttgtggctcatagagaagaaataattaaacaagctgcaagaagttttaaaaacgtaaggaattcagaagacattggatatttctttaatagtacaaaagataaagataaatctatgatatttgctttagttcagactttaggaaaagacgaatatttaaatgaagactattttaagaaagattattttgattacataataatagatgaatttcaccatgcagtttcaaataactacagaaagataatagattactttacacctaaatttctacttggacttacagcaacacctgaaagacttgattcaaaagatgtattttcattatgtgattataatactgtttatgaaatcaggctttgtgatgcaataaataagggatatcttgtacctttcagatattatggaatttatgatgatactgtagattatacgaatgtagaatttaagaacggtaaatacgtagaaaagcagcttgaagaagctttgatgtttaataaaagggcagaacttattttaaatcattataagaaatataattcaaaaagagctttaggattctgtacaagcaaaaggcatgcagagtacatggcaaaattctttagtgaaaatggagttaatagtgcagctgtatatagtggtgataatggcgaatatgcacaagaaagaaattcatcaataaataaacttactaaaggtgaacttaaagttgtattttctgtagatatgtttaatgagggactagatataccttcaatagatatggtaatgtttttaaggccaacacaatctccaacagtattcttacaacagttaggacgtggacttagaaagtttgaagacaaaaagtatcttaatgtgcttgactttattggtaattataaaaaggctgatctgcttccatttttattaagtggaaagacgtattcaagagctggttcaaaaagaggaattcccagtgaagaagaatatccagaagattgtagaattgattttgattttagattaatagacatattcaagggtttagcatccaaagaaatgaagattaaagataaaataaaagaagaatttttaagggtaaaagatgacttgggacatagaccaagcaggattgaattttttaacaatattgatgatgaaatttactgcgaaatgaaaatgaaaagtaaatttaatatatttaaggattacttgggattcttaaaagaaaataatgaacttacagatgaagaactggagtttatgaatactaggggatatgactttattaaaatgattgaaaatacaaagatgagtaagagttataagataccagtattattggctttttataataatggtaatattaagatgtctcttgatgaagatgatatttataatagtttttatgaattttatcataagggtagtaataaggtggatatgcttaaggacaaggcaacagctggctttgaaaaatgggagaagaaggactatgtgaaattggctaaggataatccagttaagtttttgatcaaaactgagagtgatttctttaaaggaacagatgaaaatttaattgaattgtataaagacatggagaatattattaataacaatataattaaggaacaaatgttggatgctttgacacttagagctaatatgtattatgaagaaagaaaattttaaataaaaattcattaatttataaaaatttgaagagttatagattgaaatatgtttaaatatgaggaaagtgtatggataaggcaaaagaattaaaattaaaaaatcaagaagttattgtagatgcgaaagaaataaaaaatagatattataaatcagtatcatcaaaggagaaaagatttatttgtttatgttgcggagaatacttatcatatgtaatttcagataaaaaaaagccatacttcagacatatcaatgaaaatgaaacaacaaaaaagtgtcaaatgagaatatcctatgattcagaacagacagtttatcaaaaagcaggtctttctttatatttaaaggaatcagggaatgaattttttgagttgtacatagcatttagaaaaattgacaataaaatatttaattccctattagaatcaaaagaaaaaataataataaaatatagaaataagagttgtgaatatatattaaataattacaatttttctcatgaatataccactttaaagaagattgattttatagcagaaaagtatcaaattttatatccgaattttgatttgaaaaaatttttaatagaagtttggggagaggaaattgaaggctttttaggaaatgaaagtttatttacttttaatgataagggaggcaagaaagtaaaaatcaatgaagaaattaaaattaacacagagtattattatctagggtcaaacgagcggatttttaaaaattataataatatcaaagttgtatataaaggtattcttgaagtaaacaatagtgagtattatctaagtcagtataaaatttataagatatcttttatacccgttaatgatgatgaatttatgaagatgagggtattatgcagagagcgatttagagtgagtttacattataataaacctaattttattggattatggccacctacagtgataaaaaacgaaagttataaagttataaattttaaaaatgaagcaataggaattattaaaagtgacaagctagagaagttatattgtaatgataagcatactgtatatgaaataagattaaaagaattattagatgataaatatataataagaattccaataagaaattatgaaataccttttattttacaagaacaatataattcgattttttttgttaatggaggatatttgaataaaataaagcaatatgaaaacaaaattgtaatagaagataataatggtatgaaaatagaaaatggaattaagaataagttaccattaaaacaaggtataagtattacttcaaaatctagatgtaaaattatacataaaagtcagaatgggttagtgataaaaaagattaataattatagtgaaataaaactagaaaatataaaattttgagatacaattataagtttttattcgggaaaagaagaaattttattacaatatctaaagcaacataaagattctaataaattactaataaatcagttacataataagaataaaaatgataagagtgaattagttgatttcccaatttatattaaaaacaagctgctaaaatctaatgaatattttgaaatatataaaattataaaaatatatatttttaaaggtaaaataccaatacaaatattaaaactaatagaaaaacattttaatagtaagaggtaaaaaggaatgagcattaattatatagagaatataattcaaaaatataatgaagaacaatttaagcagattatatcgatattaggtcataaggatctcatacaaataataaagaataatcccaaaagttttgaaaaagaacctgaattaagaggatatagaattgatacattagcaatgaaaaaaattcagaatatttatatcaaacggatatttaaggaacaagatatagtattagcccaatatatctataatttaatctctgatatgaaaaacactactaataagaagattagtagcgaattagagatagatcaattgaaattaaatacagtaaatatatatgatatagcatactgtttattagatactcaatttaaaaataatattgaactttattatataattaataataggaaagttgcacaaaaggataaatatgcacttttaaaattatgtgaatttttacagactaataaaattagagagtataaattcaagttggataattacaataacacaatagaaaattacaaaaaagacattgagaagaataaaaatattttaaacttaaaagagcatcaaattgaagaatgtaataatgagattaaaagattaaagcaaagtttatcgaaagtgcaaaaagaaaatgagaacaagatagaagaattccaagatagaataaatagattagataatttacatgaggaaagatatagtgcaatacaaaatgaaaaaaatgtgattgaaaaacaaaatattgaattgataaaaaaacaggaagagaaggattctattataaaaaatcttaattcattacttaaagatgaatataataagaattctcaggaatttaagaaaaaatttataaaagaaaatgatgtactggtaaaaggaaatactgatttaaagagaattaatttagatttacaaaataaaaagaaagaaatggaagacattatagaaaatttaaaatgtgaaaagagtttaatacttgaagaaaagcaagaaattaaagaaaatattaatattttaaagaaggaagcagggaatacagttgatagtataagcaatataataaaatatcttgatataaaaccgagtaacagtgaacaaaagatatataaatatagagagttatcagaaattactgaatctcaaggaatgattgaagatagagatgaatttgttcatgcattaaaaattaatttaactatttgtggtatagaagaaaattgttcttatgatttagctgaatatatttttgcaatacttattagtaattcaaagttgctttttgttggaagcaaatcaagaaaagttacaaatgctctatcatatttaattaatgaaaaaccagcagaaattataaatattccaataggatataagaattggagagaattgataaatttaatagaaaatgcagactctgattttatattgattgagaattctattaataatatagaggaaaatatatatttagctttaataaaacaaaatataaataaaaacattattttctcaatagatagtcttgatgatgttggtgcattatcaaccaatatattgaattatgttggagtagttgaattagataggtttgctacgttcgaaaataatgaaattttattgagtggattgactgatagtgaaatttttgaactagatttaaattataaagagaaaaagaaaaacttaagaaacttaaaaaaaatggacttgccgattagattaagcaatattactaaggtaaattatgctgaaattataaccattagtgatttctttaatgttaaatcttcaatttataaaatgatgttatttgggataatggtattgtgtgaatcgaataagactatagttgaatttaatcaatttattaaatcactaaatttagaaaatgataaattagaaatattacaaaagtatattcaggaagtagagaaatatgaggaataacataataaattttatagcagatgatttaaaaataaaaaggtataaagatgaagaattgcataggtatatttctagagtgacatattcagcagttggtatgtggattagagcagcgacattagatgagaatatattagatgataaaagttatagtgttggaaaaagtaaaaaatatataattaatagatgtagttcgtttttggagaatatgattcaaatttatccggaaattaatgaatggcttaatactaatcataaaagaaatccaatagaaattataagaaaaagattggaacgagggaatgaacttgttgatgtaggatataatactgacttggcattaccgtattatagagaatgtccaattaacaattcacataatgtaattagaggtattagatttgaaaaatttaatgtagctataggtttaactcaaattaaaagaaacgataatgagatttatgataaaaagaaattgtatgaattttatggaataagtttgaaaaaatctaatgaattactagatgaatatctaaatgaaatacaatggatagagaaaaaaaatttaaaagataaactattctttaataagaattcaaataaaattttatcagaatgttgggaatatagaaatatactgatggatggagagattacattatacaaagacggattattaaattttgggtttgtaaaaagtgtaggtaataatatttatacaagcagtttaatagataggtacttagttactaagtttgaagtgagacgatttatgtatgcattaaaaaaggagagtaataattgttttaaggcacaatttaaaaattatgaagaagataatttagttatgcttagattattcagtgcattacctcaaaaagaagaagatactttaatgctattaggatggccagttaatagtatagaagataaatataatttactgtttgataaaaattgttgggaatttgtgaaatcaataattactaatttagaaattgaattggaggaagtttaaagtgaaaaatgaaggggtttatggaacgcataatgcattaaaaagtagatttatagattatataaaagcacaatatttagaaaaaaataatttgctattaagtgaatttgataaacgagtagacaaagataaaatattatatcaagaaccgtacatagaagcaaatgcagcttatgaaatagctattaacggtattgaaaattctgaaattataccatctgatataaagatgatactaggtaaaatggaagaaaataaactgggtgtttttaaaaatccttttaaacatcaagtttctgccttagaaaacttttataaaggaaaagatttacttgtaaccacaggaactggatcaggtaaaacagagtgctttatgtggcctatgattagtaatataataagtgaagctaaaaataataaggattcatgggataacagaggcattagggcattaatgctatatccaatgaatgctttggtttcagatcaaataggccgattaagaaaaatgataggagataatgaaggaaagtttagagaaatatttgatgaaattgtaggggatagttgtagaattccacaatttggaatgtatactggaagaactccctattcaggtgagccaaatgataaaagagataaagatctagcaaaaacgttagaaaatgatttagtaggacaagataataaagaattaagaaagaataatttgattaaaattggaaaatatccagcgaaatatgatattgaagaatttataaataacttgaaaaacggaaatcatattacagataatagggatgcagaacttattacaaggcaagaaatgcaaaaacaatgtccagatatattaatcacaaactattcgatgttagagtacatgctatttagacctaaagaagatagtatatggagaaatacaagaaaatggttggaatgtgataacaataataaattaacagtaataatagatgaagcacatatgtataagggagcttcaggtggagaagtatctttattgttaagaagattattttataaattaaacataagtagggataaagtaagatttatacttactacagctagtgttccttgtgatgaaaaacaagcaactataaaatttgcatgtgatttgacagcacaaaatattaatgagaataattttcaaattatttatggagaacaagaagaacttagttttgaagattctatggatatatcggcagaaaaattatcacaattggatataaatctttttacgcaagaagatgagatgaaacttagaggaattaatcagtttgcagaattatttaatattaaggagaaatttttatcatacagagaggctcaattgtggttatttgaatttttacctaggttgaaacctatgataaaaattatgcaggaatgtaggggtaatgccataacatataaaaaattatcacaaatagcatttccagatgctaaagaggatctttcaaataaagcggtagaagtatttttatcaattgcaccattagcaaaaaataaagataatcaggttttatttcctactagattgcatatgatgtttagaggattgcaaggagtatatgcatgtagtaatcctaattgtgctgagcacgttagtgatggtgaaattacattaggaaagctttactttaatggagagagagatagatgtaaagtatgtgatagcaaagtatacgaattgattacagaccgaagatgtggtgctttatttttcaaaggatatatgtttgaaaaatcagcttcaaatgctgatttgaattttatatggaacaagactggagaccagtatgatgatacattaaaagaagtacatttttatattgttcctaaaaactttaaatttaatagtaaaagtaaaataaacaaagttaaaggatatttaaattctataacaggtaaattatatgaaaatggagataagtattttgataaagatggatttatagaggtactctatgaaagaaaagaacagaaggggagacctggattattaacattttataattgtcctaaatgtggtaaagcacattttaatgcaactgattttataactaaaggtaatgaatctttttataatttagtagctgaacaattaaaagttcaatcgcctacgatatttgatgaagaacaattaaagatatttcctaatgcaggtaaaaaagtattattattctcagatagtagacaaagagcagcaaatttagcaaaggatttaacaaaatcagctgacgatgatgcagttagaaagataattgttttagcagctataagattacaaaaatgggctgaagcaagtaataaatatccaacaatggatctattgtatattacttttcttgaagaggtaataaaaaataaattgaaattgttttatggagaaagtggaaaagaactagagaatgataaaataaaattaaatcagcgaattgaaagaattaataaaagaggaaataagttagattattctgatttaataagaagttttagcagccaaacagatttatataaagaacaattattaaaattgctctgcagtaattttagatcgctaacagatataggtttatgttatataatgccatgcaatgaaaatttacaatatgaaatagaagatatttttgaggatgaagagatagaattagaatttgatcagtttagtataatattttctacatgggcaaataaaatattaaaagatacatatgctttagatagtaatatgagtagagagattagagaaaatattagaacgtcaatggtgcctagatttggaattgatattcaaaataataaaatagattcaactatgaatgatattttaaaaagtaaatttacacaagataagattgatattatttatcaatgtttactaaaatatactgatagaaatggagaggataaaaacaactatctaaatttaaatttaatttctttacattatcaagaaaatcaaaaatggtattattgcaagaaatgttctggagtatttccatttgagttatttggaaggtgctgtcattgtggtagtgataatactgagcaattaaaaaaagagcagctatcaaaattaaatttctggagaaaacctgttattgaagcaatagaaaatgaagaaacgaatataataacaggtataaatacagaagaacatactgctcagttgtctcataaagatgaaagtaaggatctttggtcaactactgaaaattatgaaatgagatttcaggatattttacttaatgatgaaaatccagtagatattttaagttgcactacaactatggaagttggaattgatattggttcattaacagctgtaggattaagaaatattccaccaatgagagaaaattatcagcaaagagctggtagagctggtagaagaagttcagccatatctacaatagttacatttactgataacggtccatatgataattattactttttacatccacaagaaataatagcaggtaaaacaagaaaaccagctatagatattgaaaataaaaagttgatatatagacatttaaatatgactattatgaataattatcttttaaatattaatgatgatggaatggataagtatagttcaatacaattttttgaaagtgaacttgaaaactttatgaggtacattaattcttataagtttacagataaagagataaaaatacttattccaaatgtagtaacaataaatttcacagaatttaaaaataaattaatagagtctttgaaattgataaactttaaaatgaagacttccttaatagattttaaaaatgaaaaagacgaacctaaatctatactggatgtattttatgaagaggggattttgccaacgtattcttttcctaaaaatatagtaggattttttatagaagatgaaaaaggaactaaagtattacaacaaccatcaagggcattagatatggcaattagtgagtatgcaccagggaaattaattgttgttgataagaaaacatataagtcaggtggaatttatagtttccattcgaaattaaagcatggtttttatgagaagccagcaagaccttattttgaaaataatgaatattttaaatcaatatatttttgtaataataaatcatgtggttggtttgacattgaaaagcaagaagatggcaagtgcccattctgtggatcaaatgatttatcagaaaaacatatgttaaaaccttgggggtttacaccgttaaatgcaaaaagtataccggaagcagatgcaatacctactaactcatatgctgaaattccatgttattcaacaactcctaaaagtgatgatcttttagatactgagtttgtaaatataagagaagcaaaacgttcagatcagaaggtaataatattaaataaaggtcctaaaaatttagggtttaatatatgtaaagattgtggagctgctgttactggagatgaaatgttaggtaaaaagataaaacgaccatttaatagtacaaggagcaatagaagttgtagccataatgatattgaacaaaatgtagttcttgggcatagctttattacagatatgtttgtaattgaaatcacaatagataaagaaaaaataaattgtaaaccagatggattatggataaaatcagcagctcttacattatctcaagctatgatattagcagcaggtaagattttagacattgattataatgaaataaaaagtggatatagattaagatattcagataagattacatttgtagatatttttctgtttgatagtttatcaagtggagctggatatagttcagaacttgctagtagattaaaagaattggtcgaagaaactagaaaaatgctggagggatgtaattgtgattcagcatgtcatcaatgtttaaataatttttggaatcaaagagttcaaaaaaatttaaatagattcttagcaattcaacttttggattatgcaagtaatgatatactaagtaagtcattttcttttgaagatcaatgtaggatatttaaacctttaaaagaacttttagagatagatggatataaagaagttgaatatatagataaaacaataatagtaaaaagtttagataaacaaaaaaacatatgcgtatatcctgaaatgtggaatatagatagcgttaataataatgaaagttgtatatatatttctgatttattaataaaaaatgcattacctgaagcttgtaaaaaaataaatgataaatttaattaatgtattatgtaaaaataatataaacactggagataattaaatgagtaaagaacgatcagattcatggagtaaaatagagaataaagatacaaattcaatagcaggaaaaaagtagattatagtacatttaaatatggtactgtcatacctgcacgatattataaaggatttctggataatttattaggggaattaattaaagtgttatgaattcatatttgatgcaaagtacaagattgattatagacaagagtatgtaaaagcatatggaagcccagggcctaaggaagaagatattaacactatgcatagatatagggatgcaattgtatcaatatataataagaataatgattcagatttgagatctcatgtaaaaaataatgtctttggagcatttgtattgtttccttataatgatgaggaaaaatataaggaaaatactttttataaaagtatagatgaggttaatattggtgcatttccatttcttccatcaacaacaaaacttatggagcagtttttagatgaacttgttaaggaatcatcttattcaacttttgaaagagctattgataaagtaaataaggaaaactatctttcagaagatgattttaagaatagaaatgtacttataggaatggtaaagtcaagagagcagtttgaagctaatattaataataaattttatcatattctagtaaaatcagtgaatcttgtagcgcatagtgtttgagtcaagtaaaagttggcaataattttgtttattttatatccattattttacagttgttttttattattaccctacccaaatttaatcattaattataactgatatcactaaaactttttaatccacataaatcttgtattattttgcgtccaagagttgacgcagcattgctgtacggaattggtgagctagcacatttataaaccttagatttcttagctggtttagttgcttgaaacactgttaattgcatatttgaaactactgtatcaacaatttcacttggaataatattactataaattttgtctatagtatcaaataatctattactaaatttttctgctaatattctagctaaattatctgcaccattaatagaccagctcatttttcttcctttcatcctttgagctaatacatcacagatattatgttctattgtacctaattgtctatattcaatgccttccggcggcgtaggcagctttatattatctcgtaatttgtatggtattaatccatctttgttatttacaagataatcatacaactctgcaagctttttcaaagttgtttcattgtcattattctctatcattaaatccacaatcttttgcaaacctttatcaacattaccttctctaaataatttcaataatgctttctttgatttcttatcacttaccttacgaatgatagcctgactgatgtgaaatggatctaattgaaaatgtatatcttgctcttcacaagtggattttatccactttgctccatcaccatttaaaattcttgtatctatttcatccatgttatatatttctgctacagttgcttcagtaagttttttaaagtgtttggcattggcaaaactagcgcatactgttttatccacaacttgatattcttttttgctacctggacgtaaagtccatccgctataggatactgctaactttaattctttctttttacttttacctttaggcctatccttaccttgcatagacaaccaaataccatcttgttcttgaaataaaactaaaacttctttttcgccctttaaattcccattatcattcaattcaattttacggtcttccaattccttaattttatccccagttgtttgaacaatattccacacaccttgagcactaatatcttgattacaggatctttttatattttctgatgtctttctgaatgacatttccgacacgttagttaaaatagtttctacaaggtttatagatacattgccaatggtatccatacctaaatattcatctaaaagaaacttagtagctttcttaccatcctctaaattaaattcataaatacgtctggaatattcaacattccccataatagttcgcaaacaagtttgcttgcggcctttgttcctataaaccttagtatctctttcattaagcaatttttcatctaaaagttctaagatttctcttaacgcattacaggcatcatcacaagcacttttataaattttttgttctaattccttgaaagtaaagccattatcatttaaactagagtcatacataaattcatctccattcaatttagtatcgcaacttaattataatggataatttacgtattggggagatgtttttacatctcctttttatattgtattaattactacttatgcctactaaaattatactctaacgcgcatagtatagaatacgttacactattacagacaaaaaatatttttaatgatgaaagtggcgttcaatattatggacaggttactgatattaaaattgtaaaaagaagtgaaataacagaacttcctaaagagagtagtgaactttattataggattgaggtatcatcaacctgtactatgtttaaaaataaggataaatagtctataatatatacaaatgaagaagaaagaaattgtggaggtacagtaatgaatcataagccactaccaattggaatagataattttgaaatgctaattaccagagggtattattttatagataaatcattattaataaaagatttgttagataacaaagcttcagtcaatttgtttacaagaccaagaagatttggaaaaactttgaatattagtatgctccagtatttctttgaagattcaagaaaagaacttgatggagaaaagaaagataactcgtttctttttgatggactgaaaataatggattctggagaagagtatacttcacatatgggtaaatatcctgtaataaatctttcattaaaatctgggaaacagcctaattttaaaatggctcgtgaatcacttattgatgaaataagagatgaatatataagacataattttgtattgaaaagtgaaaaacttattgaaacagaaaaagaatcatttctaaatatcatgaacggaaaggccagagatattgattatgcaaaatcattaatgattctaagtaaatgcctcaataaatattatgaaaaaaaggtaataattcttattgatgagtatgatgttccactacagaatgctttttttgaagggttttataatgaaatgataggttttatccgttcactttttgaatctgcattaaaaactaattcatatcttgagtttgcagtaattacaggatgtcttaggatttcaaaagaaagcatatttactggacttaataatctaaagataatatcaatacttgacgacaaatatgatgaattttttgggtttacagaccaagaggtattaaaaatatgtgaggattataacatgctacaaaaatatgagattctaaaggcatggtataatggatatatatttggagaagccaatgtatataatccttggagcgtgatgcagtttgttgatgatttatgtgcaaatataaatagatatccatcttcatactgggccaatacaagttcaaatagcatagtaaaaagtttaatagatagagctgatgatgaaacaaaaaaagagatagaagcactgatagaaggaaaaacaatagaaaagcctgttcatgaagatataacatatgatgaaatttatgattccatggataatctgtataattttatgttctttacaggatattttaaaagcataaatgaaagagtagatgaaaatacaaagattaaatatcttactcttaaaattccaaatgaagaagtaaaatatatatttagagaaaaaattcttaagtggttcgatgtgacaataaaaactagagatttttctaacatatacaatgctgtaattggtaaagatgcagaagtatttgaagaagaacttgcctcagtacttattgagacaataagttttaatgatgcctatgaaaatttctatcatggttttgttacagggattttatctgggatgaagggatatattgtaaaatccaatagagaatctgggaatggtagaggagatattttcataaagccagtaacaagaagaaaagctgctataattcttgaacttaaagttgcaaaaaactttaatgaacttgaagagaaagcagatgaagctttgaagcagattgaaaaaatgaagtatgaattagaaatgaaggatgatggatataataatatcattaagtatggaatatcattttttagaaaagattgttttataaaattacaagaagattaacatttgtaaggaatctattagtagcagaaaaaaatatatataagttttatagaagcgttgcctaaaaaggtagcgctttttaaaataaattaaataattttgatatgtataatataatctatatcatactatacggcaataccttgaagtatcaaagtttagatgatatagtatatttaatgaatttagaattttattaatgtaggaggtgaattttataatggaggaaatattgtttttaaaatatcatgatattacagttggattactgacagtaatagataatataccaaagcagcttgagatattacgaagtgatttgttcttcgatagacataaaaaaaatatactgtttggtgatgaactcatagaatggataaaagatagagtaagaccaaatgcacagattggattaaataaaatattgaaatcctttggcatagatgatagcggatcaatgtggtattgggatttatttttaaaaacaagaggaatgaacgtaaaagataggctatggatatcaaaggatgaattcgataacagcccgtgggatctactattgactatagataaagatataccagaagtagatttgtataagaaatatttaaatgtaaataaaagttattataatataaatttaattggagcatgtgaaaaatctatagttagggtaaatggaaatcttgcaatactaaaacattcactgcagcataatacattcgatgggatagcagaagaattatgctatctaatagcacgaagcttagggataaattgtgcagaagctaaatacctaggcaatggtttgagtctttcatttattgacgaaaatatagatttaatccatgcagaagcttttttagacactgatactagaaatgttgaaacattgtataagaaactggttctaaaagacattgataaaagagtacgtatagattttttaagactatttttattcgatatcttgacaaggcagatggatagaaatttaactaattttggattctataagattaattcatatgttaaattatatagactatatgacaacggattaagcttattttcaagtgttaaatttaattccaaattagaatactcatctgtatacggaaattcagaagatatactaagatatgtggttagacagcttaaaaatgaattggttgataagccttttgcaggtcacttatcaatagaatttttagatgatatatttaaaccatatgctgatgaaataatgcaggttaaaggaaccgattataaagatattgtaaaatggattatgaacatgtatgatcatattttagaaaaattttaaatttttgtagaagcgttgccaaaaggcagcgctttttaaaattaattaaataattttgatatatacagcaaatctaaaagaataaaaaaataatttcataaaaaacataaaaatttttccacttttttctcaataaacatatatattatgtagaactacttaaaagtagatattactgaaatgtatggagggttatattatgaagtatacagtagaaggattttcacaaaagagccttattgattatggactagatgaaaaagatgcacttatattaaggtattttatagattttaaagacagtggaaaaatgaagatgaaaataataaataaagttccatattactggctgaaaggctcagcgcttttagagcagcttcctatattgagaataaacaacgtagatgttttaagaagacgtctcaaaaaaatgacttcatgtaaaatactcatgcatgaacatgttttagaaggtggaagttatgctttttatgcaattggagaaaactatcaagatcttcttttatatgatgatgcatcagaatgtgaagatagtggagatacttatggaactactgctggaaataatattgaagaaaatgaaatagtggacataaaattaaaaaaggtttctgaaataaatgaaggactgactgaaaagactgggggtattactgaaaagaaggagtcaattagtcaaaagtcggaggattcagactggaaagtaggagcaaaagattattctattaataaatctataaataataatcattctgcatgtgacattacacaggctgggatacaaagtgagaaacaaaaattacaagttaattgtaaaacaggggttccttatgatgaggttattaatatgtttaatgacttatgcagatccttcccaaaagttaaagtgagaaataagacacgtgataataatataaagaaaatgtataaaaatcttcatattgatgagattaaggcaatctttgaaatggctgaaaaaagtgattatctttctggaagaaatggaaagtggatgaactgtagttttgactggattattaaagaaaataattatatcaaagtacttgaaggaaattacaatagagactcagctgttaaatcaggttcaaaggattggacaggctattgcgatcatatggaaaaagatgaaagttatgaagcttcaaaagatgatgaagacaatgagttatatgaaagtgaaattataataaatacagaacttctggaggatttgtaatatgaataatagagtaatgccaagcagtcttgaagcagaacaaactcttataggatgtattttaaacagtacagataaatttatagaagctgatactatattaaattctgaagacttttatgtagataaacataagaaaatttatgaaactattaaaaaactttgtgataattctgttagtgttgatacagtaacagtagttgataatcttaaaaagaaaggaatccttgaagaatgcggtggtattacatacctttcaaatcttgaaactggtgcagtgaattacagcagcattgaaaattacgcaagaattgtgaaagaaaagtcagacagacgtgcacttgtaaaagccggatcaaaactcatggaggatgcttttgaaaaagaagatgtaaaagaggcaattgaagatgcagaaaagtgtattttcaatgtttcagcaagtaaaaatatcactggtcctgaaagaatagatacaatactggaaaaggcctttgtaaaacttgaaaaaaggtgcaaaaatggaggaggacttgttggaataagtacaggatttaaaggaattgatgatattactggaggccttaaacctggtgaactagtaattgtggcagcaagaccatccatggggaagactgcatttgcacttaatattgctcaaagtgcatcaaggacaagttctgtaataatattttcacttgaaatggaaactgaaagtcttttaaacagaatgataagttcaagctgtatgataaaaatgaatgatatacaaagtggtactcttactgatgatcaatttgtaaggataatgaaaagaacaagtgaacttggaaaaaggaacttatatatagatgataaaagcaccatgctttcagatataaaagctctatgcagaaaacaaaagttgcaaaaaggtcttgatgttatagtaatagactatttacagctcataagaacaacaatgaaggcaaatcaaagggaacaagaagtatcatatatatcaaaagagctgaaatcacttgcaaaagaacttaatattacagtaatagcattgtcacagctttctagagcacctgaagcacgaaatgatcatagaccaatgctttctgaccttagggaatcaggttctattgagcaggatgctgatattatccattttatatatagagatgcatattacaataacaataaaaagaaaaagggcaagaaaaaagattctgagggaattcaaggagaatttaaaataaacaattcagcatcaacatctgttaataaaagtacagctgataatagtggaaatttaaatattaataagaacaatgaaaataatatgcgaaaagatgttgagtataataaaaaacctgatgatattatagcggaaataattactgcaaaaaatagaaatggacagactaaaaccaataaacttaactggattggtgaatatcagagatttacaagtgctgatgttattaaacagtaaagaaaaatgtattaagagtattcttaaaagtgataatactttcattaattaaaataaatggccataaagaaaacatgaaatattacaatgatcatatactccttatcttatatgaaattatagaagaatttgaaactgaagaaagtaagaagttaggaatgaactaactccttacttattttataaataataaatcttgaaattatagaatttaatagtgtataatgaaaaggcttgtatttttatgtaaattataatatataatactaaattaggggattaaagacaataagggggatgtttaatgctagaagatggaaacacaagagtagaagattttgaagaaaacgtaaattatagtgggaaaatatgtgaaatgtgtaaagcaaaatatattgatgattctgaaagcagatattcaattttgtgtacagagtgcagagaaaatcagataaaatatcctattcctaaaattttcttactgttaggaatagcactttctgtacttgtaataattgcactagtacagtttcctaaatcttttaaagattatgcagtatataaaacagctgaagagaaggcaaatgatggctatgcaaatgaaacattactatcattagaaggtgtaattggaaagcatccagagacaactgatattgcggttacagcagtagatattgcaatggagaatgggaattatgcatatgcagggtatctgctggatacatatttagttggaagaaaagtttcagatacagtctattatagattagatggttatttaaataaaattgattcaatttataatgtgtatgatgagtacgagaatattgtatcaaatattgatacaaatttatctgaagatcaagcagtattacaagcaaagagtgatgtaagcaaacttttatatgatggtaaatataacaaggctgtagtatataattacttagcgttacttacagatgatgctgaagaacataaagagtatttaaagaaaagtatagaagaagattctaaggtattagaaacacaggtacaacttgcaaatgcatataggcgtgaaggtaatagtgatgaagcaaaaagtatgttagataaagttcttataaaagaaagaaataatataggagctaaaaggggacttgctattttaaatatgcttgaagggaattatagtgaagctgttgaactagctagatttgcatatgaaaaaagcaaagaatatccatatgtatacgaaactttagccattgcattattttttgatggacaagtagaagaatcaaataagataatagaagaatttaaagcggctggaaatgaattagaagaagatacaaaaatgttattaagcggccagttaacgcttaatcaatattatcaaggataggaggaaaaatatatgttttttgtaccaggtatattaatttcagttattacatttccaggagtaatagtacatgaattagcacatgctattttttgcaaattactacgaataccaatatatgatgcaaaattttttcaatgttcaaatccgtgtggatatgtagtgcatgaacctacagataaaccgttgaaatcattattaatatcagttggaccatttttaattaatacaattttaggtgcaattataatgttgccagcatctattacattaattaaatttcgtgaacaaggaaacttccttactcttttattaggatggctaggaatatcaatactaatgcatgcatttcctagcactggtgatgcagaggcattaattgcatctgtattaaaaaataagaatgttaattttctattcaaagttgttactttcccatttattattgcaatttatataggtgcttttggatcagttgtctggcttgatgcagtttacgcagtagcagtatctatggtagtacctaatatattagttgatttgttatattaaaagtatggatataatcttgaaatatttaataaaactcatagtgtgttatcagcaactgttttatttgcagtaataatattagatacatgttacagaatttatcttggtgctgtattagggtcagtcatattaaaaagcgttgcctaaaagtggcagcgctttttaaatttataggctacagaattgaaatgatagtaaacttattggattggtaaatatgaatgatttaccagtggtgatagtttgatgaaatagatgtggtaaattagtagatttataataaaataaaaatattgcatattattgttctaatggtatataatttaaggatatagaacaaaaaacatatataattagttctatatatcatatggaggtgtaatatgaagaaaagaccgtttgtaccaaatcaacttccagtatcagaattgctagatatgaagcgtttgatgttcttgcttatgaatgctggaacaaaaattgcagtatataatgaaaagttaaaatccacaaaggttagccatacaaacttactagaactatttgcattaaaagaagctgttgaatcaacaaagattgaaggaactcaaataacaatggatgagatgttaaattatcgtgctgtagaaaaaaaagcaactaatgatattttagaagttgtaaattatatgaaggcattaagagaaggccgtagcttattaaatagatatccaataagtagtagattgataaaaaaactgcatcagatcttaatggatggtgatgcaagaggtggatctagtgtagtagcaggagaatttcgaacaattcaaaacttcttgggaccaaagggttcaacaatagagaatgcaacctatattccacctgaaccacagttagtacctgagtatataagtaacttagaaaaatatataaatgaaaatgaagaggatttaccactaataaaggtggcattacttcattcacaatttgaaactattcatccattcaccgatggaaatggacgtactggaagaatattagttcctctttacttgtttagtgagaatgttattgatgagcctagctttcttgtaagtgagagcttagagaaggataaatataaatattatgctttattgaataatactagagtggttttgcctgataaagaagattatccagaagaatatgaagaaaaaaagaaagaagcaaaaaagagcatgactgagtgggtagaatttttcttgaatgcatgtattactcaagcagataaaaatattaaaaagattgatgcaataaatgagttatatgaaaataccatatctaaagcgaaagatattactaatacaacaacaataattgatgtaattgacataatatttatgtatccaatatttacaactgctaacattcgtgagcattttgacatatcagcgtcgacattaaacaattatctaaaaaaattgtgtgacaataatattatttattcagatggatcagcacgtaatagaaagtattttttctatgatttaataagcattataagttaaaggtgttagtttttacagataaagcaaaggagttagacagaataaactaactccttttttaattcaaaaattaagatatatccataaaaataaacttcaaatttaaggatataagtaccgaaaattaggtttcttaaaaacgttttcaaaggtaaaatgtaattgtaaacaagggagataataaataacaagctacaattatagaaaaatatatttaaaaatgagggggaattttaaatgaaaaagaagcttatagcaatgtttttatcagttgcaacattgatgacttttggaggctgtggatcagcagcaagtaattctagtgacagcgcatcaggaggttcttcaaaaaatttaatagtgtattctcctcatccaatagaatttatagatccaatagtaaatgaatttgaaaaccaaagtggagtatcagttgaagttgttacagcaggatcaggagaattattaaaaagaatagaatctgaaggggataatcctcttggagatgttatgtggggaggctcattatccacattacagccaaaagcagatctatttgaagaatataaatcagcaaatgaagatgcagtaattgatgaatataaaaataaagatgggcatataacaagattttctgtaatacctagcgttataatggtaaatacaaatttaataggaaacataaaagttgaaggttttgaagatcttttaaatcctgaattaaaaggaaaaatagcaaatgcagatccttctaagtcatcttcagcatttgaacatttaatcaatcagttatatgctatgggaaatggaaatccagatgatggatgggcttatgtaactaatcttacaaaaaatcttgatggaaaattattaagcggatcatcagcagtatataaaggagtagctgatggtgaatacactgttggattgacatttgaagaagctgctgttaaatatgcaaaagacggtgcaccagtaaaagttgtttacccttcagaaggaactgttgcaaaagctgatggtgtttcaatcattaaaaatgctaaaaatatggacaatgcaaagaaattcattgattttgttacaagcaaagaagcacagaatgtagtagcaacacagcttaacagacgttcagttagaaacgatgtagaaggtgaaggtttagaatcatttaatagtataaaagttattaaggatgatgaaaactgggttaatgaaaacaagcagacaatgttagacaagtataaagatatattcacaagcaactaatagatatatttcaattgacaattgacagttgagaattgacaattaaggtgaaaatccttacaggattttttaaattatatgcagaataattattgcggcatatataattgaaaatattgatataagaaaataaattttaagaatataggttaattaagatctatattcttaattttacaatagttaatttgagttattaaagaaaacgattttatttacataaaagcggaggtgggaagattgagtaaatcaattaatataaatgatgtgataaagaaatatggagaaaatacagtaattccagatttaaaggcagatataaaaaatggagaattatttacactattaggaccatcaggatgtggaaagacaacattgcttagaatgatagcagggtttaactcaatagaaggtggaactatatcatttgatgaaaatgtaataaatgatattcctgcacataagagaaatattggtatggtgtttcaaaattatgctatatttcctcatatgacagtaaaagaaaatataaaatatggtttaaagttaagaaaaatatctaaagaggaaatggagaaaagggttgaggatattcttgatgtagttaaaataacacaatataaagacaggcttccagaaaacctgtctggaggtcagcaacagagagtggcacttgcaagggcaatagttattcatccagatgtattacttatggatgaacctttatcaaatcttgatgcaaaacttagaattgaaatgagatcagcaattagaaatatccaaaagcaggttggaataacaacagtttatgtaacacatgatcaggaagaagcacttgcaatttctgataggatagcaatcatgaaggaaggtgtcatacagcagattgatacaccttataatatttattcaagaccaagaaatgtttttgttgcaacttttattggaagatccaatatatttgatacatcactaatatccttaaatggaaagtcttatatagagtttgataatggttatacagtaaatgttgatatattatgtgatggaaatttaaagaagaaaactaaagttactgtaaggcctgaggaatttataataggtgatggtgatgaaggcttaaaaggtaaaattattactgcaacatttttaggaaagtatatggattatgtagtccaattagaagatggaatgaaaatagaattatcacatgatttgagcaataatgataaagtttacgaaaatggtgatatagtttatcttaaagttaacaccaaaaaaatcaatatatacaatgaagatggatctaaaaatcttttgataagtgaggtgtaacttatggaagcatcaaaatgtaaaaagtttaagctggatttctggaatgttgtaactataggaatatttctaatatttgcagtatgtttgatatatcctctattttctttattctttagcagtttaaaagattccaatacaggtgagtttactttaagcaattttgtacagttctttactaaaaaatattactacgaaagtctatggagaagtttttcagttacaataatcactacaatattaacaatagtaataggtgttcccttagcatatgtaatgactacatgtaaaataaaaggcaaagggttaatagaaattctaattataatatcagttctttcacctcctttcatcggagcttattcttggattttacttcttggaagaagtggagttataacaactttcctctcagatacatttggaattaacttgccgagcatatatggtttttcaggaatattattagtattcacattgaaattatttccttttatatatatgtacacaacaggagcattgaaaaaacttgatgtttctcttattgaagcatctgaaagtttaggctgtacaggtgtaaagaaggtatttacagtagtaattccgttaattttaccaacagtacttgcaggaagtttattagtatttatgaatgcattagctgattttggtacaccaatgcttataggagaaggataccaagtaatgccggtattaatatactctgagttcataagtgaggtaggaggacaggcaaactttgcagcagctttaagtgcaataatggtatttataacaactataattttccttggacaaaaatatgttgtaaataaaaaatcctttgtaatgagttcattaaagcctatacagcctaaaaagataaatggaataaagagtttttttgcacacacatttgtatatatcgttgtgggattagcaattataccacaagttacagtaatatttacatctttcttaaagacaaaaggagccatgttcataagagaattttcattaaattcatatataaatgtaataggaaagcttggaagttcaattaggaatacatttgtatatggaataatagccataatattaataattatacttggaatgtttatatcttatgtatcagtgagaaggaaaaatttatttacttcaatcctagatactttgacaatgtttccttatataataccaggatctgtactaggtataacattactgcttgcatttaataagaagcctattcttttaagtggtacatttatgattatagtaattgcatttgtaataagaagacttccatatactataagatcaagtgcagcaattttgtatcaaataagtccaagcatggaagaagcatcaataagtttaggttattctcagtttcagacctttaaaaatgtcacatctagaatgatgcttccaggggtaatatcaggagcaatattaagctggattacagttataaatgaattgagtgcttcaataatactatatacaggaactacaaggactatgtctgtagcaatatattcagaagtaataagggcaagttacggaacagcagcagcactttcatcaatattgacatttactacaataatatctcttttgattttcttcaaattgacaggaagcagagatataagtttatagataagtttaaaaatagtttccccataatttaattatagaaaagaatgctatgctgtataacatggcattcttttttaatgtaaatggtataatatgtatatacatattgagggaggagaaaatatgagtcagaataaaaagaacagctttaaacatgtcataaaaaaatcctttatattatattctttagttccaattacaataataacgttaatattttataatatgctcataattagtttctccaagtggtcctataaagacaatagagacatgaatgaatacatttcacagttattagaatacgaattgtcagagtataaaaatgatataatagaattgagcagtaatgaagatacaatcaacatattattaaataaacaaagtgatagtaaaaatatttttgaaaacatttacgataagataaatagaaaaaagataaaaagtatttttcatatatataatattaaaggagagagtgtacttactaattcagtaaatgagtcagacgaaaataaaagtaagtcaatttatgactggggaaagtttagaaacatgaattcatatccacaagatgtaataatgcgaatagacaagatacagattaatcctaatgtacgaactatttatactattggaaaagcagttacgtatcatgatagggtaataggatttattgaatttgacatattggaaaatgaattaagtaatataatttcatgtagtgctgatgaagacattgtaattactgataaatataacaataatataataaatacaaataactttcttcttaataaaacagggaaatttaaaagcaaggaatacgaaagtgagaatcaagttataactaattcaatactaaatgagaacatttatatttatacaataaagaatactgcatttataaataaattctttataacaggagaaatttttcttggaatcatttttggattattatttttggtaatgatatgtgtagcaaataaaattgcagctaaaaacacaaaatctatcgatattcttttgaatggaattgaatatgtaaagcaaggagatttaacgaaaaaagtcaatattacaagtggtgatgagtttgagattttaggagaatactataatgaaatgatagataaagtattggaacttattaaaaagaatgaagaagaagcgaaaatagcaacacttgctcagttaaaacatcttgaatctcaatttaatcctcattttatattcaacacattagagatgcttagatatatgattaaatcaaatgatcccaaatgtgagaaagtgactttagctatggctagaatacttagatacagcttagataacaagacacggtctacctgtttaaatacagacataaaatatattaagtattatcttgatatacaaaaactcagatttggagatagatttgattatgatatatatataaatgaagattgtgaaaaagcaataattcctaagcttataatacagcctataattgaaaatagcataaaatatggatatcaaaataaagaaaaactttttatagatatttatgctgaacagaaagatggggacatgtttattcagataagtgataatggtgatggaataagtaatgaccttcttcatgaaattaataaaattataaaaaacaaaaataataaaagttcacatataggactttacaatgtacaaaagagaattagcttactttacggagagaagtatggtatagaaattgatagcagggaaggaataggggcatgtattcttattaagattcctgtttttagggggaataatgatgattaaagttttaattgtagaggatgaaaattttattagaaaaggactaattggaacttttgactgggttagttgtgactgcacagtaataggggaagcggaaaatggagttattggccttgaaaaaattataaatttaaatccggatttagttataactgacattaagatgccaagaatgaatggaatagatatgattaaaaaaggaaaagaaaaagtagattttgaaacatttatattatcaagctatgatgatttttcatatgcaaaggaagccatagaccttcatgttcaggattatatattaaagccagttgatgaagaatatttaactaagtcacttataaagtttaaaactttttatgaagagaagaaaatgatagataaaatgaaaaattcttttgataataataaaaaggttgaacttataaatatggaatattataaaagcaattatatatgtgataaatacacaaaaataatgatagagtatattgtttcaaattataatgaaaaaattagtatagaagatctatcatgtaaacttggagtaagcgtaagttatcttagtagaaaatttaaagcagagacatcacagacctttcatgattttttaaataaatataggattcaaaaatcaattgcccttctagaagaaggaacatataaagtttatgaaatatcagatatggttggatttggagagtataaacattttagttcagtatttaaaaaatatatgtcttattcacctagtgattacttaaaaaattgtataaattagctgaagatttagtagaaaatgaaaaggatatatttagttagaacatagttgttaatataaataaaataaaaggaaaagcgttgcctaaaagtggtagcgctttttaaatttataggctacagaattgaaatgtatagactaagaataataaacttattggattggttaatgtgaacgatttacgagtactcatatttggatgaaatggatatggtaaattagtagatttattttaaataaggtaaataattgatattattacaaaaaagttatacaataaaacataatcagatactaataggtatttatttttgaaaattaaattatgaagaaaatcattaatttataaatatgaaaggtcgtagatacaaatggcaagttatagtgtttttttaccaagctacagtataggagttgattgttataatgaaattccatatgtcacaagaaaatatggaaaaaaagctgtagttattggtggtaagactgcaatggaaaaagctaaggaatatctaatagagggaattagaaattctcatatggaaatatcaaactacatatggtttggtggagattctaattatgaaaatgttgaaatgctaaaaaagaatcctgatgttttagaagcagatatgctttttggtgttggaggaggacgtgcatgtgatactgtaaaaactcttgcagatatgttggacaaaccatttttttcatttccaacattggcttcaaactgtgcagcatgtactgcagtaactgttatgtataacagtgatggaacatttaaagaatattattatttaaagcaaccagcttatcatacatttattaatacagagataattgcaaagtccccagaaaaattattatgggcaggtattggagatgctctttcaaaagaatgtgaagttaaatttgcatgccgtgataaatttatgtaccatacaccattgatgggagaatgcatatcatctatatgtacagatccattagttaactatggtaaaaaggcacttgaagattgtaagaataatacaccttcatttgaactagaacaggttgcattagatattgtaatttctacaggaatagtttcaaactttgctacccatgaagcacagaaagatcctaaggacaattattattataatagttcacttgctcattgtgtatattatggagcatcaatgattccagaatgtgaaaaacatcttcatggtgaaatagttgcctttggagttttatgccttttaacatatgataatcagattgaagaacgtgacagaatattaaaattcaataagagtatcggtcttcctgttacattagatgaaataggaatgaaagaaagtgatcttgaaaaagtcgcagaaaaggcatcaagtgtagttgaatggacttatgtacctggaaaccctacacaggaaaaatttatagaatcaattaaaagtacggatagagcaggaaaagaacaaaactaatataggatatcttataaaataggtaatataaattaaatattatttataaatggaataatagacatataataatattactactactatcatgttgccaaagaacatgatagtagtagtttttatttatttcaagaacaagagtgaatttgaaaatttatacaagacaaggataatgctgaatgtacgagtatattttacttaactcaaagagcatctttattttaaaataataagaaataagctataatatagaaaaatacaaagtgtcataatatagtataaagactagagaagattaatatgagtatgttacgattctaaaaagtaacataactttgtgattgaatcaataagttagatatatagatatttttcaaatcacttatgaggggtacaatatatgaaagacattataacaaaaacatatgaacagattgattttaatgatatagaaaattttgatccaaaagaaataatagaagagaagtaccttataaagaataaattaatagtaaactctcaaagaggaaatttattaaatgaattaaaacttagcatggaagaatgcagaaatttttatttcagtgtagcatttattaattatagtggtcttcagttattgcttgattgtttcaaaaatgcaaaagatagaggtgtaagaggaaagataataacatctacatatcttaattttacagaaccaaaagctttagaaagaattaaaggttttgataatatagatttaaagatatttattgcagataaggaacagggatttcatacaaaagcatatatttttgaaaatgaagataattataagattattattggttcatcaaacataactcagagggctttaaaaagtaatgttgaatggaatgttatgattatatcaaaaaaagaaactgattttgtaaatgaagttttagaagagtataacagcatttatgatgaaactggttttgttaatgatgaattccttgataagtataaaatttttataagaacattacgcaaaagagaaaaggataatactgctgacttctcagaatatgagattataaagcctaatctaatgcagaaaagagcaatagaaaatttagatagaatacgtaaatgtggtgaaagaaaagcaattgttatagcagctactggaacaggaaaaacctatatgtctgcttttgatgttttaaattattctccaaagaaattgctgtttctggttcatagagaagatattctaataagtgcacaatctacgtataaaaagctatgcagaaataaaaatataaaaatgggattttatacaggaaataaaaaggatgatgacgtaaattatctttttgcaacagttcagacaatggaacgcaacattgaaaattttaaaaaagatgaatttcaatacatagttattgatgaagcacatcatagtacgagtccaacatataccaaaattttagaatattttaatcctgaatttctgcttggaatgactgctacacctgaaagatgtgataaaggaaatatttttgatgtttatgataacaatgtggcattagaaattagacttcatgaagcactggaaaatgagcttattgtaccatttcattattttggaataaccgatgtaaaggatgcagatcttaatgatatgaagctagatgaccttgcagaagtttcaaaaagactcatgataaattcaagagtggattttattatagaaaaaatgaacttttatggatatgatggtgactttcagaaaacagttggattttgtgtaactaaagaacatgcactgtatatgtcagatgagtttaataaaagaggtatagaaagcattgcacttacaggagatgactttgctcataaaagacaagagtatgtaaagagacttgaagatgataatgacagcttaaaagttatttttacagtggatatatttaatgaaggtgttgatataccagctgtaaatcagatacttatgcttagacctacaaattctccagtgatatttatccaacagcttggaagaggtcttagaaaacatagcagcaaaagttttcttactgtacttgattttataggaaaccataataaagcttttcttatgtcaatagcattaaaaggtggaagatattatgataaggacagccttaaggtttcggttgctacggatttttctgatattccaggatgctcaaatatacaaatggataaaatagcacaagaaagaatcttaaagcagctagaaaatgaaaacttcaatacattaaaatatttaaaggaagaatataatgacttcaagtcacttcttggagggaaaattccatttgatatgatggattatgtaaggtatgatggggcaccggatccattgaaatttattaattatagtaaaacgtacttagaatttttagataaggtagaaaaaagtgagtatataaaagatttattaaatgatgaggaatttgtgaaaattattaaagaattatgtggtaagcttccacttaaaagaccccatgagtttgtaataataaagtatctgttacataatgaacagatgtcattagacaaagcggtatgtgaaatatcaaaatatctagaaaaagcagatgaagttacaattaaacacagctttaaaaatctcagtcaagcttattatgataaggcacagcttaaaaataatataaaaatatttaattatgacaatgacaatctaataagaacgctgaattttataaaaattattaaaaatgaaaaatataataagattatagaagacattttaaattacggacttataagatatgaaaagaattttggaagtataaactatggagtaccgtttttaaaattatatgaacagtaccaaatggtagatactgcacttttatcgaactatgaaaagattcacagttcatttagaggaagtgggcttataactaatggaaatgaatattttttatttattgatcttcataaaggcgaagatattaaagaaagcataaattacaaagatgaatttataaatagcaaaacttttcaatggcagacacccaatagtacatcacagacatctgaaagaggaaagaatattatttataataaagacaggaatataaatttacatttatttataagaaaatacaaggaaattgataaagcagttcagccatatatttatattggaaaaggaaatactataaattttgaaggtgaaaagccaattacagtagtgttttctcttgaaaatagggtccctgaaaatatttatgttgaatttgttaaaaaagtgtagatacgaattttaaaaagatttaaattctggaaatcaaattagatatataaaaataaagatagggttttattttaactctatctttttactatgtataatataaacttagttatagcacatccttcaataataattcaacagttggaatatcagcaggagcccatactaatgtatttaaataatctttaggaagccatattaattttgcatgttcatttgctttaggtgttccactaagtagtctgcattttgtggtaattagatttacaattactttatcatattcatgtgtataatcacagaattcatttaagaattcaattgtgcatccaagttcttctcttatttcacgtactattgcctgacctattgactcaccagcttcaatttttccgccaggaaattcccaaagacagccttgagacatatcttttgaacgtaaggcgcataaaatttctccattttcattttctattattgcaccaacaacttttactgtttttttcatttttataatcacctctaaattatatagtaacatagaaaaaataataattcatcagttgattacagtgattgtagctattttttgattttataaaaaaatatactataataaactatagaaaatctaagcaactgaataaaggaagaggaacagtataatgaaaaatataataaaaaaaccaataaaaacagaattaaaagataatcttaattacatgaatctagattatcttaagaatattgcaaaagtttatgaagtagataaagcatataaaatgaaaaagcaggagttagtagataaactttttgagaagatgacagatgaaaatcatcttataagtaatcttgcagcttattatgaacatgaagaatatacgtgttctgttaaaggtaatgaagctgtatctgagtcaataaaagtattaggtcttgctaagataggactatattttttatatgatcttggtgatggaaatatagaaagtataatgccagaagaaataaagaaagttattaataatatagaagaaaataaaattgaattaataaaaagcagatattctgaagttttcaattatttaagagcttttaagaatttttatggaatatttgagattgattttttcttgaatatatttaatgaacaacatgagaatgaaaagggactttctttaaaggaattaatgtattatcttgataaatataacttacataacaatgaaattgtaaattataatgggatgcttgtatgtgaagcattatgtatgtttgagggtgatatagataaagttcttgaagaaagagaaggtaaggaatactgtattcttgaaaaggaagagttgttaaattatagtgatgattactatatgaaaaagactttatattattataatttagaagaatatctattaaagcatttaaaatataaaaaagacgttgagggtataattgaagatataaacataaaatgtgtaatggatacttttgatatacaaaatgctattatgagattacatgacatggggatggaaatacataataaaaaggatatcgaaaaactatttaaattatgtgtagagtttgggaataatactcctaaatggataaataaaggatggacaccagcagacttaatgaaaaaagattcaaaagaaactagtggtttgaatttagtagtttctaataaagtggggagaaatgatccatgtccttgtggaagtggcaaaaaatataaaaaatgctgtggaaaatagtatggaaaaataattataaaatatcatatttcttaatatcaatttaaagattatattagccttggagaaatccaaggctttatttatattataattataaagtaaaataatttaaaagtattttaacatattttaccatgggatttaatattaagttgataaaatgaaaccaaggcaaagttattaataataaagaatgaaaggaatgagttttatgataaatattttaatggtctttacagtacttatattgttaatgacaggtgttttggttattggaggaaattacttttacaagcttgccattgatacaggtacttcaaaagcttctgttttcaaaagtaaggataatatggaaaattcaaaatctgctcagaaagaaacagtaagagaaaaaaatgataaggaatggttctttaaaaattcaaattacagtgatgtatttataaattcttttgatggacttaagcttcatggttataaaatagtaaattcttatgatacagataaatggataattgcagtacatggttatgatggagatagtattaaaatgtgcggacgtgcaagaaatttctataatatggggtttaacgttattattccggatcttaggggacatggacaaagtgatggaagttatattggaatgggttggcatgatagaaaagatctcttaggatggattgattatattattaatgaaaataacaatagtgaaattattctttatggaatttcaatgggagcaagtactgtaatgatgacttgtggtgaaaatttaaagaataatgtaaaagctgcaattgaagattcgggttatacaagtgtatgggaccagtttgcttatattttaaaatgtatgtttaagcttcctcagtttccaataatgtatgtggcaaatattattaccaaaatgcgtgcaaggtacgacttaaaggaagcatcgtcagtaaatcagcttgcaaaatgcaaaataccagtgttgtttattcacggagataaagataaatttgttccattcaatatgcttaaaaaggtttatgatagtgcaaaatgtgaaaaagagatgcttattatagaaggggcaggacattgtaagtctaataaaattaatcctaaattgtattgggaaactataagcgaatttttagataagtatctaacttatgatatgaatagagaaataatgtgataaaaatactttaaatattgtgttgtctaaatattaactttttatacaagactagagtttaatgagaaaacaataggtaatggcatgtattttcaatgaattgaaaaaaatattgcgaaaaatataaaaatatttgaattatgtattgaaatttcctttaaaatgtagtattgttaatttgtaaataaacaaagctatggtagctgagtttgaaaaatatatttcagaatatattttaaaagtgtatatttatattttatgtaaaatagcataattatatattgtttgtgttatataaaaatttgcataaaacatatttttatttattgtataaaaaatctaatatgattagcaatggagctaaagaataattaagtattctttagctccttattttgttaaagagaattttattgaaaaaatgtaataaaattcaaaatatataagtgttaaaagtatctattttaacggtaactgaaaggagatctatttaatgagtaatgttaatgaaatttttgggacaagtgtatttaatgacgcggtaatgaaggaacgtcttccaaaggctacatataaagctttaaaaaagacaattgaggaaggtacatcactaaagccagatgtagcagatgttgttgcatcagctatgaaggactgggcagttgaaaaaggagctactcactttactcactggttccaaccaatgactggaataacagcagaaaagcatgatgctttcataaatccaactgctgacggtaaagtaattcttgaattttcaggaaaagaattaattaaaggtgaaccagatgcatcttctttcccatcaggaggactaagagcaacttttgaagctagaggatatactgcatgggattgtacatcaccagcatttataaaagatggttctttatgtataccaacagctttctgttcatacaatggtgaagcattagataagaaaactccattattacgttcaatggaagttttaaataaacaagctatgcgtgttttaagagctttaggaaacactacatctaagaaagttattacaactgtaggaccagaacaagaatatttcttaatcgataagaaaatgtatgatgctcgtaaggatatcattttaacaggaagaacattatttggagcaaaaccttcaaagggacaagaacttgaagatcattactttggagtaattaaaccaagaatttctgcatacatgaaagatcttgatgaagaactttggaagcttggaatatcagctaaaacaaagcataacgaagttgcaccaggtcaacatgagttagctccaatattcagcacaacaaacattgcaacagataataatcagttaacaatggaagttatgaagaaagttgcagataaacatggattatactgtttacttcatgaaaagccatttgcaggagttaatggttcaggtaagcacaataactggtcaatgagtacagacgatggaatgaacttacttgaaccaggaacatcaccacatgaaaataaacaattccttttattcttatgtgcagtaataaaagcagttgatgaatatccagatttattaagagtatctgctgcaaatgcaggaaatgatcacagacttggagcaaatgaagcaccaccagctatcatttctatattccttggagaccaattagaagacgtattagaacaaatagaaaaaggaccagctacaagttctaaatcttcaagtgaattaactattggtgttaatacattaccaaaccttccaaaggatgcaacagacagaaacagaacatctccatttgcattcactggaaataaattcgaattcagaatggtgccatcatcagcttcaattggttgctgtaactatgtattaaacacaatcgttgcagagactttagatgaagttgcaggaagacttgaaaaagcttctaatgtagatgcagaaattcaagcaatattaactgaaattgctaaagatcataagagagtaatatttaacggaaacggatactcagacgaatgggttgaagaagcagcaagaagaggacttccaaatattaagtcaacagtagaagcttctaaagctatgatttcagaaaagaatttagctgttttagaaaagtatggagttttaagcagaaaagaagcagaagctcgttatgaaattgttcttgaaaactataacaagattataaatatagaagcattaactactcttgaaattgctaaacgtcaaattttaccagcagcgatgaaatatgcttcaagccttgcagaatctattaatgcaataaaggctacaggagtacaagcttctgtgttagttcaatcagaattattaactaaggtttctgatttaacagtaaaattaaatgaaaacatcggacttcttgaagcagtagttgaaaaagcagataactttgatggtgatatctatgatttaggaatgatgtatagatatgaagtatttgaagaaatgcaaaacttaagagaatgtgcagataaacttgaagtagtagtggacaaggaattctggccattaccaacatacgaagatatgttattcaatgtttaataaaaatagatattaaaatataaaataccagtatactccctttatataagaaaggaaaaatatattccattcttataaagggagtatttttttattaaaaaattgttcataaagttattctgacaaaatgtggacaatttcatgaatattttataaaataacatcattataaaaaaacagtaaatactaaatatagaaatgttaaataaagttacatctaagtatgtaattattctgaaaggtggatgtataattatggataatttcatgaatgaagcaaaaaaattgaaagacgaacttatagaatatagaagaacaattcataaaaatccagaggttggttcaactttaccaaaaactaaagagtacataataggaaaattaaaagagtttggttatgaacctaaagaaatatgcgaaagtggtattgtagcagtcatagagggaaagaagccaggaaaaactttcttgttgagagctgatatggatgcacttcctatgtcagaagctagtgaatgtgactttaaatcaacaaatggatgcatgcattcctgtggtcatgatatgcattctgcaatgcttttaggagccgctaaattattaaaacaaaatcaagatcagattgaaggtagtgtaaaacttgtatttcagccagatgaagaaggatttacaggtgctaaaaagatgataaaagcaggagtgcttaaaaatcccaatgtggatgcagctatggcgatgcatgttcactctggaacaccatcaaatgttgtgttatatggacttggaactagtatagcaggatgcaatagatttagaattattgttaaagcaagaggatgtcatggagctatgccagagactggagttgatcctattaatattgcagctcatatatatatatctttacaagaaattataagcagagaaattccagcaactaaaccagctgtattaacaattggtaaatttgcaggtggagatgcacctaatataatacctgatgaagtggttatggaaggaactataagaagtttagataaagaattaggagaattcatatttaatagaatgaatgatatagtaacttcaacagcaaaaatgtttagaggggaagcacagttaatagaattatcttctgcaccaccactagaaaatgatactaagttagcaaatgaacttggttcatatgtaaaagaattaattggagaaaaatgtgtaatctcttttgaaggaggcggaatgggttcagaagattttgcgtcttatacttatgaagtaccaagtgtatattttatgcttggagcaggtacaaaaaaagagaattctctttatggagaaccaatgcataattctaaagttgtttttaatgaagatatactagttacaggtgctgctatgcatgcgtattgcgcaatacaatggctacacaataattaatatattattgcctcaatttttaacttgaaattaattgaaactaagtattaaatcaaatataattaatacgtacttgttaaaaaatgtaaacaggttaaaaaatgtaaaagaggcggtagcatgagcagaaagaaaaataaaattattagttttttattggtgttcttactaatgatattgaattttacatcaattggatcaattagagttgcaaatgcccagagtaaaaatttaaatgaggaaacgaaagcaaataattcattattatctaatgaaacaatggataaagatgtcacgtcatcagctgcggttaaaaagacattaactagtgatggaaaggttctagatattgtagaaataacagattttcatggtcaattaaaggattcgaaggataatcttcaaattggtgcagcactagcagaaaaagtaaaggaagttaaagcctccaatgaaaatactttaataataggcggaggagacttatatcaaggtacgccagtttcaaatatacttaaaggtgtgcctgttcaaaaggttttatcagaaatgggaatggaagttacaacacttggtaaccatgaatttgattggggattagatacaatagataatacaactatggatggtgcaaattattctatagtatgttcaaatctatataagaaaaatagtaatgaaagaaagtatgacccatacaagataataaataaaaatggaataagaattgctgttataggtggaatattaaatgatgtttcagcaattgttttaccagcaaatataaaggattatgaggtaaaggatcttgcttcagaaataaataagtgtgcagatgaaataaaagaaaaagaccttgctgatgtgacaatagcggttgtacatgaaggcaaggatcaattaaataatgttgttaaaaatttaaatggaaatgtagatgctgtttttggaggacacagtcatagtatttatgatgatgtagtatctgattcaacaggtaagcaaataccagttctaaatgcatgtaatgcagggaagggctatatagatttaaaaattaaattagatgataataataaggttactggattttcaagtaagggaaccaattggaatgctgtaagtgtaaattctgatacaaaattagatccagaagctaaagaaatagttaatcaagcttatgatgacataggtagtacttttaatgaggttattggacatgatgaagttcaatatacaagtactcaaaaaggtgaaccctttggtgagtcagaacttggaaactggatggcagatgtagtaaaaaataaggctgctgccgatataggaatagtaaataatggtggaataagattaagtcctatccaagatggagacatcacagtaggaacaatttttaaagtaatgccttttgacaatacaattactactgtaaaaatgaatggtgcacaattgaaaaaacttgtagaacaaggtattgcagataatactggaaagggattgcagatttcaggagttaaaataaaatatgataatacaaagcaatcttatgtaatgcctgttaaagattcaaatggtaatattataaaacaagaaattgaaggtgaaagagttaagagtatagtttgggaaaaagataacagtgaaataaaagatacagatgtatttgctgttgcagcaccagattttgtttcaacaggtggtgataattttactgaatttaccgttgatgatgtaaaaagcacatatgttgattcgcatattcttgttagggatgctttgttagaaagtgttaaagaaaataataagatagtagtaaatatgaataatagaattgttaatgaaccttcagcatcaaattctgtaatatcaatagtagcaacatcagatattcatggtaatgtattgaattttgattattcaactaatgctgcaccatctaaaggtatgggattagctaaagtatcaacatatgttaaaaatttaagaggaaataatcctaatgttatgctaattgataatggtgatatgatacaaggaacaccattatcatactactataatatgatagacaaaacatctccgtatccaatttctaaagttatgggtgcaatgggatatgatacagagaccctaggaaatcacgaatttaattatggacttgatactttaaatagatttatggatagtcagaagagtgaaggaattaatattttatctgcaaatatatatgatgaaaataataataatttcgtaaatccatattatataaaatcttttaatatagatggaaatactgtaaaagttggaatacttggacttactacaaaatgtattcctaactgggaagatccagagcattataagggattgcattttaatgatcttgtgagtgaggcgaaaaaatatgttccaattatgaaaaatgatggtgcagatatagttattgtagcagctcatagtggagaagaaggcgcagcagatacaattcctgaaaatcaagtgaaagcaatagcaactgaagtttctggaattgatgcaattgtagcaggacatgcacattctacttttactgataatagcttaaaaaaccctgatggtaagatagtaccagttattgagccaggaaagtgggggaacaatatatcacagatagatatacaattagatagtaataaggtaaaaagtatatctacaaaaaatgtagctatggattcttcaatagcagaggattcagatattgtatcaataatagcaccatatcaagaaaaaacactaaaatatacttcaacaataataggtaaatcaacaggtgaattttctggtaaagatcaaacagcaaaaccaactgcaataatggatttaataaataaagttcaagctaatgcagcaggaactcagctttctattgcagcaccattaagtgcatcagcatatataccaagtggagatataactataaaggatgttatgggggtatatgtttttgaaaattatctttacggaattaaaatgactggaaaacagataaaaacatggcttgaatattctgcaagatattataaacaagctacaaatgagaatgatccaatagttaaagatccgaatttgaatgttccagactataacttagatcaattgtatggagcaacgtatgatatagatttgacaaagccagttgaaagcagaatagtaaacttaaaatataatggaaaattaataaaagatactgatacatttactgttgcaataaatgattacagatacaatggtggcggtggatttatgagggaagctggaataagtaatacggatccgtctatagtgacttatagttcagctaagaaacttggagatgatgggcaggttagaagtttaatgacttcatatattaaagaaaaaggagttataacaccagattgttcaaataactggaagttatctacaaaagaagttaaagcagaaacatccaattcatcatcaggttcaagtcatcatagcagcagtaatgacagtgacacaagcagcataattactgatactggaaatactattacaaatccaaataatccagcaagcaattcaaatcagataacaaaaaatatatggatttctaatgaaggtaaatggtattacaaagatgaagaaggaaacgtaatttcaaattcatggaagaatattggaggggtatggtattactttaatttagattcaactatgcaggtaggatggtttaaagataaggataataactggtactatttacaagatagtggtgcaatgaaagtaggttggtttgaagataatgatggaaagtggtactatcttcaaacaaatggagcaatgaaagtaggatggtttttagatagtgatggaagatggtattatctaatggataatggtcaaatggcagaaaatcaacttattaatggatattacttaaatagtaatggggaatgggttgcataattcaaagtattaaaataactactgcaaatttgtttttgcagtggttattttttatatttgaatattgaaatttagttctttcgaagaattatattaaaattatgtcatattattatgtaaataaaatatattgtaatatatgagatgttttgaaaacgttatatagagaattaaaagaaagaagtggatagtatgaagatacgtgaaaaaaattctaaaaagatgatatttacagcattatttattgcagtaggtattgttttgccgtttattacaatgcaaattccatcaatagggaatatgctttgtccaatgcatattcctattatattgtgtggatttatatgcggaggaacatggggatttattgcaggattaattgtaccaatactgcgaagtgttttattcggtgctccaccattaatgcctacagcaatagcaatgtcttttgaacttgcagcttatggattaattacaggaataatgtataaaaaattatataataaaaaaggaaggatttatatatcgctcattactgcaatgatactaggaagaagcatatgggggatagtttcttttggactttacaatttacttggcaataactttacatggaaattattcgctatgcaggcatttataaattcaattccaggaatagttattcagcttacccttattccaattatgatatataagcttcagaatgctgaaggagcagtgatttcatatgacaaatgataaattaattattaaaaaatgttgtaaggagcgttttgaagttgtgaaaactgccattacaaaactgatggatgaagataaagaaacaataataataggcatagatggaaaatgtgctagtggtaaaacaacattaggatattatttaaaggacatatttaactgcagtttatttcatatggatgatttttttctacaagattatcaaaggactgaaaaacgtcttattgaagttggtggaaatgttgattatgaaagatttaaagaagaagtacttgataatattatatataaaaaagatgtaaattatagaatatttaattgtgcaaatagaaagataaaaaatggtgtgataatcccatataaaagacttaatataattgaaggttcgtattgtcttcatccctattttggacaaccatatgatttaaagatatttatggacataaataatgaagatcaaattgagaatatcagaaaaagaaatggagaagaaaagcttatacggtttaaggaagagtggataccaaaagaaaattcatattttgataaatttaatattaaagagggatgtataaacatattgtggtaatagatgtatcttgattgagaaaaatacaggtgcaattggtgcagctgttattggatacagaaagattttaagtgaaattaattaagaagttactagagaagttattttagaaaaatgcaatttataaaaaataataaatttatgaactatttaaatataattaataaaagacattacaccctaaaatatggtaaaatatttttataaattatttaatttggggagtgatatatgaatgaagaatttaataatatactttagtcttgagagcaacactaagttcattgcagagtctatagcagaagaaattgaatgtgatattatggagttaatacctagtaaaaagtattctacagggaagataggaaaatacttttggggtggaaaaagtgttatgtttaaagaaaagcctgaacttataaatgcacagttagatataagcaattataagaatataataattggaactcccgtttggtgcggtacatatgcaccgccttttaatacatttctttctaactttgaaataaagtataagaatattgcaatctttgcatgccatggtggtggcggagcggaaaaatgcttcgataattttaagaatgaacttacagaaaataattttttaggagatataagctttgtagatcctataaaaaatcaaagagaagaatgttctcaaaaggctaaagaatggataaagtcattaataagataatgattattagaactatttttgattaattaaaaaaataaaaggaataaattacgtttataagaaaagatataactaattaatggacttatctctgtataaaaacaaagataagtccaaaatttagaaatttgttaagttattaaattttactagttttttcactttcacacatatgatttacccagtctccatgagggattaatacagctttattgctaaagtttggatctatgtgcttgttgtaaaaataaacatagcattgttctgtttttttatcatctagatgttctacttttaaaagttttttctcatactcattttgtggattgttttcacttatgaatccttccatctcatccatggccttcatcgtttcatcatagatttcggggtttatttccatgatttctccataaacagtaccagttccttttaaaagagctggatagcctttataaggcatatgataaataaccatgttatgtattttgccaggctttatggaaataacttttcctttaaggtatttgtcataattaaagaaaccttctcttagacttccatagacaaaaacattaatttttttattcatttgtgaatcatctcctatattttatgaacagatattttattaacagatagtaccaccagttactttaacatcattatcgtttgaaacagatgctttaatacacaattctaaaccttttgtaatatcatcaatagacatacaaggcatattaggtttatctagaacctgtgatggtatatatggaacatgaataaatccaccttttatattagggtattttttagcagccatatatagtattccatacataacatgattacatacaaatgtgccagctgaattagaaacagaacatgggatttctccttttttcatttcttcaaccatagcctttattggaagagtagtaaaatacgcattttcaccatcctcaaatattggaagatcaattggttgttttgattcattatctggtattcttgcatcatcaatatttatagcgattctttcaggtgttattccgaatcttcctccagcttgacctatagatataactatatcaggattgtgctttattatattttcttcaattttttctaatgattttctaaatactgttggaatctcaattttaattatttcagaaccagcaatattatctggtagtttttttacagcttctagagctggatttatactttctccaccaaatggatcaaaacctgtaatcaatactttcataagtaaattctccttttatgattagtttttttaataaccttatattaaaattaaaatcctaatgtgtacataagtacaatgtgaattattaataatgcaattgcaaatggagcttgagcttttataactacatttttatctctagtttctaaaagagcagcaggaagcatattgaagtttgcagccattggtgttaaaagtgttccacagaaacctgctgttaatgcaagggcagagcagactacaggatctcctccttgagcaaaaacaaatggtacaccaataccaacagtgataactgaaaatgctgcaaatccattccccattattgcagtaaataatgccatacccacgcagtatgcaattactccagctaaagcattaccttcaggaattactccagaaatcattcccgatataacatcaccaactccagcagcagtaaataatgcacctaatgatgcaagtaattgtggtaatattgagaatacaccaacggattgaaacattctgttactatcttcaacatattgagttggagtagcttttgtaagtataaaagttaaaagaagcgcaatagtagaagaaataccaatagcaactgtaccagacaaatctgtaaatgtggcaataagcattgcaattatagcaattgcaagtgatggaacgaatattttaagtccaagcttttcggcttttaattgtgtaaaagtactatcaagctgttttaaagttccaatattaatctgcttgaatgctgataaaaatgcaataacaactataaggcatccaactataacaggtggtattattttaccaaatatgaatatggcagaaattattcctcagaataatgaagtaccaattctagttttatggtttttatcttttaatgtaaatatcattgtagaagccatatacaggccaattaatgtatagaaaatttctaataatatatttgaaatctgttttatatccattatttttatcctccgttacaattcctatttatttttttcaatatttaatttatattttctttttaaacttctatcaagcatataatttcttataatgcataaaataaaagcgaaaatagcaacagggatagaagcttgtgcaatttttagggcatcggcacttattcctaatgtttctaaagtactaacgattaataatactcctgaattagccataaatacattctgtccgaagaaattaccaatgttgtcagcagcagcagagaatcctttgattttatcaatatctttttcatcaagttcaccatattttgcaatagacgcaccttcagccattggctgtattaatggtcttacaaattgtggatgaccacccagagtaacacccatagaaattgtagcttctcttataaaagtatatccgctaagtaatataccagtagacaatccgctggctttttttataagcatgatagctttagctttcaatccatatctttcacacattcctataactgggagtgtgagcataaacaaacatgtagtacgattattgacaaatgaacttcctaacgtagttaatatttcagttatactcatatttgaaaccaaacctgttataactcctgctgacacaactacagctatcgtgtccaattttaggacaaacccaactataattattaaaatacctattaatgacataaaatgcatcctttctcttttgtaatattactatttttttataattatacatgaaaatttaataaaaatccaattaatttttaataaaaagtgagtgaaattcaataaatagaaataaaaatgtattatctagtttaaatatcgacaataaagaccagtgcttttaaatctattcaagttactctacttggaagaattataattttttatataaaaaagagatgtggaatgttttacctcatctcttaaaaataatcattatatactttttaaaattaagaattttcaagaagttttgcaagatatactgatttcatctgcttgcttgccataactttgtggacaggtgaaagttttaaaattgaagccagtattgcagccatggctttatgacttttatgagcttgattgtcaaaaataagattttgaagttgccccttttctattgcagtaataacgactctatggactgttgttactggtgttattatgctttcttttcttcttttaagttttattgcatcttttggacaattctttacacatacgccacatccgagacataacttatcatctacctgagcatatttatcttttccagtagttgttacacttattgcttccatgggacatatattagtacattttccacatcctatgcatttatgtgtatcaacgtaaggaatatagcttgtagtgtttactggaacaagaagaccgaatttctttgcagatgtaaaagcttcgcagtgacatttgcagcagttacacataaagttaggttgtttttgtacattttcaccacattgtacaagattgtaatcataacacatattaagaatatcaagagcttcatgagaatctatttttctggcatagttatgttttgttagagtatatgctgttgtgtcaaaacttaaacatgtttccataggtgcataacagtcatctcctaaatgatgagctttatgtctacagtaacatgaacttacacctatgtgttttgcactttttataatatgtgaggctttttcataatctaaaatatctatagaattatcattatttaaaacacgttcttggacaaaagcacggcccatttttgtttcgcttccaaagaaaagctctttcataaagtcatcttcaacatttaggtattgatgaaaaagctggcttaagactttttggtcaagatggccaccagttctcattaaggcaaattcaaaaaatcctgccattgggggagccataagatatttcttctcattatctttatcacattcaagatcgagaataagagcttttgaagctaatgtgtctagtattttttctgcttcactttcttttactttccagattaaagcagcagtttttatattaaatgctttaattggaagttgtgcaacaagttctgcttctttttctgtaaacatcatggataatattttgtatagagtttcagatggaggagcaccctgtggaaatttatttagtctttcttcaagacttttataagcatctttgcctactaaatgagacatattttcacctcttaatcattagaaaattaattaatagtttatattaattattagtaatttaagtatattaaaataatatcatattaattgaatttatggaaaaataataataatagtaaatattattgtcaatataattaaactttaatacatagttgttattgtagataaataaactatcatataaagattaatattaatagctggagtgaattataaatgaaaaataaaatctgtattgaagatcttaatttctatccagtagaagaagatatcagtaatatgattatgagcaaaattgatgagtatgatgaaaataaaaaatctaaaattgtaataggacttatgtgtctttcagcagttttgtgtacagcagatattcttcttgagagaggtgaagctgcaatatggatagttgcagcagtattcctatgtatagtggctggaaaagcattttttgttaataatatgagtatacattcaaaaataaaatacattaaagaaagtataaagaattcacagtttcaagtagcccatacaatagctgaagagtttgaacttgtaaaaagtgcaataacagacgtgaatgatggacaaattattggatataattatgaattatatgcgtttttaaaaacctatgataacgagttcctaaatgaagcagttgtatgcgttataggcagtgaattaaaaaatggtgaagaaataaataagtttaattttaaagaaggaacgaaaatatatatattaagatacaagcataatgatgaatttcactattatggaattgaaagtaaaagtaaggagtattttcagaataatcttaagtatatattaaattgtatttatcataaaccatttaatagaaaaaattaaattaaatgaaaaatggaagagttatcttccattttttttgtagtatagattatatcatttaaattgaataataagtaataactcaaaaccacacagtcaggttaatataaattattaattatgatatatttatatattataattaacttttaataatatatattgtataattatccatgttaaagaatctaaaaacaggtggtttgattgtgaattttttaagaagttgaataattaaactatataatttaagaatatattttatagaatagtttaaaatgttggaggaataaaatgagtattcatgagaaaagattaggaaataaaaatgttaacgatttaatgacatgcaataaacaaggtaaaataaatttatatttaatgagacatggggaaacaataataaacagagctcataggactcaaggatggtgtgatggagttcttacagaaagtggaattgaagttgcaattaatgcaggagttggccttagggatataaagtttgatgctgtatatagtagtgacttaggaagagctgtaaagactgcaacaatagtcattaatgaaaataaagcaaatgaaaaaataaagcttcaagaacttgaaggattaagggaagtatattttggaaagtatgaaggtgaacttgaaagtgtcatgtttaatgatattatgtcttatctaaaagtaagttcatttaaagaagccgaagaaaaatatgattttcaaaaagaatattgcgatacatgtgcacttttagatgaaacaaaagaagcagaaaattatgaaacagctattaaaagagtcatgaaatccataagtgaaatatgtgatgctcacagtgaaaaagatgaatgtaatgtacttttagttatccatggaggtattttaagactgattatagattatctagataagagtttgaatataagagaaattaataattcatgtatttgtaaagttgtttatgaaaatggaaatcttaaagtagaatcagttaatgatatgagctatagtgaaaatggtaagagaataagaagtattgaagaaaaataactaaaaaaatattcttataaaaatattaaggttttataagaatgtttatcaataaaaataaaagtggtataatgtgaaaggcactaaacataacttattgcttaatgctatgaatttaataaaataaatcaaaaaataaataatttctgtttgtgctgttcatataaattaagtgaggtgaggttttgagcacgattaagttgaaactcaaagaattggcagaaaaaaatatgcagaaagataatatgataagattaattttctttttacttcctgtaatatctattgtattgaagggaattgtatttcagggatttgtaacaagcgataatccatattcttttagtttttcatcaggatattctgctgtatccatagtttctatggaatattatatagcttttgcattactatttgtaagtttttctcttttgtttaaaggaaaagggagaataatttatgtttttgtactagatataatagtaactgctttatttattatcgatgtatggtattacagagggtttaatacagtaccttcagtttttcttttaactcaaacatcaaatcttgacaacctgtcagatagtataaaatcaatggtaagttcacttgattggctgtttattttagactttgtaattataggagcttatgcatatggatttagaaaatattttaataaagagtgtaaaagagctgtaaaaggttttttgtgtacgtttgtacttccttttatatttatagcgtatgtgccatttaacatttacatattaaaaaatccgtatgtaaaaaatgcatatataatcgcaggaactgacccaacatatacacatagatatctatcaacaatagggtatcatctacatgatgcggttactgtatactataatacaaggccatatgaacttacagagcaagataaatctgaaatgaacaattattttgaatttaaaaatgaaaatcttccagataatgagtattttgcatctgcaaaaggaaaaaatctaatctatgttcaagttgaatcattagaggattttgttataaatcaggaaataaatggacaagaaataactcctaatttaaataagttagtagagaaatcaatatatttccctaatatatttgaacaggttaatgaaggtacaagtgcagattgtgattttatagcaaatacatcacttttaccagtaagaagaggcgcaacattctttaggtatcctttaaataattataattcaatgcctaaaatcttagaaaaaaatggatatacaacaagagtaattcatccagataaaggatctttctggaattatgaaatcgctttaagtggcggaataggattccaggagtttacagattattattcatttaatcatgaagaatcaataggaatgggtataagcgacaaaagctattttactcaggttattcctatgataaaggaaatgcagaatccattttatgctatgacaataacattaacaagtcatgcaccatttaatattcctgaagaatatagagaacttaatcttgagtcagaattgaatgacaacaaacttggtggttatatagaaagtgtgcattatactgataaacaaatcggaatgttcatggatttacttgatgaagaaggaatacttgaaaatagtatagttgtattcatgggagatcatacaggaattcataaatattacaacgatgatattgcacagctttcaaatcaagaggaatggttccaggataatggaggaagaagggttcctgttattatttacgatccttcacaaaatgtaaaggcaaaaacatttgaaacttttggtggacagattgatatgatgccaacaatactgtatcttttaggaattccatctgacgaatatgatcaaacttgtattggaagaaatcttttaaatacagaaaaatcatttgcagtaataaataatggaagtataaaaggagaagaaaatcttacggaggaagaaaaagccatagtatcaaaatcacttgatatatctgataagattattcgttctaattataatccatatttagaagaataaaagtaaaaatatgaccatacacattttaatgattatatgactttgaaatgtgtatggttattattatttttaatattatgctagaatatattttatatgaggagttagtttattgacaagtattgttaacaagagtagtatttatattaaagtaagataagtattagaagggagaaagaaatgaagataacagcttaatttatgaatttattaaatgtttaattaacaaattaaagtgaacctttatttgttatgcaaaaatttataaagctgtttatttcatttaagttcttctttaatattttgaaaatattaatggatatttctattgagtttttgttaagaaatattctaaatttgattgaagagatttataaatgagaaaattaatttataggtctcttttgttttttatttatattattatttttgaatatttaaatgaacactaaaaacacaaaacacaacgacatattaaaatcagctataattagttattgtttataaaataaatgataatggttaggttttgcaacagataaagtaggttcactatgtatgaggtgaataatatatggcagttttacttgaatgtaaaaatattaataaagaatatggagataatcttattttaaaagatataaatttatgcatagatgataaagaaagaattggtatagtaggtagcaatggagcaggaaaaactacattggttaatattatatgtggtgttactgagtcatcttctggaaaggttatttttcataaagacaatctgaaaataggatatatgaagcaatcaattgactataaaaatatagatgaaaacaatactctaagtggtggtgaaaaaacaaaaaaagcattaaatgaagtgctttatggaaaaaatgatgtactaatatttgatgagccaacaaatcatcttgattatgaaggatctgtgtatcttataaataaaataaaaaaatttaaaggggcagtaataatcatttcacatgacagacatttcttagatcaatgtgttacaaaaatcattgaaattgatgataaatcagtgcaggagtataatggtaactactcattttatagaaaagtaaagattgacgaatatgaaaatatgcttcatttatataatgaacaggaaaagacgaaaacgcagataaacaagcagatagaacagacaaaaaattggtcaggaaaagctcatagagaatcacgtgcaaaagccatagaaactggaaataaatttggtggtaaagaattcaacagagcaaaagctaagagaatggataagcagataaagtctagaataaaaagacttgagaagatagacactgatggaataaaaaagccaaaagaagaatcaaaggtgttttttaacattgataatactgtaaaaaaaggaaatactgcattgtatgtaaaagaaatatcaaagagctatggatgcaaagttatttttgaaaaatcatctttttatattaaacaaggtgaaaaagtagggctatttggaaaaaatggatgtggtaaaactactcttataaaagccattttaggtaatatagattatgatggagaagtgtatttatcaaagtcatctaaagttggatatctttcacaagatgttattgatttagatgatgatatatctataatagatttgtttgatattaaaaataacaaagaaatgggagagataagaacaaaacttgatcttcttggatttcataatgaatctgtatataaaaaggttgcctgtctaagccttggagaaagaatgaaagtaaaacttcttattatgatgaaacaacagtgcgatatactaattatggatgaacctacaaatcatattgatctgcatgtaagagagcagcttgaagagattcttatggaatttgaaggtactcttattttagtaacacacgatagatatatgatggaaaagacttgtgacaagttgcttgttttcgataataataaaataacccgttatgaatatggacttactgagtatttgaatttaaaaagtcattcaatgtcaaaagtcaatgaagaaaaaaataatagagaaaaaaaagaagcacagcagcgcaaacttttaattgataacaggattacttgtgtattaagtgaattaagtcagtgtattcctgaaagtgaaaaatataaaaagcttgaagaggaatataaaaagctcatagaagaaagaaaatgtatactgaattttaataataattaaaagttttaatttatcttaattgtaagaaaaaatataattatggttttacactgtattaaatagtaaaagagcatgaattacttttttaaaaaagtttcatgctcttttatattttataggatagtccttagaaattttaattaatcttctttaatttctaaattatctcttctattatctaatggatttaagttaatatgatgaatttttgcaccttcttcaggtttcattaggtattcatcaagacgtattcttccatctttagtgttagcaactaccatcatttcagaacctttatagtatacaacccagttgtatccgtctcttacaactctatttacatcagacattgaaattaatgctttatgttttgggttaccaaatttatctcttagaataacagccatagtttcatgatctactttttcacagtcatttttaagagttctgttatataattcaaggttagattttctgttatctaatgtatctccatttaaatgttttattggagcctgtgggttaacatcaagtactacagtctgaatgcttctttttatgtatttaactttaccgttaacattagttttaactaatgtttgaacaaggtaattgttaaaatctttgtgccattctgcaaaccaaggtccgaattctttaactctatttaagtctgaagtatctattttgcaagttagttcacttccgtttttctttaagacctttatttcagtcataacgtcttttgtaatatatacattttcctgagttttataattagtattaattgtaaagcacctctttcatgattttatctataagagtatattattgacaaataatgataatcttatacatgtttatacttcttagaaagcattacattattataacaaaatatctgtataaaagatatagtaatattaggctaatactaaattttatataggtgaaaaactattaaaaatataatgttttagaaataatatgataaaaagtaaatatataagttatattttacagttcatggataaaattattttatgttaaagaaaagtatatgtaatattgaaattataggtggttaaaaattattaataaaaatgtaattttatagacaggtacataagttaaataaaaataaagattgtgctataataagtggtgttaaatttaggaaggggatgaaaactatgagcagtcatagtatttgaagaaataatattaacttaaaatattttgtttagtttttaaataaggagatttatattatgaaaaaagaaaggttgctggaacttgatgttatgaggggaatagcattcttatttatagtacttcagcatacaataggaggtttttcctatagagatgatatatcatttaacaattttattgtatcaaagtttatatatataggagcagaaacaggtgttgaactatttatatttttaactgctgcaagtcttatttacacatatataaataaatttgatataaaggatttttatattaagaaactgaaatttctagttcttccatttgtcatatggtcaataattataatgattaataatggacagactttaaatgttcagtctattttagttatattcactggtgatgcacaatatcatctgtggtatatgggaatgattttaaggatatatttgtattttcctataattttgtggattactaaaaaagtattgaaacaaaatatatatattaaaagtggagtatttatattgttagcttatttatatagttatgtacttaatcattatggtatagctggatttgtaattgaacatttatttaaaaatccaagtgatttggaaaagaagcttgtaaatatatcgcctattttttattatttctattttgttataggagtttacgctatctgcaattataagaaattcaaagaaaaagtattaaagtttaagtatttaataagtgttgtttatattattacttttggattttatttttatatagcagtaactgaaaggtatagtcttggacttcctgttttgaaaagcagtatagaaatgagtattttatacagaacaatgtctatcttgtttttttatcttgtttcatgcattatagcagagaagtttagtattatgctaaacatattgacagtaataagcagatactcttttccggcatatcttattcatgttatgatactaaacaggcttacattatatgttgccactggtccacatataatatattatttaagatatttctttatggtatcatctataagtatagctataagttggttgattaattatataccttatagtgaatatataataggagtaagatcaaaatttaaatttaatacgggttacaggcctattcatttcaagcaaattggacagtagatgaaaaacttatagataagcattaaaggtattttaactaagtcgatttagtagataattaatgagttataaaataaatttatataaaacagagtgttatataaaaaaacaaatcacagtacgagatatgctgttacattatttccaacttctaattaatcttagaaattatatgttatatttttattatgaaatttatgaattttattatgattatataagatttaattactaaagcatagttaatggaggagtttgaatgaataataaggtgatttttttagatgtagatgggactttatgtaatgatgaaggttttgttcctgaatcagcaaaagaagcagttagatctgcaagaaaaaatggacataaggtttatttatgtacaggacgttcaaaagctgaaatttatgattttataatggaaataggctttgatggtgttattggtgctggtggaggttaccttcaaatagaagataacatggtttaccataaaagagtttctcatagtaatgtaagacatttagtagatttttttaataaacacaatgtgaatttttatattgagtctaatggtggtttatatgcaagcgaaaatcttattccacaacttgaaagatgcatttatggtgatatagataatgatattgaggctagagaaagaaaagaaaagaatccacatcactttattgaaggccttattacgggagaagatttatacagagatgatgtgaacaaagcgtgttttcttgaaccagatggaattacatttgaagaaataaagaaagaatttgaaaatgaatttgaagtttacagatgtacagttgaagcatttggtgaaaatagtggtgaacttggtgttccaggtgttcataaagcaacagcaatagatattttactaaagtgcataaatgctagaatagaagatactatagcactaggagatggtatgaatgatgctgaaatgcttaagttttgtaatgtaggaattgctatgggaaatgcaaaagaaggtctgaagaaaattgcagatgagattacagatactcatgatgagggtggaatttatagaagctttataaaacatgggctgatttaagaataatttaagtaataatgattatattaagtttagcattatgaaagaaaaaatacttagattcttaatgacctataatcaatctgcattttaaaaaatgaattatacatggtaatagtctgttaagcctgtattaattaacagcttgaaatgtggaggaattatgaaaaagttgataataataaatggaaccatgggagttggaaagacaactgtaagcgaaaggctatataaatcccttgagaattctttctggctggatggagatagctgctggtacatgaatccatttgtggttaatgaagaaaataaaaaaatggtaattgagaatataagttttatattaaataattttataaagaattctttttcagagtatattatatttaattgggttatacagacagatgaaataatgaatttagtcttagatagtcttaaattaaaaggagtagatgtacataaaattactcttatgtgctcagaggaaaaacttatagagcgaatagcgagagatatatctaaaggtatacgtgattctgaaagtataaaacgtagtgttgataatttaagattatatgaaagaatggaaactttaaaaattaacacagataataaaagtgtagagactattatagaagaaataaaaaaaataataagatgattatgtatttatatagatgtgtacattatttaattactatgtatatatgatatagttgtcgattatccgaagtgtttgtaataatatgtattgcaaacacttttttcgactataattgacaatgaaatagaaaagggtttaaaataattgtaattagtttgataaactatttaaattgataaactaatttaaattatttttaaagaaagatatggtgattgtaataaaaaaatcattaaagaaacctttattatatttttacattacaataattatagcaactattataggttgtctatatagtatgaaaataaactcaaaaaataataagattgatgaagttttacttataacctcagaaaccattaaaagtgatttatatgatcataacaagaaaagtagaaatagagaattatatgattacataagcaaagatgagataaataaaatgatcattgaatttcaaaatcataatagattgaataaggcatatctgttaaaagcgtgtgtaaatatagctgataatgaatatgatgaagcaaaagataatcttaataaatcattaagaagtgttaatccctttacaagtataaaattaaaaacttatgcaggtacatttctttctaaaatatatttagctaatgacgatttctttaaagcatcagaggttgtaagatattgtttggctaatataaacagcaaaaattataataagtattataaagaaatatggatgcttatggatacaatatcagataaagagtcaggacaaagtaaaataattttatggggtacagatattttggaaagccataagaatttatcaaatgaagccaaattgtattttattttagagcttaaagaactatatataaaacatggaaattatgcaaaagcatctgaatatgcaataaaaggatgttatttagcttatgatttaaatgataattactgtctttcaagatgtatgattaatcttggacgtatattaagagaaattgaaaatagagatagagcagttgaattaataaaagatgctctagaactgccaatagaagataaaagtcatgaggcatatagagatgtttatgcgtacataaatttaggtgaaatatatttagaaagtggaaattatgaagaagcaaaaaagactgtagaaaatatatcttcatataaagtatactttgatgaagaagaatttagaaatatagaaataagaagaattttaatactagcagataaaaatttttatgaaaataatcttgatgaaggtaagaaattattagataaggctgatgaattaataaaagagaataaaaataatatcagtagtgatgtttatttaaattataattcattacatggaacttacttggaacagacaacaaattacaaagaagccatagaattatataatgaaatattacaatggtgtgtagataagaatgatatatacaatcagaggaaaataatgaaaaagattatgaatgtagctataaatagtaaagactacaagctagaagaagagtatatattaaaacttgcaggtttaataaataatactgaagatattatttatagtgattattcttattatgttttagaaacggtaaaatcagaagtgtctatcgaaagagagaaacataaaaataaatttatttttaaggttttatctttaactttagtgtctagtttaataattttcttaatatcatatacaaaaataaaaaaattaagagtacagaatcagaaagatgggctaacaaaatcctataatagattttattttaacgaattatatgagagttttataagggaagatactaacttttctataatgatgattgatatagataattttaaaagtttaaatgatacatatgggcatcagtttggagatactgttcttataaatgtatgcaatactatttcaaaaataattgataaagatagtaaactttgcagatatggaggagaggaatttgtagtagtttcatctaacaagtcaagacaagaattagaagaaatatcagaaaagataagagtagaagttgagaaaattgcatttcaacaaaatgtaaaagtcacacttagtataggagttgcaatgtcttgtgataataaggaagatactttaaatgtagcagataaaaatttatatattgcaaaaacaactggaaaaaacaaagtcgtttttgaacactaaaaatgaatttatgatttaaaaattgtaaagtagtatactagcaaaaatgagaacagaatgtattgtgccttgagaaatgtgcagcttaggacgatacattctgtttttattaattttgaatttaatattttaatatattttcaatagtatttagttcttgagaagagaaattaagattttcaattgcttttacattatcttcaacttgttttgtactgcttgcccctattataactgaggttacatcatcacgtagattccacgcaagtgccatttgagcaagagtttgtcctctttctgctgcaagatcattaagttttatgattttatctattttttcttttgtaacatcattttcatgaagatataaactatgacgtcctattcttgaattttctggtatgccatgtatgtacttatcacttaaaagtccttgagccagaggactaaatactacagtaccaattcctgtttgtttatgagtttctaattgagaaccttcaatttccctgttaaacatagaataaggaagttgatttactatacatggagttccaagctcttttaaaataacgcacgctttttctgtttgttcaggattgtaatttgatataccaatatataaagcttttccctgtttaacaatcaagtccagtgcagacattgtttcttcaagaggagtttcaggatcgaatctgtgatgatagaaaatatcaacatattcaaggttcattcttttaagactttgatttatgcttgaaataagatatttttttgatccgccatcattgtaaggaccaccatcatacatgtcatatcctgcctttgttgcaataatcatattgtctctatcatttgatgtgaaatttttatttagaatttttcccatggtttcttctgctgacccatcgtgtggtctaccataattatttgcaagatcaaagtatgagattccacactcaaaagcttttttgaatacagcttcactgtttgaatacacatctcctgcaccaaagttatgccataaacctaaagatattactggtagtttaagaccactatttccacattttctaaatttcataataaactcctttcaagcttgtttacgattacgaatataattttactacaatattgttattatttaaataaatttgtatataaataattcataattaatctagattatttatgaaagaaggtataattaatttagcatttaacgtaataaaaaaataaaattcatatgattttccatttgaaatatatcttccaaaatataataaataaaaaatcagaaaattcagaaataagaaaagaaaaaaatataaaagttcttttagcaatttttatataataatgataataaaatgaaaagaatataggaaaaatgataaaatagtataaaaaaaataaaaaaagtaaaaaattaatattaaacaacctatataaatatatatatatcatgaaaaacgacttgatttgacaataatataatagtattatacataaatatatgcagatgctttaaaaagaaagttttattttgcaaattttgattattttaaaaataaattcaaaagatatgtttgttaaaatttacaatgtactataattattagattacttaaaaacgggaataataaatctggaattaaacaaaaggaataattgattatagggaacaacaaaaagctgcattaaaaattgaataacgtaaggagaaattaaaatgggaaacaatgaaaaacaaaagaaattaactttaataacattaattcttatgattttcacatcagtttttggttttgcaaacatgccaagatcattctatttaatgggttatggagcaattccatggtttatattaggagcagctttcttcttccttccatatgcttttatgatggctgaatatggtgctgcatttaaggaagaaaaaggtggtatctattcatggatggaaaaaagtgtaggacctaaatatgctttcgtaggattattcatgtggtatgcatcatatgtaatttggatgataaatatctgttcaagcatatgggtgccattatcaaatatgatatttggtgtagatagaacatcagaattaggattttttggattaaactcaactcaaagtcttggaatacttggagtgtgttgggtagttttagtttttataatatctagaaaaggtatgagtaaaataactaaaataacatctgttggtggtatagcatgtgctttattaaatgtagttttaattttaggtgcggtaattgtacttgtattaaacaaaggacagctagctgaaccagtacaaagcgcaatgtcatttgtgaattcacctaatcctgcttatcaaactgtaacgtcaatgctttcatttctagtatttgcaatttttgcttatggtggtattgaagcagttggaggacttgttgatcagactgaaaatgcagaaaaaacattccctaagggtgtagcagtagcagcgataataatttcaataggttattctttaggaatattctgtgtaggtgtatttacaaactggagtagtacattatcaggagataatgtaaatatggcaaatgttgcgtatgtagttatgaataactttggatacactttaggtgattcaatgggacttagtagtgcagtttctgttcaaatgggtaactgggttgcaagatttgttggactttcaatgttccttgctttaacaggtgcattctttacattgtcatattcaccacttaagcagttaattgaaggtactccagctaagctttggccaaagaaattttcaaagcttgatgaaagtggaatgccagtaaatgcgatgatggttcagactgcaatagttggtgttatggttttagcaattgctatgggtggtaaaaatgcaaaagcattttttgaaatgcttgtattaatgactaatgtagcaatgacaataccatatttattcttatcaatagcgtttatttccttcaagaaaaaagatgatattgaaaaaccttttgaggtttataaaagtaaagcctttgcaataattgtagcaataatagtaactgcaacagtaggatttgctaatttatttactataattgaaccagctttaaatggcgattatacatcaacaattgctatgattgcaggacctttagtttttactataatagcattgattattctttatataggtgacaaaaaagaaaattaatatttttcaaaccggattttatggattcataaagtccggtttttattctttaggaaatttataatacagtcaaatttgagtataacttttaatacaaattttaatccattaatattaatactaattatgtacttaagaaaatattaaggaaatattatattgcataatcaaaaagtgtgtaatataatctaggtgtactagttcgaatagtacacctaatacaattgggagggaataatatgaaaaagtcaactttggtagttttaattggaggctttatactgcttacagcgcttcttggaccagttagttcagaaaagatgtataaaaagcagaaaaattttaatagtccagaagaaataatacaagtacttgaaacgaaacctatcttgagaatgaaagatggtacaaggggtgaattaaaggaaacagaagacttttctgaatgtctttcagttagaaagagacttactgagtcagatcttcattatgcaaagattgatgttgaagaagtggtgaagttagatgaaaagagtgaaaatgatcttttaaattattacagcaaacttcgagaaagattcagcaaaaggcttccaataagcaaacaggaagcagtgagattaaaagtaaatacgtactattatagtaatccaagaacaggagaaattgagaaaaatcaatatgacaattcttcttatgaagtgctagaccttgttttaatagatgaaggtgaaggctatgttattgattttgtaaatatgtctaatagtgaatatcctcctgactattcaaaaataaatgcaaatgaaggaatttactatgatggacatgaaaatatgagtgatgatgctaaaagtggagaaaatatatctgaaagtcaagctgattcacatgaagaggtagaaaacaatgcttaaaatagatcctaggagtagtactcctatatatgaacaaatagagcttggaataaaggaactcatattaaaaggtggattgaaatcaaatgataagttgccttcagtaagagaaatgtcaactatattaacaataaatccaaatacgataagcaaagcgtatggagaacttgaaagagatggaataattgaaaccttgagaggaaaaggtacatttgttacagataactttaaggggaaggtggatgaaaagaaaatggattatattcagggggaattaaaaaaaataatacttgaagctaactacggaggaatttcaaaggaggaatttttgaagctagtactagagattttttcggaactgggggtaaatgaaaatgatagaggttaataatgtttcatttgaaatagatggcaggacaattcttaatgatattaatttaaaaatcccagaaggaaagatttatggcataattggtcctaatggagttggaaagacaacacttcttagatgtcttacaggaatatatcagactactaaaggacttgttaagtatgatggagaagatgtttatgacaatccaaaggttaaagaaattattggttatgtagcagatgaaaatataatgcatccaaatttcagagtaaaagatctcattaaattttataaatattcatatacaaaatttgatgagaagaaatttaaagaattaaatgagatattcaaaataccagaaagaaaatttatatttcaactatcaaaaggtatgaagatgagactttcaataatgcttgcattttcaattcatgctaaatatttaatattggatgaacctacttctggacttgatgcaattcttaaaaataagttgctaaagatttttgcagatgaagtttatgataataatacaacaataataataagttcacatcatttaaatgaacttgaaagaatatgtgatgatgtggcaatattagataatggttctatttcatatgaaaattcacttgaaaatatgaaaaataagattaaaaaaattcaaattgcctttgatgaaccagtttatgaagaagatttaaatttaaaaggaatattcaaaatttcaaaagtcggaagggtatttacaattattactgatgagtatgacgatgaatttataaaagggttaaataaattcaaaccactttttatagaagaagtagatttaagcctggaagatatcttcatatacaaggttgataaggaggattaataggatgaagaaatatttaaataaagggctaatatatcagtggtttaattctgctaagatgatgatacttcttggagttatagcctggggatttgcaagtaatagattagttgagaaccatataaatatggtttcaaatgatatttcaatgaattttaataatggttactcaacatatacaattttttcttatataattttagggataatatttgcaatgatacatttcatgtcccaggggataaataagagaaataacaatatgtttttaacaagcgcaccatatactaaaaagcagattaaatataatgaattaatatgtttgcttattagtcttgtaatatttactgctgtatttatatatataagtgtaatggcttatttaagaaattatgatcttatgtccataatagacggttattttaccgtacttggaatagaaactttgaaaataattttatttggaacaatcggaatatttattttacttatagttgattcaatgttttcaaatactataatgggaataatatgtatgataagtatcttgcctgtgtcattactatttatagttagcagagtattcatgattttagattatataccaggaggaaatggaaaaagttttcttgaaaaaataggggatatcattagtgttaatttctttaaaggacaaagcacttaccttattgatagtgtaaatgttgtatttatacaaaaaagaaatcttatatctgagtttattgtagctgttgtaatcatagcagtattatcagttatatatttgattatacaaaggaaatttaaagttgaaagtaatacaaagatgtttacttcaaaattaaatgaaaagataatagttataatatcttcaattggagctggatcatttattttaacaatgctttcagagttttatacaaataatttaatgggatattactactattatggtgttttgagtggaacgaatcttataaaggcacttgcttttgatataggaattattggatttatatcatttgtagtatataagttaataaataagcttcttaataacattcaataacaaaccgcttttatatatcttgggaaagtaatattgtagcggaatataaatttataacttgttacaaaaaatgcagataatctttaaaatatatttaagaacaaaaatcagcttctatgaataagatatactaacaaaggaataggagttgataaacatgtcaaaaaaatcttgtgattgctgctgttgtaataaatgttgctgtcctcaaccatgctgtgaatgtcaaccttgctgctgtcaacaaccttgttgctgtggtggtggatatggcaatggttatggtaatggatttggatttggtggatgttcttggatctggattattcttattttattcttctgctgtggtggaactggatttggcggaggatttggtggaggatgcggttatccaggattcttctaaaatctgaatcttaataaggtagtaattatagagtaatcttgttatgatataataggggcgcttagggtttgagcgtctctattataatataaaaaaataaatacgtaagattatttttaattaatgagaatggacagatatattttgaattatgaattttcaactaccaaagtatataaattaaaatttgtttaataatatagaatatgatataataattattattaattgattaaggcggtataaattatgggaaataaagttgtgctaatgtatgaaaataatttatttaaagtatacataaatgataaagttgtagctgctggaacaaatatggattcagtagtagataaatttaagcagatatttcaagataatactccagcagttagttcggtttcttgggaaaacatatttgagagagttattagatttaaaaatgatgacattgaaataaataatgattataaaactatatcatataagaatatgaaatatttctttggatcaaataagatcttctatatttcagataatacaatgactccgcttttgggggcatatgaattatttgattttataatggaactaatagagagaaactttaaagaatatgaaaaaatattaaagttctgtaagagaatgatggaaaatgagattatttataggacctttgatagcaatatagttgtatcaagtccaggatttaattatggtttcatagaatataattttgctacagataagatttcaaagggaacggcaataatacatggaacatttgatgattttattagatatgttgaagaaaatcttgaaaataattttaaaaaataaattaatatagtgttaagaaatatggataaatctaatcatccatatttctttttttattagagcttttgaatatttatggccataggacccttgtcagattcttctattgagaaagtaacactttcaccttcttttaagtctttttccggaccattatctttaatttgtgaatgatgagcgaaaacatcattaccttcatcacatgaaataaagccataacccttttcacgatcataccattttacagtacctgtattttgtgccattagtttttcatctcctaaataaatattaaatatcattaaatagtattagcaataaagcaaattttactcaaagttaatagcagcaaaaaattaactactgaatagttatttaaaagatggattgtcttttattttttcattgaatttattgtataagttaatcatataaggttcattagaatatttatctatttcatttattggaatccacatgacaccgctattttcatcttcttttactataagtttatcattttcgttgcattctaaaagatatgccaaggataaatgaaggtggcttgaaacatagtgtcctttttttatatgtccatcaacagtaagaacatctaatgaaaggatttcttcagatacaacatcaaaatgttttactccagtttcttcaattgcttcttttatagccacatgtataagatcaggatctccatcagcatgtcctccggtccaagcccaagtcttgtagatattatgatggatcataagaacttttgtacggtctttgtttactatgtatcccgaacttgtaatatgagcaattggattttgtctaaaaagaagattatcataaacatttatgcattttaaaataagttctttatctttttcctcctgtgtattataaggaatatactttcttatctcatcaatccagttatagttttcaaatctaggtataatattattttccaaaataaatcctcctctaatgattatatataattattatacagcaattgtataacaatgagagaaaatagattttatgaatatttaatgtgagtagtatttaattaattttatagaaaggtgtatacaacaatacacaatagatctactgaatggtttgaagtaaatttacattcttcaagagaatataattaatttgtgaggagatacttttaataatgactatttttaaggagtgataatatcatgagaaaaaaatatgagaaaaataaaattataagcacaagttatgaaaaggaatatgattttaatgatcatatagagggttttacagatgaagaaggtcctgatattagaaaaaatgatgatgataacatccatgattatacaatgaagatgtttccaaatcctgattggtagtgttaaaaaacgaatattcataaaagaaagtctaataaatatttaaaattgcaaattattgaattaaagtttatataaataaaaggtgtcacttagtatggcaccttttatttgtatgtataacaattactaataatgagtacctaaaaagggagattaattgaattacatgctaaaacttacatggaaaagaaaattaatatgttgtttgtagttgaaaaaattaagtgtttatattttccaaaatttgctgtaaaatataatataagtaatacgaaggaccatgtatttaattgacacaaataatttataagtgtgttataggaggaataaaacatgtatagcaaagaagaggtgcaggaactttatattaagggtgagcctctcgaatttctatttttttgtggacatcaaaaaacaaataatggtaatataacaaagtcatgtctaagtcagtggtatcaatcaccttttgaaatgaataacataagatattcatgttcagaacagtatatgatggctgaaaaggcaagactatttggtgatgaggaagctcttgataaaatttttaaagcatatcatcccaatcagatgaagttaataggaagtaaagtaaacaatttcaatgaagaaatatggaataaagaaaaaaatagaattgtcaaaataggaaatatggctaagttttcgcagaatcctagattaaagaagtatcttataaatacaaagtcaaaaatacttgtaaaaaccaatggatatgattttatatggggaataggactggcaaaagatgatgaaaatatagacaatcctttaaaatggagaggagacaatttattaggctttattttaatgaatgtaagagatgtattatcttaattaattaaaattaatattaaattcatggtgattataaaatgactagaatagtaaagacgagataagtatagagttaaagcatattctgtataaagatacctttacatagagtgtgctttattttttaagttatagttgctaggaacagagtttttagttaatggttggcgactatctgaaaatacgctgtaaattattccaaagataattaataatgctccgcaaataaaacgcaagttaattatttctcctaagagcagagatccaagtaaggcagagatcattggctgaagtggataaaaaagagaacaacttgatgcttgaataagagaaagacttttattcccagagaacatgggagatagaggtacattattcaggagattatgctatattttttatagaagatggacatagactaggatgtgctcttggagaatgttcaaaagtaaaaaaagttcttgtaaaagtttcacgttaacatagtgaaaaaagtataattttgaaatttaacagatatatttttatcaatatgtctagaattaatgtaaattaattcataaaagtacaaaattatatataataataaaaaattttaaatggacgaaacaccatattcctactataatagattaagattttaataaaaaattacaaggtggtaggtacgaatgaaaatatatgaacaagctttggaaaaattttatgagtggttatcaacaagcggtttgaaaatcgtaataggactattgcttgtatggataggttttaagattataactagagtaattaaggctgctaataaggttatggagagaagaaatgtagatgttacacttgcttcttttttagatggttttatgaatatatgtctaaagttattgcttgttttaatgataatgaattatgttggattatctacaagcggaattatagcacttctaggttcagctggtattgcagtagggcttgctcttaaggaaagtttatcaaattttgcaggtggtgttattattctttttatcagaccttttaatgtgggagattatatagaaggtgcaggtgaaagtgggaaggttgacaaaataggaattttttatactcatatgtcaactgttgataataaacaaattttagttcctaatggtacactagctaatggaattgtaagaaattataccgctcaagaaatgagacgagttgatctcactttttgtgtgggttacgatcaagatataagggtcgtaaaaaacgctatatttagcgttataaacaaagaagagcttatacttaatgaaccagagccatttgttgctgtttccgaactggctgatagttcagtaaactttattacaagagtatggacagaaacagataattattggaaagtgtattatagtcttcttgaaaatgttaagattaaatttgatgaggagaatataagcataccataccctcagatgagtattcatgtaaataagacacaagaaaatactattaactagaatttatagaagaacttattttacgttattttagcaaagtaggaaactaattatgatgtaaaatgagttcttttctatataagtttaacaggaatgatattctgagttatatgatagatattttcatttacaattgcaagattttattgtattatatatgtagcgataagaagctaataagggaccttgggaggtattaaatatatgagtatttttaatttaaatcctggacaaagaggagtaataacaggtattaatggaaattcaaaacttacaaagagactttcagcattaggttgcatagaaggaactcaaatagaatttaagagaaaagcacctttaggagatccggtgattgtaaattttagaggctttgatcttgccataagaaagaaagatgctgaatgtattatacttgaaaatattggatagtattaattgaaaaagttatagaatagtgttttatatttaaattgataacaataatcaatttaaataatataaaatcttatacaacttaaaaatagaagtaaaatattttgcataatttgtagtaaatatataaatggagaggaaaatatatatgataaatgttgctttgttaggaaatcctaatgtaggaaaaacaacattgtataatgaactgactggttctaatcaatatgttgggaactggccaggagttacagttgataaaaaagaaggatattttgaagatgttaaagtagctgatcttccagggatttatgctatggatactttttcaaatgaagaaaaggtatcaaaaaaatatttagaagaagaaaatgttgatgttattttaaatatagtggatgcatcaaacttaaatagaaatctataccttacaacacaacttaaacaatttgacaagcctataatactggctcttaacatgattgatatttgtgaagcaaaaggtattgagattgattataaaaaacttgaagaagaatttggagttgaagttattccaataactgctggaaaatcaatcggtgttgataaagtaaaagaaagacttaaaaaagggaattttaaaaaagaagaaaatgataaaaggaagtttaactttaaaactgaaaaagaggcatatgattttatagaaaatgttcttaaaaaatgcataactgaaaaagaagataaaagagaaactataagcgaaaaacttgataaatatgtacttcatccagtgtttgcgtatcctatatttttagggataatggttcttatgtttgaactaactttttcgtgggttggacagccgttatcggattttcttgatggtgtacttaatgattctatacttccttatttatctcatattcttgagaattcatcgccttggtttagttcacttattgtggatggaatagtatccggagtaggtggaataatagtactgcttccaataattcttgtattatttatatgtataacaattttagaagacagtggatatatgtcaagagtagcatttatgatggataagcttatgagaaaaatgggactttcaggaaaggcgtttattccaatgataataggatttggatgtactgtgccagctgtaatgacagcaagaactcttgaaagcgaaaaggatagaaaacttacggcccttttagtaccgtttatgtcttgtaatgcaagacttccagtatatacagtttttgcatctgtatttttcacaaatcatagagggctggtagtaggatctctttatgcaggaggagttttagttgcatttttattaggaatgttattaaaaagtacatattttaaaaaagatgaagaaccatttattttagaagttcctgaatataaaatgcctacttttaaatctgtttataaacagacagttgacaaggcatcaagctttttaaagaaagcaggtacagtaatttttgcaatgagcgttgttgtatggtttttatctaatttcaattttaatggaatggttgaagaagttaacgagagtattttagcatcaataggtaatgttattgctccaatttttgcaccattaggatttggaaactggcagagtgctgtttcacttctttctggacttcttgcaaaagaatcagttttagcttcaatggaaataatatttgcaggggatttaagcagtgtgcttcctatgcatttttcaattttatcagcctattcatttttagtatttgtacttctgtatacaccttgtatttcagttttaggtactatgaaaaaagaatatggtggaaagtttactattatgtcagtattatttcaacttatagttgcatggagtgtagcatttttagtatttaatgttggaacattactgattggttaaaaaagtcttatagttattaatggagatgataaaatcatggaaatatttattacggcattgatagttatatttgcagcatatgtgattgtaaaatcattgaagaattcatcagaaggaaaatgtaatggtggatgttcaaaatgtcatgcaaaatctaaatgcagtggaaattctgatgaaacaaaataaattaacaattatgaaagctgtggagtttactccatggctttttatgttttaataactaatttaaaggcaaggaatataactgtttttcttttgtcattgaatgtaaaaagattattacatatttatcaaatggatagttaaattgaaaaaataatattaaaaaataattaatttaggaaaaatgtcgaaagtatatacattttattaaaaataagttattatttttagtgtaaaatattaaataatgaaatggggagaaagaaaaccatgtcacaaaacaacgataaaaaaattatgtggtatactctggcatttatggcattctcaacagtttggggctttggaaatgttattaatggtttctctgaatacaatggtttaaaagcaattgtatcatggataatcatatttgctatatattttgtaccatatgcccttatggtaggggaactaggatctgcattcagagaacatggtggtggtgttagttcatggattcatgaaactataggaccaaaacttgcatattacgccggttggacatactgggttgtacatatgccttatatttcacaaaaaccatctggttttatgattgcatcaagttgggctatatttcaagataacagaataagtagtatgaacacagttgtgttacaattagcttgtcttgttatatttataatagggatgtatattgcatctaagggattaaatccacttaaaaaactttctgcacttgcaggaacatcaatgtttataatgtcaatcttatttatagtattaatgatagctgcacctgctataacagatgcaagcttaaatagtattgattggtcattaaagagttttatgccaacatttgatgttaaattcttcacaagtttatctatcttagtttttgcagtaggtggatgtgaaaagatatcgccttatgtaaacgaaatgaaagaatcttctggattttctaaaggtatgatagcacttgctataatggttgcagtatgtgccattcttggaactgtatcacttggaatgatgtttgattcaaacaatgtaccaaaggatttaatgacaaatggagcgtattatgcattccaaaaacttggtgaatactatcatgttggaaatgtttttgttatactttatgcaataactaacatgattggacaatttgctgtgttaataatttcaattgatgcacctttaagaatgcttcttggaagtgctgataaacgttatataccagaaaagttatttgttaaaaatgaaaatggtgcatatgtaaacggacataagcttatatttgtaattgtttctatattaattattgtaccagcatttggtattggaagcgttgatgatttagttaagtggcttgttaagttaaatgcagtatgtatgcctcttcgttacctttgggtatttgtagcatacattgctcttaagaaagcaggagaaaaatttggaagagactatttctttgttaaaaataaaatagttggaatggtacttggtgcatggtgctttgcatttacagcatttgcatgtataggtggtatgtattcagaagataaattcaaacttatcctgaatgtagttacaccaatagtactagtaggtttaggattaattatgcctaagcttgcagaaaaaaatagcagtaatcaataatagttaagtaaaatgaacatagtggatgataacatgacactatgttcatttttttgatttatgctattttaccttattttgaagcagtgatataatgtaaaataggtcgttattaaggggtgaatatatgattagaaagttcgtaaaatatattgctatggctattactataagttcagttagtatttgcctttcaggatgtaaaagcaacgtagaaacaatagatgattatttgagtaatgataagtatgttaaagcagtaaagaaggcagagagtcttacaaaagatgaagatatagcgaaggcaaatgatcttattaaaaataagattgaagagattaagaatgagtatattgatggtgaaattgatggtgcccttgcaatatcagatattgaaaagctaagaagtaaaaatcaagagataaatgattctgttaattctgtaaatgaagaaatacatatgcgtatgaattctaaaaaagcttttgatgatggtgtgaaatttgaaaatgatacggactacaaaatggctcttcaatcatatcatctcgttaatgaagacgatactgataattatgaagaagctcaaagtagaatctcaaatttaaaagaacaacttaagaataatgaaatactaagtgttactgaaggaaaagtaattgtaaccagtagaacacacaaagatctttatcctgatcaattacagattattctaaaaaacaatggaaattcaaatataagaaaatttgagattaccatatttggatatgatgaaaataacaatccagtaaaaattaaaaataaagaatcagaaagtgaagcatatccatttctaggacttgcggacaatataagtatcaattctggtgatacatggggatacgaatatggatggagcgttttgaatgataatataaggaaaattgaagcgtgtattgaatatgtagaatatgaggatggatcaacttgggaaaatcctctttacatggaatggctaaaagatcactggatagacgaataagaaaacatcactgatgtagattgcattagtgatgttttttgattttagattaatgagtaatgttttaacgctttgtaaataccatcttcttctatatcagttgttacataagagacaagatcaaatagaaggggattactgttgcccattgcaatgctgttttttacatatttaagcataggcaaatcatttgtgctgtcacctatggcatatgtattttcaaaaggaatattaagttcatttattaaaaattcaatacctgaagcttttgaaaatccctttggtactatttcataaaaattcacatctctatggatgaagtcaaagtcgtttttataaatattatggaatttatcgaaatcactttcatcattgtaccataccacaaatttatcacaatcaatatcatcatcatcaaaggtttttattacttgtccttcttttaaaacatggtgttctttaatttcttttacttcaggaccataaataaaatcatcataatatgttgctgttttactttctataattccgtctagtttgcattctcttatattttttactagctcttttgaaaatgcgttatctaatgtttttgaaaagagttctttatttttaaactcaatatatgtaccacatccacaaacatatccatcaaattcaaagtcttttatgtaattgtctatatttgaagatgctcttcctgtatttataaaaagaagatgtccattatctttagctttctttaaagctaattttgtgctttctggaacaatatgcgtagtttcacttaaaagtgttccatcgatatcaaagaatattatactttttgtcactgatttttcctccattaacttatgctattttatattatacaacattgaatgttattaacaaagaattgaattaaattgtttttgtaatattacgttaaaaaattttaaaaaaatgcatccataataaatgcttttataaaatatataataaaaaaataataaaaataatagaatatatagaggtgatgtaatatgaaaattattaaaggatgcaaaacatgtgagtttaatcttaataatgtctgtgaaagtcatcatagtgaaaatggttataaatggtgtatagatgattttgaaaaagaacgtagatgctgggcagtgtcatcaaaatacagcgaaatgcttttggatagtttaagtgaagaagataagattgattatgaaaataatcatagtcttggagtatatgacattataagaaaaattgaaacaggaaaatggaaataaaaatatgaaattatactaaagaggtattagaataacaatctaatacctggtatttaagaagaagtatagaagaaattataatttatttgaaaaactaaaaatcactatacttatacataaaaatattgttataatatagtaaaatgatgaaaaagaagtagtattgtttattaggggagataataaagatggaagttggtgcaaaggtttttcaaggtagaattattataaatgatggtgaagccgatgaaaaaatcacaatcaaagcagggaaaaatatatgcttgaaaataaatgatattgattgtgaaccttttggaatatatgaggttacatcaaaggataaaattgaatgtgaatgtataaaaacagaaagcaaaaggaatgtccatataagaatatctgaagataagatgaaagcgtatataaagattgattatataccagaaatacagtataagcttaaagatagagatgtctttatgaatcttgctgttgctgcagaagagggagaattaacagaaccacctcactttactgtagaagaacttaagaatatattaaaagaaaatgggattatttatggtttagatgaagaggcattatatgaagcctcctttgggaatagtaaagagatgcttgtagcacgaggggatgctccagttactaacataccaagtgacataaaattgttctttactccgtcacagatggtttttccagatcctgattctgatgagaagattgattataaaaatctttttagaatatctaatgtatatgcaggcaataaaatagctgaaataattccagaggttccaggaaaagatggaattaatgtattaggacaagtatgtaaacgtgaatacattcgaagtttacctataaatattaaatcaggatgcaaaattgaaaataatgatgttatagctttaattgatggaaaagctcatatttctaataatacaataagtgtaaacaaggtttatgcagttgaaaatgtaaatatggaaacctgtaatataaaattttcaggagatattgaagtatatgatagtgtaagcgataatatggcagttaaggctggaggctcgttggatgtgagcagaaatgttaatacgtcaagtgttactgcagggactattacaatacttggaaatgcgataaaatcaaatattttttcaggtcagatagatattgaaaaaaaagaatattcagaagttttaataaaatttaaagaaattcttaatgatatagttcagattgtagtgcagacaaatagaagtgaccaatcagttagtttccctgaaatgataaagtccctcacagagttaagatttgtagattttcagaaaatagcactaaatatagtttcattgaacataaaaaataaaattaaacataataagcttgttgattatataaaagaccatgttttgggatataatatattaaatttgaaatctatttatgaattaaataaacttcttgaaatagtcgataatgaaattgaattttatgataagaatataattgttccattagatgtaagaataggctattgtcaagattgtgagataaaatcaactggaaacataataatcggaggaagaggagagtatacttctaatttaaatgcaatgaaagatattctatttacccaaagagactcagttgcaagaggtggtattttatctgcaggaggaaatataagtgcgggaataattggaagtgctgcatctgtaagtaccatacttaatgtaccattgacaggtaaaattacagcaacaggtgcatataaaaacactacattttgttttggaaagaaaaaaattacaatagaaagagatatggaaaatatcaatgcattttataattatgaaatacgtgaaatacaaatagtatcatcaggtttgtagtacataatatttgacacataaaattataggtgtacaatttaataagaggaaaaattccaaagaaaagatatttacagagtacagttatgaaaagaggagataaaaatgaaagcatacgaacgtttattaaattatgtaaaagtttatacaacatcagatgaagaatctacaagtcatcctactacacaaagacagtttgatcttgcaaagattttggtagaagaaatgaaggcactaaaaatacaagatgtaagatgcgatgaaaactgctatgtatatggatatatacctgcaacaaaaggatatgaaaacaaaaaagcaataggacttattgctcatttagatactgcacctgctgcatgtggagaaaatgtaaaaccacagataatagaaaattatgatggaaatgatatcgtattaaagggaaataacagcatactttctccaaaaagatttccacatttaaaaaacttagtaggaagaactttaataactacagatggaacaactcttcttggagctgatgataaagccggtatagctgaaattcttacagcatgtgagataatattaaatgaaaatattccacacggtaagatatgtataggatttactccagatgaagaagtaggacttggagctcatctatttaatgtaaaagaatttggagctgacttcgcgtatacaatagatggtggagttgaaggtgaaatttcttatgaaaactttaatgctgctatggcaaaagttgaaataagcggtgtctcagttcatcctggaagtgcaaaaaatacaatggtaaatgcattgaatgttgcaattgaatttaattctatgttgccagcatgtgaaagacctgaatatacagaaggatatgaaggattttattatttagaaaaacttaatggtaatacagataatgcatgtgctgaatatataataagagatcatgattcagagaaatttaaagttaagaaagatactataaaacttgctgaaaaacttcttaatgaaaaatatggcgatggaactgtaaaagttacattaaaagaacaatacaaaaatatggttgaacacataaaaccatgtttccatttaatagataatgcagttgaatctatgaaagagttaggtgttgaacctgttatagagccaatcagaggtggtacagatggagcaacattaagttatatgggattaccatgtccaaatcttggtactgggggatttgcatatcatggcgaatttgaacatataagtgttgaaggtatggatatggctactgatataatagttaacatattaaagaaatacgcagaagctgatgattaggatatgtaaatttaaaattctctattaaaataagattatataagtattaacatgaatgaggtagattagcttgctaatctaccttgaattatttgatttataaggttctgtaagtttcattatgaagtcatggtatcccggaagcttttcaagaagaaactttacttccaacaatttattttctatagtgttaaatttttcataaggaatttcagatttatttaataaggaattaagatcattgcgaagttctgataggtcatcctctactgaatctaaaatatttttaccttctgtccattctctttccataaattcactgtgagaatatattatccgtagtgtagaaacaagcatatttctgtcattaatcttttcttgtaaattctgaattatactatcatttatacattgaagcattgcatcattacagggttcgttttttactgaaggagattttgacttttttttaaaatgatcagatataaaatttttgattatacctgtaaaaaggtttgaatttttatttacaaaatataatggtaataggaaaatcatagtaaaaaacccacctaagagttcgagaatattattttgactactgacaagggtcattgtagaaccgctattatcatctgaaagtttaatactggaataaagagcgttagatgtgttgtctataattccagtttctatttcggtaaggttacgaatttgtttttttaaactgggatcaatattgtctgaatttactatatatgaattatcttcagcaatttctttataactatttaaattgctcagaaaattactcttttcagatatagttatatattcagagttatacaggttgtttatattatctgatgcagtattataatttttttcaaattctgttttataatattgatctcctgtaataagatagtatttactcattattgccatatctataatgctttctttgaattgatcaagtgatgatatttttgctcttaacatgtcgttgttttgcatttttgaagaaattgaatgatttgttgagtacatataaatcataaacggcataataagaattatataaagatagaagataacttttatgaaatttttcattaatatcacttccacaagtattatatgaaattttataggtaaagttgtataatataataattattacttaaaattcataaatacaataataatgatatttatgtaattatgtgctataatgtgtaaataaaaggagtcaaatagaaaggagcaagttgctgttaatggcataattaatatacagaaattaagactgtttgttataaaatatattaagtatgcaaattattttagaatatgaatgtgtggttcattagtgtatataaacagcggcgaaacaatatatgttagagttaaaaaatatctgctttacagtagaagatgataaagaaattttaaaagatgttaatcttaccattgatgattcgaaatttatagctattacaggaccaaatggtgggggaaaatcaacccttgcaaaaataattacaggaattaaatcacctacaaagggtcagattattttaaatggagaagatataacaaatttatctatcacagaaagagcaaataaaggaataagctttgcatttcagcagcctgtaagatttaaggggattacagttaatgatcttataagacttgctgcacgtaaaagtattactaaaaaggaagcatgtaattacctacatcaagtaggattgtgcgctaaagaatatatagatagagaagttaatggaagtctttcagggggagagcttaagagaattgaaatcgcgactataattgcaagaggtactaagctttcgttatttgatgagcctgaagcaggaattgatatatggagctttaataatatgataagtgtgtttgaaaagatgagaagagaaatagatggatctatagtaataatatctcatcaagaaagaatccttaatattgcagatgagattgtacttattgaaggtggaaaaattaaatctcatggaaaaaaggatgacttattacctaagctacttacagcagcaggaaattgtaaattttataaaggagaagaatagttatggatgatatacaaaaaaatttactaaaggaaatttcagatttacatagtattccagaaggtgctttcaacataagaattgatggagctgtagcacttagaaatacaactgctaatgtagatatagtacctaagaaggataaaagtggaatagacatctatataaaggaaaatactaaaaatgaaagtgttcatattccagttattttaagtcagacaggaatgacggaacttgtttataatgatttccatataggagaaaatgcagatgttactatagttgcaggatgtggaattcataatgaaggaagtgaaaaagctgaacatgatggtattcatacattttatatagggaaaaatgcaaaggtaaaatatgttgaaaaacattatggtgaaggtgatggaactggagaaagagtattgaatcctgaaacaatagttaatatagaagatggtggctacatggaaatggaaactactcaaattaaaggtgtagactcaacaaaaagaactacaaaggcaatattagaagataatgcaaccttagttataaaggaaaaaataatgactcatggcagtcaatttgcagaaacggaatttgaagttgatttaaatggtgaaaattctagtaccaatgttatttcaagatctgttgcaaaagataattcaaaacaggtgtttttatctaaaataaatggaaataataaatgtgcaggtcatactgaatgtgatgcaataataatggataatgcatgtgttaaagcaattcctgaaataacagctaataatattgatgcaagtctaatacatgaagctgctataggaaagattgcaggagagcaacttataaaacttatgacgcttggtttaacagaaaaagaagcagaagaacagattgtaagtggctttttaaagtaatttaagtggaaaattataatgcgtgtttcgacaagttcgacttgagattgtgatgttttgtgagagttttatgttaaatatataatatagataattttatgactttaaattatttgaactatgcataaatcctcactacacagtatattttttcataatagtatttaaaaaagattaatattacggtataattaataaaaaagaattatcttaaatttaataactaaggagaatgtaatgatgaaatgtactgcttgcacactaataattaaagatgattttgaaaatgtacttattttaaaaaagaaagtaaaaaagggacaaataggaaaatggtcacttcttagtcagaacttaagaggtaaggaaagcgatgaaaaatgcttgaataaagccagcaataagattttaaagacaattatattcgatttagaaccttataaagagtttgtgttagatagtgattctgacgaaggtattagagtgtataaaggtgaaattaagggcagatttgttctagataaatcttatgatgatgctcaatgggttaataaaaataaacttagtgagtatgagtttgaagatatagacaagttgataatggaaaattttatagctgaataattataccttgaaaaaacaataaaagtttgtttttctataaaatttttataattagtgcaacaatgaaaagttactagcagctttaaaaaagttgtggtgactttttttattttttgtcaattttatattactatattaaataggaatgtatttataacaataaaagtaattaagaagaaataaaacaaaatcatatggacataataattgcaggaggtgtcgtagtgaaaaataatgcagctataagagaattcaaaaaatataaaagtcagataaatcagatagaggaaattatagaacattcaaagtctggagcgcttatagaacatgagagttcagtaagaaaaaaattacgtcatttaaatgaactaaaaatagatttgaaagattacagtgaggtagttgaaaagtacgaagaattattagagtatgtatctcaaaggcttcttgaagagtataataaaaagaataatactgattttgatttttttgaagttgtacgtggaaattataatgtatttttaaattctggaattatgacagtgttgacaaaaatgcatattccaaagcttgtaggtaaagaatttgaagaaactttccctgataatccaaaagatgaatataaacaggctagaagcatgaagagaaagttttatatacatcttggtgatacaaatacaggaaagacttatacagcgctagaaagactaaagacagctaaaaaaggcgtttatttatcacctcttagaattcttgctcttgaaaattatgaaaaactaaacaacgaaggtgtaaagtgtgatcttcttacaggtgaagaggaaattgtgaatgctgactcaacacatgtatcatgtacaattgaaagagttaatttaaaagaacactatgacattgctgtaatagatgaaattcaaatgataagtgacccgtttagaggaatggcatggagtaaatcagttcttgggcttcaatgtgatgaaatacatgtatgtggagcattaaatgcgaaaaatttacttatagacatgatagaggactgcaaagatgaatatgaaataaaggaatataaaagagcaattcctcttgttgttgaagatacaaattttagttacaaccatgttaaagatggagatgcccttgtagttttctctaagaaaagagttcttgaaatagcacaggagtattcagaaagaggaataaaatgcagtattatatatggtgaccttcctccagaggtgcgtaaaatgcagtacgaacaatttgtaaataaagaaacaaaagtacttgtaacaaccgatgcaataggtatgggagtaaatcttcctatacagaggattgtattcatgagtataagaaaatttgatggtgaagaagtacgtgaacttacatctcaggaaataaaacaagttggtggtagagctggaagaataggaatatatgatgtgggatatgtagcagcagtaggtggaaattctcatataataaaagaaaaaattgagagagaagatgcacctatagaaagagctgttataggtccttcagatgctatactttctataaaaagccttcctttaaatgaaaaacttgcactgtggagtacaagaaaagaaaaagttgaatattatacaaaaatggatataagtgagtatttgtatattttagataaaataaaaaaatataagcttttagaagaagttcaatgggatctattaaaagtgccatttgacgtatcccgtgatgaacttatggatacttttttggactatgtggatgaactttttgtgaataagcaaaagaaattattcgaaccacaatgttttgggggaaatttagatgagcttgagatatactatcaaaaaataaacatgtattattcgttttcaaaaatatttaatttaaaattcgatgtgcagtgggtgtatgaagaaagaataaaaattagtcaagaaataaatgaaattcttttgagaatatagtaattatgcgacataagaagatttaaatttgtatgaaatgaaaaaaagtatcaacaaatctgctaaaaaagtcaaaatgatgtttaaaaattttattttttagtatatactattaattgattaaagatatattaattatattaaaataatcccaaaggagagcgaccaatgactgaattaaaccatgaacttggaattatagcattagaaagctgtaaagagttaggagatgctatagacaagtatattcaaaaaaagagagaatgtagtgattcattcttaattcctcttgatgaaataagattttcaaatggggaaggaaaggtaaagatttctgaaacagtaagaggcagagacatatacatattatgtgatgtaggaaactacagctgtacatataaaatgtttggaatagaaaaccacaaaggtccagatgaacattttcaagatataaaaagaactgtagctgcaatcagaggtaaggctgctagaattacagttataatgccacttctttatgaatcaagacaacatcgtcgcaaaggaagagaatcgcttgactgtgcattagcacttcaagaattagaaagacttggagtagatgaaataattacatttgacgttcatgatccaaacatacaaaatgcaattccattattatcatttgaaaatatttatccaacatatgatatggtaaaggctattgtatctcatgaaaagtctttagaattaaataaagaaaaattacttgttatcagtccagatactggagcaatggacagagccatctactatgcaggagcattaggagtagatgtaggtttattctataagagaagagaccattctacaattgtaaatggtaagaatccaatagttcaacatgaatacatgggaagagatgttgctgataaggacgtattaatagttgatgatatgattgcatcaggagaatcagttattgatatagctaaagaattaaagaagagaaatgctagaaacgtatatgttgctgcaacatttggattctttacagaaggtgttgaaagatttaacaaattctatgaagaaggaataataagcagaatatactgctctaacttaacatatgtttcaccagaattaaatgatgcaccttggttccatggcgttgatatatcagaactttgttcaagaataatcaacagattaaaccatggtagatctatatcaaaatatatggacgcaacaagaatcatacatgacttattaaatgaataattcggttaagaaaactgtcttaagattaatttcttgaggcagtttttttgttttggtaatataaaacaaataataagaatataataagtactaaatatataagctttctaaaagaatcattttacttttagaaagcttatatatttaaatgtgaaatgtgaattcaatatgaacaaagtaatacttttttaataaatatataatttatatgttattgactagaaaagaagaaaaatattataatataaaatatgtaaatagatataaattaatttgaaataattaatttatatacagacaaaagtgagtcttattgatgagagtccataagattagaggagattagtatgagaagtagaaagatacagacactagtggcgctaatggtaatttcatgtatgacagtaactagtggaatgcctgtttttgcagctccaaatgagacagtagctgctgatactgaaataacagccaacgatggtacagataatagatccatagaaaaaattattcagaatatacaagaatgtgatagtcaaattgaatataaaatgggaaaattaaatgagttaaaagaacaaattcttgaaaaagaaaatcagatacatgaaaatgaacaaaaaattgaacttgcagaagcagacatagaagaaaaagataatgcattagcagagagattaaatattatacaaaaaaatggtggtattgaatctacacctatgaagtatcttgatgcacttttatcatctgaggatatattagatgcagttcaaaaagttcatcttatatctaagatatgtacaagcgataaaaaacttattcaaaatgccaaagatgctaaagataaccttacacaaataaaggaaaatatagaaaaagagcaaaaagaacttgaaaaaagtaaagagtatttagaaaatgaaataaaagcattagaaacagataaagaaaagttgatagactatgtaaaagaaaatagtagtcttctagatttaagtactaataatataatacctgtaacattgccatcagatatttcagaagaagcaaaagcaattatattagaagctgagaaatatcttggagttccatatttatggggggggacaactcctgatggatttgattgttctggttatatgcagtatatatttgcatcaaaaaatatatcaattcctagagtttcacaagatcagcaaagttttagtacaaagatttctatgtctgaaataaagccaggagatttagtatttaataaatcttctgattcaacacatgttggcatgtatatagggaatgatatgtatattcatgcaccgcatactggagatgttgtaaagataagtcaattatcaacatcaaatatgaagtatgcaggaagaattttagaatcaagtacaagcagcagttctagtaatacttaataacattattatgagttaattaacaattttttattcatttattcttataaaaggtaaaataatataaaaaataagaacatatttaaaaagaaaactaaaacaagtttgtaccttgttttagttttctttttaatataatagattatatattcaatataactaaactttatgtaattttaaaatattaacaagttttaaagcccatttttgctatccaatttttcattccatctggattacgtgtctgaataaatattttcccaggtcctttaaaacgacatacaagtccttcgccagaagtgaaactgcttatccatccttttttagaagccttttctatattgtactcaagtgtttcatcccaagcaacaagatgagagttatcaattattatttcttcattagaatttaaattaatttcatgtatagcaccataactgcttacaaaaacagtaccttgtcctcttgcgccaagaacaaaaaaaccttcacctgaaaataatcctttagtaagattttggacttttgtttcaagatctacatctatagttgaggctaaaaaaccgtccttttgaattttaaggcctgtaccatttaatgttataggtacaatatctcctggtagagaatgagcaaaaataatatctccagctcctctattagcagataagtgttggaaaaagaatttttcaccagcagccattcttgcaatgcctttaaatattccgccttcagtatttccagttacatctattgtaggagacattgttatcattgcatttgattcagctttgatttgttcaccgtgttcaaggtgacattttaccattggaaaagtaccttcatgtaaaatctcataattcattattattacctccgaattctaaaaataatactagtgtaataaaatagttttcatagtattaattaccataaaatgatatcataagataatcttaatttaaacttaaattttcttaaataatgtttaaattaataaaaaaatatttgaaataaaagaaaaaatgatgtaaactgaatatgtaaaggtttaataaagcgtataatttaaaaattttgataaatttcgggggttaattatgataatatacattttaaatatacttcataaaagtatacaaaagaaacttgacaaaaataaagaatctatagatgaaactgtttcaagtgaattaatgagtgatgcacagtatgtatcatattttggagaaataaagaaatctaacagtatttcagaaatcaacagtaaattaactaagttttttgagataataaagaaacatagagtttctgtaaacgataccttcagtattcttgaagaggttataggtaatgatacaaacagatggataattgaagaagtttataactataatggcaagtacaatattaatgatttatatttaagtaaatttgttggtgaaattctttataattatgaagaaggatttaatgatatagataaaatatataaatcatcacctaacttaaggcgagtcatattagatagtgtattcaataagattaaagatgataatagaaataatatcattgaaaaactttcagatgcttcctaggaaaacaaaatatatttagcgaaaaaatgctaacgaagtctatactttatgtatagacttttgtgtttttaatgaaattataaaaaagatacgatataaaatgaaaataatagggagaattgactaatacttaaaaataaagtacaataattaaaatatgactaataattagaaaattaattattactttgataaaaatactcggcaatatttattaaagtatgcatatgagcaatgaataaaagggggaaaattcatgtcaattaaaacaagaagagtagttatagtaggaagtggaaatgtaggatcacattgtgctttttcactagcagttcagggagtatgtgatgaaataataatgatagacaaaatagaaaaaaaagcaaatgctgaagctgttgatttaagtgatactgtttcatatcttcctcattatgttacaagcagaaaaggaacatttgaagactgtagtgatgcagatattatagtagttagtcttggggtgcctccagaaccaaataaaagcaggctagactttttagaaggaacaataagagaagtggatacgattattgagcctattatgaaaagtggttttgatggtattatagttgttatttcaaatccagtagatgttgttgcgaattatatattggaaaagacgaaattacctaaaaatagagtatttggaacaggaacaactctagattcatcaagacttagacgaatattatcacatgaaacaggaatagatgcaaagtcaattcaagggtatactatgggggaacatggtgattcacaaatggttccatggtctcatgtatctttaggtggaaagccaatatttgatcttataaaagaaaagcctaaaacatttggaaatttagatttagatgatattgaaaaaagagctgcatttgctgcatatgaaataatagcaggaaaaggatgtacagaatttggtataggcgttggacttactgaaattgtaaaaacgattcttcataatgaaagaaagattctaccggcaacaacattgttaaatggtgaatatggacaaactgatgtttttgcaagtgtaccagtcattatgagtaaggatggtatagaagagattattgaaataaatcttacaaataatgaaaaggaaaaatttaataattcgtgcaatattataagaagttacattgaaaaatcaaaagaaatttagttttttttaagtaggataagaaggttattgcagagtaggattattctgcatggaaggagtaaatatgaataatagtgcgacgatgattccacttataatagtattagtatacattggtgtgcttatggctataagtgttattatttcaaaaaaacaaaaaaaagatggggaagcgtttttattatataaaggaaaaaataatgcaattattacagcagtaacagtagcaggccttgccattggaggagcatctacaataggaatagcagaaaatgcagtatcagatggcatgagtgcaggatggtataacgtagcatgggcaagtggagcacttgcagctgcttattttgtaatatctaagtttagaaaaagtggatttaatacaatagcaaaaatgcttgaagtaatttatgataaaaaggcagcatttataattattatagctcaggttattatgcagtgtgcaataatatcacttcaatacaaagctggtggggctattcttgcaagtctacttccagatgtgtttgatgcgaatatgggaatattttttagttttattatgtttatgcttatttcccttattggaggaatgggttctgcaagtataagcaatattttaaatattgctcttatatattttggagttatagtaaccactggaattgtactttttactaataatcccaatgttggaatgaatggacttcaagctgccatagaatttaattctcaaaatcctcagaactttttcagtccttttgaaggaagggaaggagttgttatttttagtatacttgcattaattataaccatgacagctaactgtacctcactacaaggagtggttcaaataggtcttacttcaaaaagcgatgaagatgcaaagaaaggatttaaattagctgctataataatgataccaattggattcttatgtgctttattaggaatatgtgcaaaagctatttatcctgacttagaaccagcaacaagagctctaccagttataattttatcattatctccatttattgcaggaataacacttgctggactttgggcagcagatatgtcaacagcatgtagtatgcttataggatgttctactactgtcagtcaagatatattagctaaaacaaagcttaaagatataattgaaaaaaattcattactatggaataagctaataatattaggtgttggagttattacttatgtgttagccatgcaaaagggacaaattataacaacaataaaaactgcattatcactttcaatacctgtatctattgttgttcttggtggaatatggtttaaaaattatgtttcaaaaaaatcagcattttacacagtattaagtggaattttgatggttcttatatgggttgctttaccagttaaatcatatttttcacagatgccagtattaaatgtaatatttgcagatttagcttatccaatgtttatagttacttttgcagtattttttgtttcgaatgttatatttaaagaaaaagtatcagaaattcaagagacttgctgttaaattaaatctattgcaaaaaatatataaaatttgttataattccattggaatgaggtggaatcattatggcaagaaaaagtagtagaaatacagacatattaacagatactaaaaatacaacgtcacctaagatatattcaatgttagttgaactagttaatgctgacagagaggatttggcagaagatgttttaaaagcagattatctattagaatatacaagtacctgcattaaagataaagattatagagaagcgaaacatactatagctatggcaaaagaaagaattgataaagtggaaaaattcggctttgacgtagaatatcttatgtatctttatgatggaataaaagcaaagattaaaaataaatagcagattttaagaaagcaccattaaagaaattataatttctttaatggtgcttttttgactaatagctgttaaatctgcaaaattagtcataatataacattttttaaatgaatttttcatagaaattgctaattcatattattttgataagaaatccttgacattgaaaaagattatcagtattataataaacataatgatagtatatttcagttaatatatgttattaattgattgtgattttgaaaggagaatttacttcaaagttttattttgcaaatcatatttttagtattaagttaagcaaaaagtaaaatgagaagttatgatgattatgagtaaaaaaatattaataccgatgtttattatattgtgtataatttcactgttcattggagtgaacgacatatcagtaatggatataataaactttgatagtgagaaaataaatattttattgataagcagattaccaagacttgttgggcttgttgttgctggtgttggaatgagtatcggtggagtgataatgcagcagataagtaacaacaaatttgtatcacccacaacagcagcaactcttgattcagcacaatttggtgtaattgtagctatgatgattttcccagttgcatctttaacgcaaaagatgattgtagcctttatattttcacttataggaacatttttatttatgggaattctaaaaaagataaagatgaaaaatgccatattcataccacttgtagggattatggttggaaatgttatcggatcacttacagagtttatagcctataagaataaccttgttcaaaatgtgggatctttctttcaaggtaaatttgcacttgtgattaaaggaaattatgaaatgctatatttcactattcctttgcttatagtggcatttatgtatgcaaacaaatttacaataataggtatgggagaagatatttcaaaaaatctaggtcttgattataagaaagtcagtaatattggaattaccatagtggcattagttagtgcactggttattataacagtaggtaatataccatttataggtttaattgttccaaatttagtatcactttttaatggagataatgtaagtaaaaatataggaattacagctttgtttggagcaaattttgtgattttatgtgacataattggaagacttgtaatttatccatatgaggtttcaataagtcttactgtaggagttataggaagtataatattcctttatttaatattaaggagaaatagaaatgaagcatagcagagataagaagaaaatactaattctttcagcattaacaataatatgtatagggttatttctttttcaaggattaaattctagaaattttgattataacataagcagaagaatacctaaaataatagcaatgtgcctaactggaacaagcattgctgtatcatcgatgctatttcagacagttacaaataatagaattcttacgccaagtattttaggtttggactcattgtataattttggacagacattgtgcatatttgcatttggtgtaaatagtattatgatgacagataaaaaaatgaacttttttgcttctgtatcaataatgcttcttggaacaatattattatataacttggtttttaagaagggtaagaatatatttactttgcttttagttggaactgtagttggaactttatttagaagcatgagttctttcatgtcagtgcttattgatcctaatgattttatagtactacaaaataagatttttgctagttttaacaatgttaacactgacatactgcttattgcagtaataattataataggaactggatgctttatttataaagatctaagtaagcttgatgtaatgctgcttggaagagaacaagcaataaatttaggtgttgatcatgatagattatctaaaaagatacttcttattgtagctattcttgtatcagtatcaacagcacttgtaggaccgattacgtttttaggaattctggttgtgaacttatcgtatcacttattcaagacatataaacacagctatctaattgctggttcttcacttataagtatgagtgcagttgttggaggacaattcatagtagaaagaatattaaatttttcatctactgtaagtataataataaatttcataggtggaatatactttatatacctattgttaaagcaggctagaaattagcttcgagtgaatcttaaattttaatataataaaaaataaagatttctattaagtatagtaattttttatggaggaaaaaaatgattgaagtaaaaaatctcatgaagaagtatggaagcaaaatagtagtagataatgtttcgttaaatatagaaaaaggaaagataacttcatttataggtccaaatggtgctggaaaaagtacagtattatcaatgatttcacgcattatggataaagattctggaactgttacaatagatggatgtgagcttgaaaaatatgactcaaaggaacttgcaaaaaagatttcaattttaaagcagtctaacaatataaatgtaagacttactataaaagaaattgtaagttttggaagatatcctcattgtgaaggaagactcacagaagaagatgaaaagtatgttaatgaggccattgagtatatggaacttaaagatattgaagataggtatcttgatgaactaagtggagggcagagacaaagggcatatatagcaatggtcatagcacaaaatacagaatatgtattacttgatgagccattaaataacttggatatgaaacactcagtttcaatgatgaaggtatttagaagacttgttgatgaacttggaaaaacagttgtaatagtaatgcatgatataaattttgcttcagtatattctgataatatagttgttttaaaaaatggaaagttagcaaaagatgataaaactgataatattatagataaaaaaatattagaagatatatatgaaatagattttgacattaaggatattaatggtaataaaatttgtatctatttctaaaaagtaagataaataataattaattataataaaagagtgataatgaaaatcatatacataattaggaggaattttaaatgaaaaagaaaagattattaagtgcattattgactacggttgtggctgcagggcttttagctggatgtggtaaggtaaaagaaaatagtagtacaaatatagaaaaaataactgttacagatagaaaaggtgaaatcgaagtacctaaaaatcctgagagagttgtagttttagattatggaacactggatgtactagaggaaattggtgttgataatgtagtgggagtgcctaaatcggggctaccagaatatttaaataaatatgaagatgaaaagtatacagatgttggaggagttaaagagtttaactttgaaacaataaatgaacttaatcctgatttaataataatagagggaagacaggaagattcgttagaagaattatcaaaaattgcgccaacagttttccttggttctgtaggttcagattatttaaatagtgttaaaaataattcaaaagttattggacaaatatttgataaagaaaaagaagtagaagaaaagttatcgactattgatgtgagagttaatgaaatcaaagaaaaagttacaggtaataatttaaatgctttagcaacaatggttagtgatggttcaatgagtgtttatggttctggatcaagatttaatatactttacaatgaattaggatttaaaccaactgatgcttctatagaggtatctaatcatggacaaagtatatcatatgaatatttagcagaaaaaaatccagattacttatttgttatagataagggtgctgtaactggaagtggaaatccagccaaagaaacagttgaaaatgaattggttaaaacaactaatgcttatattaatgataagatagtatatgttgattcagtagcatggtatgttgggggagcaggatttaaggctcttgataaaatgcttgatgatgtggagaatgtactttaattaattataatttatattaaaattagacactaataaaaaatgcagagttaaagtttaaatctgcattttttatttttaataatttttattaaagatttaagtataatatataaactttacagtagaattttaacattatttataatattttcattgaaatatattttagtctttataaaattataatatgaatgttgacaaaatagaagaatatgtgtagaatatgagacatcaagtaaaacaaatattaaagctttgaagagaaagagtaagattaatagagttataaagagaggttccgggtggtgaaaggaacataacaagttaatttgaatacgtctctgagcagcactccgaaagataacaaccagtaggcagatgtcgtaatttgcacacgttatagtgctagagtataaccagattattattaaatttatatctgagtacttgaagaggttgttattgtgaaataatgataaaataaggtggtaacacgtaagtattgctttcgtcctttacagttaaggacgaaggcttttttgttttgtataaaaatatgtgcaaagtagcttttaaaaattaaattatctctgatcaagataatctgtttgcttgataattattaaaaaatatatggcgccaaaaatatttcgttattagttattacaatttaataaagtccatagattgaatttattgaagaaaagttataccaatttattaaataatctatgttaagagttttatatgttaattataaaaataaaaaaagaaatattggaggaagtaaatatgataaatatagatgaacaaataaaaataattatgaaaggtgcagatgaaataattggacttgatacattaaaggagaaattgaaaaaatctaatgaagaaaacagaccacttatagtaaaattaggtcttgatccaagtgcaccagatatacatttaggtcatacagtagttcttagaaagatgaaacagcttcaagacttaggccataaaatagtaattataataggagattttacaggtaaaataggggatcctacaggtaaggctaagggcagaaaagcattatcaactgaacaggttctagaaaatgcaaaaacttacgaaaaacagatttttaaaattttagataaggaaaagactgatgttagatttaatagtgaatggctatcaaagctatcgtttgaagaaactataaagcttgcatcaacaatgacagttgcaagaatgcttgagagggaagattttaaaaagagatatgaaagtcagattccaatatctatacatgaattcttttacccacttatgcagggatatgactctgttgtgcttaatgctgatattgagcttgggggaactgatcaaagatttaatgtgcttatgggaagaatgcttcagaaggaatatggtcaagaatcacaaactacaatattcatgccacttttagaaggacttgatggaaaagaaaaaatgagtaaaagtcttggtaattatattggaattgatgaagatgcagatgtaatgtttgaaaaagcaatgagaattcctgatgaacttataataaaatactttaatttagtgacagatatacatcctgatataattgagggaatagagaaagagttaaatgatggaagtattaatccaagagatataaaaatgaggcttgcaagagaaataactttattgtacaacaatgaagaaaaaacaaagtcagcagaagaaagatttaaaaaagttttccaaaaaggacagattcctgataatatagaagtaataaaagtaaataaaaataatttagatataagtgaaatacttgtaaataacaattttgttaaaagtaaaaatgaattaagaagaatatctaatcaagggggattaaaagtaaatgaaaataaaatttctgatttaagtaaagtcgaaattgaagataaaatgataatacaaataggtaaaaagaagtttgtatgtattgagcttgtttaaaaaatactatgattatagcttgaggagattaaattgggaaaactagttatgattattgcaactttaataataatactaattgttgcaattagaaatatatattataaaaaaatattaaaaggttttaagattcttataattgaaataacacattattatttagggttgtttaaagacataacaagaacaagtattggaagtattcttcaaacagcattgctcattttagctcaaatatttatgagttttaatgtaatttccgctgtgagtatttatattaattttagttcaaataatctaataaacttaattataaaaattataattataattgcaatgatttttatgctatatcttgctgttggatatgtccttttatcatcatcaatgatttttaaacttttgagtaaagttgaagattcaaatattaagtatgatttgctaataagttatttcgtattaaatacctattttacggtacttattgtatttcctaaacagtttgaagagtgctattttataggattgataggcgtagcaatttgttatatgatgaatttaagggttcttataaaaataataaaaaatccagaacacataaatattcatttggagaaatatagaaattttaaaagtacaacaacattggcaatactcattttgataatgatgattttaaatttattcttagctgtttgttttataaacagtgcagatattaattcatatactggaaatccaaataattttgatttattttattatacaataataacttttacaaccataggatatggtgatattgtacctgtaacagtattggcaaaaataatgagtattataatatctactacaagtgtggtttgcataactattttcttaagctctgtattatcttttaatagtgaaaaaaataaataatataaaaagactttctatgataaggtatatataaatatactattattatagaaagtcttttttgtgaggtgaaataatatgaatgttaataataatgattataagattatcaagttacttggaaaaggaaagggtggatattcatatttagtagaaaataaaggtgtatattatgttttgaaacagatacatcatgaaccgtgtccttattataagtttggagataagatacaaagtgaattaaatgattatgacagattaaagaaaattggaataagaatgccgttgatgatagacgtagatataaaagaagaaaggatattaaaagaatttattgaaggtgatactatttttgatattattttaaatgatagaatgaaggactgttatattgatgatgttaaagaaatgtgcagggttttatatgcatcaaagactaatatagattattttcctacaaattttgtagtgaaagatgatgtactttactatatagattatgagtgtaatgattatatggaagaatggaattttgacaattggggaataaaatattggtcaaaaacaaaagagtttatagattacttagaaaatgtgaaattagatgatacagattgtgagtaaatataattatatattggtaaaaaatgagtataaatgaaggaatatgaatgtatttggatgaaaaaatttaaaaaattatgcgcaaacgtttgacaaaatgactgtttgattgtagaataataaaagtggactagtttttattagtctgcttttattatttattaaatatgaaaatagatgtagcaatatacatagtaaaggaagagaaaaatgaaacatggaattaatttagttaaaagaattatattattctttataggaatgagtattattcagttaggagtagctttatttttaaagactaacatcggttcggatacttttactgttttcacacaaggactggcgacgacacttgataatacatttttaaaagatagtacaattgtcaatatgatatcagggaatcagggagtaacacctggtgtagctaatatgattatacttatagtaatgtttgcaataatattatgcacggaaagaaaacgtattaatattggaacattaatatgcgtagtaggtgtagggccaattattgatttaggtataaaaataatgtcatatttcccagtagaatcttataatttatttgtaaaaatgttattagtagtgtttggatgttttataatagcagtaggattttcagttttatctgctagtaatttaggtgtagcaccaaatgacatagttccattcattattgtagataaaactaaagttgagtatagatgggttagaatatgccttgatgcagtatttttaattgggggatttttcttaggcggaacaattggtataggaactgtcctttcattaatatccatcggaccattcatacaattatgtcttccagtaggagagaaaattgtaaactttattgttgatggtaaaagtgagcaattagaagaagttacagcgtaatttatataaaaaaactggggctgtatcaaattgaaattttttaaattcaatttgatacagcctattcttataaacgtaaattttattcatgtatatatttccaaatattttattttgaaataacacaaataaaggataaacattattatccatattttaactatatatttaaaattacgaagcttgctgcttatgaagcagctcaccgttacgattttgaatggttttatggtacaatttattaacattataaccaaacgccattaacaaaaattcagtacgaactttaatatttccacgcataaaaaatcttctaaaaccataatcttgtttaataactccaaatgctccttcgacttgaattgatctgttcattcttaaaagtattcctttaggtgtagtgatgtttttaagtgaatttgttcttagacgcataaaatttttagccacatgtatttgtttattaccttttgctttcgtacatttactcttatattcacagccatcacagtcttcacattcatagatgctaacagtagtttcatatccagattttgtttttttcttttttgttccttttagaagcatttttttaccagatgcacaaatgtagtaatcttcatctgtgttatagtacatattttctttcttactaatatcactcttgaatttctttgtctttgacttttcataatttgcaggtttaataaaagcttcttgtttcttagattcaagatatgcataattttcttcactttcgtatcctgcgtcagcagttacggattcatatttttgatttaaattcttttctaatctatctaaaaatggtataaaagtaagctggtcagatctttcacttgaaatgtctactcctacaatatattcaccttctacccctatttggatattatatgctggttttaattgaccgtttttcatatgatcttctttcatatgcatgaaagttgcgtcatgatctgtttttgaaaaactgtttcgtccattaaaaatgctattgtattcattatatttattttgcttttcaataaattcattaagttgttcagtatatctttggaatttactttttcttttaccttttccataaacaaattcaatattattggcttcaatcataattctgatactatctaaaatataattagcatcttgaactgatattttagcattagtaataataagacataaattcaaatcatgattcatttttattaagctttcttttattttcttttgtagtctatcttcaaatttatcaatagattttttccaaacaaaagtatatcgatttgcagatgcttcgattttagttccatcaataaaaatatttttaaattgaatttcattaagttctctaagttttttcacaagttgattaaataaattttctatacaaccagctaatcgttcacgtctaaatctatctatagaattgtgtcctggtggtagttgaccttgtaaaagccatttgaaatttatatctcttttgcatgccttttcaagagcacgacttgaatatattccttccatatatccataaactataattgcaaacatagttttaggtaaaagtgctggatttctaccaatagtagagtaagttctatttaattctgaataatctaatccctccataacatcataaagcactcttactgaatcactatcagatataatattttctatatttattgggaaacctatttgatgcataggtataatattattagtgttcatattaatattatgcgcaaaaaagagaattcaaatttatgaattctctttttttatcggctagtatcaaaattgttttgatacagccccagttttttgtatattgcgtatctataattatttgaataaaattactagggtatgaacaattttataatttgacatatcatctaaataaataaataaataaattataataggaaattagataacgtattataaattagaaaacaataaagatatatttgtaagaggatattgtgtggtaaaatcttgtgttaatgaataattattatatgaggatataatataaataaattctatattaaaagacaatattgtattgtgtcactttataaaaaacattggtagaaatttaaaaaaatgtgttataattgataatgaacattaaataaagaaaaaataattaatttaatataaattgaattttttaattttatgtggccataatctagtataggtagatttaatttaaaatggaataataagatgaaattaataatgttgtaaataaggttgtgattagtgtggaagtaagtataaaggatgttaaccataaaaaatatatagaactgaaaggtaagctcgatagcaattcaagtaatgaggtcactgaaaaaatcttagatgtaataaaagatgaaagtgatataacaatagatatgagcaaatgttcatatgtttcaagtgcaggattaaggacacttttaacaataggaaaaagcataaagatgaaaagcggacatatgaatattgtaaatctagttgaagaagttaaagaagttatggaaatgactgggtttagtaatattttcaaaggatttgagcattaaaagttattcaaaaataaggggaggatcataaatgatacgtgttgatagctatcctactcatgaaaaagatggaattaaatatagaataggaaaggttctgccatatggagcatctattgttcctaatggtgttaatttttctgtgttttcaaaatatgctacatcatgtgaacttgttctttttagaaaaagggaaaaggaaccatatgcaataataccattcccagatgaatttagaattggtgacgttttttcaatgatcgtttttgatattgattatgaaaatgtagaatatgggtatagaatggatgggaaattttcaccatctgaaggattttggtttaataaagaaaaatatcttcttgatccatatgcgaaatctgtttcgggaagaagtatatggtgcgaagaaattgatgaagagaataaatttcaacataggggaaaaattatgtacgatgattttgattgggatggagacaagcctcttgaaacccctatggaagaactaataatttatgaaactcatgtaaggagttttactaaacattcatcaagtggtctaaagcatggtggaacttttgctggtttaagtgaaaagataccttatcttaagaatcttggtattaactgcatagaacttcttcctatatttgagtttgatgaacttgagaatgcacgaactattgatggaaaaagactgcttaattactggggatatagtacagtaaatttttttgcaccaaaagctggctatgccgctacaggaaaatatggaatggaagcagatgaacttaaaaatttaataaaaaaatttcatcaggctggaattgaagtaatactagatgttgtatttaatcatacagcagaaggtaatgaaaagggaccatatatatcttataggggaatagataacaagacatattatctattaaatccagaaggacaatattataattttagtggatgtggaaatacgttaaattgtaataattcaattgttagaaattatatacttgattgcttaagatattgggtatcggagtatcatatagatggttttagatttgatcttgcttcaattttatcaagagatgaaaatggtgctccaatgaagaatccacctcttcttgaaactcttgcacatgatgctattttgtcaaagagcaagcttatagcagaggcttgggatgctggaggactctaccaggttgggaattttccttcatggggaagatgggcagaatggaatggaaaatacagagatactgttagaaaatttttaaaaggtgataatgtagctcttgaattcatgaaaagaatggaaggttctcaagatttatatagccaaagaacttcaaatgcatctattaactttataacatgtcatgatggttttacgttatatgatttagtttcatataatggaaagcataacaaagcaaatggtgaaaataacatggatggaactgatgataataatagctggaattgtggttttgaaggtgaaacaaatgatgtttccataaatgaattaagaaagaagcagataaaaaatgcaataactattcttcttatgagtagaggtatacccatgattttgtgtggagatgaattctgtaatacacaatttggaaataataatgcatattgtcaagataatgagatctcatggattaattgggataacttaaaaatatatgatgatatatataattattttaaagctatgataaattttagaaaatctcatccagtattaaaaaattccacatatgatatgaaaaacaataagacaggatatcctgaactttcatggcatggtgaaaaaccatggagtttcaatgtttcgaatgataatctttcacttgccattatgtatgttgaagaaaaagagaagtataaagttgaagaggatacattcatatatatggcaataaacatgcattgggaaatgcatgtttatgaacttcctataataccagaagataaaaagtggtatatattctgtaatacttcgtgtgaatatggaaaagacatttttgatgaaaagataagaataccaatagatgaccaaaagcatatagttgtaaatccaaggagtataataatattacttggaaaataacctacagaccttaagatgaaaaaaataatttaaacgagcttatataataagagtgtaggtgattttatggaatggttaagaaaagaagccacattaaataacttgaacacaatgatcgattttatactgaataaccttaaaaaagatgtaatggtaacagagcatattgacatggagataaggcttttatgtgaggaagttcttatgaatataatcagttatgcatatgaagaagatgatgatactggtgagatgcttattggatatgaatatgatgaaaataataattatgtagtcttaaaaatttgtgactatggagtgaaatttaatcccatagaagaaaaagatccagatcttacatgtgatattatggaaagggatataggaggccttggggtttttttaattaaaaaaatttctgatttcattcaatatgagagaaataaaggcatgaatatacttacaataaaaaagcattacaattctataaaaggatcaaagtagccgaataaatgtagtatgcttaaaaaatatatatgttgcattataaattttatacttataatctagaaatgacataatgatatcaaccaaaagtgataattgctcacaaggagcagcacatgtcaagcaatatatactattatatttgttttggaatagcatattataagctaaaatggataaaatgatttactgtgatttataagttttggaggagtgaaattttttgaataaaaatttctcattaaatataaataagattcaaattaaaaaaggaataatatgttcattatttatatttatatgtgcattgttatttaaaagtatgaggggatttatacctagcattatagaaataaaggtagaaagtgttttccctcctgttataggattgtattttggtgcagttggtgctatggcttgtgcagcaggaaatttttttgctgccatagtaaaagatggaagtagttttaatgttcatcttataaatttattttttgattttttatatgcatatataccatataaattatggtatacatttaatataaaagataagtgtgaaataccaaacctcaatgatattaaggggatcttaagatatatttatatcatatttttagattctataacagtaactttactatcaaaactatcaataggcttagtagaaaaaagtagtataaacttgaaaattgtattacttgaattttttaataattataattttcaagcaataataggagttcttatattaattatattttctacaacagaaatacggcctcatattcctaaaacaaaatctactgtactaaagaatatgcattatgaatatcttctgtatttcagttcgtttttggggatatatggaatagtgttgcaacaaagtgatttatcattaagtaaaaatattgaagttataacaatattattaatttcatatgctcttatgattttgtttattgtgacaccaataataaataaaggaaataccattgaaatttcaaagataaaaggagccttttctataaaaggaaaagttaccataggacttttaatttttgttattatatttataggacttttatatatactaggatatgtatcgcttaataattatattgattctgagcgttgtagtcaggtttatattattattggtatagcaagttattttatatttgcagttgctcttttagctttaaaatatgtggagaatacaattacagttcctattcagattttatttaacgtggttaagagatttgcaaaaggtgactatgaaaaaattgttaatcaaaaggatttaaaaacccaatgtgaagctataaaaactggtgatgaaatagaagagcttgcaaatgctttttgcaagatgatgagtgatatacaagaatatgttaaaaatattgaagaagctgctatagaaaaagaaaaagctgaggctgaattaatggcagcaacgaagatacagtcttcgcttcttcctaatatttttccagcctttcctcaaagagatgactttgaggtgtttgcaaatatgagaccagcaaaaggtgtcagcggagatttttatgatttttatctttttggagataaattagcatttgttatagcagatgtttcaggaaaaggtgttccagcagcactatttatgatgactgcaaaaagtgttataaagaattcttttttatcttcttcagatataagagaagttgtaagaaaagttaacaatgaactatgtgaaaacaacgaagctttaatgtttgtgacagcattcttaggaataatagatttgaaaaaaggtgttatgacatatgttaatgcgggacatacgccaccgcttttaaagcatgactttggaacttttgagtacattaacataaaaaataactgtatccttggaataataccaaatgccgattttgaaaagcaggaaatgaatttgcagaaggatgatatactgtttgtatatactgatggtgttacagaagccatggattcatatggaaatttatatggaatgaatagacttaaagatgtattgaataaagaaagtatgcagtatgtagatatatatggaatgattccaatggtaagaaaagatattgataatttttgtaaagatgaaaagcaaacagatgacataacaatgcttacatttaaatatttaaaaagtgaagatttattataaaaaactatagaaaaatagaactgccttaataattttataagggcagttctatttataatagtgtatatttttgagaaaaatatgttttctagtattagttttatatgaattataatcttaagtaataagagttatatggtgcaataaagacaattgtattgttaacactaaagaaaaagtgtatagtaattagtgaattatagaaagagagttgcaatttatgaagaatatagataataaaattttattaacgtgtccaatctgtggggagaatttacaaaaagaatctgaaagtaaagtttataagtgtgaacaaaatcattcatatgatattgcaaagcaaggatatgtaaacttattaataagcaatatgaaaagaagcaaaaatcctggtgattcaaaagatatggttcttgcaagagtagattttcttagaagaggattttataaaaaaataagtgataaaataaatgaagtaatatgtgagtatttcaaagattcagaggaaaagataaatgttcttgatgtgggatgtggtgaaggatattaccttactaatttgaaagaagctataaaaataaataatatagaagcagatttttacgggatggatgtatcgaaagaagcggtaaaatatgcaagcagaagcgaaaaagaatgtttatttgtggttggcaataactatcatatacctgctaaagataattctgttgattgtattttatcggtatttagtccaattgatatagatgagataaatagggtattaaagaaggatggcatttttgtaagagttcttccaagaacaaatcatcttatagaacttagaaatattatatactctgttgttaatcttaatgagaaagtttataaacctgatagtgaaaaagatgattacattaaggaagttaatgttacatatgatctggatttgaataatgaagaatttacaagtcttttaaaaatgacacctcattattggaaatcaactccagaaaacaaggaaaagcttgaagaatataaagatttaagcataaccgtggatatgagaattggtgtattcagaaagaaaaattaaaaatatattaaattccagaatcagtatactttataaagactgattctggaatttttatttattaagctataatagtgcatttttacttgaataattttacagtcaaataaccaaacagattcctaagctatttttaatgactcaaaaattttttctatcggcgtaccgcttgcggcagcttcataaatatatattactttagatttttgcagatctttcttagcagatttatatccagtattgaagtgataagaattattagaatacattttacaaaaagtatagtttattaacattattgttagatatctattaatacttttttcacttcttacttgatatccatcaagtcctaagtaagttttacaatctttaaagaatggttcaatagcccaacggtcagtatattgaattaaaagcttcaaaggttttattaacgagtctatagaaataaaagttttcaatgctttatctttttgaaaggcatccttaggatagcttaaaacaatagaaacattctttctatcttttaaattgccaacataattgtaaatataatattgtttttctttgactgtgacaaggtcaaaatcttcaatatttaatatttcagcaaatttatgaagttttattcctaatctctcgtgacctttcggaaaaataactctgttagtttttaaagctccaatataactgtagccagcttttttactagcattaaaaatatccttacaactataccaactatcggctaaaacataacctttatgttcaggcttaggaagtgcttcaattaaattttcagttaattttattttactcatagattctttatcgtagatatcaattgaatatggtagaactaatccgtcacacgatagtaaagaaactaatatttgatgaccatatacagttttaccttttaaatgtgaattatgaaatgagcacttctcaatgggatttataacctttgacgagggcttagtcttttcagagatagtgtcgtcaacaataaagtatataggctgtttagattctcttgatttattccaaataagttctactatataagcttttaaagatctttttagaagattttcattccaagaactatttgataaaaatctagtaatactagttcgatgccttgcaggcgcaagctccgctatgtcggaaatcttaccattaaatcctttagatatcatagcattcatgatattttctaaatgctttaattgaggattagttaagtaaaaatcaaaatttaattgcttaaagaatttgtatatagatagttcatctgatataattgtgttctgaaacatttatgttaaactccttgttgaattttgtgtcggaacttaattataacagggatttatcataaatgtttttttattttattcacttgtaaaattattcaagtatttttgcactatcatagtattaagctaaaattaaggttgattaattataatgagaaacgatatatacaaaaaagatcaatataaagaatagattatgttgattttatgattataatttattcgaatagtcaaatggaaagcagaatttttaacatatttttaacagagatataaaatgtataaaaatgtagaaaattaacgaatagattaataaaaatatagaataaaattattatttatcttataatagaaaatcgaggggtaattttaaaagtaaatgttatttactaaataaaaagttttttcatttttaagggagaagaaattatgacatttgatgatttttcaatgatgtttcagtttgtcggaggactaggaatgttcctttatggaatgcagatgatggcaacaggtcttcaaaaaactgctggagataaaatgaaacatttattaggtgttcttactaacaatcgatttatgggaatattggtaggtgcattgattacagcaattatacaaagctcaggagctactacagttatggttataggatttgttaatgcaggtttgatgaatcttttccagaccgttggagtaattatgggagctaatataggtactacaataacagcatggattgtatcagcaggtcagcttggagatgcttttactgtaatgaagccgagtttttatgcaccacttatgattggtataggtgctatgcttgttatgtttgcaaagaaggaaaaaaagaaaaatataggagagatattaatatcattaggtcttttatttgtaggacttgactggatgtcaggtgcaataaaaccatatactgatgcccctatatttgcacaagcctttgctttgctaggaagtaatcctttccttggagttttggttggagcaattgttactgcagtaatgcagagttcatcagcatctgttggtgtacttcagactttagcaatgaatggtgttgttacaactaatgctgctgtatatatatgtcttggatccaatattgggtcatgctatacagcgcttctttcaagtattggtgcttcaaaaaattcaaaaagagccgcaataataaatttactatttaattgttttggagttttaatatttgcattaatcggatttggtgtatttactgttaataagacaattgccaatgcaactattgatagtgttcagatttccattttccacactatatttaatgttgttaatacgattataatgtttccaatagctaatctattggttaaagtatcttgtatcatagtgaaagagggaaaggtagagaatgaatcttcagaattatcattagaaaatcatcttgatgatagaataatgaaaactccttcttttgcaatagaagcaactttgaaggaaattaatgaaatgggaattctagcctatgaaaatacacgtctttcaattaatgctgcaatgtacggagattatgaagatatacagaaggtctatgaaaatgaaaagaaaataaataagtatgaaaaatccatagcatcttatcttgttaaaataaataatttaagtttgaatgatttacagcataaaacagtaaaaaatcttctgtatacaattaatgatcttgaaagggttggggatcatgctaaaaatatagctgaatttgcagaaactatgaaaaatgataatctgaaattttcagataaagtaataagtgaactagaaagaatgaatgaaaaagttcttcaatctttaaatgcatctcttgaagcgagaaaatcaggaaatactgatcttataaaagatgtattgaaatatgaagatgaggtagatttaatagaacaggatatacgtgaaagatacatatcaaggcttttagatgaagagtgcaacattgaaagtggtgtacttttcatggatataataggaaatcttgaaagagtctcggatcatgcatttaatattgcaggatatttaaaagacgaaaaataggattttaaaattaatttcataaaaacacagaactttttttgagttctgtgtttttagttgtatagaaaatcttattttaaactatctaattatttagatttattgcttttatagataagagtaaaataacaatatgattaaaaataatattcttctaaaaacagatatatttttagaagaaaagaattataataatatatatttgaatttgtaattaataaattgtaagaaagttaaaaatatatattgcaatttgtagtaactaatatttatttataaaagtatatattattataaaaaggaggaaagcagataatgaagaaaatggacataataaatttcagcatagttctgcttagtatattatgagatatgttattgtttctgtagttaagggagaagcgggggaatttaatgatattttaagaatggatatttatgataaatttaaagcaaaatcatcgaaacttccaccacattttacaataaaggcgccatttgagtatgaaggagatataacttctctagagaaagatcttgagggattatgtagcaaggaaaaaataaaaagctttacaatgaaaaaatacaaccattttgataaccgggtagtttatatggatgttaacatgtccaaggaaggaaaaaaatttcatgataaattaattgatgttttagaaaaatatccatatataaatttcaataaaaatgatgggagagacaaaaagtttcatgtgactctaacatccaaaaaagttcctcctatttttgaagaagtatggcaatatgtgaataaatatccatttgaatttaaatgtgattttgataatgttactatatacaaatgggtaaaaaatacatgggaatttcataaagaatttcaactgaataaaaaaactgattaataataagcatatgaggcataaaactatgtgttgacaagtatatataaataagataatatataaaaaacaatgtattttgaattaaacatgttcctgggggagtagtttgcatatataatatgtgattagatcaacaatcatgatacgtcattagaatgtatctggtctaatcttaaaaagcgagactcatgtacagcatttttgttgtacatgaatctcgcttttttgtttagtgtggcataaatttaaaataaagattataaagattaaactgcaaagtttaggacatgtttaggaaaggtgtgtggagatttgaaattttatagtaaaagttcagaagaagttgctaaagaattagacgttgaaatttctaagggtgtgtcaaatgaagaagtagctaaaagaaaagaaaaatacggaaaaaatgaatttacagttaaagaagaaggaggttttttacaagatttaaaagaagcgttaagcgaacctatgatactaatattgatagcagctgcattaattagtgcacttattggagaatttactgattcagtagggatagttggggcaattgttcttggtgttggaataggcatgataacagagggaaaatcaaaaaaggctgctgaagctctttctaaattaacagaaaacattgaagtaaaagtaataagaaatggaagcgttcatcagatttctaaaaatgaaattgttgttggtgatattgtatcttttgaaacaggagatatgattccagcagatggaagacttgtacaaagtataaatcttaaaataagagaagatatgcttactggtgaatctgatgatgttagaaaaaatgaaaatattattgtatcaatggaaaagttagatgttaaggggaaggaaattttacaagatcctgttcctgcaaaacaattaaatatgctatttggtgggactttagttgcttatggaagaggaacaatgattgttacttctgtaggggacaacactgaaatgggaaagatagctgaaaatctttcacaagatgacattgagacacctcttcaagttaaacttggagacttaggtggaaaaataactaaaatatctggtgctcttgcagggttactatttattttaatgattgtaaatatggtaatgaaaaatgtgcttaatatagatgcgtcaggaataataccatttttagaatcaatagaaccagtgaaaacagcatttacagtatgtgttgctcttattgttgcagcagtacctgaaggacttccaacattagtcaatatgacacttgcagtaactatgaataaaatggcaaaaataaatgcacttgttacaaagaaagaagcttgtgaaactataggttcagtatctgtcatatgttcagataaaactggtactcttacacaaaatagaatgacagttgaagtggtatataataacggtggatatatggatgatgccgaaaaaagtggacaaggatattttcttgaaaattgtctgcttaattcaacagcagatattgaagaccttgatggaacttataaatatattggaagtgcaactgaatgtgctttgcttctttataacaaagatgaagattacagagagtatagaaattcatcagaaatagtatctcaaaaaccttttagttcagaattaaagagaatgacaacaataatacgagaaaatgacgattatatactattatcaaaaggtgctccagaaataatattaaatagatgttcatacatacaaaaggaaaacaaagtaatggaattaacatctgaagtaaaaaatgaaatcttaagggaaatagaaaagcttcagataaaatcaatgagagcattaggatttgcatacaaaaagattgaggcaagcagtttagaagcagcagcagaaacgttaaatgatgcttcttttgaagaaagtgatgatggattagtatttactggttttgtaggaataagagatcctttaagagaagatgttaaagaatctgtttatacagcaaataaagctcatgtagaagttaaaatgcttacaggtgataatatagtaacagctaaggcgataggagacgaacttggattattaaagaataatatgagggcagttgaatcatcatttatagatacattatcagatgaagagctacaaaatgaaataaagacaatatcaattgttgcacgttcaaagcctgatacaaaaatgagaatagttaatgcactccaaaataatggtgaagttgttgctgttacaggagatggtataaatgatgctccagctttatcaaaagcagatgttggtatagctatggggatttcaggaacagaagtatctaaaagtgcagcagatataattttaactgatgatagtttttcaacaatagtaaaaggaatacaatggggaagaggaatttatgataatttccaaaggttcatacaatttcagcttactgttaatataatagcatttttaattgcaatattatctcagattactgggaaagaaatgccgtttacaacaatacaacttttatgggttaatataataatggatggtcctccagcccttgtacttggattagagccagtaagaagacatgtattaaaaagaaaacctgtaaatagaaatgcaagtattataacaaagcagatgattacaacaatagtattaaatgctctatatattacaggtgtgttacttgttcagcagaactataatattcttggagcttctaatgaacaaatgacaactgttatgttctgcacttttgcttttagcgtgctatttaatgcatttaatagtagagaatttggaacagacagtattttcccaaatttcatgaaaaatacacttgctataaaggttattatattaactggaattggacaaattatgtgtgtggaaatatttagagatttctttaattctgttcatttagattttattctttggagtaagatatttatagtaggagcaagtattgtagtagtaaatgaaattgtgaaatatatacttagattattcaaaaaataatatgtagtgtaacttctttataaacctgaatgttttattttgaatatttaggtttattttttatattaaaaatcgaaatatgagtaataagtatgaattattagaaaataaaaaatattacatatatattaaatcatatggataaaaatgtacctttgtgttaaattattaatatatcataataaatatgatatacatcgtttagaatgttaatggagggatattatgtcaaagtataaagtaggagaagaattaatcgttgtaacagatccaaacaaagaaactgaaaagtttaaaaaacttactcaccttactgttgatggtgattatgctcaaatagcatggggattaaaaatagttgatgttaagtttgaaaaaccatatgtaacattaacttatactaatgctaatggtgcattaaataaagtttttgcagaatgtaaagatgttgcaaactttgatactgaaaaagttttagaaaaagcattattaaaagcattccaaaacgaaataattaatataactacatttaaaaataattagtagttataaaaatggaatgaatatgattgcatttcctcatattcattccattttcttttaaaggaaatgataaatagcagattggggtgttattaaaatgaaatgtgatacaagcataatagtaaaagaaatgattaattattatgcaaaggatgttaaaagaataaatcattttttgaaggtatattcctttgcaaaatcaattggtgaattagaagcacttgataaaaatactcagtatgtattagaagtagcagctataatgcatgatataggtataaaaataagtgaagaaaaatataactcatctgcaggtaattatcaagaattagaaggaccgcaagtagcaaggactatgcttgaaaaacttaatgaagatgaagatgtaatagaaagagtatgcttcttaattggtcatcatcatacatatggcagtatagataatattgattatcaaatattagtagaagctgattttcttgttaatatttttgaagataaaataaacaaaagtagtatttcagtaataaaagataaatattttaagaccgcagcaggaattgaatttttaaataagttatatatataattttaaacagagcagttctaaaagaacagctctgtttaaagtactagcatatttcagcatgcatatcaatgtgcatgctttttttagacatatatacatagtaattgtatgcatctacataatattgaagaagatcagatctatactgagcaacattttttaaaaaatcatcaaatatatttaaattaacaaggatttttataatgtctttgggataaggtgtatttttagtaaagatttttcttgggtcaatcacttttatattttcatttttatctacgaaaatatgtgcatttctgatatttaatcttttgaatttcattttcttaaaatcttctataagatcgattatttcacaagaaagtttgtaagaaataccattttttttcaaatgttcaaataatgtaacgccatcaacatattctctaagaatcatattgccagcgataaaaattactttaggaaaaaatttacttgttttaaccagctctaatattgatacttcttctttagcttttttctttttgaggaagattttaagcgcatagccttcaggagttaaataaacagaaccttcatggcctttgcctaaaaattcacattcttttatatctaagatgtatctcatttcataccctaaaaatattactttttatatactatgcattaggttgtataagttctacttaaagtatatagaaagtaaatttgaagactaaaaccattatattatgaatttcttcatttaatttatagatgttaaattaaaaaaatgattatattttaaaaaaatacgtaaaataaagttgaaaaagtaaataatatctttgagttaatggagtacttaatgtataattgtatttgaaatttaagttaaggttaaaacacgaggagaaaacatgatgaatattattatagttggtgcaggtaaagtaggttatgcaatagcgaaaaatctttctacaggaaatgataatgtaactattatagataataaaatgactgctttagagcgaataaataataatttagatgtaatgtgcgtaaaaggtaattgtacaagtttgaaggtgcttaatgaagctggaatagaagaagctgatcttttaatttctgtaacaaatagtgatgaacttaatatgctttgttcactagcagggaaaaaacttggtgcaaagcatactgttgcaagagttagaaatcctggatatgatgaggatattacacttcttacagaagctgtaggtattgatcttgtaataaaccctgaaaaagcagcagcaggagaaatatcaaaattaataaaatatccatctgtatgtagcattgataattttgctaatggcagagtaaatatggtgggttttgatataactgaagatactggacttgaaaataagaaaatttcagaacttggttatctaagaggtaatgtacttttttgtggaatcgaaagaaatggtgaaatgattgttcctaaaggagattatatctttgaaaaggatgatcatgtatatgttattggagaacataaagatatacaggaaattttcaagaaattcggaaagtatagaagaaaagttagaagttctatgataatcggtggaggtagaattggatactatcttactaagattgttagtgaagcaggtgtacattgcaaattaatagaaaatgattttaataaatgtgaagaacttgctgaactgattcctaattcagtaataataaatggagatggccttgatcaggagcttcttttatctgaaagtctagaagaagcagacagtttcattactttaacaggaagagatgaagataatcttatagcttctttatttgcggctaaaaatggtgttaaaaatataattactaaagtaacaagagataattataatgaaattgcaaagacaataggaattaattcaacaattaatcctaaatcagttactgcaaataaaataatcaagtatgttagaactcttaaaaatagaaagaaatgtccaatcgaaaatgtatataaaatatgtaatgaaaaagcagaagcgatagagtttattgtaaaagaaaatgcacaatacataaatataaaaattaaaaatcttaactttaagtatgatagcttaattgcaacaattgtacgtgaaaataaaacaatcatacctagtggagatgatattttaaaaccaggagatagagttgttgttgtaacaaaagatacaaatcttttaagccttagcggtatatttgtcggaggaggcaagaataatgaattataaagcagtactgagtattcttggcaatgtagtcaaatatatggttgcacttttatttgtaccattattaatagctttatattatggtgaaggtgatgcaaaatcatttttgttaactattcttataggagcaccaataggtttcatattaagtaatatcaaagcagaaaagaaagctatttatgcaaaagaaggatttcttattgttggatttgcatggataataatatctgctattggtgcacttccatttgtgataagtggtgcaatacctagttttatagatgcattttttgaaacagtttcaggttttacaacaactggagcaacaatattaacagctatagagggtattccaaaaggtatattgttctggagaagttttactcactggataggaggaatgggatttcttatttttatgcttgcgcttattccatctcttggaagtaattcaatccatcttcttaaagctgaaagtccaggaccatcaccaggtaaaatagttcctaaaataaaagaaacagcaaagatattatatttaatatattttgcactaactttaattgaaggaattcttcttatgtgtgcagggatgaatttgtatgatgctgttatacatgcaatgggaacagcaggtaccggtggattttcaaatatgaatgcaagtattgctgcatttaatagtcctgcaatagaatggataataacaatatttatgcttatatttggtattaattttgcattatattttcagattttaaaaggtaattttaaaggattttttaagaatgaggaattaaggtattatttattaattattgtaagtgcatttatattaataactgtaaatataataagtttaaatggtggagatattatactttcaataaggcagtctgcttttcaagtctcatcaatagtaacatctactggatttgctacagtagattttaatttctggcctactttaagtaagctgataatagtaatgcttatgtttgtgggagctatggcaggatcaactggaggcggaattaagactgtaagaattgtaataatgcttaaagctattaaaagagagattaataagataatacatccaaagagagtaaacagtgtaaaaatagatggaaaaactgtagatgaagacataatacatggagtgtttttatttattggtgcgtacataataataagtcttatagctatttttataatatcttttgacaattttgatgttgttacaactgtaacatcagtaataacaactatgagtaatataggtccaggtcttgaagttgtagggccagcagggaattttgcagctttttcaccacttagtaaattagtactttctttctgtatgcttgcaggaaggcttgaaatatatccaatgttaattatgttcagtccttcaatatggagaaagaatcactaaaattttatggcttatatgattatgaagacacctctgattgattttttattaatcagaggcactttttttcatgaataattgataaaataaaatatagtaatataatgaaattagaataaatatataggtattaaataaataataaaaaaaggaaagtataaggagaaaacaatggaagaaagattacaaaaatttatggcatcgtgcggaattgcatcaagaagaaaatgtgaggaacttattcttcttggaaaagtaaaggtaaatggtaatataatagaagaattaggatttaaagtaaatcctttggaagatatagttgaatatgatggaagggttataactaaggaagaaagaaaggtttatataatgctaaataaacctgaagatgtaataacatctgttaaagatgaaaaagataggaaaactgtaattgatatagtaaaagttaatgaaagaatttttccaataggaagattggattatgacagtagtgggcttatacttcttactaatgatggagaattatacaataagataattcatccaagagtagaacttgataaaaaatatgtagcagttgtaaaaggtgaagtatcacttgatgataaagaaaagtttgaaagtggaattgatattggaggttatataactgcacctgcaaaacttaaaatgcttgaatatagtcataggaaagatttatccacaattgaggtgtgtattcatgaaggaaaaaatagacaaatcagaaaaatgtgttctgcaataaatcatgaggttatgtcattaaaaagagtatctataggaaatattaggcttggtcagttaaagaaaggtgaatatagatatttaaatgatgaggaaatgaaatatttaatgtcactataaaaaaataattaaatcttaaagtcaattttacagtaattgaaagtgattatataaaaacttgcatatgattaataaaaaagcgaaaaataacttattttattgaatattatggattataatgatagaattaaattaaaagtattcaattgattattaggaaggcaaattatggaagaattaaataatgaaaacagcaaagatttaatgagactaatacaaggaaagtttataagacttagtaaaggtcaaaagctcattgcagagtacatactaaaaaattatgataaagcagcctttatgacagcagcaaaacttggtaatgcagttggggtatctgaatccactgtggtaagatttgctatagaagttggtttttcaggttatccgaaacttcaaaaggctcttcaggaacttataaaaaataaacttacaacagttcaaaggcttgaactacgaaatgattatttttcagatggagatgcacttaaaggtgttttaaaagcagacatggaaaatataagagccacattggagaaaattaatcaaaatacatttcaagatgttgtacaacatatttttgaagcaaaaagaatatatataataggattaagaagttcaacagcactagcagaatttttaggtttttatttaaatataattcttcaaaatgttaaagttgtgagttatggaatttcagatgtttttgaacagatgataaatgttggagaaggggatcttgttattggaattggatttccaaggtatgcagcaaaaacaatagatgctttggaattttctcaagatagaggtgcaaaggttgttgcccttacggacagtcttctttctccacttgcaacaaaagcggattatacattaatagcacaaagtaatatggcatcatttgttgattcacttgttgcacctctttctgttattaatgctttaataatagctgttggaatgagagaaaaagaaaatatctctaatgtattttcaaatcttgagcttatatggaagaactataatgtgtattcgataaataataaaaatgtagcagatgattaattaaatatgagtagaaaaaggttttaaaggacgctagattatggcagctttagaacctttttaactgtgaagatgaaagaggtgacaatatgaattataagttgaaaataccatctgatgttcaatatataattaatgttttgattgaaaatggatatgaaggatatatggttggaggctgcgttagagatcttcttataaatagggaaccaaatgattatgatattacaacaaatgcaaagccagaaattgttgcacgtctttttgataaagttattttaactggattaaagcatggaactgtgacagttataattaataaggtgcaatatgaggttacaacgtatcgagaggatggagagtataaagatagcaggcatcctgaaaatgtgaaatttgttactgatataaagaacgatttatctaggagagattttacaataaatgcaatggcatataataaagaaaagggactaattgattattttgatggattgtctgatttaaagaataaagtaatacgaactgttggaaatcctgaaaaacgatttactgaggattccctaagaatgcttagggcagtaagatttgctgtacaacttgattttaaaattgaagaagctattatacagtcaattaaaattcttaataataatctagaatttatatcaaaagaaagaatcagagaagaatttaataagataattcttaataatccaaatggtttaaaattattacatgaatgtagtattctaaaatatattgctgatgacttggataaggcctatgattactatataaatgataaaattaaatgttataatttatatgaacatttaattttatcatcgtgcaatataaaaaaggatttatccttaaggctcacaatgctttttcatgacttaggaaaattaaaggattggaataacaagttagaaaaagtagataatatttttatagaaagtgcttgtatggcagaaaaaatattaaggtctttgaaatatgataatggaacaattaagaaagtaaagacgttgataacatatatgcatagtgatttagaagataaagtttcaataaaaaaattacttaatataatagatgtagaattattcgaagatcttattaaagttaaaaaggctcacataatgtctgaaaacattgaagaagttaagtttttgaatattgaaaagctttattgtgacattcttgaaaaaaacgaatgttttcgtataagggatatgaagattaatggtgaagatataattaaaataggagtaaagaaaggtaaagatgttggaacaatgctgaattatcttctttgtaaggttattgaagataataatcttaattataaaaaaaagcttttagaattggcagaagataaattaagtatgaatatctaaatattacattttaataatatttagatataaactatgtaaaaatagttggacttatattataataatactataatttggtgaaattattagtaagtatataaggaaaaaagttaagttttatattgggctggatatttatgttaggagaaagatcaatgaaaaaaattaccaattgtatggagataagcgtcaaagaatgcttagataagcttatagaagagagtaatggatgtaaatgcgaaaagtgcagatatgatatgatggcaatagccttaaataatttaaaaccatattatgtaactactcatttaggtgaagttataactaaaataaaaaacatggaacagcaaagtgaagcgaatatagttgttgaagtcacaaaagctattaaaaaggtacacatgtcgcctaaacattaatatgaatatttttggagtgtataaattttatttggtctgtttagttttgaattaagctattaaaatgaaaggttattcctattttaatagcttatttattttatatagttatataattaaatgtaaatattgtaagtactatattatgaggtgatattatatggagaaaaaaaagaatctatatatgcttgttggagttttgatagtagtagttccacttgtgatttgtacaataatatatatggggtacagctacactcataaacctgaaaataaatggcaggaatatactgaacttcttcaaaataaagaatatgataaaatgtacgatttaatcgacagtactgctcaggcaaaaataagcagggaagattttgttgcaagaaataaaaatatttatgagggaattgaagctaaagatataaatataacaattaaatctatttcaaaagaagataacgatacattgataaattacaatactaaaatggatacaatagcaggtgaacttgaatttgacaatagtgtaaaaattgcaagtgaacttggaaaaggccatacaataaaatggacgtctaaaaatatttttcctgatttgggtgaaaatgataaggtgcgtgtaaaaacattaaaaggacgacgtggaaatattactgatagaaatggacaacttattgctacagattcatatttatcaaatgtaggcgtagttccagggaaattaggagataataaagaagaaagtatagctaagattgcaaacatactaaaatgtagtactgaaactataaataaagcactaagtgccaattatattactgatgatatgtttgtgccaattaaagatataccatatggagatgcaaaagtagttgatttattaaaagtaccaggtgtaatgataaaagaaaaagattctagagtttatcctttaggaagagatacagcgcatataacaggatatgtacaatctattaatggtgatgaattggaacaaaataaagataaagactatactgaaaattcacttataggaaaagcaggccttgaaaaaatgtatgaagattttttgagaggtatagatggtgctgaaatatatattcaaaatagtgaaggtgaaaaaaagagtgtggtattatctaaagatgccagaaatggtgaggatttaaaattaacaatagatattaatgttcaaaaaaaagtaaatgaggaacttggaagtgataagggatgtgctgttgtaatgaatccagaaaatggtgaagtattagcgctatcaagtacaccatcatatgatcctaatgattttattttgggaatgtcacaagaaaattggaacactttaaacaataatgaagataaaccattgtttaatagatttcaggctacatcagtaccaggatcagcattaaagccaattatagcggctattggggttgatagtggcagcgtaaagccagatcaagtaaggaagattagtgggttagcatggcaaaaagatgaaagctttggaaattattatgtaactaggacaagcaatatagaagaagtaaatttggaaaatgcactggtttattcagataatatttactttgcacaaattgctatggatatggggagtaatcttatagaggaaaaactaaaaagttttggatttggagaaaaaataccatttgaatttgcactatataattcacaatattcaaacgatggaaaaataaaagaaggtgctcaacttgcagatacaggatatgggcagggagaagtaatggtaaatcctgttcatttaacatcaatgtatagtatgtttcttaatcaaggaaatatcattgaacctcatttggttatagataataaaaataataatatcatatggaaaaaaagtgtagtctcaaaagaaagtgcacagatagtacttaatgatcttatacagatagtagaaaatcctgcaggaacaggacatgaagcatataattcaaaattaaaaattgcaggaaaaacaggaacagcagaaattaaaaatagtcagactgataccagtggaactgagcttggatggtttgtaggtatgacaacagaaggcgataataaggttcttgtaacaatgatgattgaagatgtaaaaggaagaggcggaagtcattatgttgttcctaaggtaaaagatgtgatagaaagtgtatcattaaaacagtaaatataagattttataatatcccttgtaatatagatcaggtaaatttctatattgcaggggatatttgatatttgaaatattactataatttgcattataaaaataatttaaatttaagagaaaaatatcaataacaaagtgtaatttataaaaaagagaatatacaaaatttgtggaaaaatgtagaatggtatgatattattatatttgttaataaaaaattaatattagtaatattacatatttttagtgacagtcagtatacttaagtttagtcagaaaatcataagagattcagattatgatataagaaaaggaagtgataatcattaataaattgaaaaataccattttaaaaatatcagttattttttttattttaaatctgtttacaagtattagtgtagtaaaagctgaggcgtatagcaacatagtctttaaaaatataaccattgaagacggacttgcacaggcaactgttgaatgtatgattcaagacagcaggggatatatgtggtttggaaccaatgatggattaagcagatacaatgggcatgaatttgaagtatatagaaacgaaattggtgtagacaatagtattgtaaataactatattgtatgtatgaatgaagacagggatggaaacttgtggattgggaccatagatggagcaagtaaaattaatttgtctaccaacgagataacaaattataaaaattcaagtggattatctaacaataatataactgaaatacttgttactaaagatggagaaattctattagctacaattgatggactgaatatatatgataagactaatgatagatttacaagaatattcaataatgagcatcttaaagatcaagaaatttattctttagatgaagatattaatggagatatatggcttggtggctcaaagaatattacaaagataaatttaaaaaataatacttgtgaggatttttctgatataaataaagagtatgaaaaaattaatgactgtgcttataaagttttatgtgatgataaatatatatgggttggaacaataagtaatggtttgtataaaattaacattgaaacttcccaaatagaaactattaatttaagtaatagcaagatttcaagcaataacatacatactattatgaaagataaaaatggaataatgtggattggtacggattctggattagtaaaatatgattctaaaaatgatgagtataatacctatgttaataaagcttacgataaatattctttagttgacgattatgtttactcagtgatacaagatagaagtgggcttatatgggtgggaacctatgctggagtaagtatgtttgaacctgaaaataagatagaacactataaagtagatccattatcacattcaagtataaatgaaaatcttatacatggtatatatgaagatgatgatggactaatatggattggaacaaatacaaaaggagtaaatgtattagatagaaaaaatgaaaatatatatgatatatcagagtttacaaatggaactgcattaagcagtaattcaataaatgatattagtggacatgcaaataaaatctttattgcaacaaacaatggtttaaatatatatgacaaaaatacaagaaaaatctcagtgtataatgaaaagcaggggcttaatgcaaaaaagataaggaatataacatatgatgattctggtgtattatggattggtacaacaaatggaatcaatatattgaatttagaaactgatgaaatcacagatttaaattatattttggataaatactcattagatgatagatattcagaatgtattttcaaagatagcgaaggattctattggcttggtagtttcttaaatggtggattaataaaaatagatccatacaataatactgctattcaatacaagcatgaaggaaaagatggtgatttatctaacaatactgtaagaacaattattgaagatgatgagaaaaatatatgggttggtacaagtggaggacttaataaattagataaagaaactggtaagtttaagacgtatacaacaagtgatggacttgctaataataatatatatggtattgtaattgatggaactggaaacttatggatgagtacaaatcttggtatttcaaaattagatagagaaaaagatagattttttaatttaaatataactgatggtttacagagtaacgaattcaatggtcattcttatggaaaattaaaaagtggagaattaatttttggtggtataaatggattaaatatatttaatccagatgaaatattgaataatatgtatatacctagagttgaatttgatagatttagagtaaatggtagaactatagatacattacaagatgctaagttgaattataatgaaaatacaattggaattaaattttttctaccggattataaaaatataaaaaatatacaatattattattcattagaaggagccggtaatgattggtctctagttaatactaatgaacttgtcttaagcaatcttggaagcggcacttacatttttagggtgaaagcaagaaatagcagtgggatttttagtgaagaaagtagtttcaaatttactataaaacctccattttggagaagtgctgaatttatattaatatatatattgataggtgtaagtttagtagtattaatagttaaaagtaaaaatactaagatgagattgttagatgatatggtaagtaagagaactagagaattaagtgatgaaatggaaaaaaatacagaattactaaataagatcataaatctagaaaaaagaaaaaatgcatacttagtaaacatatctcatgatttaagaacaccattaaatgttttatcgtctattcatcaacttataaaccaattaaataaaagtgaatcaggtattgaaagagaaaaacttgattattacatgaacatatttggtaagaacgttgatagacttcttaaattgataaatgacttgatagattcatcaaagatagagcatggcaattatcatataaatataggcaagcataatattgtttatattgtagaagatacagcactatcacttaaagattatgttgaaagtaaaaatatagaattaataatcgatccagaggtagaagaatgtttcattgaatgtgattctaatgaaatagagagatgtataataaatcttgttaataatgctgctaaatttacagatgaaggtggacgtatattagtatctgttgttgaacttgaaaatgaagttaagattatggtaagtgatactggaataggtatagatgaaaaacatcttgaaactgtatttgatagatttaatcaagtaattgactctaataaagaaacaaaaggtggaagtggactaggtcttacaataacaaaacttattgtaggattacataatggaaggatatttgcagagagtgaaataaatgtaggaagcaaatttacaataatacttcctaaaaaacagccaaaagaaaaagttgaaaaaatttaaatatagaaacaacttcaacctattatttagttaaaaaattatataggttgaagttgtttttagtttaacttattttttaacattatttgaattaaaatcacgctcaaatagtgacattttttgtttatctttaaaatcatcaattgaattgattccaatttcttttaagatattatcaagagtttcgctgtgtaatggtacttttattggagaatcaaatgcaaaattatcaacttgttgttttcctttttcaagaggtataagggttttgggaccaccaacgcaaccacctttgcatcccattccttcaatgaaatttgaatcaagttctttatttagtgccttttcaagaatttctttacattctttaacacctgaagcagtacttgatttaaaagacttgaatttatctggataaagttcctctataatgtctgaaacagcagttgatacaccaccacttctagcatacatcctaccacctcttgaagtataatcttttgatggtattccctttaaagatgataaatctatttttaacgctttaaaaatttcatcaagttcagcaaaggttaaaacaaaatctatgacatcctttaaatcattttccttagcttcagctttttttgcaatgcaaggacctataaaaacaacttttgcatcaggatttattttttttattatacgtccagctgcaatcattggtgaaatagagggtgatagatcttttactaatgaagtatatactttttttaacatgccaacccacatagggcagcagcaggatgttatcataaggtctccatctttatttacatgtttatcaaattcacatgcttcttttatagataatatatctgctgcaaaggcaacttcaatcatgtcagaaaatccaattttaataaatgcttctctaagcatatccattgtaacattatcgccaaattgaccattaatggctggtgctactgctgctattactgtcttattttcttttatcaaattcattacaggtataaactcaactttatctaagattcttccacctttacaactgtcaacacatataccacagttaatgcagatatctttgcttatgtatgtggttttattagtagtatcatattttattgcattaaaaggacaggctgcttcacatgtaaatttatcgtccttactctttatacaatttactccagaacattcaagtttctcaacaatacgcttattcacagagtacattgttattgctttttttagattataaatataattattatcaaattcaatatttacgccacaaagtgatgttatgattttaaaagtttcctgaggtgatgattcatgacataccataatacgtgaaagagtttcatcaaaattaccatcatagtatgcttgaataagttcatgaaataaatcagtatatttactattcatatataaacctccataatataagttatatttaatcaaattgaactaagatttcttttatagtaagctgtagtttataatgtattttttataataaaataaaattcttacatatctttatgcgataatatatattttatgtaagtagagcaatattttattcaagatttaatagagagttgtaaaagataataaatatttctttaagaaactggataaatttgatataattattaatatgatagaaaataagatttgcatttttgagtttaaatttggttgatttctataaatataactaaatttttttgtgtgttaagggggatattatgataaaaagaaataataaaaatatagctctttttttgagtacactaataacattagctccagttgcagcttttgctgatgataatgtaagcaatacaaaaggacaagctaatacaagtagtattgaaaaaaattctgaaattaattcttccaaagagaccgaagaaaatatcagatataatgtaggttgggtacaaaattcagatggaagctattatctttatgatggtttaggtgacattgtgaaatcatcgtggtgtaaagtagggggaaaatggtactatcttaaagatgatggaaaaatggcaactggatggataaaaaatgaagggtcatggtattatgtaggccagtggggtaacatgcataaaggttggataaaagatggcggtttgtggtattatctaaatgaagatggaataatgcaaagaggatgggtttatagtaataattcatggtattatctaaatgaatatggagctatggtaacaaatgccactattgatggatataaacttggaccagatggagtatgtgagtaaaaactttataataaacatattataaaaaatgtatctataatgatggaaaaagtatgttataatcagtaatttataaattaaaacctaagaataagtatcattcaacttattcttaggtttatttttattttaaaaataaagtgaatttttaaatatatttagtaacttaacattgatttatatttgtaatttcagtcagttttatgaagatatagtttttaacataataatcatgattctatttagtttttgttaaaaataaaacttaattttaagaattaaaaataaatgtcttaaattcattatgaataacataattatattaatggagataagatttggaattataacatattcaatataagattgaaagaagttttattttataagcatagcattaaaattattttctttcaaacaaagaaaggatgtaataattaaatgaacgaatttatgtatgagaagagtacaaaaataagctgcattttgttaattgttttatttttaatatatttcttaggagcattttattttaaaactcatttctttttcaaaacatcagtaaatggtattgatatatcatttaagacagtagatgaagcaaaagatatagtatataatgaactttctgattttaaagttgtaataaaagacgatagcaatgaagataaaattgaatcaaaagatattaatctagagtataacggagataaaaaaatagaagaaataaaggaaaagcaaagtttttttaaatgggcctcagcattaatttacaataagcaatatgagaatttggatatttttacatatgatgaatcaatgcttgaggaaaaagtgaaagatctaaatttttttaaaaatttagatgtaattgaacctaaaaatcctcaattccaatatactgatggaaaatatattgtgttagaagaggtaaaaggaaataaactaaattatgaaaaaacagttaaggctataaaaagtgcaattgagcatggtaataaagttgtggatttaaatactactggatgttatgaaagacctaagtatacaaaggattcagaaaaagtaaaagaagtaaaagatattattgataagtatgtttattcaaagatagtatattcttttgatgaacttatggaaacagtagatggatcaataattaataaatggattgatatagatgatgatatgaatccatctataaatgaaaaaaaagttaaagaatatatagatagtttatgtgaaaaatacaatacagtaggtaaagaacgtaagtttgatagtagcattggaaaaactgttattgtaaagggaggatattatggatggaaaattaattctaatgaagaggttaaagcacttattgaaaatataaaacatgggcaatctgtttttaaagagcctatatattctcagaagggattatcaaggagtgatgatgatattggggatacgtatgttgaagtcaatataacaagacagcatttatggttttataaaaatggaaagcttttaacacagggggatattgtaactggatgtcaaagtaaaaatacacctacagctgaaggtgtatatgctctgaactacaaacagaaggatgcaacgttaaaaggtgatggatatagttcaaaagtttcttattggatgccctttaatggtaatattggtttacacgatgcaaggtggagaagttcttttggaggaaatatatataagactaatggaactcatggttgtgtaaatatgcctcaatatcttgcaaagataatatttgaaaatattgaatcaaacacacctattatatgttatagtgaggacactaaaaataataactaattttaaattagaattttttctatcattaagaaacagcctgtaaaatatgcaggctgttttttattatattttaggaaggaatatagtatcacctaatggaagaatgtcatttttataatcattaataaaaattaaaagcttcataatagaatctatatcgtatactggataatatttttcgcatattttactccatgtatctccttgcgaaatcgtatatatacttccatttttcattgttgtttctggaatttttaaagtagttccagctttcacatcattagtagatgtaatattattaagttcctttataagctttaaggatgcattaggagcacatgttgaattatacctcattaaaatatcgttaagagtttcgttttctttcactaaatagctagagcattgttggttgtttataaattcacgtattgttatatgaaccgcatttgagcatggaattacaaaatcatcactgttgttattagagttttcataattattgtttgaatcactattttgatttgcatcatttgaatgtatatcaaatgaattattgttaggacttattgacttattacttttaagtgaaggtatgaattggcatgataaaagtaatattgaaataagtgctgtaaataaaaatagataataatattttttcaaaattaaacatctccaagcatatttttttataattattgccgtatttttataaaatattcaaaaaatatagaaattaaaaaaataataatttataaaatgttttaataaaaatatgtcatctagataatgaatattttaataaaaattgtacaaaatttataaataagaagaatttaattattgattattgtaaagctttaaaataatcagttattttaattactctaattttaaaaatataaaaaagaaaaagaggtgtaagtttgtttgaatttaatattggtgataaagtagtgtatcctaatcagggtgtaggggttatagatctcatcgaggaaaaagaatttaaaggcaaaaaggaaaaatattataaaattcatttaattaataatacaatgaagttatcactcccgcttagtagagtaaaatcagctaatatgagacatataagtgattcaaaaactttagactctaaattaaataatataaaatactatgttaaagaggttgataaacttgctaaaaccaattataaagaaagaaatgaaatatattcgactaaagttaagtcaggtacattagaagatcttttagagataataagtaacttgacagaattaaagacaattcatgatttaaattccatggaaaaaactatcttaagaaatacaaaaagaattctaatagatgaaatagcacagtctaaaaaaatatctcttgatgaggctggttatcttcttgatatattcatgaattcctaaactataattatatttttgtagtctgaaaatattcagttacttataaaatttgtaactaactgaatattttttgctatgttattaataatatataaaatagtaagctttcaaatattgtttgttaggagtggatttttatgattagaccaaaaccattaaaaaaaggtgatacaataggaataataggtacatgcagtcctcctaaaaaggaaagaatagatcctgctataaaatggattaaatcactagggcttgaagtggttattggaagaagtgtaaatgaaaatcatggatatttgtgtggagaagataaggtacgagcagatgatcttaactatatgttccacaataaagatattaagggaatatttattgtaagaggtggatatggagcagccagaatactcaatatgattgattatgataatataaaaaagaatcctaagatactagcgggatatagtgatgttactgcactacatatagcaataaatcaaaagtgtaaaatgataacatttcatactcctatgccatgtactgaattttatacagatatagatgattatacagtggaatcatttaaagatagtatatttaaaataaattatacaaaaaaagtagttaatcctgataagtgcaagagttttgaaggtttagttaaaggaaatgcatgtggacggattactggggggaatttatctattatagcatcacttatgggaacaccatatgaaattaatactaaaaataaaatattatttttagaagatattgatgaatcaccatacaaaattgataggatgcttactcagcttaggctagcaaataaatttaaggatgcagctggtattattttaggttcgtggacaggttgtgatgctaaagatacaagtagaagtttaagtcttaatgaagtatttaatgaaataataatacctgaaaagaggcctacaattatgaatattgcatgtggacatactcttccaacaatgagcattcctcttggaagtaacatatcaataaatgcagatagtcttgaaatattgaatatagataaagattaaataaaataagaatgagatacctaatttggatatctcattcttatttagtgattaatgtctatagcattagatagtttattgtattgatcacaaggtttaggggatttttctcttgctaaaatggttgttgagattataataagtgaagttcctaaaattaaagcaaaagttaatttttcatttaagaatattattcccattatgatactgaccacagcttcaaaagtggctaaaatagaagctgaagttgagccaatgagtttaatagcttttagaagaaatagcattgatgcaatagtagaaataattgaaagaccaagataggaaatcatcatttctaaattaattgtaaaagttaaagattcagtaaaagctccatatattatcattcctaaagatgcaccaaaacatatatacatagttacaactctattatctatggattttatagatttaaaacttaaagaaataacgtttagagcatatgctaatccagaaaaaagcgctaaaagaatacctaaaatattaagagttttactttcaaatgcaattagagaataaacaccaattattgataatactagtgaaaaaattttttcttttgttatattttctttatataaaatgaaactaaatatacaaactagtgcaggataaatatagtgtagagcagtagcaagacctgaatcaaggtaattgtatgatacaaataacgttattgttgttatagtatatccaaacattccaatgaaaaacagaagcaaaaattgcttgactgaaatcttaatactaacttttttaaaatttaaatatagtagtagtattaaaccagaaataagaaatctaaaaagaagcgatgaagttggattagacccatttttgtaagctattttcgcaaaaataggcataataccaaatgctattgaagataaaatagcataaattatacctttgtaattattcaatttattttcccccttgaaaatagtattaataacttaatttttataattaaatacttactagattataaataaattttagaagttattcaataaatattattgaattttaagaaaaatatttaaaaagcaggcacggttgcgcctgcgaaaaatatctaaattaatggaaactttcaaataccgacaatataataagtaaaatgcttgtaattagataatgattagtctttatatattttataaactttttattataaataaagttaccagcaatataaaagaatatacagattagaaaattaaataaaattgttaaaggaagatttatattagtgagacttccagcaatagatggcaatatattattaagacttagtgcaatagaaatattaaaaagatttttaaaagaatcagaataaatatatggattatttaactcaataagatttttgtgttttttgaagttattcacataaaatgaagtatcatatccatcattatctttttgtatccttatatgttcaataagataataaacacctacaaatccaagaagaactgaaccaaaaatattacttaagctatgtgtaaagtatatatctattatttttccaaagcaaaaagcaagaaaagtaataaaggtcgtaaaaatagaagcaaaaagtatttttaaatttagcggcactgaactatcgttttttgaagaaaatgaaatttttaatgtgtctatattaatggctgtacttaataataatgctgataaaaaattcataatctgctcctaaaaatagctttattacaatatatacaatcaagtatttaaatgttctaaatttattaattaagtaaataaagaaagtttgaagattgtgatgattaataaatgtttaaaaaatatttgtattttttaataaaatgcatagaaatacctcgaaatatttacatgtaatcaatattgtggtaaaatacatttaatgttctaaaaattacaaagaggtgattttggtggggttaacaagaaagtagataaagtaattatatttattatgaagataagaggtgtagttgaggggctatatctgagaatataaaaatgaatgtggacattagaattaaatttataataaatatattggggggcactatagatgttaaattataaaaaatataaaagatttgaaacaataaaattaaaggatagaacatggcctgataatgagataacaaaggctccaatttggtgtagcgttgatttaagagatggtaatcaggcacttataaatccaatgactgttgaagaaaaaattgaattttttaatttattagttaaacttggatttaaggagattgaaattggatttccttcagcatcacaaatagaatatgattttttgagaagacttgtagatgaaaatcttattcctgatgatgttatggttcaagttttaacacaagcaagaccacacctaattaaaaggacttttgaaagtttaaaaaatgtaaaaaaagcaattgttcatatatataattcaacttcagtgttgcaaagagatgtagtatttaatatgagcaaggaagaaataaaagaaattgctgtcgagggaacaaagcttgtaaaagaatatgcaaaagattttgaaggagaaattcttcttgaatattcaccagaaagttttacaggaactgaagtagattatgctcttgatgtctgtgaagctgtaatggatacatgggaagcttctaaagataataaagttattataaacttgccagctacagttgaaatggatactccaaatgtttttgcagatcaaattgaatggatgtgcagaaacttcaaagatagagagagagttatattaagtgtacatcctcataatgacagaggaacaggagttgcagacagtgaacttgcactacttgccggagcagatagaattgaaggtacattgtttggtaatggtgaaagaactggtaatgttgatgttttaaacattgcttataacatgttttcccatggagttaatcctcagcttgatattgaaaacataaatgaaataatagaagtatatgaaagatgtgtgaaaatacctgtacatgtgagacatccatatgctggtaatcttgtgtttactgcattttcaggatcacatcaagatgctattaataaaggtatgaaaaaatacaatgaacgccatggaaacatatgggaagtgccttatctaccaatagatcctagcgatttgggaagagaatatgaagctttagtaagaataaattctcaatcaggtaaaggtggagttgcatttgtaatggatcattgctatggatttaaacttccaaaaactatgcagaaggaatttgcagatataattcagaagatgtcagaagttaaaggggaaatatctccatcagaggttatggatgcatttactaaagaatatttagatttagatgttccttttaaattgttaaaatgtacattcactgatatttcagaaatggatggaagtgaagatactaaagctgatgtaattgtcgtttataatggtgagcaaagagttctagaaggtataggtaatggtcctatagactcatttaaaaaagctttagcagaaagtagtttaattaatgttaaaattatagattatactgaacatgctatgagtacaggatcagaagcaaaagctgcttcatatgtatatatggaaagattagataataaaaagaagacttttggtgtaggaacagatagtaatattacaagagcttcaattaaatctatgatgagtgctattaatcgtttatataaataataatcaattaaaaatccctaaaattaatttttggggattttaatgttatattttaaattaaatatgtttgataattaaataaaaaatattgggggtagagcaatgagcatatattggaatgaccatgtaaagacattagaaccttatgttccaggggaacagccaaaagataaaaaatatattaagttaaacactaatgaaaatccttatggaccatcgcctaaggttatagatgctataaaaaatgcagtttgtgatgatttgaaattatatcctgatcctacatgtagtaatttaagtatggaaatagcaaaatactatcatataaatgatgatgaaatattcatagggaatggatcagatgaaatacttgcatttgtatttatgactttttttcaaaaagacagaaaagttttatttccagatataagctacacattttataatgtatatgctgaaatgttcaatgtgaattatgaacatataaagcttgatgataaatttaatattccacttgaaggattttataaagacaatggaggaattatatttcctaatcctaatgcaccaactggaaaatatattgagactaataaaattatagaggttttagaaaaaaataaaaattcagttgttattgtagacgaagcatatattgactttggtggcaaatcaatggttgagtatatagaaacataccctaatctccttgttatacaaactttttctaaatcaagatctcttgcaggacttagagtgggatttgcaattggtaatagtcaactgattgaaggattaaatagagttaaaaatagttttaattcatatacaattgatagacttgcactgattggtgcagcagaagctatcaaagataaaaattattttgatgtaactactaaaaaaataataagaacaagagaagatacggtaaaaaaattagaaaatcttaattttgaaattttggattcaaaagctaattttatttttgtaaaacataaagaatttagtggaaagtatttatatgaaaagctaaaagaaaatggagttcttgtaagacattttaataaagaaagaatagaaaattatcttagaattacaataggaacagatgaagaaatgagtttacttattacaaatctaaaaaaaatattaaaatattaaaatatatgaaaatatcagttaatcttacaattattttaattataattgtaggattaattttttatttggaaaaattactaattaattgagattgaatgtaataaatggtataattattactgttgaaaaatggggggatatcaaatgacatacaaaaaaaatagattattggcattgggaattattactataggtttgagttttatatccacaaatgctaatgctgaaataaaaaaaacagaagtttatgaagagacaatgcaaaatgagaaattattagcaaatgatacttctattaaggaaaaaactcaatctgattacaaaataaaacgtaactggttaacagaagaggtagcatcacaattaaataaagattttaaagatcttacaactgaagattttgaacatattattaaaatagattttagatataaaaaaatagatgacacaatacctgatgaaattgcacttcttaaaaatttgcagtatttagatttaaactattgcagattgtatggtgatattccagaagaaattgcaaatatgactaatcttacacacttagatttaggtgataataaattggggaaattgccagaatctttagaaaagaaaattattgatggagattatccttattgtgatgtagaaggaaatcaattaaggcttgaaaaaggctggcatttattaaaaggaaattggacatatattgacagatatggtgagagacttactggagttcagacaatagataaagtaacttatgattttggagaacaaggtttcataaaagaaggatgggaacaagttgataatatttggcactattatgatagagtttcaggaatgataaaaaatgattggaaactaataaattcaaaatggtattactttaatgctgatggaataatggttacaggacttcagaatatacaaggaactaaattttgttttgcacctagtggagaaatgcttacaggctttcaaaacataggaggatataattattctttctgtgaaagtggtggaatgcagtatggattagttaatgttaatggaaaacagtactattttgatgaaacaacaggtataatggctacaaatactgaaaaagttataaatgggaaaaaatatatttttgcagctgatggttcaggttcaataaaaagcaacgtatggatagataactatacttatatacaggctaatggacagactgttaatacatattatgattattctcattctaatacaaactatcagttatttaaatatatgactgatttaggaaatcaaattagtgtagatagaactgctgtagctcttcatgggggaattacaagcaataattgtgtatattttgcatcagaagctttaagaagagtaggagttggaataccaacatctacatgtaatacttatgaacttgaaaacgaacttaagtatatggggtttgttccttgttatgatttatcacagctcaagccaggagacatagtatttacaaataactatagtcatgtttatatatttatgtgctgggatactgatggatatgcttatattgtggacaaccaatcttataattttgataataaagttttacacaaaagacaagtatatcaggacacatctataactgatagggcaacacatttttattattatcctaattaagataaatattagttatatatttaattgatgagaacatatgagagctgattttttaaatagaatcagcttttcttatataattttataaatatgattaatggtgtataattatatggaaatgttaaaatttaatattatataagaatattaaattttatgaaataaaaaattgagaaaagagttgattgtatgaatattaatgtaaataaagaatatctacttaacacgctaaaagagatattacaggaaaatagtccaacaggattttgctttgaaataattgataaaatagaaacaattgttagtggatttggttattcatttgaaagaaacaataaaggatgtggaataattacaattgaaggtaaagaaaatagtaagactataggattatcagctcatgtagatactcttggatgtatggtaagatctattacagaaagcggaaaacttaaatttacacttttaggaggcccccttgttccaactcttgatggagaatactgcaatataagaactcgtgaaggaaagatttatagtggaacttttttaagtactagtcctgcagcccatgtatttgaagatgcaaagagcaaaaaaagagatccagaaaacatggaaataagaatagatgaagttgtatcgtctaaaaaagatgtaattgatcttggaataagaccgggagattttgtgtttatagatcctaaacctgtaataacagaaagtggctttgtaaaatcaagatttattgatgataaaggaagtgtcgcttgtctattaactattcttgaaatgttcaaaaagaataatgtaattccagattatacaactaaaataattatttctacatatgaggaagtaggtcatggagcatcatctataccaaaagatataacagaaatgataagtgttgacatgggatgtattggagatgacttaagctgcagtgaatatgacgtttcaatatgcgctaaggattctggagggccatatgattataatatggtaactgaccttgtaaatttagcagaagctaataagttaaattatgcagttgatatatatccattctatggatcagatgttggggtagctcttagaggcggaaacgatatacgtggagctcttataggaccaggtgtttcagcttctcatggtatggaaagaactcattataaagcacttgaaaatacagttaaactcatttatcattacttaactaaagaaacattaagataagtaagacttcgaactcaccaaagtttttagggagtgataaaagtggatgtgaaaaaattcactgaagcatcaatgctcagttcagcatttgttgtattgagtgttttatgcataggtttgggatttggatatttaggttatatagattttgttgttccagctttttttggaataatattgctaaagtgtaatttgaaatatacaataatgtcatgtgtttcatctttaatattgataatatttgtaattggagatcttccatcaggtataatgatgagtcagaatatgattttaggcatgataattgcatactttataaaaaaagatgaaagtgtttttgatgatttatttttttcaagtatagccgcatgtattattatgatttttgtggatattaattttagtacacttacaggatatagtttattaaaggagtcaagagaacttatggaatttataccatcaatacttgattcttataaagatttaatattttatttaagtatagcatgccttccacttggaactgttattattggctatatagtgacattactttttgcaaaaagatttaagattttaaatgatttagcaattaataaaagtaatataattaaaaattttaaaaattatggtcagtttatttcatgttcaagaaagaatatttacttagggatatttagtataatttttatttcatttataaatgcatacatagtaatagatagatattcgtattttacaatattgattacatccatacagtatattatacttttcttcatattgcaggattcagtgtctattataacaaaaattatatatgggtttacgaaatctagaggcaaagtattaatttttcagttaattttaatatacttattattttcatatttcaaatttgtaagtagtattatcatattacttaacttatattttgattataaatacaaaattaagctaaaatataaagaaatattagataagtgcataattcaaaagtaattttattttttatagtacatgaaaatatcgtcgtttttatagcgacgatattttatttgttttaataatacaattgggcattaaatattcttacatacttttattttttaccaaatctaataaagaatatgttgtaaactcattttgtgtagaatcattaaattctaatgaaaaagtttttaagtttgagaaatcattattaaatttaacctttttaaacaagctatgaatatagtttatattgaaacttggaattccattttgtctcagcatatctgaacaactatttttacttgggaatagaggaatgacattaccacacttgagaatttttttacataaagaatcgtcaatacaattaccagttgcaacaggaataaataagctatcagaatatttttcataaatgttatgaagataatttaatgaaaatagttcggagccattaattataaaggcgaaaattcccatttttcttgattcagaaattattttatcaagttcattataatttaatgtctttaaaccttgattttttgaattggaatttataatcaatgaacgaggctgagaggaattttcagaaagaaaaatatgatttttctttttagcactaatattgctacctaaaatatttactataaagttttttaatattttatagtctgtattgtttattaaatcatcaacatatgctttgaagtctggaacttcattgtatgaagtttcaaaatcttttatcatatcacatgatgatttatcagaaactaataattttgacatttttactattttgggaagattactttgtggatttttttctaataaagctgcgattgactgaagtagtgtatctttcgctttatcacctatagaatttataaatttcatatattattctcacctttttagattttaatgataaaatagtatattaaaatttgtaatataatatcacaaaatttattaaataataaaaaatataatgaaattttgtattgaagaatgctgataaaatatagtaatcatcttgttaagctaacgttaagactgtcatgataatataaatataagataaaggtggtaaggattttgtatgtatacaatttatgtgaatcttaccgtagtaatatgtttggaggacgttttaaatgaaaagaaaacttgtatctatattaactgtattagtagtgacaacaggctttttggtaactgggtgttcaaaaactttatataacactgaagtatatgaaagtaaaatacctgttacatctgcaaatagtgaaagtattggtaaagttgatacgtatattgagcttggagcatctataaagacagagggttcaggtgttgatattgagaataacattgtaaagataacaaagggtgggacatatagcataagtggtacactaagtgaaggacagatagtaatagaggctacagagctagataaagtttacatagtattaaatggagtcaatataactaattctaaaggtgctgccatatatattaaagaagctgataaagcagtaattgcaatgaaggataatactgataattatttgactgatggaaaaacatatgcatttgaagatgaaaataaagatgaacctaatggtactattttcagcaaaactgatttagtctttataggtaatggatcattaacggtaaatggtaactatgatagaggtattgtaggaaaagatgatattcaaatagaaaatggaaatataactgtaaattccgttggagatggaatacgtggaagagattccattgttgttactggtggagatatagttataaattctggtggcgatggtatgcagtcaaacaatgatgaaaatacagaaaaaggttatgttcttattgaaggtggaaacataaatataacttcaaatgaagatggaattcaaggtgaaaataatgtttatgttagaaatggagagataaaaataaattcaggaggtggaagtgataataatgattctcataaaaatcaaggaccaggggaaaacatgggaagaaatcaagaaatctcaaatacatcatcagaatcattagaagaaagtgcaagttctaagggtataaaagctaatacgggaataataattgaaggaggaatattaaatataaattcatgtgatgattctcttcatacaaatgatagcctaataatagacggaggagcattagaaatacagtcaggagatgatggaatacattcagataatacattggagataaatggtggaaatattaatgtatctaaatcatatgagggtattgaaagtgagagtataactattaatgatggaacaatatatgttgtatcaagtgatgatggaattaatgcatcaggaagcagtacatcagaagaaatgactcctccatctggaaatagtaataatcaaaataatatgtcacctcttgataggaataatttgcaggaaaatgagttttcacaagagcaaaatcaagctgtgaaacaagagagaaacagcatagctaaggaagaacaagcacctggtgaatctaatagtattacacaagataatactggaaataatacacctgattcaagtcaaaattctgatggcgcttcacctaagatgcaaggcactggacaaggagcaggatctggaatgccaggtggtggtggacctattggagaatcctctggtaccggagttttaacaattaatggtggatttatcactgtagatgcatctggtgatggtattgatgttaatggatgcgcaactatgacaggtggtacagtaattgtcaatggccctgaaaataatggtaatggtgcacttgattacgatggaacatttgaagtaagtggaggagtattaattgctgctggaagtactggaatggcacaggcaccgtcagatggttcttcaataaattccataaaacttacattatcttcccaaagtgcagaaaatattgtgagaatagaagatgaagatggaaatgaaatagttacatttgctccagctaagcaatatgcatcaatagttgttgcttcctcagaatttgaaacaggatcaacatataatgtatatgttgggggaagctccgatggaacttccaatagtggattgtatgaaggtggaaattataaagatggtgaaagaattatgtcatttaccataaatgaaaagataacatcatctgtacaggacggagtatctgctcaatccatgggtggaggtggacgtggaatgcgtcatccatagaaaaaatgtattattcaattaaaaaatgctctttcttatgatagggataaaatctctgtcgtaaggaggagcatttttttaccagcttattgtaaatttatcttttgaatttttcattggaagtttaaattggaagaaacgcaaatacttcccgttttttgttattctatcggctattatgtgaaggatatacccaagagaaaaacctaaagataaataatcattccccattaatgtagtactatagcagaaagcaagagttccaagccacttatgtgtaaacattctatgtggtgagagttttccgagtactgtaagtattgaaaataaaattattcctttagagttaagatctaaaattttatttaaggaatatatgtatgaagtattaaattttataccaaaagtataaaataaagcaataataattattataaacataagtactttattaaatacttgagatgctgttgatttgtggctatcaatatcaggtatatatgatccagcaatagctcctaaaattaaaattatcatatcaaaatttatactcatgttaccaagtccaataagaccaataacaagtccaattgaagccgaggttcctattgtcatatgttcttttccactcatttttttctcctttgaatatgtgttatagaaatattatataccgaataagtgttctgctaaagagttttttaaaaaaattatgtccaaaacaaattattttgtaatctttctgcatatatactggttatgaatagtataaattattacatggattagtgttttaataggagtaaatttatgaaaataactgtggatatattttcaggctttttaggtgctggaaagacaatgcttataaaaaaacttttaactgaagatgcatataataaaaatactgtaataatagaaaatgaatttggagaagtgtcaatagatggagaaatactaaaggaaagtaatattgaaattaaagaaataaattcaggatgtatatgctgtcaggtttcaggaaaatttgatgaagctgtacttgaagttataaacaaatataatccggaaaatataataatagaaccatcaggggttgctaaattaagtgaaataataaatatactgaccaacataaagtttagtcatatgattgaaattagaaatgttttcacattaattgatgtaaaaaattatgaaaactatataaaaaattttaaggagttttatgtagatcaaataaaaaatgcttataaaattgttttaagtagaactcaatttgaaaataaggcttatattggcactgtaaaaaaatctataaagaaaaataattctaacgcagatattatatataaaccatgggatgaattaaaagcaatagattttatgaaagaaaatacaataaacagtattaaggaacataaaaatatagtaaagtcagttagcaaggttaacagtgctttaataaagaaaaataccaacaatcatcgtgcagacgatatttttgaaagttatccgattcatatggataaatttatgagtgcagatgaattaaaaagtaaatttgaattcatatcacagacaaatgtttatggaaatataattcgtgcaaaaggaattattgaaaatgatagaggtctgtattttcagttcgattatgttccaaaagaatttaaaataagagaaataaagtggtcaaataaaaaagttatttcgattattggaagcagtctggataaaaaaaatttagataatctttttaaatagctacagatgtactctggtgctttgctatctttaataaaaggatttttaattaataagaaggggggagtagtttgaagattgaagttgaagttgtaacaggatttttaggctatggaaaaacttcttttatcaattctcttttgaaggagagccaggttgaaggagaaaaagtattagttattcagatggaagatggaaataagaaaatatatgagattaatgatgtaaattatcctgtaaaaatatataaatttgatgatacaggagattttaaaaaacgttttggagatgaaattataaaatttagacctaatagaataataattgaattcaatggaacagacaatattgaagatcttatacaaaagttagaagatagagaattaaaaaaattaatgaaattgtcaacgatttattttgtggcagatagtagtaaattattaaataacatagataatttaggttattatataattccatttataaaatattcagatatgataattataaataatacagaaatgatgaaaaatgctgagttgaagaaagagattaatatattaagaggagttaatccgaaagcattcattttaaaagtagataataaatttaatttgtgtaccaaattacggcagtctaaagtaataaataatggatgtttaaagaaatttaaagtcaaacttatgaatttataaacgtattttgaaagaggggaaacttatgagaggaataagagggatatttacttttttgataggtggagctgttatactgactgcatatatttataaaaaatataacattgtattcagtattcatgaaataggtgattttgcaacaatttttacaagtataatattagatgcacttccatttataattattggttcgcttgtatcagcatttatacaaatttttgtatcacaagaaattatagaaaagatgattccaagaagttcagctttaggatatataggtgctggacttattggattaatttttccagtatgtgaatgtgctattgttccaataacaagaagacttataagcaaaggtgttccagtagggttaggtgttacgtttatgctttcggttccaattgtaaatccagttgttataatgtctacgtattatgcattttatgatcataaatcaatggtattagtaagaactttaggtggttttgcttgtgcagttataataggcattattatggatatgctatgcagagatgatagaaatattatttcaggacaagctgattttgataatttatgtaattgtggctgtaatacaattattacagcaggaaaaagcagaattagaagtcttatagaacatactaatcgtgaattactagatataacaaggtatttaattctaggtgcatttttatcaagcatatttcaggttgtagcagcacataaaggatttgaattcataagtgaaaacaaagttcttgttattgtattcatgatgttccttgggtttgcactatctttatgttcagaagctgatgcttttgttggaaagacattttattcaacatattcttttagttcaataacagcctttcttcttatagggcctatgttagatttaaaaaatttaataatgctttcaggagggtttaataaagagtttgtttctaaattaagttttgtaacacttggaattgtgtttattgtttcatgtatttttatgatgtgtggtttataaaagttaagttatttcttagaattattttaatttgatataagttaaatatgttgtaaaccagaaagggagaagtgtaagtgaaaaaattcaattgggatgaatttatatggttcatcactcttatttttatggcatttggattattgtatttggttaattcaggcaaaattcaattttatattggaaacaaaatgattaaatatgtgtatttttcagtgataatgataaccattatatcattatttcaaattagaaacatatttacaccaaaaaataatataaacttaaaagtgaaatatatacccataattttagcattggtaattggaattgtatctgtaaaaagtcaagattcatttagacatatacaattaaataatgttcttattaatgaatatagtgaagatttggaagagaaagatcaaaagaatataatagaaggtagtaaatatgatcaatttataaaaatagatgataataaccttaatatattagaagatattcaagcaagtccagaggaatttatgggaaaagaaattgaaatgtatggttttgtatgtaaggaaagctatttgaaaaatactcaatttgtaatagggagaatcataatgacatgctgtgcagcagattcaaaaattgttggaatacttgcagaaggcaaaaatattgctgaattgaatgaaaatgaatgggttactataagaggctccctaagttttacaactattaatgatgatgatggaataagtcatagagtacctgtgataattatagataatcttactaaaaataataaagtggaaaataaaggggctgtatcaaaacaattttgatactagccgataaaaaaagagaattcataaatttgaattctcttttttgcgcataatattaatatgaacactaataatattatacctatgcatcaaataggtttcccaataaatatagaaaatattatatctgatagtgattcagtaagagtgctttatgatgttatggagggattagattattcagaattaaatagaacttactctactattggtagaaatccagcacttttacctaaaactatgtttgcaattatagtttatggatatatggaaggaatatattcaagtcgtgctcttgaaaaggcatgcaaaagagatataaatttcaaatggcttttacaaggtcaactaccaccaggacacaattctatagatagatttagacgtgaacgattagctggttgtatagaaaatttatttaatcaacttgtgaaaaaacttagagaacttaatgaaattcaatttaaaaatatttttattgatggaactaaaatcgaagcatctgcaaatcgatatacttttgtttggaaaaaatctattgataaatttgaagatagactacaaaagaaaataaaagaaagcttaataaaaatgaatcatgatttgaatttatgtcttattattactaatgctaaaatatcagttcaagatgctaattatattttagatagtatcagaattatgattgaagccaataatattgaatttgtttatggaaaaggtaaaagaaaaagtaaattccaaagatatactgaacaacttaatgaatttattgaaaagcaaaataaatataatgaatacaatagcatttttaatggacgaaacagtttttcaaaaacagatcatgacgcaactttcatgcatatgaaagaagatcatatgaaaaacggtcaattaaaaccagcatataatatccaaataggggtagaaggtgaatatattgtaggagtagacatttcaagtgaaagatctgaccagcttacttttataccatttttagatagattagaaaagaatttaaatcaaaaatatgaatccgtaactgctgacgcaggatacgaaagtgaagaaaattatgcatatcttgaatctaagaaacaagaagcttttattaaacctgcaaattatgaaaagtcaaagacaaagaaattcaagagtgatattagtaagaaagaaaatatgtactataacacagatgaagattactacatttgtgcatctggtaaaaaaatgcttctaaaaggaacaaaaaagaaaaaaacaaaatctggatatgaaactactgttagcatctatgaatgtgaagactgtgatggctgtgaatataagagtaaatgtacgaaagcaaaaggtaataaacaaatacatgtggctaaaaattttatgcgtctaagaacaaattcacttaaaaacatcactacacctaaaggaatacttttaagaatgaacagatcaattcaagtcgaaggagcatttggagttattaaacaagattatggttttagaagattttttatgcgtggaaatattaaagttcgtactgaatttttgttaatggcgtttggttataatgttaataaattgtaccataaaaccattcaaaatcgtaacggtgagctgcttcataagcagcaagcttcgtaattttaaatatatagttaaaatatggataataatgtttatcctttatttgtgttatttcaaaataaaatatttggaaatatatacatgaataaaatttacgtttataagaataggctgtatcaaattgaatttaaaaaatttcaatttgatacagccccttttttgcgcataatattaatatgaacactaataatattatacctatgcatcaaataggtttcccaataaatatagaaaatattatatctgatagtgattcagtaagagtgctttatgatgttatggagggattagattattcagaattaaatagaacttactctactattggtagaaatccagcacttttacctaaaactatgtttgcaattatagtttatggatatatggaaggaatatattcaagtcgtgctcttgaaaaggcatgcaaaagagatataaatttcaaatggcttttacaaggtcaactaccaccaggacacaattctatagatagatttagacgtgaacgattagctggttgtatagaaaatttatttaatcaacttgtgaaaaaacttagagaacttaatgaaattcaatttaaaaatatttttattgatggaactaaaatcgaagcatctgcaaatcgatatacttttatttggaaaaaatctattgataaatttgaagatagactacaaaagaaaataaaagaaagcttaataaaaatgaatcatgatttgaatttatgtcttattattactaatgctaaaatatcagttcaagatgctaattatattttagatagtatcagaattatgattgaagccaataatattgaatttgtttatggaaaaggtaaaagaaaaagtaaattccaaagatatactgaacaacttaatgaatttattgaaaagcaaaataaatataatgaatacaatagcatttttaatggacgaaacagtttttcaaaaacagatcatgacgcaactttcatgcatatgaaagaagatcatatgaaaaacggtcaattaaaaccagcatataatatccaaataggggtagaaggtgaatatattgtaggagtagacatttcaagtgaaagatctgaccagcttacttttataccatttttagatagactagaaaagaatttaaatcaaaaatatgaatccgtaactgctgacgcaggatacgaaagtgaagaaaattatgcatatcttgaatctaagaaacaagaagcttttattaaacctgcaaattatgaaaagtcaaagacaaagaaattcaaaagtgatattagtaagaaagaaaatatgtactataacacagatgaagattactacatttgtgcatctggtaaaaaaatgcttctaaaaggaacaaaaaagaaaaaaacaaaatctggatatgaaactactgttagcatctatgaatgtgaagactgtgatggctgtgaatataagagtaaatgtacgaaagcaaaaggtaataaacaaatacatgtggctaaaaattttatgcgtctaagaacaaattcacttaaaaacatcactacacctaaaggaatacttttaagaatgaacagatcaattcaagtcgaaggagcatttggagttattaaacaagattatggttttagaagattttttatgcgtggaaatattaaagttcgtactgaatttttgttaatggcgtttggttataatgttaataaattgtaccataaaaccattcaaaatcgtaacggtgagctgcttcataagcagcaagcttcgtaattttaaatatatagttaaaatatggataataatgtttatcctttatttgtgttatttcaaaataaaatatttggaaatattggtgttagtataaagtagtagacacattgagtcgaactaagtaaaataatatttagttaagaaaggatgtgtccattatgagtaagggcagaagatatgatcaggaatataaagatatgatagcagacttatataagtcaggaatgagcttagcagagctaagtagcgaatatggcattgcaaaatcaacaatcaacggctggattaaagatgtgaaagaaattaaagtagatgaaaatgaagttatgacacttaaagaagtaaaagctttaaaaaaagaaatggcaaggattaaggaggaaaatgaaatattaaaaaaagctatggccatatttgcaacaaaaaattagatcaagtaataaaatttatagataacaataaaagtaaccatgatattaagactatgtgtaccgttctaggcgtagccagaagcacatattataaatcttttgataaaactaaatctgcaagaacaatagaaaatgaggaattaaaattagccattataagaatatacacagctaataaaggtatatatggagctcctaggattcatcatatacttgctacagaaggctttaatgtttccataaaaagagttcaaagaagaatggctgaacttgacctttgtgcaataactgtaaaaaaatacaagcttcattcaaataaaaaggtagcagaaggtttagaaaacgttttaaaaagagattttacaactacgtctattaacgaaaaatgggtaggagatattacatatattcatactattagacatggttggtgctatttagcttcggttttagatttacattctaaaaaaataattggctatgctttcggtaaaagaatgactaatgaattagttgttaaagctttaaaaaatgcctattacagccaaaatcctgataaaaataagcagttaatattccatacagacttaggatctcaatacactagtaatgattcgaaagaactatgtaaagaatttaatattatacaatcatttagtaaaaaggggtgtccatacgacaatgcttgcatagaatctttccattcttcaataaagaaggaagaaatctatagaaatacataccgtaccttcgaagaagccaatatagctatatttaaatatattgaaggttggtataacagaaaaaggctacattcttctattaattacatgactccagatcaatgtgaattattagctagaagtgcagcataaaaaaatttgactttttgtgtccaaaatattgacataagaccaatatatacatgaataaaatttacgtttataagaataggctgtatcaaattgaatttaaaaaatttcaatttgatacagccccttttcatattatttatattgttcatcaagaataacattaatgcttccgagtttatttccgtcagtttctgatggaattactgaaatactatatgtgttaaattgatttgtccatgcaagatttgctggtgaaagaacatctgcatctccagctgttatacctaaaatttttaatgaatttgttgcatcagcaggatacttcattaaagattttggcgtgattttaatttgtccacatattgaatcgaaatatgttatatcaaatgtatagccatctttttcataagtatatacattattattttcacttgaaggctttcctaaaatagattcaacagcttttgaatcttttcccttaaagtcatcaacagaagcaattttagttacttcagtagttggagaatcaataattgatgaagactgaactggatttgtaacctcagtatttgaagaagattctgttgatgaatctgctgtttcatttttttgtgttgaagctgaattaccacaagctgtaattaaagtactgcttgctattgctgctaatgtaaggcttaatatttttttattcatgaattacctccataccattacggtataaaatttattttactgttaaattatatcactataagacaagttaaaagttcagttaagataattgtaataataatttaaagaaataataattttagattaaatggtaaacctaattcatatagcatttaacacaaaaaatttaagaaaatactgcttgactattaagtgagcatttttattttggaggaatataaatgaattttccagttaattttcctaagcaacatcagaatgtacagccaggtttagaagttgaaatgaatccagctccagtatatgattcacctgaatataataaaaaaggagatactttaaaaggaaaagttgcagtaataacaggtggagatagtggtataggaagagcagtttctatagcatatgcaaatcaaggagccaatgtggtaatagtttataaaaatgaagtagaagatgcagaaactaccaaaaagaaagtagaggaagtaggtgcaaagtgtacattaattccaggagacataacaagtatggaattttgcacaagtacaatagagaaggtaataagtgaatatggaaagatagatatccttgtaaataatgcagcagtacaatatgagtgtacagatataaagcagctaccatgtgagcagtttgataaaacatttaaaacaaacgtatatggagcattttatatgacaaaggctgctatgaatcatttgaaatcaggaggatgtataataaacacaacatctattgttgcatttaaaggtaatgatactttgatagattattcaatgacaaaaggcgcactagaagtatttacaagatcacttgcattagcgcttgcaaaaggaaagacaggaataagagtaaatgctgtagcaccaggtcctatatggactccattaattcctgcatcatttgatgaaaataaagtatcttcttttggaagtgatacgcctttaggaagagcaggtcagccggttgaatgtgcaggtgcatatgtatttttagcaagtgaaaatgcatcttatattacaggtcagacaattcatgtaaatggtggaaatataataaatggttgaataacctaaccaatccatgagaattccgaacaaactctgacaaaaatgctattttggggggaattcaactaagacaaaaacttcaacccaaaaatcaagagttgagaacaaaatctcagctctttttttatgcagataattaagagtgagtggcgtttattatttttaggtgcaatattttcaacaagatttgttagagattctaatgaactatgccgaaaatcaaaagtagtagaaatttacaaataaaagttgtaatataaaattatggatataattaaaattagggttgatgaaacaatatgctaatagtaattttgtggttgacgcaagaaatggatttgactatgataaagcagatattgaagggggaatatagatgaaatatgaatggctcgatgaatattgtctttctaaggatggagcattaagagattataaaacagagtgggaagcaacaagataccttattggtgataaaatgtttgcaatgcaaggagaagataaaaataaaaaagaaattataactctaaaatgtgaaccaagttttggatcatttttacgagaagagtatcagcatgttgttccaggatattatatgaataaaatacattggaattctgtatatttagatggtgatgtaccagataatattttaaagcaaatgattaatatgtcttatgaattagtatttaaatctttgagtaaaaaagttcaaaaagagattgctggaggaaataagaatagttgaatcaagatgccaacttttgaatcagttctattatgatattgatgatcttaataatattagtagtagttttataatgaataatgattaaaaatatataaggtaaatgatagatggttgttgaataagaattttgagtattctaaagctcataaaaaacgagaattatatttagtttagtaaattcaataaagaaagttggaaagtaatatgagatgtagggagtgctatagtgataatccaaggataactccgattttaaagccagagcattgcttagaaaatcatttacaatatatatgctcaacatgtgggcgatgtatatgtattgataaagatgataagcgaaatgtttacagatggagttttctattcaaaacattggaatttgctaaattatatttgagaacagcggaagtaagttgtaaggacacttgtggaatttatgaaattacaggaaagaacaatagagtttcatataaaatctttcatacaaaagaagatttagaaaaatatttattaaagaaccgagataaatcatgtaaatatatgaagcctgtctatatttctaaagaatattttgaaagttctaatgctcaaattcgcaaattaaataagcaggaaatagaagattatctaaaggaacaaatgcagtttaaaaagtaatgtatctattagaattaggagaagagatattaagtgatagtagataatgattatatatagatttttataaggagacgtaaaatgaaattttcaaatccattgatagttgttacaaatatggaaaaggcaaagcaattttattatgatgtgcttggattagaagttgttgttgattttggtgcaaatgtaactttaaaagggggaattacgttacagacaaaagatacttggtctacttatattgataaagatgaaaatgaaattctttttggaggaaatgcagccgagttatattttgaagaagatgattttgatgattttattcaaaagattaataatattgctgacattcactatgtacatccaatgttagaacattcatggggacaacgtgtcattcgtttttatgatcctgataagcacattgttgaagttggagaaaatataattatggttgttagaagattcttaaacagcggtttatcaattgaagatactgctataagaatggaagtaccaattgattatgtaaaatcttgtttatagcagattagtagatgttaggaattgagagatcttattgaattactattattaataattaagaaattaggtgataaagttggattttgaaacgtgctttaatacatcatcatcaattttaatggagggtgcattaggagaaagattaaaacgggaatataatattaggtttgatgataaggttgcaatggctaatctaatttatgatgataagtcaagacaagctatggaaattatttttagagaatatatgaaaattgcagagaaatatagcttgccatttattgcaacaaccccaactagaagagcaaataaagagcgagttttacaatctaatttaagtggaaaaattattgaagataatgtgcattttttacaagaaattaagaaaaatacaacaactaatatgtttgttggcggattaatgggatgtaagggagacgcatataaaggaacagagattttatctatagaagaggctcaggagtttcattcatggcaagcaaatttatttaaaaattcaggtgtagattttttatatgcaggaattatgccagctttatctgaggctataggaatggcaaaagctatggaaagtacagcattaccatatattattagctttatgattaagaataatgggaagctaatagatggaactactattcataatgctattataaatatagataatgcaacagtacataaaccaattggttatatgacaaattgtgttcatcctatagtgttaagaaaggcattgtctactcaattaaataagactaaattggtaagagagcgtttctgtggaatacaagcaaatgcttcaccattatcaccagaagaattagataattgtagtgatttaaaatcatctgataatgttagtcttgctaatgaaatgatgaagttgaatcagtattttaatcctaaaatttttggtggttgctgtggtacggataatactcatatagaagaaatagccaaaagaataaaaaattaagtttcagagtattggttaagttggcaaaataaatggagcgacttaaaaagcatatattaaaacttaaaaatgacttattaaaggctaaaataagacaatctgtagaaaagataagtgaattattaatagatggatttattgagtttacgagttctggatacatatataattatagtataggacaaatgacagatgaaggaactaacttgcatgagattgaatgggagataccagaattaaaatggaggaaatgaaatgactgaattaataactttagaattattatttgaaatgggagaaatgagattttatatttatccagttgtacttaaaaataatgatgatttgatcttaattgatacagggtttcctatgttcttgccattaattaaaaaggcttttgagaaaaatggcttggacataagacaacttaaacaagttattttaacacatcatgaccatgatcatatgggcgcagtaaaggagcttgtagaaaaatatccttctgtaaaggtaaaatgttcagaaaagcaaataccatatattatagggaaaaagaaaccacttaggttagaacaaggagaaatgttatggggagacagtggacttatacaaatgataaaaagcgtggaacctttggagtttgctttagtagtagaggataatgagactatttgtgatggagtaaaagtgattgaaacatcagggcatatgccaggacatatttctatttatattgaacctatgaaaaccttaataagtggagatttgttaacttgtgaaaatggtatattaagtattgctgatgaacgatttgtattagataaagaagcagaaataaattcactgaagaaaattactaatttggatattgaaaaaattatatgctttcatggtggagagtataaaagcaataatttaaaagaagatttagaaaaaattatattgaaaggatataatggataatttgtgcgttggaatgtagtttgaaactggcctacatattttgtatgcacatattcatggtaaaatattttgtaattgattaaaaatggcggaataaaacacaacacgtaaaagaatgattttaagagtagatattaaatagcaaaaattatattctattagggaggagtagtttaggagatatgaatgaaatatttaaacaaatacctttatacagatttattatgttctgtaatgagacagctatgaataagaaagtgttggattgtggtgcaggaggagattatccatcactaagcttattttcagaatatggatatgaaacacatgggatagaattaaatagtaaacaattagaaaaggccaatatatatgcaagtaaaaaaagccaaaatttaaatattgaacgaggagacatgagaaaattaaattttgaaaatgagtattttagttttgtttattcttacaattcagtatttcatatgacaaaatcagatgttttaaattctataaatgaaatgaagcgtgtattaaagccagaaggtcttctttttgttaacttccttactacaaaagatcatcgctgtggaacaggtgtagctatgggtgaaaatcaatatgagcaaatggatgattatattcccgtaattcattcatattttgaagaagatgaaccagaaaagtattttaataacatgaaaatattatataaagagagtagagttttagaaagaatatttgagggtaaaaaaattagacaaggctttgttgattatattgttaaaaaggaataaaaaaggagtaatctgaatgaataaggagtaaatagaaattatgatgacttctataattaggaggcttttatattttatattaaatatgaatttcggtgaaatgtaatttatcacttgttaggcggtgaaaaatatgaaaatatgtgtgatacatggtagtcagaggaatggaaatacagaaaagaccattgaaatacttaaggtaaagttaaatttaattggaaacaatgattttttcgatttatatttaccaaaggatttaccattgttttgttgtgggtgttttcaatgtcttgaaaaaggaagctttggaggtgaatgttgccctcatgctaaatatactcatcctattttggaaacaatgaaactttcggatggtattattataggttctccagtatattcacttgctgaaagtggacaaattaaagtattttttgatcattttggttgtatttttatgagccacagaccattacaagaaatgttctcaaagactgcactcatagtatctacaacagcaggtactggtacaaaatatgtaataaaatcagttgaaagaagtttaagtttctggggaattccaaagatatataaatgcggtttaactctttggtctaaaaattggaatgagatgtcattaaaaaagcaagagaaatatgaaaaatgtttgggtaataaagcatatgttttttacaaatcacttaaaaataaaaaagtgcatactccattaaaaacaaagatattgttttatatctttaaaaatcttatgaatagttattcagacggccatcaagataaagaatattggagacgtaaagggtggctacaaggaaaaagaccttggtaaaattattttgaaaatagttattagtatttttaatatataaatttagaaggggtagaattaatatgagcaaagaattttatgtgggatttggaacattagctttgatcaatgcaggaattgcacaaggaaaaaataggtctggagtgaattggtttttattgtccttatttcttggaccgatagctacattatgcttagtaatatgcgataaaaaatagaagtgttatcggggaatttcttttgcttttttgggggtaatttacataggtcttagtataacttattataaaaatgatagagagaaatagttctatattaagataatataaatatagagtattataggatggtttaaagtgaagaaagataaggctattaaatatttaataaaaaatatattactgaatattggaatgattgaaccaatacgtagatgtacagcagaaatattatatgctgagatagatggagtacttatacgagagaaaaaaagtaatgcttatatgatttcagtagatgattttgaaataggaagaaaattaatagatactatagaagaatctagtttaattgtctcacatcaacaatttatggtggattatatattaaatagatttaaattaaccaaaagtcttgaatgtgttcaagcagtctatatgagcagaaagaagcttcctgtgaaaaaatatgaattagaaataaataaattaaaagtagaacaaattaaactaatattagaacattatgataagttatctattaatgaaattgaaatactgttaaaaaacgggaaaatatttggcggatataaaaatggaaaactgataggatttgttggaaatcatttggaagggagcatagggctattagaagtatttccgcaatataggtgcctgggatatggaacaatacttgaaagctatataataaataaaatgattgatgaaagcttagttccatttgctcaaattgaaatagataataaagaatcaatgatattacaaactaaacttggatttgaaatatcaaaggattgtttgtattggatattttaaatccaagtttagatatacgcattacttattcttaataatccactaacttgctctttttccatctcagtggtactactcaaaaaacggaaaatcatataatattaattattatagagttggaaaatgtaattaaatgaatttatttactaaaaagaattagattgaggggagaatatgagtaattatattataagagaaagtaatgaagaggaatcagaattaattgttgacaaaatagttgagtataatttatctaaagttcctattattcaagagtcttcatttatttggattaacagagtaattgtaggtacatatggagatattattgcgggaataaatagcaaaatgtattgttggaattgcttgtatatagatgttttatgggttaaagaagagtatagaaaagaaggacttggatcaaaaattttaaatgaaatagaaaaagtggccaaagataaagggtgttacctaattcatttagacacatttgactttcaagcaaaggatttttatattaagcatggatatgatatttttggcatattagatgaatgtccacagagacacaaaagatattttatgaaaaaaatcatatagtaaggtgaaaatcttatatgaaaagaattcaactatataaatggaggaaattgtatgaaagtagcggttttatctgatattcatggtaatggtgtagcactaaaatatactatagatgatttaaaaaaaataggcattaaaaaaattattattttaggagatatagtgatgaaaggacctatgccttttaaatctttagaattgttaaaagataaatctttagaaattatagcatgggttaagggaaatacagatttatggcttgaacaaattacaaatgattggataccaagatcaatgaaagaaaaggaaataaaattatactataaatatgcaacggaaaatttacaagaagagcaaatagaattccttaaaaagttaccattagagtgttcaatcaatgtaaatgaaattaacatactttgtgttcatggaatatctaaatcaatatttgaagcaatagatagtagtgtttcagaagaagaaattaagaaggcaataaaaggtgtaaaagaagaagttattttaagtggacattcacatacttcctttattggtaaagtagatgaaaaaatgatatttaatgtgggaagtataggcaattcacttgacggtgataatagaatatcttatggagttttagagtttgatgaaaacaaagttaacttaataaatagaagaattagttacccagtaagtgacgttataaatatagcaactgataataaatttcccttacttgaagaatatagaaaactcatattaaatggattgatgtaatatataaggttgttatataaaggagtacaaaatggaattagaattaaagttaaattcgctatacatttgcgttaaaaatatggaaagggcaataaatttctatgaagaatttttcatgcaaaaggtagaggtaaaagatgagatatttagtgtttttgacttaaatggatttagattctgtctatttaataatgctaaagtaaatgaagatgttttttggggagataattgtcttccaagctttgaagtcaataatatagaaaaattaaccgagagattgataaaattaaaggctgaaatagtttttccattaactaaaataaagaataattttgttttagaatttaaagatagtgaaggaaatgatattgaaatatactgtaaatgctgatgttttactacgattagagttattatggcttttgatactttttggttgaacttattttacaattaagaaattatgaaagtgaatatgtgaaaaaatcagtagcaaatgtttttagaagatagaagagatagttaaacaacttaaaatgtgtgatttataagataaagcagttaatcaaagtatataaattagcaactaatcatataaagtaggatatttaatatgaaaaatgaggtgtaaaaatgattaaggaaattcttcaaatagaagagttatcaattaatgcttttccagcaatattgacagaactatatgatgggtggattttaagatattcaaatggatatacatatagggggaatagtgtgaatccactatattcatcaacaattgaattagaagataaaattaaatattgcgaatgcaagtactttgaaaaaggattaccttgtgtgtataagataacagaaaatgttgagaaagaattggatgatagcttagaaaaactaggatatactatggaaaagtcagcagatattatgatttgtcaattgaataaaaatattaatactcaagttgaagatgttaaaattactttagatattacagaagaatggttagatggttttctaaaacttaatggaacaacggaggaaactataaagttaacagcaaaatttatgctttccaatataaaaaacaaagtattttgtgtaagtataaattatggtgaaattatgatagcttgtgggcttggtgtacttgaaaataaaaaaataggattatatgatattaatgttatggagcagtatagaatgggaggacttggtacaaaaatatgtaaaacaattataaatgaaggaattagaaatggtgcagatacagcatatttacaagtagcttcatttaatgaaaaagcaattcacttatataggtctcttggttttaaaagattatataaatactggtatagagtaaaaaaatatcctaatcaataatcattttttataaatcatacgacttattttgagttatggaggattttaagtggattttaaattagaatatctagatgagaattatgctagagaaatatgtagttggaagtataatgatgaatattcagtttataactatccagaatgggaagttatttctaagcaaaattgggatattacggtagagaaaaaagaaaaaatgaatttgtagcagttattaataaatgctttggattatgcggttatattagatttaataacaattataattatgttttagtaggattaggtttgaaacctgatttatgtggacaaggattaggatataaactaatggatatattaaaaagtgaaagtagaagaagatataataataaaacaattatactataggttcgttcttttaataaaagggcaattaattgttataaaaaatcaggatttaaagtatttgacatttataaaaaggatacgttattaggacaggatgaatttgttaaaatggaactagctttttaaaacaatgtttaggagaaacttaaaaatgaagatacttgagagtaagagaataatcttaagaccttggcaaatttctgatttagatgatttacatgagtttatgtcaaacgagcaagtggcaaggttagcaggctttaaagtaaaaaagaacaagggtgagagtcttagaattttaaagcaatttataatagattctagtgattctttatgggcagttgaactaaaaaataataataaagttataggatgggttgaattgcatgaatatcctaatagaataaataaagattcaaaagaaataggttgtgttttattagagaaatattggggacaaggattaatgccagaagcacttaaagaagttattagttatggatttaatgaagaaagacttaaatgtattatatgttctcattttttaaataataatcgatcaaaaagaattattgaaaagtgtggttttaattatgttaaagttagtaatgagaaagtatattattgtttaaataaacatactgtttaatttaaaattcactaattagaatatatcactattataattgtataaataaagctagaagtaattacttaataacaagaactatagaaactaggtattatatgttaaaaaatgaaagcaggttcacataaatacatagtcgaaagatgaaaaattttgactatgtatttatgtgaatatattgaaaacaaaatatttaaattggctttgattttgattttgagtaaatgattacttctttattataaataaaatttcatatataatataataagttgaataaacatttgaaggataaaatacagtaattaatagaacttatttagaaatggatgtaattttataaaattcatagtttgttaataatgttctattatactgggagagtatgtgtgttataattttttctgtacaagtatatgattgtacaaaatattgcaattaatttaatacatatacccttattaggaggaaaaaatgggaaatattttaaaaataggagtagatattggttctactactattaaaatggtagtcattaatcaagatgaaaaaatattatttaaaacatatagaaggcatctggctgatatcagaaatgcctttaaatcatgtcttgaagatgcaaaaagtattataaaagataaaaaacttacattttctatttcaggatcgggaggaatgagtcttgctgaaaagcttaatgttgaatttatacaggaagtaatagcaagtacaaaggctatacagattaataatcctgaaactgatgttgtaatagaacttggaggagaagatgcaaagataacttatcttaatggtggtgttgaacagagaatgaatggtacatgtgctggtggtactggtgcatttatagatcagatggcatcacttcttaatatggatgcagggaagctcaatgaagaagctaaaagttatactaatatatatccaatagcagcaagatgtggagtttttgctaaaactgatgtgcaaccattaataaatgaaggagcaaaaaagtgtgatatcgcaatatcaatttttcatgctgtagtagttcagacaataagtgttttagcttgtgggcgtcctattttaggaaaagtagcttttcttggaggaccattaacttttttgtcagaacttagaaagagatttatagaagttttaaaacttaaggatgaggatgttatatttccacaagattcagaactttatgttgcattaggtgctgcattaagctgtgaaggaaagtctgaatatgattatcacagtatattagccagacttgaagatataaaaggtgaagaagaaaataaatcagatagcctagaaccattgtttaagaataaacaagaatatgattcatttaaagaaagacacgataaaagtgtagtaaaagagattgatataagcatggctgaaggaaagtgttatttaggtattgatgctggttctacaacaacaaaagctgttcttattaatgaaaaatgtgagattttatattcatattatgctggtaataaaggaaatccagtagatacagcagcaggaattataaaagaaatctattctaatattcctgaaggtgcaaagattgtttatagtggagttactggatatggagagcatcttctaaaagaagccttttctatggatattggtgaaatcgaaacggttgcacattataaggctgcaaaattcttctgtccagatgtagattttattttagatattggtggtcaggacatgaagtgtcttagaataaaagacggaacaatacaaagcataactttaaatgaggcatgttcagcaggatgtggatcatttcttcaggcttttgcaaagtctttaggatttgaaataaaagattttgctaaaaaggcactttttgcaaaatcaccagttgatcttggatcaaaatgtactgtttttatgaattcaaaagtaaaacaggcacaaaaggaaggatttactgtagaagatatagcagcaggacttgcttattcagttgttaaaaatagtctttataaggttataaagcttagaaatccagatgaacttggaaataatattgtagttcaaggtggaactttctataacgaagccgtacttagaagttttgaaagattatctggtagaaatgttataagaccaaatatagcaggacttatgggagcctttggtgctgcaatactagctaaagaaaattatgaagctagagcttgttatatagatgatgaaacagctgcaacagttgaaaataatatttcagataataagaatgatgaagttaaagcaaataatatacatatatcaacgttagtttcaaaggaaaatgttgataacattgaaatgaaatcaactaacagccgatgtaggggatgttcaaatagctgtcttttaacaataaacagatttccaaatggaaatagatttattgcaggaaacaaatgtgatacacctcttggaaataatacaaaagataggaacatacccaatttatatgagtacaagtataacagaatatttaattatgaacctttagaattaaataaagctaaaagagggattattggtattcctagagtgcttaatatgtacgaaaattatccattatggtttacactctttacaaaccttggattcagagtggaaatatcagaaaaatcttccaaggaactttatgaaaagggactgacttctatagtatctgaaacagcctgttatccagcaaaaatgacacatggtcatgttgaagatttaatagaaaaaggtattaaaaatatattttacccttgcattcttcatgaaagcagggaatttaaaaatgcaactgatacatttaactgtccagttgtaacatcttatgctgaagtaattaaaaataatatggatagcttagaagaaaacaatgtaaactttatgaatccatttttaccaatagctaataaaagcaaacttaagaaaagattaaaagatgcactttctatatttaatatttctcaaagagagataaattatgcagttgataaggcatgggatgaacaagaaaatttcaaaaaggatataagagaaaaaggtgttgaaactttaaaatacataaaggatcataacattcaggggatacttcttggtggaagaccatatcacgttgatccagaaataaatcatggaatgccaaaacttataaacagcttagggtttgccgtatttacagaagattctgtagcacatcttggagaaattgatggtaaattaaatgttgttgatcaatgggcttatcactcaagattatatagagcatcaaattttattattgatcacgatgatataaatcttgttcagcttacatcatttggttgtggacttgattctattactacagatgcagtggcagagatattagaatgtggatcaaaaatatacactaatataaagattgatgaaggaagcaatcttggtgctgcaagaataaggttaagatcacttaaagctgcaatagaagaaagaagaaataaaaatattgagacatcaattacaaaaaaggatactaaaaaattcataaatccagggaagaataaaactataatagtacctcagttttcaccaatacattttaatatactagaatctgcatttagagcttgtggatatgatttagtggttcttaataatggtgataatgcaattgatgaagggttaaaatatgtaaataatgatatatgttatcctgctatagttgttattgggcaagttatagaagcattaaagagtggtagatatgatcttgaaaatactagcattcttcttgcacagagtgaaggacagtgtagatttacaaattacacaagtgtacttgaaaaagcattaaaggaagcaggatatgaagatcttccagttttatctcttagtcttgcaggtgttgataaaacaaattcattggaaggaatgaatcttgatcttgttaaaaaatccatagtaggagtaatatatggagatcttttaagcagagtacttcatagagtaagaccatatgaaaaaatcaaaggaagtgcagatgaactttacaaaaaatggacacgtatatgtagagaatcatttgaagaacctttaaagaagaattttaaaagtattatttcaagtataataaaagaatttgaagagcttccaagaattgatgtatataaacctaaggtaggacttgttggtgaacttttagttaagtttaatcctattgccaataatagtattgtaaatatgcttgaaaaagaaggtgttgaagttgttcataatgacttgctttcattattcttatcatcagcaaaaaatcagatatttaactataaacatcttgatggaaagtatataagcaaacttaaaggagaaattacaataaagcttatagaaaaatatcagaaagtatatattgatgcacttaaaaagagcagaattttttatgttactgaaaaaatagatgaaatggctcataatgcaagtaaaataatttctcttggaaatcagtctggagaaggatggaaacttccaggtgaaattatggaacttgaaaactggggagtgaacaatgttgtttgtatgcagccttttggatgtctaccatcacatgctgtagcacgtggaaccataaaagctcttaagaagcttaataataagcttaatatagtaacaatagagtatgatccaggctctagcgaagttaatcaaaataatagaataaagctaatgcttgcaagtgcttttgataaaatataataaaagttatataaaggaaaaaatattttcatattcatataatttttattggtaaattctaataaattgatgtataattaataaataaaatataataaatggcgaagaagtcaacttttgtaagttggcttctttttgttttaatggaggaattagtatgaaaagattaagaaaaatcatatcagtagtattgagtatatcgatgctaagtatattgggaggatgtggcgaaagtaatagtacaggctcttctgataacggagaaaaagtacttaaagtaggtatggaatgtgcatatgcccctttcaactggacacagactgatgatagtaatggagccataaaaattgatggaaataatgagtatgcatatggttatgatgttatgatggcaaaaaaaatagcagataaattaggatataaacttcaaattaataagatggaatgggatggattgtgtcctggagtaagttctggaaaaattgatgtatctatagcagggcaaagtattacacctgaacgactagaaagtgtagatttttcagatgtatattataaagctgatatagtagcattaactaaaaaaggaactgcctatgaaaatgcgaaaagtgttgaagatttaaaaggagcagcatgtacttcacagttaaatactgtatggtatgatatgcttgatcagattccagaagcaaaaaaacaggctgcaattgatactgttccagcaatgattgttgctttaaattctggtaagattgatgttgtaacaactgataaacctactgcaatggcagcagcatattcaaataaggatttagttttacttgattttaaagacggaaaaggatttaatgcttctgatgaagatgtgaatatgggaattgcaataaaaaaaggtaatacagaattaaaagaaaaaattaatgctgcccttgctgaaataagtgatgaggatagggcaaaaatgatggacgaagcaataaaatgccagccattatcagaataatttattgaatttgatttgggggagtagttatgacatctaatttaccaaatgacttttttggatgggtagtatttttaatacaaaaatatggagaattatttataaaaggtgcagcatatacacttatacttgcacttattggaacagtaattggatgtattattggatttttagttggaattgtaagaaagattgaagtacaggaagattgtaataaattttataagtatacattaaaattatctcaggttattttaactggatatgttgaattttttagaggaactccaatgattgttcaagctatggttatatattatggggcgatggaggcatttaatattgatatggctccatttacagctggtttatttgtagtatcaataaatacaggagcatatatggctgaaacagttcgtggtggtattgaatcaatagatatgggtcagacagaaggtgcaaaagcaataggaatgactcattttcagacaatgctttatgtaattctacctcagacacttagaaatataatgcctcagataggaaataatttaatcataaatataaaagatacatctgtattaaatgtaatatctgtatctgaattatattttgttggaaaatcagcagcaggggtttactacaagtattttccagtgttttttataatatgtgtaatttattttgtaatgaactttgttgtatcacgtattttaagattaatagagaaaaaaatggatggcccttctgactataaactttcagaaagtgattttatgtcaggagatatataataaatatttttaatttatacacaaatattagatatttattaatgattatgcttataaatatattaaaagtaagtattgagcatataaatgaatttaatattataagtttatttatatattgtaatttaaaatggataaattatgttagaagttacacatagaaagtttatatatttaataaaaatatataagtagggagggaaatgaaagatggaagctttcaaatgcaaaataaataaggaatatgacatgcctgtaattaaagtttcacatttaagcaaagtctttggagaacatgaagtattaaaggatatagattttaatacaaactgcaaagatgttatatgtataataggtgcatcagggtcaggcaagtctacacttttaagatgtatcaatatgcttgaagcacctacttcaggagaaatttatcataataataacaatattatggataagcaaaacaagattacaacatatagatcgaaagtaggaatggtatttcaatcatttaatctttttaataatatgacagtacttgaaaactgcatggttggagttataaaagttttaaaaaaggataaaaaatatgctaaagaaatttctttgaaatatttagaaaaagttggtatgggattatatttaaatgcaaagcctaaacagctctcaggaggacaaaaacaacgtgtggcaattgcaagagcacttgcaatggaacctgaagtgcttttatttgatgagccaacaagtgctcttgatccagaaatggtaggagaagtactaaaagtaatgagagagcttgcaaaagatgggatgacaatgataatagtaactcatgaaatggcttttgcaagggatgtttcaacaagaacaatttttatggaaaatggagttatcgttgaaaatgatataccagaaataatatttaataatcctagcaatccaagaactagagaattcttaaaacgctttatggatagttaggcataattaaggagataaagaaatgggagaatttaaagaaagcaagataaaaatagttgtaaggaaatctaactgtgaattctataagaagggggatgagatttatattgaaggtgcattattaaacaaagaaaaatcaggtaatatatgcctaacagcagtaaatgcaatttatccattcatatatgcggcgagaaagagagtctcaaaagatgtaatgggatttgaagaattagtgtttagatgtcctgattgtgcagagggagttgaatttgaacgaatagctgaataagtatttaattgaattaaagcgctgttaaaatagcagtgcttatttcaggtttttatattatttacaaatataatataaaaagataaagttattaaagtatacttataaaataatatgcgaaaatataatgtatatattaaacataactcacacttaagattaaattctttacataataaaggatatattgtataatactgatagaccgaaaataactaggggtgctgaaaaagctgagagagtaaaatttacttaaccctttgaacctgtcttgggtaattccaacgtagggaagtgagcttgtaagtatattttgaaaataactatgattatatttaaaaagccgtctttcttataagatggctttttttgttgcttaaaaaaagttttccttaaatcaaattagttactttttgtgtctaaaaatttaatatttgatgaaaagaggtaacaagatgaaacttagtaaagtactttatgacagtgtagaagacatatggaattcatataatgaacatccatttgtaaaaggtattgaaaatggacagttagatttagaaaaatttaaatattatatgatacaggattatatatatcttttagattattcaaaaatatttgcacttggaattgtaaaggctccaaatgaagaaattatgagattctttgcagaacttgttcactctactttaaactttgaaatgagtgtacataaaaaatacatggaaagattgaatataacttccgatataatcaaaaattcaaagccttctctttctaatacatcatatacaaattatatgttatgggtatctcaaaatggagatatattagatttattggtttctgttctatcatgcagttggagctataaagttattgcggataaaattaataataattctttagctaaagaaaatgaattttttggagaatggataaatgggtatatatcaaaagaatatgaagagtgtaatgataagttgatagatttggtagataaattaggtgaacaatgcagtgacacaagaattgatatattaaaaaatatatttataaactgcagtaaatatgagtatatgttttgggacatgtcttataataatggacaaacatctatttaataattgtattattagaaaactaataaattaggagaaaaatcatgttggaatttaaaaatgtaacatttaaatacattgaagataatcaagcaatgatgaagaatttatcatttcaagttaatgaaggagaattcatttctataattggtccaagtggttgtggaaagagtacaatattcagacttataaatagtcttgaaaaaatgcagaatggtaatattttgattaatggagaatcaatagagaaaattaaaaattatagtgcatttatgccacaaaaagatttactttttccatggagaactattggtgaaaatctagctcttcctcttgaaataaataaagtaaataagagcgagcgagaaaaaaacataaaaaatatgctaaaagaaattggtcttgaatcatataaagataagtttcctaaggatttatcaggaggaatgaaacaaagggtttcatttgcacgaacacttttaactggaggaaatattcttcttcttgatgagccttttagtgcacttgattcattgacaagaatggctatgcaggaatggctattagatatgtggcagaatttgaataaaacaattttgtttataacacatgatgttgaagaagcaatattattatctaaatcagtttttgtagtttgtgatagacctataacttatttgaaaaaagttgatattcctttagattatccaagaaatagatcggttctttcaaagcctgaaataatatctttaaaggaaaatttaattgaacagcttagatctatcaataataattaattacaaattaaatatataggaggcttatatgaaaaagaatttaccatcaattattcttacaacaattcttctaattatttggcaggggattgcaatgataattgatgcacattatatacttccatcaccagtccaaattatgagtaaattatatgaacttagagagccacttttaaaagttcatcttccagcaacaatgggagttacaattttaggacttataatatccatagttcttggaataagtcttgctgtatttatggatattaatgaaaaagcagctaatgcactatatcctataataattgcatcacaaacaattccaactactgcaattgcaccactttttgttttatggtttggttatggaatatggagtaaagttcttgtaactatattgattacatttttcccaataactataactctttatgatgggtttaaatcaacaaaaagagaaatggaagaattattaattacatatggtgctaataaaaaggatattttcataaaactaaaaattccaagtgcactgccatatttcttttcatctataaagatggctattcctttgagtattattggggcggccattgcggagtggcttggagcacaaagtggtcttggatattttagcaagagaatgatgacgcaacttgatggagcaggtgtatttgcaccgattgtattattatcagtagtagctatggtattagtatatttagttgctattgcagagaaacactttgtgaaatggagaaaagaattataaattaataaacaatgtgttatttaattattattaggaaaatatttaattttacaaataaccaatctactttacatatagaaaggaatcaataattatgaaaaagaaaattttatcaatattaatgtcaggaataatggcatttggaattttagggtgtaaaaatacatctatgaataatgaatctgtagatggaaaaaaattagaggaagttaatgttgttcttgactggtatccaaatgctgttcacagtttcatttatacagcatttgaaaaaggatattatgaagaagaaggacttaaagtaaatattcaatttccttcaaatacaaatgatgcaatttcaatgactgcatctggtaaagctgaccttggagtatactatcttcaagatgttgcaatggctagaggaaatgaaaatattcctgtaaaagcagtaggaacaatagttcagtcaccgcttagcattattttatcacttaaagataaaaatataacaaatcccaaggatttagttggtaaaaaaattggatatggaggaactgctctttcagaaggtattatttctacaatgcttgaaaatgttggtgaaaatccaaatagtgcacaaacagttgatgtaggatttgatttaatgagttcaatgactacaaatcaagtagatgcaacaattggatgtcttgttaatcatgaggttccacaaatggaggaagaaggaatgcaattaaattatttcttccctaatgagtacggtgtaccagattattatgaacttgtttttgttactggtgaaaatacattaaataaaaacagtgaaaagatctctaaatttttaagagcatcaaaaaaaggatttgaagatatgaaaaataatcctgatgaatcattaaaaatacttcttgataatcaaaataaagaaaattttcctcttagtgaaagtgttgaaaagaagagtatggaatttttgattcctgttatggaaacagagaatgcaaagttcctctaccaggatacgaaagtatggcagaataatattgattggcttgttagtaaaggacttcttaaagaaacatttgatgcttcagatgtagttgaaaatttggaatattaatagaaatgtacagtcttaaagataaaggctgtacattttttatttaatagacatataatgatgtatatcaattttgccaggaattattatgaaatattgtagatggataaaaggtaaaaatagaggagaaaatattaaattattcttcacacgagaagaaagttcagatactgcaaaaaaattaggaataaaatttgataaagaaaaatttgatttagaagaattttatatgggtatgaatgtggaattagagcatggaacaagatttccagtggcaaatgtaacaaataatgatccaatattaactggaatgatagcacttgcacaccttcttgaatttcctgattattatacaagacttttaaaattagaagatgaagcaaaaaaatactggagtagtaaaaactaaaaaatacattaatatgagctgacattgaatttgtcagctttatgtataagttttattaataaaaggattaataaaaggattaataaatagtatcaactaaatgtttttattttatgtgatttgtgctaatatattattatgtaataattattattcaacaagtatatctagagtagatttacttttgatatttagatataaaatagaagtttataagattaagataaaaattagacggaggatatataaatatgttaaacataggatgtcatttatcaactacaaagggattttataatatgggaaaagaagcattatcaataggtgcaaatacatttcaatttttcacacgtaatccaagagggggaaaagctaaagatattgatgaaagtgatgttaataagttaattaagcttatggaagaaaataatttttctaaaattcttgcacatgctccttatacattaaatgcatgttcaaaagacgaaagtacaagagaatttgcattagaaatgatgacagatgatttaaagagaatggagtacatacctaataatctatataattttcatccaggaagccatgttaaacaaggaacagaagttggaatagaatttattgcagagcttttaaataaagtattaaaaaaagaacagacaacgaaggtacttcttgaaacaatggctggaaagggaacagaaattggcagaagttttgaagaaattgcacagataataagtaaggtagaatttaatgagcatattggtgtatgtcttgatacatgtcatgttcatgatgcaggctatgatatagtgaataacctagatggtgttttagaagagtttgataaaataatcggacttgagagattatgtgctattcatttaaatgatagtaagaatccatttaacagtcataaagacagacatgaaaagataggtgaaggaagtattggtttaactgcaattacaaatattattaatcatcctaaacttaaagatatacctttctatctagaaacacctaatgaacttgatggttatgcaagagaaatagaattgttaagaaattcttataaatattaatattagaataatcgccattaaaaatgaaaggatggcggttatttttatttaagaataaaagtaatcttaaacacatatttttaatgaattaattgtattaaaaattgccatactataatatgcaatattttttaatatattttaagaatttaatttctgagatatgattacaatttagaaaattaggagtaggtgaatatatgaaaaaaagagattataaagaatatgaaaaaattctaaaaaaagaacagttaaaaaagattataagtattggagctataagtattgcggcaggacttacagctaattatatttataagaagaacaaagaagatgactatactacttataaacgagtttttaattctgatacagatagtaatgtatattttattggaggtggtcttgcatctttagctggtgctgcatatcttataagagattgtaatttcaaaggagaaaatatacacataatagaaggattaaaaattttaggtggaagtaatgatggagcaggatcacctgaaacagggtttatatgtagaggtggaagaatgctaaatgaagaaacctatgagaacttttgggaactattttcaactattccatcattggaatatccaaataaaagtgttactgaagaaattttaaactttgatcaccatcatccaacacatgcaaaagcacgtttagttgataaatatggagacatagtagatgtaagtacaatgggatttaacaatattgatagattagagttatttaaattaatgatgactaatgaagaaaatctcgatgaaatgacaatagaagagtggtttaatgatcatttctttacaactaatttttggtatatgtggcagactacatttgcttttcaaaaatggtctagtttatttgaatttaagcgttatatgaatcgaatgatttttgaattttcaagaatagaaactttagagggtgttacaagaactccctacaatcaatatgattctgtaatacttccattaaaaaaataccttgaaggctttggtgtggattttatggtcaacacaaaagttacagatttagattttaaagcaggtcgtggtataacagttagtgcaatacatttagaagaaggttcaccaataaattatgacagtaaaacagatactacagatggtgtaatatctgatatagataatcttgaaaaccaatcacatttagatggttctgatgaagaagatagtaaatctaataatgtggaaaaagatcctgatgataataatcctaatgataatgatgaaaaacatgatagtgctatagtaagtgaagttatgaaatcacttcatataacagatggtgaagaaaaatccagcactaataatgagaaaactaattcaaaagagaaaattatttatttaaatgataatgataagtgcattatgataaatggatgcatgacagataatgcaacacttggagattattatactgcgcctaaatttgatgattcaaaaccaatgggatcagaactatgggaaaaaataagtttgaaaaaaccaggacttggatgtccaaaaccgttttttgattatccaaaaatgacaaactgggagagctttactgttacatgcaaaggaaatacacttcttaaatatatagaacaattttctatgaatattccaggcagtggagcacttatgacatttaaagattcaagctggcttatgagtatagtagtagcagcccagccacattttaaaaatcaacctatggatactacaatattttggggatatggactatatacggataaaaacggtgattatataaataaaccaatgatggagtgtacaggagaagagatacttatagaacttttatatcatattcatttaatagataaaaaggaagagatattaaaggatataattaatgttattccatgtatgatgccttatatagattcacaattccagccaaggaagatgagtgatagacctgacgtagttccaaaagggtcaactaattttgcaatgataagtcagttcgtagagatatctgatgatatggtatttacagaagaatattcagtacgtgcagcaagaattgctatttatacattatttaatgtaaccaataaagaaatatgtccggtaacatcatataataaagatgcaaaagttctgctaaaggctttaaaaaagtcatttaagtaaattaaataatatcatttttatactccttatcatatattgtattatataacttatgataaggagtgttttgatgtctatttttaaaaagttaaataaaataaatggattcgacttcaaagatttaaaaaatgctaaacaaaacaactattcatggtgtatggctgaatttaatggatatatttatgttggaacagcaagaaatataccttggaatacagtttcgttattaggagagaatgctaagtcccctcttttaataagaacaactgagaaaaacaacaatggtgaaatatggagatataaaaaagatgagtctttaccatgggaacgtgtttataaagcagataattcagaagatattaatggatttagatttatgttaattcatgcagctgaaaattcatcaaaagctttatatgctgcctctttttctttaagaggtaccataactattttaaagacaacagatggaagtaactggacaaatgttactggtgttcttaaaggtggttcgtcaagagcaatgttatcatttaatggtctcttatatgttgcagatattgatgattcaacagccataggtggaaatgttcctttactatactatagtgaagatccagaattttttgattttaaatttgtatttgatccaaatgaccctgatttaatcccagagcaaaatccaatgggtggaatcgataatatggctatatttaataacagattatatgtatgcataagtaaggatgatggaatgcaagtttggagatcaaattcctcagttcctaaattaaatgattggacacttgttgcagacaaaggatttggagattcattaaatagaaatgcaatggcaattaaagtatatggtgattatctttatataacagctacaaagcaaataccacttgtgttcttaattccaatgggtgcagatattgttagaatagataaaaatgataattgggaagttgttgttggaggaaatgcaattataccatcagatccaacaactggtacaagaaatagaagtttatctggatatttatcaggattttctaatccttttaatgtatatgtatggcagctacaagaatattgcggatgtctgcttgctgcaacttttgatcatggaaccaatatggaaactttacgtgatgtagtgcttcttaataaagacctaatagttgaaaaagttggtttgattttatatgagttaatattacaattatacgataaaatactatatttatttgatatgtttgattatccaaaaggatttgatctttttgcatcaattgatgggatacactttaaaccattaaatttatctggtcttggaaatcctaataactatggtggaagaattcttatggttgataaaaatgatttatatgtaggaacagcaaatccattccaaggttgtgaagtactaaagactaataaagcatcatttgttaatatgttataccactgccaaaatccagattatgataatattttttcaaaactttttgaagatatagatattatgtatgataatataataattgaattgaaaaaaataggaatgttagaaatactaaaataataatttttattataataaaataataaccacaattaaaagctctattattaatagtagagctttgttaattaacaaattaatagtattgtatattaaaatactagattaatgtgttataatctataaagcatacaataaggaaggagataaaatatgtttagcaaattttatttatacgaaggaaaaaacaaaaaaatcgaacaaggaagaccttgggtctatagacatgaaataaatgaatacgatggagaatatgaaaacggagatattgtagaagtatataatcataaggggtactttataggaagaggttatataaatgatgcgagcaaaatatcaataagaataatgactcgtaacataaatgaagaaatagatgaagaatttttcaagaaaagatttaatgatgcatgggaatatagaaaaactcttatagatacctcttcatgtagatttatttttggtgaagcagatttccttcctggactaacaatagataaatttagtgattattatgttatacagatttcaactttaggaatggagaaatacaaagatctaatagtaaaaatacttgtagaagaatacaatgctaagggtgtatatgaaagaagcgatattaagacgagggaaatagaaggtcttgaacagataaaaggattccttacagagccttttgatactaatgttgaaataatagaaaatggtgttagatacatagtagacatagaaaatggacaaaagacaggtttctttttagatcaaaaagaaaacagagctgcaatacatagaatatgcaaaggtaaagatgtacttgactgctttactcatacaggctcatttgcactaaatgctgggattgctggagcaaaatcagttttaggaattgatgtttctcaacatgctgtagactgtgcaataagaaattcggaattgaatgatttacaagacattgttaaatttgaatgtcataatgcttttaatgttttaggggaatggtcaagggatggaagagaattcgatgttgtaattcttgacccaccagcatttacaaagtctaagaatacaattaatcaagctataagaggatataaagagataaaccttagaggaataaaaatggttaaaaaaggtggatactttgcaacatgttcatgttcacattatatgagtgaagaacagcttaagaagacagtatgtgaagcagcacatgatgcaagaagaactttaagacaaattgaagtgagaactcaaagttgtgaccacccaattctttggaattctgatgaatcatactacttgaaatttttcatattccaggttgtataaaagaataaattagaatctatatataaaataaatacccaataataaatttttgtattattgggtatttattttatagttattgttaaaacttagtatataaagatagaaggaagaatttaatgttaaataaacaaatagcacagaaaatagtagataaaatatcaacggtacttccatataatatcaatataatggataaggaaggtattataataggtagtagtaataaaaatagaattggaactattcattatggtgcagcagaggcacttacagaaaaaaaggaagttgagatttataatgaagatgaatttgtaaaacctggattgaatattcctatattctttaaagatgaaatagaaggtgttataggaataacaggcaatccagaagatatttcagcttttggaaagataataaaggttacatctgaacttcttctttcagaacaatattcattgaaatcagcattaaaaaaagaaatgctaaaggaagaatttctttatgaatggatatatttaaaagaaaaatataacaatgaatttattttaaaggggcagtctattaatattgatattttaaaaccaaaaagagtggctcttatattacataaaaacattaaatctagcactattttaagagaagtaaaaaggtatatatatgaagatgactactatattaaattatctgatgagaaattaattttgattttaaaagataataaaaattttaaaaatagaatagaacttataagtgataacatggagaagtatagcgtaaaaattgctgttagttcatcaaatgagaatctcaataaatcatttatagaagctatggatactttaaatataataagtgctgtttataaaagtaaaaagatattgttttttgatagtataagactaattaataactctataatgaatttaaattattctgaaatcgaaaagattaaaaataaattatatgagcaaaatggaggtaaagagttactagaaactttattgaaatttattgaatttaatggagaaaaaaataaggtttcagaaattcttcatatacatagaaatacattgaattataggcttaataatattgaggaaattacagggttaaagttaaatgattacatggatttataccaattaatactattttttctttgcattagaatgaaagatgtttaaaattgttcaaatgcacaaaaaaatattgttatttttgattgattaaacgatgacataacacctgtaaacatatacaatcaattgtgttattttaataaacaaatatcaggagggaattatatggatatacaggtaagtgcattaggtgctgtattggctttagcaatttctatttttcttattataaagaagatacagccagcgtatgcattaataataggagcactaattggaggacttataggaggtgcaaatcttacagatacagtaactctaatgatgaatggtgcaaagggaatgatgacagcaattttaagaatactaacagcaggtgttttagctggtgttcttattcagtcaggagcagcaactaagatagctgaaacaattatttcaaaactaggtcaaaacagagcacttattgcattaacaatttcaacaatggtacttacagcagtaggggtatttgtagatgttgcagttataactgtagcaccaatatcacttgagattgcaagaaaatcaaatataacaaaaagtgcaatacttttagcaatgattggtggaggtaaagcaggtaacataatttcaccaaatccaaatacaatagcagtttctgaaaatctaaatgtttcattaacaagtgttatgattgctggtataattccagcaattttaggagttgtaataacttgcattatttcaaagagacttactaaaaaaggaacatatgttgaagctgccgaagtaattgaaaataatgaaatgacaccatcatttttatcagcaattactggaccattagtttcaatagggcttttaatgcttagaccaattgctaatataagcattgatcctttgattgcacttccagttggtggtattataggtgttattgccatgggaaaacttaaaaaattaaatgaatatgcttcttttggattaagcaaaatgaccggagtagccatattattaataggtacaggtacacttgcaggaataatttcaaattcagcattaaaagacgttataatttctggaataaatacattaggtcttccaagttttgcactagctcctatttcaggtatattaatggcgggagcaacggcttctacaacatctggagctgctgttgcaagttcagtttttggaagtacaataactagtcttggagtatctagtctagcaacagcagcaatgattcatgctgggtgtacagtaatagatcagctaccacacggaagcttcttccattctacaggcggaagtattaatatgaatatgaatgaaaggttaaaacttataccttttgaagctatagttggattaactatgacaataatatcaacaataatatttgggtttataatttaaaatattatttattaatatacttatcattgaatatttatttcattggtaagtatattgtttaaaaataaaataatggagtgtatgataatgaaatttgtattagcaactgattcttttaaagaaagcataacatctacacgagcatgtgatgttatggaaaaagcaataaagaaaattaaaaatgatgcagaagtagtaaaagtaccaatggcagatggtggagaaggaactgtagaagctttagtaaattcaacaggtggggtttttgttgaaactgaagttttaaatccacttggagaaaaaattaaagcttcatatggaattttaggtaacaaagaaacagctgtaattgaaatggcaaaagcaagtggaattgaaattataaaaagagaagatagaaatccattaataacaactacatatggaactggacagcttattaaacatgcaattgaaaatggaataaaacatattgtaataggaataggtgggagtgctactaatgatggtggctgcggtatgcttcaagctttaggtgtaaaacttttagatgaaaataataatgaaatttcatttggaggaggatgcttaaataaaatagaaacaattgatttatctagtctacatagcatcataaaagatgtcacaattgaagttgcatgtgatgtcactaatccatttataggacctaccggggcttcatatatttttggaccacaaaaaggtgcagatgcagaaatggtagaattactagataaaaatcttgagcattttgcggataagataaaagaaattttaaatgttgatattaaatatgttaaaggtgcaggtgcagctggtggacttggtggagcacttcttgcatttttaaatgcagaattaaaaagtggtatagaacttgttataaaatatactaatcttgaagataaagttaaggatgctgattacgtatttaccggtgaaggatcaatagacggtcagactatttttggtaaaactcctgtaggagtatcaagaatagcaaaaaaatataatgttcctacgattgcatttggtgggaaggtatcacaagatgcagaaaatttacttgatgaaggaataattgctctatttagcataatgagaggcgttgaatctttaaatgaagcattgaaaaatggagctgataacttagagaagactgttgaaaatgtagtaagaatactgtaattttaattaaataaacataaaatatgaatcaataaaagcttggaataatatttgtattttccaggtttttttatattcatgattaatttatcttgtatgcttcttattttgttctttgctagtaatttttagtataaaagaaactacctatgaatattttaaaaacttatctctaaaatatatattttacagtttatattgatataataaaaatacaaaaccataatgaaaatataattggaacatttattatttgtgtattggaggagtaaatatgacaatctatactataggccattctaattatccagaagagaaactgatacatatgctcagacactacaatatagatacagtagttgatataagaggaactccatactctaaatataatatacagtataataaagaagttattgaaaaaactttaaaatctgaaggatttatatatatttatatggcgagagaacttgctgcaaagcgtacaaggaaaaactcatataataaagaaggttatgctgattttgaaaaagttattaatgaaaaagaatttattagcggtattgaaagattaaaaaaagggtgtagtaagggatataatatagcacttttaggagctatgcaagatccaataagatgccatagaagtattttatgtgggagagcattgacaaaagctgaatttaacgtacgtcatatattagatgactatagtacctgttcacaaagagaaattgaagaacgaattttagataaatattttccagaaagagcacagctgactattgattctttaataggagaagaaatgaacgaaaaagaaatgataaatgaatcttatagaaaagcaaataaagaaattggatatagaattgaaaatataaaaagttaaatttggtattaaagaaaaaagttttatacaaaaataaataaatttcatatagtaatagaaggtatcaatatttatggatagatgtatgagtattataagtaaattattgcacttagattttaaaaatgaacctgaaaactatactttgaaatttaaattgagaaatgataaagattatgatgggaacattaccgattttgttaatagtaataactacagtagtataacacaatttctaatttacgttgatttaagtaattttaaagttaacatatttaagggaacaaaaaataattggaaattagataaaagttacctttgtacaattggaaagaattctacacctacaccatctggtgtttttaaaattggtgtcaaggggctttactttggagttgagaaaggatataaatgctggtattattctagctttaagggaaattacctatttcattcaataatatataatctagatggaacagtaagggatggaagacttggaatgaaattatctaatggctgcataagacttttaaaaaccaatgctaaatatatatatgacaatgtaccaaaagatacaaaagttataattaattaaattatgtctatatataaaaatagcattgatagctttaataaaagttactaatgctattttaaattgttatatatatttttatgaagtataatagataagataaatgatagattaaggagctgatttttaaaattgagtaaggtaattgtgataggagcaggaccagcaggtattatggctgcaattgaagcgagcaagtatcatgatgtaacaatgattgatggaaatgagaaaataggcaagaaactttttattactggaaaaggcagatgtaatgttacaaatgctaaagatatttcagaattttttgattatatacctggtaatccgcattttctatacagtgcattatatacatttactaatgaagatactatgaatttctttaaaaaccatggtataaagctaaaagtagaaagaggagatagagtttttccagactctgataagtcttctgatatcctaaaaggtttatctaatgcacttaaagaaactaatgtaaaaattaaacttaattcaaaagtaacagacattaaatttaaggataaaaaaataacatcaatagttataaataattctgaagtaatgaaagctgattactttattatggctactggtggaggatcatatccacttactggttcaagaggagaaggtcaggaatttgccagaaaacttggacataatataataaaattagaaccagcacttgtacctatggtggtgaaagatggaaaaactaaggagttgcaaggactttcattacgaaacatagaaataaatattaaagaaaacaataaaaaaagtgtctataaggaatttggagaaattaattttactgtatttggagtttcaggacctcttatattaaaaggaagtaggtttattgaaaaaggaaaatcatatactgcacatgttgatttaaaacctgctctgagcattggagagctagataaaagaatacaaaaggatttttcaaaatacataaataataaatttaaggattctttaaatgatttgcttcctcaaaagattattcctatgataatcaatatgtctaatataaatgaggaaaagattgttaatgaaattaccaaagaagaaagaaaaaatttagtaaatactttgaaagattttacttttgatattgatggacttcgcccattagctgaagggatagttactaggggtggagttgatgtaaaagaaattgatccatcaacaatgaaatcaaaaattatagataatttatctttctgtggtgaagtgatggatgtagatgcatttacaggagggtataatgttcagattgcttttgcaactggatttatagcaggaaataatatcacaatctaggttgtattaatttgtcatataaaaacttattcttgtttgccacgacaaaaaattatataatcttattgtaagcgttaaattatggttctaagaaatgaggagaataactttgaaaataagtgtagcaatcgatggaccagcaggtgcaggcaaaagtactatagctaagcttgttggtaaggaacacaatcttatgtacataaatacaggagcaatgtacagagcagtagcactgaaagctgaagaaaataatatatcaccagaagatgttaaagaaatttgtgccttaacagaaatgttagagatgcattttgaaaacgatgatttaatagtaaatggtgagaatatacaggaaaaaataactatgccacaaattagtaatattgtatcagcatatgcaagtattccagaagtaagaaaaattctagtgaaacttcaaagagatatgtcagaaaagtacagtgttattatggatggaagagatattggaactgtcgtattaaaaaatgcagattttaaattctttttaacagctagtgcagaagaaagagcaaatagacgatttaaggaacttcaagaaagaaatattgagtgttcttataaagaaatattaaatgatattgtggaaagagattataaggatagtcatagagctactgatccattaagaaaagcagatgatgctattgaaatagatagtacttcactagatattaatggtgttgtagatgagattaatagagtaatatatgctggcatatagattagataaagtgctaaatgctgggtttacttatgaaaaggagtatggtaatgagggaagttattttagcgaacaattcaggtttttgttttggagttaaaagagctgttgatgaagctattaatattcaaaaacagtataataaaaaaatatatactttaggtcccttaatacataataatgatgttgtaagttatttagaagataataatgtattttcaatagagcttgaagatatatctaatttggatccaaaagatgtaattgttataagatctcatggagtttcaaaagatgtattagcaatgttggaatcaagaggtctaacagttgtaaatgctacatgtccctttgtaacaaatattcaaaaaaaggtaaagaaatattcggaagaaggatatcatatagtaatattaggagatgaaaaacatccagaagtagtaggtattaatggttggtgcaataatgatgcaaccataactaaagatggtaatatagatattgaattaccagaaaaggtatgcgctgttgctcagacgactgaaaagaagaaaaactgggataatactgtggagcatttaaaagatgcaaaggaattactctccttcaatacaatttgcgcagctacagacgtaagacaaaaaagtacttatgatctttcaaaacaagtagatgcaatgatagttattggtggaaagaatagttctaatactactaaactgtatcatatagctaaagaaaactgtgaacatacaatccacattgaaaatataaaagatttgcctaaagattttattaataatgatataaaaaaaataggagtaacagctggtgcatcaacaccagattggattattagggaggtacttgatattatgagtatagaaaacaatgtaaataatgaagatcaattagcattaatgaatgagactgatatgaaagttgtaattggaacagaagttactgaaaatgttatttcaaagaacaatgaaggtcttgttattggaatgaatggatatgggatagatggaattattccttacaatgaattaacaggaaaatgtgatccaaaagaatttgcacaaagcattaatgtaggtgatccaataactgcaaaagttattaaattacaaaataatgatggatttgtagtcttatcaagattagaatatgaaaaagaagaggcttttaaagaattagaagttcttttcaatgaaggaaaaacttttgaaataaaaataaatgaagcaaaagataaaggtttagcaggaaattataaaggaataagagtattcgttccagcttctcagatagatgttaaatttactgaggataaagaacaatacttaaatcaaactttagaagttaaacttattgattttagtactgcaaaaccaattaaagttgtagcatcaagaagagctttattagaaaaagcaaaaaatgaaatggaaacaaaagcatgggaatctttcaatttaaatgatgttgtaaaaggtgaagtaaaaagatttactgattttggtgcttttgttgaaataaatggagtagatggattgttacatttatctcaaatttcatggaatcatgttaagaagatcgaagatgttttaaagataggtcaaattgtagatgtaaaaatcataggtttagataaagaaacaaaaaaattatctttaagtatgaaagaacttatggcaaagccttgggataatgtaaaagaaaaatatcctgaagactctatagtacttggtaaggtagtaagattaagcaagtttggtgcttttgttgaattagaaccaggtgttgatggattggttcatatttctaagatatctcacgaaagaattgaagaccctgcacaagttttaactattggacaggagataaaggctaaaattttaagtgttgatgaagaaaacaagagaataagcttaagtataaaagatatttaatattaagattatattaacttagtaccggatctatagtttgtgttatagattcggtattttttattcttacttaaattataatacgttggctaaagaattaattttaatggagttgactttttaatatgtagtctatagaatggtgaccttggcaattttttattaagatacttgcatattattgactataattaacataagaactataatttacttatcgtatagaaatggagtttaagcatgattactattgaaaaattgtcattatttaatattgagaatttcagaaaattatataattcaaagtatagatcttatatatgtgatagggatttttttactatttatgatgaagaatcttttgtggtaaagtatttactacggaagcaggtgaagatttttaaatacaacaataagaatataggatatatatggtatgatgaatcaaaaatagataatactttaaaaaatatttattcaatgtacttttttgatgattttattgaattactagatgataaagttttagattttataaaatgtaatacacttaaacttgatatagttgaaaatgagagtattagcaacttaatgaataggcttggttttactatatatagtaaaacgtgccttatgaaattaatagcttctaaaaaacctattgaagttaaagatggtataaattttaagcactttataaaaaattgtgatgaaaagttaagatgcgatgttcaaaatgaaatattttatgatgaaaatagagttcctttagatacagaagatatttttgatgaagaagaacaggattattatatcaatgatttttctgtttttttatacgtcaataatgaatgtgcaggatatgggcaaataattttaagcaatgacttatatactattgttaattttggtataataaaaaaatatagatgttgtggatatggacaactacttttgaattatcttattgaattatgtagaataaatcaaattgagcatgtatatataagagttgagaagaataattataaagctgtttcgttatataacaaagttgggtttagagagtatatttcatatgatacttggtataaatgtatataatataagcaaagtgaggtttaacatatgaagagggcacgtatagatgatgtaaaagatgctattagagatttacctgttgataagcagaaaaatgttatgcttattgcaaaaactcatggtgttactacacgttttgttgatatgattaatgatcctgaatatgaaaaaaatagatcggttgattcttggattcaaaaatatattgatgaattaaaagagaaataaaataccagacagcttaaataaaagctgactggtattttatgtttaggttaaaactatataaaaaagtgcacttagaacattgtgtgtagcatgagaaagctatcacaaagttttaaatctaagtgcattcaagatgttaatataatttataagtttaataatgatttaattatattagtatttggctttcaaaaaacaaaataacaagaaacttgaaaaaatgttaaaatagttataagatgaagatatatttcatattataactatttttcattatataggaatgtttaaatttacattattaagctatgattatagtgtttgtattatgaaaaatagtaataaatataggaaaataaaggagaattattaaaatgacaaaaattgatattatttcaggattccttggagcggggaaaacaacacttataaaaaagattattgaagatgtactttataaagaaaagcttatgataattgaaaacgaatttgggcagataggaatagacggaggctttttaaaggatactggaattgatattactgaaatgaattctgggtgtatatgttgttctcttgtaggagattttggaagtgctcttagagaagcattagaccaatataagccagatagaataataatcgaaccatctggagtcggtaaattatcagatgttattaaagcagttgaagaaattaaagatgatacaaatgtaaaacttaatagcttttgtgctgttgttgatgcacaaaaatgtaaaatgtatatgaaaaattttggagagttctttaataatcagattgaaaatgcaaatacaattatactgagccgtactcagaaattatcacaagaaaaacttgaagatgttgtttcattaataagagaacataatacaaaagctactgttattacaacttcatgggaagagataaatggtaagcagattgtcgatgcaatggaaaaatcaaactcactagaaaatgaattgttcaaagaagaacatcatcatcacgaacatggtgaaaaatgctgtcatggatctcatgaaggtgaagaacatatacatgaggaaaattgttcatgtcatcataatcatgaacatactgaagaatgcacatgtggtgggcatcatcatgaacatgatgagcattgtagctgtgggcatgatcatcaccatcatgatgcagatgaagtatttacaagctggggaattgaaacccctaagaaatataataaagataaacttaatgatattctttcactattaagtgatagttctgattatggtgttatacttcgtgcaaaaggtattatttcagatgaaaaaggaaactggtataactttgatcttgtgcctggtgaatttgaaataaggaaaggtgaaccagattatacaggaagactatgtgtgattggatctaaattagataaaaataagatagaaacattattttgtttaaaatagtattaattattgtagcaaccttaatagaaaagaggcgaataaaatgaaggttccagtgtatttatttactggatttttagaaagtggtaaaacaacatttataaaagagattttaaaagatgaagattttgtaacaaatgaaaatagtcttcttattctttgtgaagaaggagtagaagaattagaaaaatatgaattagaaaaagctaatacaacagttattcttataaattctgaagatgaacttacacctgaattaataagaatacaaatagaaaaatgtaaggcagatagggtacttattgaatttaatggaatgtgggattttgataatttatatgattcagttctgccaaaaggatgcgaaattgctcaagttgtatgtactatagatgcatcaacatttagttcttatatgaacaacatgggatctataatggtagaacaattcagggatgctgatttagttgtatttaacagatgtaataaagatactaaaaaaatttcattaagaggtagcgtgaaagctattaacatacaggcaagaattttatttgaaaatgaaaatggagaaattgataattctgaagatgtacttccttttgatattaatgcaaatgtgattgaaccagaggagtatgattttggaatactatatgaagatatgatgtcaaaccctaaaaagtatgatggtaaaaaactaaaacttaaagtgatggcttatgatccagataaatatccaccaaaattttcgattttaggtcgtaatgcaatgacatgttgtgctgatgacattacgcctcttgggctaatatgtaagtttgaaaatgatgttgaacttgaaaataaagaatgggtagatataattgctacagttcataaaacaaagattgctcaatatgatgatgaacttcctgttctacacgttgaaaaaatatcatcaactaaaaagccagatgaagaattagtttatttctattagaaatactgtataaagcttaattataataaatctactataattaagctttaatttttatattgtgatcattaaatttaaaaaaatctagatacgccaataactataaatatagagatctagggataaatagaataaatctaaaattctaatatgtaaaatagggattttagatgatttgtgaaaaagaaattcataaaaatatctagtaagtgtattaatgtttagaaatagtaaactttttttaaattagtatcgaaaattcccgagtgttaattatataatactaaacatttactttaatttagaaaaaaagatttcttgtgatttctatagatctttaactttaataaaattgaattgtacttactcgagatagttaaaagactaaggtcttttaataaaactaattatttgttataatacaaaagaaaattgtatataaaaaggagaaataaaatggactttaatatagaagaattagatcaaaataaaatttcacaagataaagcaaagtttttctttattcaaacattcggatgtgcgttagtagaagaaaagaagaattgaaaggctagtaaaaatgagggtttagacctcgtatatgaatgttgatattagaccattcgtaaattgaatgcttataacttttctatcacgaacggttattttggtaatcaagctattaacaaattcttttattatatctctgccaacacgctgtattaatgatttcatgtttatatttccttcaattatttcttttgagagttctagtgttgcagtattaagaaaaaagttaatattatatgttgatgtggaaattgtagcagatgattttatctttgcatcaatttcctttatttttgtattaataatatttttcttaagtatataatctttttcagacatttctttttcatcatatagatatagattttcaagtctttctaatgctctatgttgtttctttaaatcagcatccaatttatttaaatcaatatttgctggtttagtttcttgtttattaggcttaaatattttacttgaagtattataaaaagaattaaaaatatcatcaatttcaattattccttttacatcattaaaagaagatcctgaaagtaaattcttttcaatatcttcaggagatagttttttataagttttagataatttaatcatatttgaaataaaattcagagtgaaattacctataatggtatcgcttattgttttttgattgcaacctaaatggttatatctacttgagcatgtatatatgcttggagtatatccatctaaacttgttttatcagatttagaataaaagcttttgtgacattctccacattcaagtaatccagcaaaaatatgtgttttagacttagctctgaagcgagcactgtttttctttgcattttcatcaagaatattattacacttagtccataaatctaaagctattataggatcatggttattatctaaaacaatccattcattttccttcttctttttgccacgagcagattctctaaaattataacgatatgttcctttataaaatgggtttctaaggatatcgccaacagttttagttgaccaattaccatcacgtttagttcttatattatgttgattaagatattttacaaccgcagaggttgattctgtttcaatgtacttattatagattaattcaactgttaatctttcttcatcatctattactgggaatttgataattttatcccatttgtagccaagggggattggagcaccattccataaaccttttgtagcacgatcaagcattgttgctgcaactctttcaccagtaagttttctttcaagttctgcgaaaacaaggattatttttaacattgcttcacccatggcgctactagtatcaaactgctcatttttacttataaaggtacagttatatttttttagttcatcatacatagaacagaaatctaataaatttcttgatattctatcaatcttccagacaagtaaatgactaaattcaccttctttaattcggttaaacatatctttaaatgcaggtctatctgtattttttccactatagccagcatcttcgaatacaacataattatctattcccagtattagtttagagtaattaattaaatctttacgttgaagaggtaaagagtctttatctatttgatgtgaagttgatactctaacgtaaattgcactttttttattcatttttcctccatatttttaaagagctatgaagatcataactctttactgattattttataatttttaaatgatcctgaacagaatcaagtttaattttaatttttgttaaatcagattgaatatttttctgatttttcaaaatctgatgtaataaaaattcaattttattatctattctaattacatcctttcttgaattagttaacataagggatactatcacgatataaactatcgggacacatatcaatatcatcattccaagcaatagtatagttataaataatatgaactttattaaataaatttttatctttaagtggtttataaactgctttgtcaaaaagtgatttaacatcaaaaagacgtttctcatgattactaaattctatcaataacatgtagttatctaatggatcaactgagattattgataataattcacctttacttataatatcgctcataagatcacccctaaaattattttaatggttctattttataaagagtttcaccagacatagctaattgccagttggcgtttaattcatcttcatgaagaacagcccaggctgcaataagtttctgctttttcttagggaaagagccttctactacttcaccatcaaaattaaaagtagctttaaactctccgtatatagcatgaaaatgtggtgggttatgctcattattattatacatttgaataagcacaccatagaacatagatatagttggcattacatttcacatccttttactttagtatttaagcgccttttggctttcctgaagctgataatatttgccctttttgctcggcttcaagttctttacgataggattcaacttcataatcaatattatttgttgaagtatcttcagtagtagcagcttcttcattattaagcttaaaaaatccactaaaaatattttgaataagttcacttattttttctctatcagaatcgctcaattcaacatatgcttgaagagcttgtttttcagcaacactaaagttatatttagaagcaatctggtcaactaattcattagcagtttttacaaacattggctcagaaccattacgaagccattcttcattaacattaaattctctacagatatcaaaaataactctatccataatattacgagttcccttttcataattggatattgcagatctagtaacattgattttttcaccaaattcttcttgatttagttttaatgtttttctaatttgagatattctttcaccaacattcttggcttttctatcaaagatattcattttttcacctcccataatatgattatatattttaaaatacacggagtcaacaaaaaatacaaaaatatgttgacacaattacacgaagtagaatataatatacacatagacgaaataaaaatcaacaatatcacatctgaaaaaacaagcaactacaaaatctgtgtagtaattcaagtttgttaagcagttagtagaagaaaagaaacatttatatataaggaggacgaaacatggaaacaagaaaaataacaccagaattcgaaaagaaaattgatagagatatgtcaatgtttgcacaactagatgaaaatgaaaaaagctttatcatgggagctatttggactatgttatcacagaaaaaaggaaagggggtgaattagttggataatgtaaaacttgatgttattcaaagcaatacattaagtagcgacagacttatagatgataaagaaaaagaagtagctcaaaaaatactaacagacttggaaggaacattagtaattagagccacttcaattttaaaattttgtttaaatgctattcaatatacaaaaattaataaacaaactgctcctgaagtactagttcaagagcagttagaaaatttagaaataaagattgattctaaaaaggtatctgaaattgcatctagctatgtaaccaatcatgataaagcttgagtaattcaagtgtaatagttatgttttgtacacctatagcagttacaagattaggaatacctttcacatcagatgtttttgaattagctttttcagatattgcttcaataacgtctggattaagagttgataaaaaatcatcaaaatttttcaaaataagcacctcctttcaacataattttaccatattttgctgaaaggagaaaagaaaggagacaaattaaatgttagagttcacatcaccagtaccaatggaaaaattaaaagaaaagattgaagaaggttggtttgatgaagaggtgttaattcattttgttaatgctttaaaaggacctgataaagaaaaattacttaatggagaaattaaaccatatgatctttttgaattagacataatgatacgagatagaggatggatgcaagtatatattaattcacaagaatatgcagatatggatagtgaaacattaaatgtagtaaagaaaagaattgataggcttttcgaacaggcaaaagaagaatgtagagttgatatagatggaacagaagaggttgctcctgaagtaccagttcaagagcaatcaattttatcaatatgttcaaaatgtaaagaactaaatatagcatttgagataatgcatactcttcaatggacaggagttgataattatttatcagctttattatttgataaagacacaaaaacaattctaattgatgaagaatcattaatgagagccattagtattgctaatccaaagcagccaattagaaaattaaagctaatttctaatgaagaatatagggaacttaggtctaaataatcttattttttaaataatttaatgccatttaattgaatatgagggggggcgaggaaatgaaaaatataaaaacagaagaaatgacagtagaaaaagcgtgggatattttacacagtagaggaatttacactattgaagaattagatgaagaactaaagaaaactaagttagaaataggaatgttcacaatgccttttgcaaaagaaaatgtaaaagaagcttaataataatatatttggagggttaagaatgaaaagtataggaattgtaagaaaagtagacgagcttggaagaattgttattccgatggaattaagaagaacattaggaatagccgaaaaggatgcagttgaaatatttgtagatggagaacaaatagtaatgaagaaatataatccatcatgcatattctgtggagaagcaagaaatgtaattagttataagggaaaaaatatttgtaaagattgtttagaagaaataaaaaaataacaggtggttttttataatggaagaatgaattttagacacaaaaaagaaagtgattgcgaccaaacaaaaacactttcttaattcaatgcataaatattatctctatatttaattataactttatgcattgaatgtgtcaattttttaaacggttttataccgttaaacggtcttgtaatgggtattaataaatcaaccatatagaatttataagagggtagacacatgaagaagaaacataaagattatgattatgaatcaatatatagcaagttacttagggaagagacaagagaagaaaagatagaagatttaagaatgaatagtaattatgtttacatgagaaagaaagtaacaagtggggatatggtagaaattgaagtttatccaatatggaaatgtaagcataatatgacaagaagtaaacagaaaaatgagagcaaagaatcacaaaagaaattgaataaaaagaattcagagaaaaaagtaatcagattgataaatacaaattttgagaaagatgatttattcataactttgacatatgaagatggatatttaccagatgaaaaaacagctagaaaagacatacagaattatataagaagattaaagagatacagagagaaaaatggattaccagaacttaaatatatatattcaataggatttgaaaataatcctgaacatagtaaaaaaattagaatacatcatcacataataattaataaaatgaacagggatgaagctgaaaatttatggggaagaggaagagcagatagtaaaagacttaaacctgatgattttcaattgacaggggttgcaaaatatatatctaatcaaggtcctgaaagatggagtgcatcaagaaatcttaaaaaacctaaagtatcaataagtaggacaggctttacaagaagaagagctcttaaacttataagcaatccaggaatatttaaagatatatttgaaaagcaatttacagactgtacctataaagattatagagcatattacagtgatgattcacctggagtttatttgtatgtgagaatgaggaaaaggaatgataaaaatgagtgaagcaagtgaacaagcagcattatttcaatgggcacaattagcaagacaagagtatcaagagttagaacttttatatcatgttcctaatggtggaaagcgtgaagcaaaagaaggagcagcattaaaaagacaaggtgtaaaagctggtgtaccagatatatgcttgccagttgcaaaagatggattctttggattgtatatagagttaaaagtaggaagaaataagacaagctctatgcaggatatttggataaaaaggttacgagatatgaattatagagtagaggtttgctatggatggcttaatgctagagatgttatagagaattatttggattcagaagatactttaactaagatactttggttatagaatttacagggggtacaatgtatgaaatataaaaaaatgacacctcatgaatttgcagaaaagacagttagagatattgaaattagaaggaaaagagtagaggaaggaaagaaacaagctggaatgcattgggcagaaaataaagacagaatacaaagaagactatcacatttaagatgatgaatgagttcaaattttaaaataaatatgagaagaggtttttcaatgaaagtaatttcaattattaatttaaaaggtggtgttgctaaaacaatgagtagcataaatattgcacatattttggcaactgtccacaataaaaaggttttacttgtggacaatgataagcaaggtaatacaactaagttatttggattacatgatgaagaggaattaagtatagctgatattatggttgataaggaaattgatattgaagatacgatatcacctacacagtatagaaatttagatgtaattgcagcagacatgagactattaaaagcaaatcttaatgtgattatggatgttggaagaccacaacataacagattacaaaaggcattaaagcagattgaatgtaattatgattattgcataattgacaatccaccagatataaatataagcgtaataaatgctctagtagcttcagatgatgtatttattccaataaagattgaccagttcgcatttgatggaatgaaagagttgatggagcagatagaaaatgcaaaagaaatgaatccaaaattgaaattgcaaggttgctttataacacagtattcaaaaaaccaagtgaatatacagggtgaggagctattaaacaataatacagaatatccaatgtttaaaactcatatacgaaggactgtaaaagttgacgaaagtacatttgctaatcaaccaatattggaatattcaaaacgttgtggagcatctaaagattatattgatttagtagaggaatatttagataaaacggaggaataactgttatggctaaatttaatatgatggaattgttgaataattctaataatacagatgttaagcagaaagaaaaatcagtaaaattcaaaacaatacttgtagatattaatgaccttattccatcagataataatttctattcaattgatgaagaaggaataactgaattgaaaaattctattgaagtatttgggatacaacaaaatttagttgttaaaaaaatagaaaatgataaatatgaaataattgcaggtcatagaaggcatttagcattaaaagaacttgtagaagagggtaaagatgtattcagatatgctccttgcaaaatagagacagaggaagaggatttacgaagcaaattattattactaataactaattcaacggcaagacaattaacagagtgggagaaaacccagcaagcagagaaattaagagaattattaatagaatataagaaacaagaaaaattgccaggaagagtaagagagattgtagctgatatattaaatgttgctacaagtaaagttgcacgaatggaaagtatatctaagaacctatctgagaatcttaaagaagaatttaaaggagataatataaatatttctacagcatatgaagcatcaaaattaccagaggaacaacaacaggaagtttacaaagaacttaagggaaaaggtaacataacaatccaagatgtaaagaaaaaatcagaagttaagaaagaaaaaataaatgaagatgtatccaatttggacacaaatacaaataatgaaactattgatttggatacaggagaaatagtggaacaaaaagtaccaaattatttaaataaaaaaatattcgatttaataaaagaatttaacatagatgaaatggcagtatttttttgtagtagatgtaaatgtgaaggacaattttgtgattttgcatcagattgtacagaagaaaataagcatcagttatgtgttgactggctaagtcgtttaattgaatagaaattaaatgaagagggaattatttcaggaacttgttgttgaagtatctgaacttagatgtgttggctgtaaaaaatgtgattatgataattgtgaaatatatcatgcattagatgatgtgaatatggcatttgttagtgaagaagcaaattgtccttatgcatgtgatttaaataaaatgacagatgaagaatttaaaaaggtaagtgaactaaaaaacaaactaaaaaataagaatatatttttcaaagatggagggataaaaagtgaataaagtagttttaataggaagattaactaaagatcctgaacttagatttacacctggaagtggtgcagcggtaacaactttaacattagcagttgatagatataatccaaagactaaccaaaatgaagctgattttattcctatagtaatatggggtaaacaagctgaaaacactgcaaattatatgagtaaaggcggacaagttgctattagcggaaaaattcaaactagaagttatgatgctaaagatggtactaagagatatattactgaagtagtagcagatcaatttggtggtgttcagtttctagggaataagggtgaagtaaatcagaatgatggttctaataattttggaaatatgaatcaagacatatttgaagaggatataacaccagtagatggaggggacatgcctttttaacaatggaggaatagtatgaatccacaagatataatggatcaaattaaaaaggcacaaagagaacttagtgaattgaatacaaagttgtttaggtatggacaggaaaaagagtatgcagagcagcaatataaaattcaattaagtaagaagctgttgcagctaagaactgaaaaatgtgcaacaacgattattaatgatatagcaaaaggtgatgaaagaataagtaacttaagattaaaaagaggattagcagaaaataagtatacagtatgtcaggaagcattaagaaataagaggttggaactggattgcttaagaagtttattgacatggcatagggtagaacttaataacagttaattttttacttatgagcggataaaattttaaaaaatgtatatgaggggtattgaagatgaaagagaaagaaacagaactattaagggaaaagatgtatgattgtattttaaaatatggaactaatgataataggacaattttagcaagtcagaaattagatccttatgtaacagaggagcagagagagtatgggaataattaaagatatagtggataaagttgcaccaatagcacaagaaagaattgaaaaagaaggaatagatattaaacaagctgttgaagaggaattaataaaattaaactatttaaaagatggtgatccaaatgcaaaaagaaataaagccaaaggaatatgaattttcagatgcgtataagaaagcgttagaagatggtgacataataattacaagtttaaagtcaaaagataaatatagaattgaaaatgtagagggaaaaacaaagctaaaattttttagctcaacaattgataactggaggaattgcccatttatattagctgaagaaatatcaaataaatggatattagagaagaatggagttgttgaatatgaaagttaaagaattaatagagtacttaaagagagaagaccaagaaggagaagtatatatagaatgctatagtcaaaataaaggttatgaaattgatgaagtaactaatggtgtggataaaaatcaaaatcctattacagctatatttattaatccaataaatgaacaatagtcagaaagggtgtagaaacatgaatttagaagaattagattttaagattagagaaataaaaacaggagtcatattagatttcggttatatagataatatatatccaatggaaggtatggtttgcataataacaagtgaaaatggtgatacaacagattataacttaaatgaatgggaagtacttagaaatactggaataaatgatattgatggagacagcatttatgaaggggatacagttcatcaatattcagtgttattagggaactcagatatagatattgttggagaagttcaatttttagaaggcgcatggatggttgtaaatgaagaaaaaaaggaagcttatcatttatggaatgagtgcgttgaaaataaaattgtagaggaaatgaggtagagcagtaatgaatgattttaaatatggagataaagttatttgcatagcaagtggtgtgactggaatagttataaagcaatatgtcccaacagcatgtgaagagcaaacaatgattagatgtgtagatggtaggaaatatcacgcgccaacacgtttattcaaaaaaataaattaattcagaatatgcagattggaagtgagagacatgcctaagatattaaatgtaaatatagtagttccagataatattggtaaagatgaaatacttacaatcgtaggatctataacaagagaaggctgcattgttacaaatgcaacattacaaactaatgaattaagatggataaacggagatggatttattaaattgaaataatactgaatatgcagaaaaggcgaagtaaattaaaaatatgaaggtgaggaattagttatgaaaaatttaaaaatgtggttaattggtggagctagtgtaatacttataattttactaggagtatttttggtacaaggtagtcaaaataaggctatatcgtttgaggagcaaattaaaacagcaaattcagatattgaagtacaagagaaaaggagagttgatttaattaagaatttggttgattgtgtaaaaaactatgacaagcatgaatcagagactattaaagcagtagtcgatggtagaagtgctaaagatataaatatagaacaaattactactatgttaactgcaacggctgaagcgtatccacaattaaaatctgatggtaactataagcaactaatgaatgaattaagtaccacagagaatttaattgcacagcatagaagcaactataatcaacaagttaaagaatataatcgttacgttaaaggattcccacataaacagtttcttaatgttctcggctatgaagttcaaaactataattatttaaattataatgctccttcagatgcaccacaaaatttatttggagataaataattatggagataactaaaagagaagtagttgccagcgtaattatcatagcgattatgcttatattaggattatctattggagacaagttaagtaatcatatgatggaccaaaattcaaaatattatagagctattcatgtaaatgctacagagttatttcaatacggattagatactagtgtaggaaatgcttttatatatggagatttggttgccgaagatactgtgacatatcctgaaatcggaggggaatatttagctgttgagaagataaaagaagaatacactatgcatactagaacagttacagatagtaaaggaaaatctcatactgaggtatattatacatgggatgaagtgagtagggataataaagaatctcagaaagtagtatttttaggaattgaatttaaaacatctcaattcaatatacctagtggagattatataacaactaaatatgaatcctcagatataaggaataagtattatggatatgaaattagctctacagggactatatttagtaatttatcaaatgggaatatagaacagaaaaatgtaccgttctttaaaaatatgacaatagagcaaacattgcagaatttaacatcaggcatatatatttatatattttggggtgtatggattgtaataactgcattatgtgtatatggattttattacatggataataattggctaaataactaatacacaatacttataaagtcagaataaaggagagtaaaaatgaaatttaaattgtcagaagaacaaagacaacagatattacaaaatattaagaaattatatgattggataaaagaaacagttagaaagataatgaaaccaatagtaagttggataaagaagaattatggacaagtgaattatattatccaaagacagaaagcatatttaaaatataagagaagagttgagaatagacaagtattatatttaaaacgtagaagaatatatggtaagtaatagaggtgagaatatggaatcaataaatattgaagagatagttgaaataactattcaaaaatatgagaagaaacaaaagaataaaataaaacaaaaggcattcaggaatacaaagcttcttatgaaaaattacaatgattttaagaaacatattaattattcggtatcagatgttaatgatctacagaagattgtagatatggatttaaaagaaaatgagtgtgatgaattatttatattaagtataaagcaaagtaaaacaaaaactctaataatgacaactcatatagagaatgcattggatatattagaggatgaacaaaaagaagagggaacaatagaaaaatatagagcattgagaatgtattatatagaaagaatgagttatgaaaagattgcagaggctttaaatacaggaattaatacacctaaaagatggataaaacagatgttagacaggcttggaatactattatttggagttgatggaataaaattagattggtaaataaaaggtaaaaagatggtattttaatgatactttaattaatatataatgatatcatggaaaagctattagaaagtcctcaaatcataattgttaaacttaagagacatttaggtaatactaagtgtctttttattatgtaaaagaaggtggtatggtgataaagttttataaaacaattaaatggaaaaataaaagacagaatatattgaaacgtgataattatctatgtcaagagtgtaagaggtatgggaagactacaggagcaactacagtacatcatattaaacctttagagtttaactatgacttaagatttgataataataacttaattagtttatgtagtaaatgtcatgataagatgcatgatcgtactaataatgaattaacagacttagggaaaaatttaattgagagaatccaaaagaaaaaaatttatatccccccaccttaaaataaatttaaagaggtcttaggagaccggggagtggaactctttccaatagagcgaaaaaaataaaaaaggggggtaagggtcaatggcagttaaaactccagaagaaaaagaaatgagaaaaattgaaaaacaaacaattaaagacatgcaaaatattggcacttatcgttccgaatttaatgcaactattagagcttattctgaaatgagacaacaatataataaattaacaagtgagttttatgcaggtggatgcaaaataacagaagagtatacaaataaagcagggtttacaaatataagaaagacagctttatatttagcgatagaaacattgcgtaaagatatagttaatcatgaaaatattcttgggcttactccagcaggattaaaaaaaataaaaagtgaagctccagggaaaaaagtaagtaaacttggaaaggctttgagtgaacttggacaatagtaaatttaaaaattatgatttagtaatggagtatgctaaaaatattataacaggtaaaaaattagctaataaggaacagatacaaggttgtcaaagatttataaatgatttagagaataaagattatgattttaatcctaaagatgctgaatttgttattggaataatagaaaaaacatttgtacatgctcaaggtgaaagattggatggaacaccattaagatattcaccatttttattagagccatttcataaatttcaaatatataatctacttggtttctataaaaagggaacaaaaataagacgatttaaagaagcatttatttttatacctcgtaaaaatataaagacttcttttgcagctgctttagcttgggcattaggattgctagaaagaaaaagtggaagcaaagtatatataactgctgctgctcttaagcaatcacttgaaagttttaattttataaattttaatttagagcaaatgggagaaaaagaaaattttagagtaattgataataaccaggaacattctataagtggagatttaggtgatggtagtatttatattcaagctttagcagctaatccagatagccaagattcacttaattgtaatattgggattgcagacgaaatacatgcttataaaacacctaagcaatataacatcattaaagaggcaatgaaggcatatacaaataaattaatgataggtattactactgctggtgataatatgaattcattctgctataggaaattagaatattgtaaaaaaatacttaatgggactgttaaagatgaacagtattttgtgtttattgctaaagcagatcaagataaaaaagggaaagttgattatacaaatcctatagaacatgaaaaggctaacccagcttatggagtatcaattcgacctgatgatattcttaatgattctctacaggcaatgaatgatcctcaacaaagaaaagattttcttgccaagtcacttaatatttatactgctgctttaaaagcatattttgatattgatgaatttagagcatctgatagaaaatataattggacattgcaggatgtattaaagtttcctatacaatggtatggtggtgctgacttgtcaaagctacatgatttaactgcaagcactttgtatggaacttattataatgcatataaggatgataatggtgaaatgcatgatgtagatataattatccctcatgcttggtttcctattgttatggcagcaaagaaagctgacgaagatggaataccgttatttggttgggaagatgatggttggctagatatgtcaaataatcctacaactaatacaagtgaggttgttaactggtttaaaaacatgaagaaaaaaggatttaaaataaaacaagtaggtcatgacagaaaatttgctagagaatattttattggaatgaagaaagctggctttaatataattgaccagccacaatatttttataaaaagtctgaaggttttagacatatagagaaaaaggctaaagatggtgatttatattattttcatgctgattgttttgaatattgtgtacaaaatgtaagagcaatagaaaagactgatgatatgattcagtatgaaaaagttgatggtgatggtggtactcaaagaatagatatatttgatgctgctgtttttgcttgtgtaagaaaattagaagatatggaaaaggtagggtcagctagtaagtggcttaaaggataattgttaggaggaagttagataatgaatgaatttatagaaaagtgtaaaagtatagtggcagtatatttaggaaatccgaatatgtcaaaagatgaaatatttgttgtttggagttgtaagacattacaaaataagaaagcactattaagtgccacagctaagggagctccttattttgaaattacttataatggcgataaggatgaaacttatgtagatgtatataaaaaagaaagaaattatgttgttaaataagtcttaagaaattaaggctttttattattctcttgaaaggtggtgagaacatgaaaaagagcagaaagagaaaaaatataggaaagacaagagcagagcctacaacccaaaatgctttaagttggtttcttagtactgatgcatatgatactttatgtgttcaaggatatacacgcttaagtgataacccagaggttaaaatggcagttcacaaaatagcagatttggtatcgagtatgacaatccatttaatgcagaatacagacaatggagatataagaatcaagaatgaattatctagaaagatagacatcaatccttatagtcttatgacacgtaaatcatgggtatataacatagtttatacaatgctccttgagggaaatggtaattgtattatatatcctaaaatagttgatggattaattgatgaattgattccgttaaaggctagtggagtaagttttatagagacaccaactggatacaatgtgctttacaatggaaaaacatataactatgatgaagtattacattttgcaataaatcctgatcctaattatccatggaaaggtactggctataaagttgtattaagagatatagttaaaaatcttaaacaggcaactgctactaaaaatggatttatgtctgataagtggaagccgagtgtaattatttcggttgatgctttcaatgaagaaatggcaagtaaagaaggaagagacgctatacttgagaaatatatatctgaaactagcgggggtaaaccttgggtagtacctgctgatttaatgaaaattgaaactgtaaagcctttaagccttacagatttagcaattaatgatgctgttcagattgataaaagaactgtagctgcaatattagatgttcctgcatttatagtaggtgttggaagttatacaaaggatgaatataacaattttattaatacaagaattaaatctattgctgaaataattcagcaagtgcttacaaaaggattgttatatggtccagatttatattttaaacttaatcctcaatcgctttatgcatatgacatgaaagagctgtctgatgtaggttctaatttatatataagaggaatgatgacgggtaacgaagtaagagactggataaacaaacctcctttacctggtttagatgagcttgttatattagagaattttataccagttggaatgattggagatcaaaagaaattaaatcaagggggtgatggtaatggatagaaataagaagcaaaccagaagcttaaaaacagaacttaaaacaagatctgaaggtgaaaatatgactattgaaggttactttgtagtttttaatagccaaactgaattatggactggtgcatatgaagaaatagcaccacaggcacttgatgatactttaagtaatgatataagagcattaataaaccatgatacaactcttgtattaggaagaaataaagctggtacattagaacttaaaacagattctagagggttatggggtagcattaaaattaatcctaatgatacagatgcagttaacctttatgaacgtgttaaacgtggtgatgtagaccaatgtagttttggttttaatgtcacatctgaagaaactgattggcgtgatgatggaacagttaagtggactattacaggcgtagatttacatgaagttagtgtttgtactttccctgcttatgaagatacaggagttgcagcaagaagcaaggaagttgaacagcataaggaaaaacaattagaagtaagaaaagcaaaattgaaagagaggttgaataaacatggcaattaaacaattaatgttaagtaaaaagattgaacaaaggaaatctagtttgacagaattacaaacacaacaagaaggtttaacaactagatcagcagaattagaaaaagctttagaagaggctaaaacagatgaagaaatagaagcagttgaggaagaagtaaacaaacttgattcagagcaatcagaattagatgaaaagaaaggaaaacttgagggtgaaatcgcagatcttgagggtgaattagaaaagttaaatgctaatgaacctgaaaataatccagcaccagcacctacaggaaatgaaagaagtaaaggagttgtaaacagtatgaaaattagaggtaagttctttaatggaatggaaagagcagcagttcaaaatttaattgagagagaagaagtaaaggaatttgtaactagaactagagaatttatggaacaaaagagaagtgttactggtggagaacttggaataccaacagtattcttagatatcttaagagatactttaaatcagtattctaaattaatttcaaaagttaatttaaaaccaattaaaggtaaggcaagacaaaatattgctggaacaattccagaaggtatttggatggagacttatggaaaactaaatgaattaaacataagttttaatcaagttgaagttgatggatataaagtaggtggatttattgcagctccaaatgctttattagaagattcagatcttgatttagtaaatgaaattatgtacaacattagccaagcaatcggtattgcaatagataaggctattctttatggtacaggaacaaagatgccaataggtattgtaaaaagacttgctgaaactactaagccttcttattggggagaaagtgaaaaaacttggactgatttacacacaagcaatttgttgttaatagatccagcagcaaatacagatgttttattctataaagatttaattcttaagtgcggaaaagctaaatctaattattctaatggtggaaagttctggtgtatgagtacaaatactaaagcaacattaactgctaaagcattgactattaatgctgctggggcaatagtaacaggacaaagcaatacaatgcctattgttggtggtgatattgttgaattagattttattccagatgatgttattattggcggatatggttcactttatttattggtagaaagagcaggtgctacattagctcaatcaacagaagtacagtttatagaagataatacagtatttaaaggtactgctagatatgatggtagaccagtaattggagagggatttatcgctataaatataagccagaaagatggtgctacagtaccaagtgcgacagcagtaacatttgcagcagatagtgctaatacaaattcataggagatgattaaaagtgaaagctaaagtattaaaaacttttgttgatggtgtaagtaagaaaattagaattgaaggcgaagtgttcgatttatcagtagaaagatttgcatcaattagttctataaatgataaactcattaaggagattgataacgtaattgaatatcctaatcatataggtgggggatattatgaattatctaatggtgaaaaagtaaaaggaaaagatgaagctttaaaagctgaagaagcattaaaggaaacagcaggagatccaccaaataatgaaaatgaataaggaggattaataatgaatacagaaacaatcctcggacttgtaaaggctaagttgggtataagtacaactgtaagagatacttacttacaggctattataaacggtgtagttaaagagttagaagatgaacaggggttagtgctagatggtactaactcttatcatcttctttttattgtagattatgctacatggagatatgaaagtaaggataaggatggagcaatgccaaggcacctacaattaaggttgcataatttagttattcatcagaaggctaaaggaggtactatataatgataggtgattatggattaacattaatttcaacagatgtaacctatgatgatattggaaatcctgtagagactccaaaagaaattgatatattttgtgatatgaaatctataggtagaacagagttttataaagctgctgctaatggacttaagccaagttatatatttgtggtccatccttatgaatataatggcgaaacttatgttgaatttagcgaagatgaaaagcctaaacaaaggtataaggttatgaaaacatataaaaagaatatggaagagttagagttaacgtgcgagaaggtggcaggtaatggctaaaataaatttagcagatgaaatagcaaaagcattaacagattatacagatgaaattactgaagcacttgaaaaagaaaagaaagataaaggcaaaaaagcagttcaattactaaaagaaagaagtcctaaaggtaaaacaggtaaatatgctaaaggatggacagaaaaaaatattgatggaaaagaagttgtttataataagacaaattatcagcgtacacatttgctagaatatggacatgcaaaaagaaatggtggaagagttgcagggaaaccacatataagacccgtagaggaacaaataaatgatgaattcctagaaggtgtaaagaaggtgattaaggggtgatattaagtgatatatatacaatcttaaaggctactggttatccagtggcttattcgcattttactgacactcctaataatccgctgcctaatcctccttatataacatatgtgagtgcttatagtagtaattttaaagcagataataaaatctataataaaattgataatttacaaattgaactttatacaaataaaaaagatttgcaagcagagaaaatattagaagatattttagatacaaatgaaattgcttacgaaacaaccgaaacatggattgattcagagcaattattacaaaaaatttatgaagtgaggttgatataacatgagtgaaaataaagttacatttggtcttaaaaatgcacattatgcaaaaataacaattggtgaagatggagaaataacatatgcaacaccaaaagcattgccaggaaatacagagttatcattagatccaagaggtgatatgacagaattttatgcggatgatatgttgtattattctgctgataacaaccaaggttatgatggaagcttaacattggcaaatcttactgaagattttcttacagaaatacttggagaagaaaaagattctgaagatttggtaataacagaaaaatctactgctacaggttcatattttgcgcttatgtttgaatttgctggagatgtaaaagccataagacatttaatgtactattgtaaagcatctagaccaaaagttagttcagctacaaaaactgataaaacagaccctaatacagtagaattatcatttgtttcaagtcctagacctggagattatgcagtaaaaacaaaaactacgacaactacaccagctaaaatttatgatgcttggtatacaaaagtttatgaaaaggtagtagcttaaggaggttaggtatggaaaagactattgaaattgatggtaagcaagtaagctttaaatctacagcagcaacaccattaagatataaagcacagtttggaagagattatttttcagaaatactcaaaatggaagaattaacaaaaatcaagaaaacaaaaaataaagctgaaactttagctaaaatagacttcaatacattttacaacattatatgggtgttagctaaaaccgctgataagaaaattccagaacctttagagtggcttgatacttttgaagagtttccactatttgaaataattccgcaaatacaagatctaattgtggctagtatacagggtaaaaaaaaatagaaaatgaagatacaaggaacagtgaagtaatgactactgagctgttcctttctttgtgcagaaaatcaaagctaacattagacgatatggaagttatgactataggaatgtgcctggattatatgcaggaatatgttgatataaataatcctaaaaaatctagaaatagaaaggcaactcaatctgattttgatagtttttagcctttagaaaggaggtcatatggcagatagaataaaaggtataacaatagaacttgatggagaaaccacaggtcttaaaaaggcattaggagatattacaaaacaaagcatagatatacaaaaagaattaaaggatgttgataggcttttaaaatttgatcctgggaatactgaggctttagcacaaaaacaaaaacttttatcagaacagatagaagtaacttcaaaaaagttagatggtttaaagagtgctcagagtcaagtcgaacaacaatttaaaaatggagatattggagaacaacaatatagatcttttcaaagggaaatagaatttactgaaagttctataaaaaaattaaagcaatcattgtctaaaatagatgatggaagtaatgttgataaattaaaaaaagacatgaaagaattgggagaatcaacagaagaagcagaagacaaggttggagaattaaaaagtggattatctcaattagttattggagcagctactggtgtaggaatatctcaagtaatagaagatgcttttgatacatcaagtttaaatacaaaattatctatttctatgcaacttgatgaaggttccgtacaatcagtaaaagaagcaataaataatattacaagctatggagttgatgctgaatcagcattagaaggagtgcgcaggcaatgggcgcttaataaagatgcaagcgatgaaagtaattcagaagttgtaaaaggagccgcagctatagtatcagcttatggagatgttgattttactgaattaatacaggaaacaaatgagttatcttcgaatttggggataacagatcaagaagcattagctctaacatatagcttattaaaagttggttttcctccagatcagttagatataataacagagtatggaagtcaattagctagagctggatatagtgcagaagaaattcaaggaataatggcagcaggggtagaaacgggtacatggaatattgatgttttattggatgggctaaaagaaggtagaattgtaatgtctgagatagcacaaggtgtaggtccagaattagaagaattatttgcacaaatagatgtctcagggaaacaattaagcgattggggaaaagatattgcggcaggaggttcagaaggttcagttgcaatgcaggaattagctcaagctgtatctaatattgatgatgctacacttcaaaatcaaataggtactactatttggggaactctctgggaagaaaatggaactaaaattacagatacaatcttaggaatgaatgataatctaaaaacagcagaacagaatcaaaatgatttaaatggtgcaatatctgatttagattctgatccaatgatacaattccaaactgctcttgcagatttaaaattagcattatcaccgcttcttgaaattatatctaatttgataggtaaatttgctcaatgggtatcaaataatccgaaattagcagcaactataactgcaatagtatcagcattgggaatattaatggggatacttactggaatagctccattggtaatgacattagcatctttggcaggaacaatgactgtaagtattggagcaatagcattacccgttttaggggtagtagctgcaataactgcacttgtagctgctggtgtattactatatacaaattgggatactataaaagttaaagcggctgaaatatgggaaggtataaaagcaacaataagcaatgccttaaatggaatagttacattttttacagttacaattccacaagcatttcagactgtaattgattttgtaactaataactggcaacaattattattattattagtaaatccatttgcaggtgcattcgctttgctatatagcaattgtgatggatttaaaacttttatagatggatttatacaaagtgtaattacttttttccaaacaggatggaataacatagtaacattttttactgaaagtgtaccagcttggttagaatcaatgtatgcatggtttgcagaattacctaataaaattgcctatgggttaggtgaagctttaggatctattataaaatggggaacagatacaataaattatttaacaactaatgttccagtatggattgaaaatatatcaacatggttttcagagttgccaggaaagatttggacttggcttgtaaatgttgttactaatttagggacatggggaagtaacgtggcaagttggataagtactaatgtaagtgcttggataactaatatagtaacttatttcacacaactcccaggacaaatatggacatggttaactaattgtgtaacaaacatgacaacttggggtgggaatatgttgacagaagctaaaactggaatgacagatgtttttaatggcatagttgatactttcacagatctacctagcaaaatgatggatataggaaaaaatatagttgctggaattaaacaaggaataagcgatgcatggaatggaatgaaaggatggataggcggactttgcgatagctttattgatggtgtaaaagaaaaaatggatatacattcaccttctagggtaatgagacaacttggtgtctatacaggtgaaggatttggattaggtatcggagatacagtaaacagtatatctaagcaagcaaatgcaatagctgaagcagcaataccagatataaataatggtagtattggtgttaattattcatctgtgggtagtgaaagtgattttagtttggaaggtggcaatttaaatgcaatactttctaaaatggatagtctgcaaaaagcaattacaaatatgaaaattatgatggatagcaagcaggtaggtaagttagttgctccaacagttagtagtaacatggtatttaatagtggaaggaagggattttaatgaaatcatatattttttataacaataaaaatagtaatgatttagatttaataatcgaaaaaactccagaaattccttctagtaatgttatatataaaactattgaaatagatggtggcgaaacacttacaaaagttgaaggcttttcagatattaattttaaaattgactttgtatattttgctgatagagaagattatttaatgaaaaaagctataattgataattggctattaaacagtataggtgagtaccttacttatagtttagatgagtttgcaagttataaagtaaagcaaataaatattggtaatacaacaactacaagcagaacaatgagacattttagtgttacatttacttgtgcaggtctgaaatatatgactaatggattaactccaatagaagttttatctagtggaatagtttttaataattttggaagctataaagccaagcctttgtttaaaatttatggcactggaaatgtaaatgttaatataaataaaaatagttttactgttaaaaacattaataactatgtaattatagatagtgaaattaaagaatgttataaagagaacataaataaaggtaaagacatggctggagattatccagttttttatattggagaaaatatgataagttggactggagctgtaagtaaaatagaaattactccaagatggaggtgctattaatgattaagttatttagaaataatgaaatagattttacacataatgaatgggttctaaatgaaattatagaatgtaaggttacagaagaattaaaaagtgattataccacagaattacagtatccattagaagataaaggtatttctagtaatttaattataggttcagtagtaactattccaactatggataacagacaagatcaacagtttagaataatagataaagatacatctaatgacactatatcagtacagatgcaagcaaagttactggctgatttaaaagaaaatagactaaaagccatgacacttacaggaatgactagaaaacaagcaatacaagccgtattaaatgcagcattagatcctcataactataaagttgggaatttagatactaatacaaatactaatgtaattgtaaatattccagaagggagtgtgttaaatgcattaataggcaatgaaaatagcattttaagtgaatatggtggagaatttatagttaataataattctatagatataattgatagaagaggtgatgataatggtgttgttattgagtatggaaagaatttatcatctataagtgaaaaaacagataatattgatttagctacggttttaataccaaagtgtggtgattatcgtcttccagagtattatattgaaagtcctaatgttaataaatatgagaaacgatattttaaagaggtagaattaaattttaatatttgggatggagaaaatgaaaaaggtgaagatcaaataactttagctgaagcatattctcttatgagattaacttgtaacaagatgtttacagaagataaggttgaccaaattacatttaattatgaaattaattttatagagctgagtaaaacagaagaatataagaactatgctgtacttgaaactgtaaatttaggtgatacagttacagtcaggcataaaaaattaaatttagacctacaggcaagagtgaataaaattagttatacagttgattgtgaagggaataaaacaatagatactgtagaaataggatttaccagaaaagaaattacagatattattaaggatactgctaagcaaattaagtttgcaaaagatgaaataaaaatgcaagttaaaaatgatataagcaaagttaactcagaacttaaaatacaggatgggaaaataagtgcagtagtagagagcgaagatggtggaatgacatggcaattaagtaaaagtgcttttattgttgcttgtacaggtgcaagtaatagtaatgtaactatagatgctaatggacttactgtaaataataataaaataagacttaaaaattctagtggagatactgttttttatgtaaatacaaaaggtaaatgtaatgcagatggtggatttatagttgatgatggaaatgcaagctgctatataaattctagtggtattaagttaactggaagtaatggaaacatagcgaaaattgaaattatcgacgattctgattatagtggtacatatattcgtgatgatctatacgtagaagatgtatgcagaatttttgggaaattaagagttcacgatactgcttggttttataaaaaagtttatgttggagatgaatcgctagaagatatgataattagattaatagaagaatatgctcctagcagtaaaggttaaataaggaggttcaaaatggctatatttgatttaaaagctaatatagatttgaaacagaatttaaatctatatactacttgtaagcaattagatagtttgaatttaattttaagtgtatttgataatagtgtacaaaccaatttgacaaactacaatgtcagattaaaagctatgaaagcagataaggtaccattagtccaagaacatacaggaatatctataagtagtaatgtaataactatagaaactgatgaacaattgacaataacatcaggaaaaacattaatagagctacagtttacagataaaggcacaggtaaaaagaaagcaacttttaatttagtattaattgtagtatctactacattagaagtggacagaggtattagcaaagccacttatacattgttggaggaattagaaaataaactggatcaagcaagtgatttctttgaaaatattgaagatgctatagtagcaaataacaatctgaaaaagactatttctaatagtgagactgctgaaagtaatttagaaacagcaattacaaatgcaaataataagaaaaatgaagttgatgaagctataactaatgcaactaataaaatagaagaagtagagcagagtattattaatgccaataattctaaaactgaacttgatgcaagtaaaactatagctgatacaacaaaaatagatttagataatgctaatgtacaagccgaaaaaaatattgaagaattaaataagcttggagatgctacagatcttgcagctaaagttcaaactaatacagaaaacatatctaaaaatactaaatctatagaagaagttaattcgcaaatgaatgaaatagcgaacaataagcttgataaaactgcttatataagtaagagtacaagtttaacgttattaaataattgggtaatagaaacaggtactgctgaagtatgtatagaaggtaaacttgttagtattagggcaaatataaagggaggtactacaacagacagtacaattataacagttttaccagaggaatatcgaccaaaagaaatttgtatgttgccttttattagttgtgatgcaacatataattatataagcggttatttaatggtttataagaacgggcaagttgtaattggctattctgcaaagaatactagagtaataattaatgctacttttaacttataggaggttgtatatgattagtgaagaattaaaaaaattattagaaagtgctaatataaaatttgaagattgttatatatctgaaagtaatatgatatttactccattatatgatgaacaatttaatataataaaatcagcattagaagtttataatgaagctaataatattacataatagacagaaaattttataaaaaaataaatttatgtaaaacaatagcagaatagacataattattatataataaaatgggatggagggatattttggaaaggaaatattatgcggatttattaagagttatagcaataatacaggtgataagtatacatgtatcaagcggattttttggaaatgtagatttaattgatacatatccatggcgagttgctacaattgtagattcgatttcaagaactggggttccaatttttataatgattagtggaatgttattattggataaaaataaaaactatgatataaaagtgttttttaaaaaaagggtatcaaaaattattattccatttattttttggggtattttctatttcgtaaaatatggaaataaaatgaactttgaagggataaagaaattcattttagcattagtaaccaataatatattttatcatttgccatttatgtatattataattggtctttatttaataacacctatacttaatgtatttgtaaaaaatgcaacacaaaagcaactatggtactttgaaatattatgttggattgtaggtggagtaataccattcataaatgaagtatttaaaatcaacattgggattcagattcctatggtaggtaatatggtgggattatttgttttaggatatttactagataatatcaaatttaataaaaaaacaagatacgctatttatttactaggtgcaattagtattttattaacaatagttgggacatactatttttcgataaaaactgggacagctaatcaaatattatataacaatggaggagtaaatataataataatagcaagttcaatatttatattatgtagacaaatatattataaatataaaattaatgataagtttaatataataattgctaatattagcaaactatcatttggtatatatttaattcatgttcatatagtattatctttggaacagagcaaaataccattattattacctcaatatatgccttgcactttttatggattactaatgagggttattacggtatttataattacatatataatagtatatgtaatatctaaaataaaatatttaaataaaattgtttaaaataaaagaacaggctatttttgagaatagtctgttttctacacaataggttaataaaagctttgaaacctagtaagttacaggtacaggctgtattttattataaaaatgaataaaaaaataaaaccaggtaaaactaatattgttcagataatagttgcctggttttactatatgtaaataaggatatatccctgtttacattattagtataaccacgcctattaaagttattcaaaattaaaactattattttattttatttttgaaagaagtggttatatgaattgtaatgaagaatttattatgaaagctcttggaaaattgacattagaatttaactttgattgggatcagcaaaggaagattagagattgtttatattatgcattatataattatgaagtcaggacattagaaaaatcattgattaaaggtgatattgaagaaaaagcattgttatatcttaatgttaagaaattagctggatatagtccagcaacattgagcaattataaatatcttctacaaaaatttgcaggatttattaataagccaatacaaacagtaaatgttaatgatattagaatgtttttagtattgaatagtgaaggtaaaaagccaagctcagttaactctatgatttactatcttaaggcattttttaattggcttgaagtagaggagcttattgaaagaaatcctactaagaaattagaagtaaataaattacctaaacgacttagaaaagctttatcaatagaagaattagagaaactaagaattgcatgcaagacaaatagggaaagagcactaattgaatttctatttgcaactggatgcagagtctcggaagtggttaattgcaacataagtgatttgaatttcaatgaaaactcattaagagtaataggaaaaggggataaggagagatttgtatttttcagtgataaaacaaagttatatttgaaaaaatacttagaagatgatagaaataaagataatgaagatgctctatttgtatctgaaaaatttccatataatccacttggtaggcgtggaattgaaacaatagtaacaagaataacgaaaagaactgatttcaataaaaaagtatttccacatttattacgacatacaatggcttgtgtagggttacaaaatggagcagatcttgtgacaattcaaaatttattagggcatactgaccccagcactactcaaatttatgctcagaatagcattgataatttaaaacatgaatataaacaacattttaattgttaaatgaaagagattagagaaatctagtctctttttgcatataaaaataaatagaaagaaggtattacaaatggaaaaaacaacgtatttaaaaacattagttgcatcaattggagcatttttaagctttaagttaggaattttactgcctgttttaggattgttatcattagtaatgataacagattatgttacaggaattcttgatgctaaaagtagaggagaaataaacagtagaacaggaatgtggggtatagttaagaagttgctctatggggtggaggttgccatagcaatggtggtagattggactattataaatgttgctggacagttgaatatagacatacatatggggactttctttggtttacttgtttctatatggcttatattcaatgaaataatatctattttagaaaacttaactagactcggaactcctatgccatcattcttagttaaatttgtatcaacttttaaggttgttgttgaaaataatggagatatgttaacagataatttagataaaaatataaatgaaaatagttagataaagctgttcgtcatggacaccttatttatataaaaatagaaagagggaatgggaaaatgaaacatataatatcagtaggtcatactgcaagtggtaatattggatgtggagcagtagggttattggatgaatcaaattgtacaagagaaataggaccagcagtagcagattatattaaaagcgctggagaagaatcggtattgttaaggatagataaatcaaattcatataattacgaggattgctatgtaagggcatcacaagcgaatgaaataggagcagatacatttacagagattcatataaatgctggtggagctggtgcaagtggagttgaagttttacttaattctatggatagtcgaatgaaaccttatgcagaaaaggtatgtgagaatatttcattagctttaaacatacctaatagaggagttaaagtacaatcattaatagttcttaaaagaacatctatgccagctatgttggttgaatgttgttttgttgattctccagatgcagaaaaatataatccttatgtaattgctaaggctatagctggagcattagtaaataaagatttatcagatgatgatcctataaagttaggttggaatgaatcaaatgataacagatggtggtattgtacagatgtatcaaacaaaagttattataagtctgagtggaaattaatcaacaataaatggtatttatttgatagttatggctggtgtattactggatgggtttattatcaaacttacaaagataaaaaagatgtatggtattatttagatccagcaaattgtgatatggctattggatggcataagatagatggagactggttctactttgataataatggtgaaatggctacagggtggattgttgacaatggaaaagactattatttatacagcacaggtcagatggctcacgactgcgaaatgtatggttataagtttgattcagatggagttgctactaagatttaatatgatataatatgtaaggctagattgcacaaatatagctttaacaccaaaaaggcagcagataagttaagtgatctgctgccttttttattacacatatcataaaacttgacaatttttatatataatatacaattaatgtatattaacatttagggggtaacaaaataatgagcaaaatgataaaatgcaagacatgtggggttgatatagctaaaagtgcaaaatcatgtccaggatgtggagcgaagaataaaaaacctttttatactagatggtggttcatacttattgctatatttataataataggagctttaggtggtaataaaggtagtaacgaatcaacaacggcttcgacaaatgaaagtacaccagtgactacagctaaagatgaaagttcttcatcagtagatgcgtcaaatgattcaaaagatagtactgacaaagatagtactgacaaagatagtgcagattctgatacaaagaccgatagtgttccaattgaatataaatctgcattaaagaaagctcaaacttattcagatagaatgtatatgtctaaagctggactatatgatcagctaacatctgaatatggagaaaagtttccagcagaggcagctcaatatgctatagataatgttaaagcagattggaataaaaatgcattagagaaggcaaaaacatatcagaaatcaatgtctatgtcaaagagtgcaattcatgatcaattaatatctgaatacggtgaaaaatttactgaagatgaagcacaatatgcaataagtaatttagaagagtaatatatctgttttaagtatatgatgtttacactattaaatttaaggactagaattattttctagtctttatttatgtgaggtggagaaatgccagttaagaataaacttagagaaatacgtatgcgggagtacatgcttaatcaaaaagaattttgcaaaatacttaaaataagtcaaagtacatattctgcaattgaatcaaataaaattcaaggaaatatagaaaatatattaactatagcaaaagcacttaatcgtaaggtagaagatatttggtacctagaagattaggtgctttctttattgacttcaatatcgaatattaataattaaacctaagattagaaatttatatttaaattagtaatttttacgtaataatgtacatataaattaaacataacaacgtggaaaggaagtaaaatattgtgattttagaagtagatgttagtacaaaaatgttaataaattttgataaggtaggtgaatatatatggcaagaatagatataagttttaaatcaactagtagagatatggaattatataattattggtttaacatcgaggatagatcaacagaaattaaaacagtattaagaatagagatggataaaagaaaagagcaaacaataataaaaaactaaattcacagaaaaaaatgtagataataagtatcaagaagtcgacatacttaacttctaatagtgtactaatagtgcactattgtatataaatcatatataaattaaatgtattgagataactcgatagagtaggggaggggaattatgagagaatttaagggtcgaaaaaatgaagaagaattgagaacggagcgtgttgttgcacatgttacagaggcagaaaaaataaaaattatccaagaagcgaaaaaatatggtatggatacttctacttttataaggacaatctgtatttataaaaagtttatagaactagctaatgattttatagaggaagtgtagtaatgcctatatggatttttgagggtacgttcttaggtttaaaaggtgggttctggttaattgggttaccattaacaatagcgatgatatacttagaagtttatacttataagaagcaaaagaaagcggaaaaggatacagcagatcttccagttgaaaatataattgtaaatttaagcaaagaagaaaaatggatgttagagaatataattaaacgtagtaaatctgaaaatttagatttatatataaaagatataattaatagaatgaaataattaagcatcttttatttgaagagaatatttgctataatacaaccgtaaagcaaataagtaaaaatggaggaaagacatgaactttaatatagaaaaattagataatctaaaaataaaagataagaaagaacaattcttctttatttctacattcggatgtcagatgaatgaagaagattcagaaaaattatctggtatgcttaagagacagggatatacccctacagaagataaagaagaagcttctattattatatttaatacatgttgtgtaagagaaaatgcagaaaacaaagtgtttggtaatctaggaagattaaaaaagagaaaagaaaataatccagatttaataatagctatctgcggatgtatgatgcaacaaaagggaatggctgataaaattttaaatgaatatccatatgtagatataatttttggaactcacaattcatataaattcccagagtacttaaacagagttaaaactgaaggagtacagataaaagaaatatttgataaagaagctgaaattgtagaaggagttccaatagacagaaagagtagtgtaaaagcatttgttacagtaatgtatggatgcaacaatttctgtacatactgcgtagttccttatgtaagaggacgagaaagaagcagaaagccacaagacatagaaaatgaaattaagggattagtagcagaagggtataaagaaataactttacttggtcaaaatgttaattcctatggtaaaggattagaagaggaaataacatttgctcagttattaagaagaattaatgaaatcgaaggattagaaagagtaagatttatgacatctcaccctaaagatctaaatatggatgttatagaagctataagagattgtgataaattatgtgaacaaatacatctaccagtacaaagtggaagtgatcaaatacttaaagtaatgaatagacattatacaagagattattacttaaacttagcaaaagcaataagaaaagaaattccagatgtaactttttcaacagatttaatagtaggattccctggtgaaactgaagaagattttcaggctacattagatttagtacgtgaagtaaagtatgatgctgcatttacttttatatattctagaagaaaccacacaccagcagataagatggaaaatcaaattcctgatgatgttaaacacgaaagatttaacagattagtagaggctgttaatgaaggaatagttgtgggtaacaaagctatggaaggtaaggttgttgaggtattagtagaaggaacaagtaaaaatgatgaatctagattaactggaagaactagaaatgcaaaacttgtaaacttccctggatgcaaagaattaattggaaaattagttaatgtaaaaattgtaaaagctaattcgttctccttagtgggtgaaattgtaaaataacttacttaatgaataaagacagttttcattaaaaactgtctttatttggcattattgttgttttattaatacatttatgttagtctaagtatgcaaaggaaatataaacatttgctcaaaaggggggatttttatgttaaaatctaaaaaactaaaagggttaatatgcatatctgttattctaactttaaacctaaccaatgtaataacaacttatgcaaaagatgcatctactcaaacacaagacatacaaagcgaggtgaatgaagggtataataataaagcaattgatgattttgtaggagacttaaaatatgataagatggaagttttagcgaatcaaggtgatacagtagagagctttataccaaaatcttctaaaaatgttgaggataaattcattgttgtagaacgtacaaaaaaatctataaatacaactcctgttgatatttcaattatcgattcaatgactgataaaacttatcctggtgcattgcagatagctgatcgttcatttatggaaaataaaccaacattattaacagctaaaagaaagcctattaatataagtatagacttaccaggaatgggtaaaaataattctttattagtggacaatcctacatatggaaatatatcaggttctatagataatttagtatcaaaatgggttgatgaaaattcagacactcatacgttgccagcaagaacacaatatacagaagcaatggtacacagccaatctcaaataaatgctgaactaaatattaatgctaaagcgttaaatttaggtttagattttaatgctatatcaaaaaatgaaaaaaaagctatgatagttgcttacaaacaaattttctatacagtaagtgctgaattaccaaataatccttctgatttatttgatgatagtgtaactgttagtgaattaaaaagaaaaggtgtaacttctaaaactccacctcttatggtttctaatgtagcttatggtagaactatatatgtcaaacttgaaactacctcaagtagtaatgatgtagaatctgcatttaatgcactagtaaaaggtatcgatataaatgaaaaagctaaatataaagatatattagatcaaagttcctttacagctgttgtattaggcggagatgcatatgaacacaataagataataacaaaagactttgacgaaataagaaatgttataaaagaaaattcacaattcaatgcaaagaaccctgcatatcctatttcgtatacaagtgtgtttttaaaagataattctgttgcggctattcataataatacagaatatgtagaaacaacctcaactgaatacactaaaggtaaaataacattagatcattatggtgcatatgttgctcagtttaacgtttgctgggatgaagcatcgtatgatgataatggtaatgaactattaaatcataaaacatgggatgggaattgggaggataaaacggctcattttaacacagtcattccattgcctgcaaatgcaaaaaatattagaatttttgcaagagaatgtacaggactttcttgggaatggtggagaaatattttagatgaatataacgtgccactaactgatgatataaaagtagagataggtggaactacattatatccatcagcaagcatttcaactaataaataggtcatattaatattatgaacaaaaaagagaattcaaatttatgaattctcttttttatctgctattatcaaacaatatcattattttttattaagtcagcaaattcgcattcgataacaagaggcacatcattaggattcatttctatttgagatcctattttaccaccgctaaaaactatagtttcacaatctaaagcagtattatgtatgaatgttttgaatacctttttcatgccaaggggagagcatcctccacgaatgtatccggttatcttattaatgtcctttacgtgtatcatttctatattcttttctccagcagctttagcagcttttttcatatcaagttcctgtgcaactggaataacaaaaacgaaattatcttttgaatgtccaactgtaacaagagtcttaaaaacacaatcttcatcttttcctattttgtgtgcaacagcaataccatctatttttccatcttcgttttcataagaatgagtagtgtattcaaccttatttctatctaataatctcattgcattagttttattttcttttgcttttgccattatctttttcctccaatcaagtgattattattatcactttttttctctatctatagttattatatcatattcatttttgggttaaaaataaaaagctttaatagtgtgttttgtgcttctctttttctctccctctgttttttcttgagaatttgaaagggtagtgctatttttttaaaaaacagtttttgcacaaagcttcaaattaaatggtatttaaaaatatgaatactagtaattaaaactataatatattaagttaatatttataattataatgttaatattataattatataaataaataattatttgtataatattatttttttaaatatagtatataaaactagtaaatatagttattttaaagattataaaattaaatttaaaaaataacaacttgtagttatttttgtttgaacatatttttaaatttttatttcgcttaaaatcaacatgtaaaaactagattttagtaaaattcaattatatatgcaacaacatttaataaaccaacctgattcaaagttaatttatcaccggtttaaatatattaaaataatgatatttctagaattttatttttgattaatcttaataagtagcgataaattcagaatagtgagtttatattttttaaatacaaaggtagcttgaagataaaaaacaaattattgatataataattaaatttatttatacattaataatttcgctaaatatacatttagcgaaattattgaagaaaaatcgtaattttgatataatatacttaaacttagtgtacaagccgttttccttatttttatcttattataaacgagattttgtacatttagtaaaaatataaagaaatgattaaggtgattattatgaaatatgacattcaagtacttaaaaatgatgatcttccagaaagtgtttctgattttttaaattacctagaaacaatacgaagtaaatctccaaacacgattgatgcttataagatagatcttactttattttttagatttttatgtgtttatcgtggattggttaaaaatgatattgaatttgaagatataaatataagcaatatcgataatgaatttcttaaatctattaaattaagggagttatatgcttttttatcatttgtggaaaaatacagaaataatagctcttatgctagagctcgtaaggtagcaactttgaaatcattttttaaatacttatttggaaaagcaaaaataatatcggataaccctgctatggaattagaatctcctaaaataaacaaacgtcatcctgtttatcttacactaaatcaaagtattgctttgttagaatcattggataaagatgataagaattacgcacgtgattattgcatactaaccttctttttgaactgcggaatgcgtctttcagaactttgtggtattcagatagaaaaaatacgtggtgatatattatctattgttggtaaaggcgacaaggaacgtactgtgtatttaaatgaagcctgtttgagagcacttaacaattacttgagtgtaagagatgattcaaaagcttcttatgaaagtaagaaatatttgttcttatctgctagaaatgcacccataaataaaagaacagttgaaataatgataaaaaaacatattaccaacgctgggtttacaggcgaaaaatatactcctcacaaattaagacatactgctgcaacattgatgtataaatacggaaatgttgatataagaagtcttcaaagtattttaggtcacgaaaacatttcaacaacacagatatatacacatgttgatgatgatgatttaagagatgctgttaaatcaaatccgctatcaaaattataaccacattataaccacttccctacactaaaaaagatgaacaagctataataagcaaattcatctttttaactcctatattaaaggattaccatagagagtgttaaattctgttatgtacgcatcgtttgtaccttcgtaaataactatagtatctccttttctatagtaatgtggttttgttgtataaactgcattaccatcaatagttaaaccgtctgaagatattttctttacagcagcatcagcatcagctgaatttttgaattcatatactcttataagttctccgttttctgatgtgtaatctgtttcagttgtaccagcaaaatagtcttttttgctatctacagattcctttaaatcacgtcctgatttagatatatcattttttacatctatggctgtatactttactgcatttccaacaccttcaacactgtcttttacagcttcagctccatcttttacagcatctcctgctttgtctgcgctttctttaagcttatcagtagcagtattcccattgtcagttgtattagtagagttatcagttttgttgccacatccagttatcattattcctacagtaagcatcgcagttaaagataacgctaaaatagttttatatttcattaaactcatccctttcacattaattatcacattattattatgtgaaattaatataaaactattcaaaacttgttgctatgtaaaaattaaaatgtaataaataaaaagcgagtaaaaaagtatacactaaatctactcactttttaacctatttatctgtatttttaaaacgtctaactcctggataaacctcttctgtcatatcttcaaaatcagcatcgtttaattgtgaaagttcttctatgtattcaatatgctcgaaagcatcttcgtactcttctgattcggaattttcatcaaaagaactgttaaatccaaatctattatatatatcctttaaatctaaattttcttcatttatttcatgtaattcatcatctgtaagatttgactttaaatcatttataaattcttcttcaagaactgaattttcttctaggtttttagatatatcttcaatttttattgcttttgtatcgataccttccatttcaagacatttaccgcagttgtcacaaattttattctcatagatgtcacagtaatcatcatctgtatatttatatcccatcacacagcacttcctctccaaataaagtcatcttaaaattataacaaaagcaatagtaaaaatcaaattataaactaatttaattggttctttatttcaaaattacgattttattagctacagaacataggtttgctatatatatgacaatatggtataattaatacaagaatagcgaggtgtatgcaatgggcgacggaaaagataaacaatcagagatatacgagtttttaaaaaactacacagaaaataagggttatccaccttcagtaagagaaatatgtgaggctgtttcattaaaatctacttcaacagttcatggtcatttaaaaagattagaaaaaaaaggacttataagaagagatccttcaaagccaagagctttagaaatagccgaattatctactcctaagaaagaaatgatttctattccaatagtaggtaaaataacagcaggtcttccaatactggctactgaaaatgtagaagatactttttcattaccccttgattttataaaacatgataaggaattatttatgcttcgagtttctggtcaaagtatgattaaagctggaataaatgataaagatttagccattatagaaagatgtaatgatgcagttaatggtgagattgtagttgcattaattgatgatagcgctacaataaaaagatttttcaaagaagaaaatcatattagacttcaacctgaaaatgatacaatggatccaataatcgttgatgattgttcaatacttggaaaacttgtaggaatattcagagcatattagaaataataaaaagacatacctatgtattcttatgattatataggtatgtctttttataaagttaaaatataaattcatatattttaactttatttagagtcaacaaattttctttttctagctttttagcgctttatcaagacctataagaacaccgattttaccgtgatcaaagtttaatccaccttgcatatatgctatgtaaggttctcttacaggaccatctgccgataattcaattgtagacccagatataaacgctcctgctgccattacaatttcactatcatatcccggcatagcccaaggttcacatacagcaaatgcatctattggcgaacctgcctgaattccactacagaaattcacaagctttttaggatcaccaaattctattgcttgaataatatctgttctcttttcatgtgatgatgggaaaactttaaatcctgatatctccattactcttgcagtaaatatagcagttttaaccgcttccatagtaacatgaggagctgagaataatccctggaataaacttctcataagtccatatgtagcaccatactctcctcctacacctggaacagtcattctattggctgctgcatctacataatcttttttaccaactatatatccgccacctggtgctattccaccaccaatatttttcataagagatccagccattatatcagcaccaaaatctgtaggttctacagtttcaacaaattctccatagcagttatctacaaatattattacatcgtttcttatttctcttatacacgaaataacttctgcaatctgagatactaaaaatgattttcttgaagcatatccagtacttctttgaatatgtataagttttatgctcttgtcgttttttaaagcctcttttatagcatcaaatctaaaattaccttcttcatcaagatcgataacatcagttgttattccatattcatctaaagaaccaggattttttttcttagataaacctaatactccaagcaaagtgtcgtatggcataccagaaacgcataatattttatcattaggtcttgtattaccagcaattgcacatcctattgcatgagttccacttactatgtgtggtctaacaagacctgcttcagtattaaatattcttgcatatactctatctaatgcatctctccccatatcatctaatccatacccagtagtattagtaaagtgagaatcacttattttttcttcttggaatgctttcaacactttaagttggttatattctcttatttcgtcataatctttaaattgctcttcaatatcatcaatagcctgtctatatacttcaaaagtattttcgcttatattataattatttcttaaaaattcttcagttttctttaacatgtgtaagttttctccttcaagttacattaaaaagtacttattttaatacttttacatctattataactctacttttttcttatgtcatcaataagtttaacatgatgtatacaactaatacattatttatctaggctttatttcacattaattatgatctttttttgaataaagttcttttaaatacttacttagttttatattctcttcataatctactctacaatcaattattgaaggtacattttgtttaaatgcatcttctaatgtaggaataagatcctctgctttttctattctatatcctttggcatgcataccttcagcaagttttacaaaatccggatttgaaaaattaacaaaacattcttgtccatattgatctaactgtttccatttaataagcccataattgctatcattaaaaataagagttacaaatggtgtaccaatacgtatagctgtttcaatctcttgtgaattcatcataaagccaccatcaccagttatggttaggacttttttttctggatatataagtttagcagcaacagcaccaggaactcctatccccatagtggcaaatccatttgatattatacaagtatttggtttataacattcatactgacgtgcaatccacattttatgtgcacctacatcagatattacaatatcatctttccccataacctttctcacatcgctcaaaattttctgtggtttcataggaaatgaattatcatgttcaaattttttgaattcttgttcaatctctttttttatttgtaaagcataagaaggttcatgctttcttgaagttcttctaagaatattatgaagtgaatctgatatatctccaactacctctacaattggctgatataacttattaatgtgagcaggtcttgtatcaatatgaactatatttaaatgcccatcattattccattttactggagaatattcaacaatatcatatcctacagcaataataagatctgcactatccacaattttattaatatgatctttttgtggtattcctatggtaccaattgaatatttattatcacaaggcactattccttttgacatcatagtcattacaacaggaatctttaaatctgttgcaaatttagttaatgattgacttgaatctgcacgtacggcactacttccaactaaaataactggtttttttgctttaaatatttctgcagcagcatcttcaattttatctataggcgcaaattcttttgaaataatttttttctttaaaggcttttcactgctatttatagacatctttgctatatttacaggaaggtcaatatgacatgcaccaggtttttcgctttcagcatatttaaatgctatccttacaatctcatttacagtatcaggacgaactatcattttcgttctttttgtaataggttcaaacattttacataaatctaaaaactgatgtgatgtaagatgcattctttctgtacctacttgtccagttattgcaattaaaggagctccatcactatgtgcatcagcaacgcctgtaacaagattggtagcgccaggtccaagagtagataaacatactccagcctttccagtaagccttccatatacatcagccataaatgctgcaccttgttcatgccttgtagtaatgaattttattgatgaatcgcgtaaggcattcataacctcaagattttcctcaccaggtataccaaaaatatattcaacaccttcttcttccaaacattttaccaataattttgcagtatttaattctgtaggttccataaaaattctctccttaattgaaatcaatttataaagtatagtaaaaaaagagctctggtattttcaaaccaaagctccattgctatatattaaatagtatatctttaaataaaaatcatatcaatacttaaaaatatttccctacatatttcttgtaataaatagcaatatttattacagtttaaaaaataaataggcatattatgcctatttataatgtatattaattattaataaaaggtattggcttttcaggtgttattgttgaaattgaatgtttatatattaacatcatattctcatcacattctaagataactgtaaaattatcaaatccttttacaatccctttaatttgaaaaccatttaataaatgaactgttaaattagttctattttttcgtgcattatttagaaaaatatcttgaatattattaaccgttttattgaccaaatacaacacctcccatattttactagtacactataattatacccctagttatttcttatgtcattaagaactttatgtaaaatttcatcttcactcattacatccttatcaaggaatatgcatcgtttatcacgcctaaaccaagtaagttgtcttttggcataatttcttgagccttgctttatcatatttactgcatctccaaatgaaattttattttcaagataataaagaatttctttatatcctatcccctgcattgattgcatatctgaagtataacccatttctcttaattttatgcattcttcaagaaggcccttttcaatcattatatctactcttttattgattctttcatataatttatctctattcattgtaagaacataatagtagacatcataatcacttttatagaaatcttcaccagcattaaaggagctaaagggcttctttgtaagtttatatacttctaaggctcttattactctttttctattgtttgcatgtatttctttatagcttataggatcaatttcttttagcatttcgtgaacaaaatcattacctttttcttctgataatttttcaaggtacaatctatattcttcatctttttctgcttctgtaaaagtcatattacatgttagtgaatttatgtagagtcctgtaccaccagcaataataggaaatttattttttgaaagtatattttttaaggctatttctccatattccttaaaatctgctactgaaaaaggtacattaggctcaattacatctattaagtgatgcttaatgccatccatttcttgttctgtgaccttggcagaacctatatccatgtatttatatatctgcatagagtctgctgagattatttccccttttaactctttagcaatttttatagaaagctcagtcttacctacagctgtaggtccaccaagcactaatagtttttgtttcataagtttatttcctctccaaactaaaataaatagtatttaggtatctatatttttatactattcttttaaattttttatctatatctgtacttgtaaattttattataattggtcttccatgtggacaatgaaatggatcatctatataccttaaatcctcaatcaatttaaccatttcatttatttgaagttcatcatttcctttaatagctgatttacaagcctttgttgcaatagcgttatgttttacttcagtagtttttccattacctaaatttttcaaattatcaagtatttcaataaatagttttttaggattaagtttacctaaaaagtatggaacttcttttaatgcaattgacgttcctccaaattcctctaaaataaatcctgcatctttgaatatttctttattttcttcaaaatatgaataatcatcaatcgttaaatctataatgcttggtatcattagtggctgaactattatatctccagactcaatatcttttagatatttttcaaaatatattttttcatgagctgcatgctggtcaatcatataaagggttccgtcatattctcctaagatatatgttttattatactgacctattattgatattggaggaaattttgcaattttttctttatattttactttttcactataattaatagtatctgaatctttctgtaaatcttgatctaaaacactattatcagcattttttgataactcactactagaagattcttcctgaataacatgagattctacaatattgttgttagaagtcatttcaaaagacgatttttcattattattgtaagcatccttgttattattaacgttacgcttaagatctaccggaatatcaatactattatctataacacagctatcttttaaaacaaagtcctttttatcttctttaaataagggactatttataaaagagttatctgcctttaataccccaccattatttaaaatttcttttgcagcattacttgcaagtttaactttttcttcttcttctttaattttaaaggatatttcttcaaaagatggctgaactgtctcttcagattttacttcctcttctattgcaaatgattcaaaaatatcattctttaaagaattgtgtacagctgaaaaaatctttttaaacaccattcgctcatcattaaatttgatttctgcttttgtaggatggatattaacatctacgtattcaggataaatttcaacgaataatacaaaaaaggggaatttattaactgtagaaaatgatttaaatgcctgttctactgctactgcaagacttttattttttatatatcttttattaacaaaaatgctttggttatttctagatcccctagcgatatcttcttttcctacatatccatgtatagtaaccaaatcactgctgtcttcaaaataaataatgttatcagttatagatttcccataaatagttcttaatgtatcttttatatcattattaccaaaagtatgtattactttcttgtgattattaaaaagtttaaaacttatgtcgggatttgctagagcgattctagttattatatcatttattaaagatccttcttttgaaactgactttaaaaatttttttcttgcaggtacattaaagaataaatctcttacttctattattgttcctttatttgtaccacattcatatacatctccaaatttgccaccttcaatatttatttcatatccatactctgaatttgctgtttttgattttaagtttactttagctactgaagcaattgaaggaagagcttcccccctaaaacctaaagtacttatattatatatgtcttcagattttgttattttactagttgcatgtggcatgaaagctttttttatatcatccttaaatactccatcaccatcatctataattctaatgagagatgtgccaccatcttctatttctatagttatattttttgaagctgcatctattgaattttcaactaattcttttactacagaagaaggtctctctactacttctcctgcagcaatcttattagctgtatcttcatttaatatattaattcttttcataagagtaaatatccctcctttcacttatttaaacataattcatgtatgtttcactatgagctttaaaatttaaaagccacataattatttaaacattaattatctatcgtatttatttttaataacaaatgtattatataatagtttaccactcaaaaacaaataaaagcaaaatgatttagaaaataaaacttaatcattctgctttttatataaatatattaaaatatcctttaatttttatatttatgttaaatcatataaatttactgcatccatgcaccagaaggaccaattttatatccatcaatggtagtattaacagccatagctccggatttatataaataataccattttccatcactgtctaaaaaccaacctgtaagcatttgtccagctgaatttaagtagtaccaattcccacctgtaagtatccatcctgtagccttgcttccatctgaataataataattccaggtattatttacatttacccatccagtattatgagattgagataatgtcacagaagaggttgtattactattttgagtatatggattagtcattgctaatgtatcttcttttttagtcttagttatatttacagtataactcttagattcattttcatcatttgtaactttaataataactggtgttacactatctgttagagttactttttttgaataataatcagattcagaaactgtagaatcattaattttaacagtataatctgaatcttctggtatggcttcaacagaaatgctatttaaatcagaatttacatttatattataagaagatgtattcttattgaaagttaaagagccaccgcttaatgaaatactattcaaacctacatcagaagtgctattgtctgaatcactaccatagtttatttttaaagtatactgactataatctgaactgctgtaattttcgtcttcatcataatcactatcataaactcttacttttaatgtatttgtgccacttgataattttattgaatcacctaattcataaactttactattatagagtattcttatataatcatcatctacatcatctgtgcctagaataattttattagtattactttcggcatagtaggtttcatcttcttctaaatcatcatccacttcttcatcataatcactgtcataatataaatctatgctatcaccatcactgtcttctaaatctaattgtgataattctccatcactatcttcgtcattatcatattcaacttttattgtatactgattataatctgaattagagtagttctcatcttcatcatattcatcttcatatactcttatttttatagtgtttgtcccgctttttagctttattttatcaccaagctcatattctgaattattagcaaatatacgtacgcagtcttcatttacatcgcttgtatcaattgtaatcttattagtagtactttccgcataatacgtttcaccctcttctaagtcatcatcaacttcatcttcataatcactatcagaataaagatctaatgcatcaccgtcagaatcctcaatatcaagttctgatatttcatcagcatcatcagatgatgcataagctgctgttgtaaaaagatcatattttcctcctacacataacatgtttgcagttactaaggaaaatgtaattaatccttttgctgttttattcatattaaaatcccctctcatcatatcagttataatttttattacatatactatatattttggaatatgttatatatttatttataatatacaaacctgtacattagcttaacatataacagaaattataaagataatctaaagaagctttagtttttgtatcaattaattatataaatgatacttttattcaacttttaaaaacatcttttgaagagttagtccacttttatctgatataaacactgagctttcagtaaaaaaacctgcctttttataaaattctattgtatctattcgtgcattaagatatattttttttatttttttctctaatgaggttttaatatgtattttcagcatatcaattcctattcccatattgttataatcaggatgtacaacaacatttgatattttgcctacagtattttccctacttaatggagtaaatcgtgaatatgaaactatattattatctattattccaactaaatgataactgtaactatcaaattgatcatatgtatatttttgaattttgccatatggtttaaataaaatatcatatctcaaatttattacctgtttaaataatgcattatcaaactttatatatctatattcaatatcttccataattttctcactttcttaattaattacatatttattataaaacatatttttgcaaaatgcataattattaattatcaagaagaaatataaaaacatatataataaaaagaacatatattaaactgtatattaaaaaatattgctatattttaaaaaacaaaaaatggcagattatatagatttattaattgtttatttttagtaatagtgtatcgttttttgtacttaatctatatattgaaaatgagatgtataattagggagtttttattatgactaaacgtaaaaaacgtaatcagacaaataataagaccaaaaaagcattaaataaacaaagagaaatcccactgactggaaattatttaagagaacaacaacttattgataatttatcttgtaaaattcaagagaagtgctcattaaaaaatgtacttccagcaaaaattaatcttccatatcctaaaatacaagttaaaaacaaaaatgaagaatatgcaaagatattaagtcaggatttttgtagcaatgtttctgaattcacagcaataagccagtatgtaaaccatgaaattcgcttaaataataaatactgtaaagcttctgaaactattctttctatttctaaaacagaaatgatgcacatgcagatgattggagaacttattactcttttaggaggaaatttaagctatagctattatgataatggttcctattcatattggactcctaagtttgtagagtttggtactaattatgttaatatgatacttcttgatattaatgatgaatataaggctataaggcaatatgaagaacatataagggttattgatgatatgtgcataagagccgtactagagcgcataattaaagatgaaaagtaccatattgaattactaaccgcacttcttgatgaaaacaactatagtaaaagtaatgattaaatataagcaaaaaagaagcagaatgaaacttactatttcaatctgcttctttatatataaataatattatattaaaaatttaagcataaatattaatgctactataatagttgtaatacttatttcttttctcttccctgcaaacacttttaatattatatatgatataacaccaaataccataccatcagaaatactgtatgcaagtggcatcattataatagttaaaaaggctggtattgcttctgtatagtcacttaaatctatttctttaataggttctatcataaataatccaacaaggacaagagcacagcacgttacagctgatgttatacttgcaaaaagtggtgcaaaaaataatgataaaccaaacatagcagcagctgatatagctgtaagccctgttcttccaccttcagcaactccagatgcactttctacaaatgtgcttactgtacttgttcctacgcaagcaccgaatgttgtaccaattgcatcggcaaataatgcttttttaatatttggaacttttccatctttatcaagcatttttgctttagttgcaacaccaactaatgtacctatagtatcaaacatgtccataaataataaagtaaataatactataagcatatcaattgaaaaaatattatgccattcaaattggaataataacgaagtaaatgaaggtggcatacttaaaatgcttggtggcattggtgttatccccataaataatccaataattgcagtaactatcattccgataaataaagcaccttttatttttcttacaagtaaaacaccagttaataaaattcctataatagctaatagtgcaggaccacttgttatgttacctaaagcaagaattgttcccccatcttctgggtgtactattatgccggcaccttcaagtcctattaaagcaataaataatcctattccaacagaaatagctttttttatattgtcaggtattgaatcaacaattgcttcacgtatattaaataatgttaacaatataaagattaaaccttctaaaaatactgctgttaatgcaaattgaaaagaataccccatactaagtacaactgtatatgcaaagaaagcatttaaccccatacctggtgcctgagcaaatggtagcttagcgtatagtcccataataagtgttgctacaattgccgataatgctgttgcgctaaatactgcaccactatccattcctgctgctgacaatatagatggatttacaataagtatgtaagccattgtcataaatgttgtcacaccagcaatcatttctgttttaatattcgtattattttcgcttattccgaaataattatcgaatttaccattctttttaaataaatttttcatagtctcactctttcgtatatcaaattgtcacttatctatagtaaaatatatttcgacttttttcaagtgatttttcgaataatatactataaattttaaatttatttcgttatttttaaatttattgtaatatataatcttttaattgtattaatgttcgtattaataaagtgcgaaaactataatcccagatgaaaaaatcaactctgggattatagcttatttatcttttgttaatttataaagataatatatatttgtgaatgctattattaaattaacgatagcaacaggatatgcttttattataaagccataaattgtgaataaaatacatccgattaaatttataaatctaagttttactatatttttcataaacatagatataccaattaaaattgatgctgcatatcctacatattctattaatggaacattaaacataaattcaccactttcataaaattagatacgtttctaatttagtgtggctgaaatatataatctttattataatttttagttgtttttatatttgtcataaaaataatttaaaatatcattataatcatcaaatgacaagcctgataattgacaagtatcagttatagcttcaatcttcatatccattggaatatcacttattcttaaatactcagtttcatctgtattataagtttcacagatagctttttctaattcagcttctccaattccttgttcatgaaaaatatctaagaatattttatctgtataaaatttttgttcattttctgaaaaaacctttttcatttattttctcctttattttgaaagtcttcataaatattataatatatttacataaattcataaagaaaacacagataattttacatatatagaaattatctgtgtttttaatactgttaattattttgttaattttttagcttctccaactagcttataaagcatattcatagcttccataggatttaaactcaaaatatctgtttgacttattgaatttataaatgtatctttttcaaatgaatcaaaatttatctgcattgtgtcatttttaatatcacttttagctttatgaatatgtttttctttatgcatttctgattttagagcacttatttctttttcaagttcagaaacattttgtatatactcctgaatcttattttcatactcttttaacttgttatctttaaatgaaagttcattaactttatcaattagagctttttctatttcgtttatacacccttctgaattttgtatttcctcattaacacagtcttttaaactatttgtgtataaatcatcatcaatagcaatctctttaatagtagtttcatacgatgaaaggttgtttatatcaactttatttgccttctcaagatcttctaaaatttctctagccctctcaataacagcattaggaagtccagcaagttttgctacttctataccatatgattcatctgctccaccttcaataatttttctaaggaatataacactatcctcattctttttaacggctactgaatagtttttaactccttttatcgttccctcaagtttaacaagttcatgataatgtgtagcaaaaagcgtcttacatcttagattctcattttttgttatatattcaataacagaccatgcaattgataagccatcatatgtagaagtacctcttcccacttcgtctaaaaggactaggcttttacttgtagcattttttaatatatttgatacttcccacatttctaccataaatgttgattttccacctgcaagatcatcagatgcacctattcttgtgaatatcttatcacatatagaaatatttgcagatactgctggtacaaaagatcctatctgagccattagagttattaatgccacctgtctcatatatgtagatttaccagccatattaggccctgttataagaagaagttctttatcatcatcatttaagattgtattattcgatacaaactcaccgcgccctattactttttcaacaacaggatgtcttccttcatttatttgtattattcctgtttcatttatttctggttttacatagtcattttcaagagcaattaatgcaagtgttgaaacaccatctaagtctgaaattatccttgcactttttttaagtcttgctatatgtttttcaacttcatttctaacttccataaataaagcatattcaagattaactaatttttcttcagatcctaaaattttatcttccataactttaagttcttcagttatatatctttctgcatttgtcaaagtctgttttcttatatatcttccttctggaattgaactaaaattagctttacttatctcaatgtaatatccaaaaactttattgtatcctactttcaaggatttgattccagtaaattctcgttcacgattttcaagtgcagcaatccattctttaccatgaattttgctttggcgaagttcatcaacttcatcattatatccatcttttattatattaccttcttttattgtaagacttggatcttcctttattgatttttcaagaaggtctcttacatcatcaagagtatcaagattatcgtaatattcacataaaagaggtgattttgcatattttaaaagttcttttatttctggaattctgcttaatgaagattttagtgaaagcatatctttagcatttacattctgatttgatatttttccaactattctttcaatatcataaatttctttaagtgcagttcttaaatcatcattaaaacttattgaattaaatatttcttcaacaccactaagtcttttttcaatttcagattttattataagaggttcatcaatccatcgtcttaaggttcttccccccatggttgtagcacttttatcaaggacccataaaagtgaacctttctttgttttttcccttatactttctgtaagttcaagattacgtcttgaattactatcaatagtcatataattgataatttcatattgttctaaaaggtttatatttgtaaggctcatcatttgagtctcatttatgtattttaaaagtactctgcttgttaattctctttcattatcaaggccactgacttcaagatctgaaaattgttctttaagttcatcaaaagaaacaataaaatccgaaaaatctttttttgttataagggcgctgcttatcccctttatatcatttataagactttcagaagcatttacatcaagtaatatttcttttggatttaccttggcaatttcatccaaaagactcattcgtatatttttaaatgatgttgttttaaattcacctgtacttatatcagatgttgatattccaattttctcaacatcttcatatattgacattagatatgtattgtcattttctaaattagaattagaatcaacaaaagttccaggagttattatctttacgacacctctttttacaatacctttagcttgctttggatcttcaagctgttcacatatggcaaccttatatcctttgtttacaagtcttggaatatatgcagctgcagcatgatgtggtattccgcacattggcgctctttcttcaagtccacagttttttccagttaaaacgagttctaattccctagatacagtaattgcatcatcgaaaaacatttcataaaagtcacctaatctataaaataggatacagtcactatactgttccttagtcttcatatattcaaccatcataggcgttaaagccataaacaacatcctccctcataatttaactttataataatatatttgctaaattcttaactattttgatgggttttatacattatcatttgaaattataaaataaatcttaatgatttatgatattaatatattaaattcattgatatgtcaaaaccagtattattttatcacagggagacttacttatcaaaagaaaaaagaagatttaataatttaaaacagtctttaaaataaaaaatacagcaagccaatagggatgtttagcctgctgttaattggtattgtaggtttttccgaggaatcgtcttttgtatgattcaatattaacatattattccttagaattctacattttatgatatttttcaaaaactttccttcgacaaacttatggtaaaatacaaattaagttctataacatttgtatgtatgttacaattatagagaatctatttattttaggaggctactatgattgattttaaaaatagtgattttttaaaacttaagaaaatttcaaacgaagaggtaatcaatcaaattacaccattacttatatctggtgaatgtttgataagctcttataaaacaattcgtgattttgtagtatttacaaataagagagttatagctgtcaatgttcaaggaatcacaggttcaaaaaaagattttacatctcttccatattcaaaagttcaagcttactctattgaaacagcaggtacttttgatttagacagtgaacttgaaatgtactttagcgcactaggaaaagttaaatttgaatttaaaggtacttccgatatcgtaaaaataggacaaattattagtgaatatgttttataataaattcacttaaataattataatttatatccaaatagaaataattatcatattaaaaattaaatttctatcataatgttcaaaaaaataccacaaagttcaaaagaataattgaactttgtggtatttaaaataatattatttatattacaaattaatcattatattcataattagtaatttcttttattgaattatcatcattaacaaaaacaactttaggtttgtgttctttcgcttctttttcttccatttgtgcataagcaataataataacctgatcacctggctgaacaagtcttgctgccgcaccattcaaacatattataccggaatctctcttacctggaattacatatgtctcaagtcttgcaccattattgttgttaactatctgaaccttttcattttcaattatgcctgatgcttccattaatgttttatcaattgttatgcttcccatataatttaattcagcttgagtaactgttgctctgtgtatttttccttttaacattgttaatatcatcttttttcctcctagagatgtacttataaattaaaattatttaatatgtttttcttaaacttcataggtgaaattatctattaatcttgtttttcctatataaacagctattggtataagaatattcttttcaatagttgatacatctgtcaaattttcactgtcaactatttcaacataatcaatttttgcaagagactcagtatttatttcagatattattgcatcctttattttagctgcattcctctcacctttatcaagtaattgtttagctatttttaaacttctgcttaataccactgcagcttttctttcatcaacatttaaataagtatttcgtgagctttttgcaagaccatcttcttctcttatgataggacatggtactatttcaacatcaatacttaaatctcttaccattctttttaatactgcaacctgttgtgcatccttttcaccaaagtaagctctattgggttttactatattaaaaaactttgtaactacaagacatactccgtcaaaatgtcctggtcttttagcaccacataaaacgcttgtaagtcctgatacgcttataactgtagatttattttcaaagtacatttcagatggttctggattaaatacagcacaagcaccagcattttcacataattccatatccttttctatatttcttggataagaatcataatcttcatttggaccaaattgcgttggattcacaaatacacttacaataactttatcattttctcttactgctttttttataagactttcatgaccttcgtgaagtgctcccatagtagggacatatccaacagtaagaccttgctttctccactgttccactaaacttcttacttcatcaactttttttaataacatattccccatccttttcttatatagcttaaaactatttattgcttctattatttaatataaaaatcatattatattttttaactaatattaatataatttttttaattcttcttcatcgattttataagtatgaatttcttgtggaaagcttccttcctttacttcactaatataggattctattgattctctcataactgaaccaatattagcatattgtttaacaaacttaggtacaaaatcactaaacataccaagcatgtcctgataaacaagtatctgtccatcacattctttacctgcaccaattcctattgttggaacctttacggtatcagtaataatctgtgcaactcttgatggaataccttcaagtgtaattgcaaatacaccagcctcttctagtattttagcatcttctattaatctttttgcagcttcttcacttttaccttgaactctaaaaccaccaaatgcatttattgactgaggagttaatcctaaatgccccattacaggaatctgagcctctacaatggctttaatctgctttgctacacttttgccaccttcgattttaaccgcattagccccgccttctttcataatccttccagcattcatgacagcttgttcaactgatacatgatatgataaaaatggcatatcactaactataagtgcattcttagccccttttttaacagctttagtgtgataaataatatcatctactgttactcctaatgtatcttcatctcccttaactaccatgcctaatgaatcaccaattaaaattccatttatgccactttcatctaggatctttgccattgaataatcataagctgtgagcattgataatttttctccatttttttttgccttttggaacgtcaaaactgtatttttcattattctattcctcctaataatctgaataactccatattttttttagatgtattcaatgcattttcctcattgccatttgtaagattcaagcaatgattttcttcaatattagaattttgcttttctgcaagtcttaataaatttaatgataatgatttgtacaattctgtatcttcatcatttagactctcaagatgtctatttattgttttaatatctcctcttacaacaggacccgttaaagatttaacaaacccgtttttatgaatactttctaagttcccttctattagaggaaataatgcgtttaatgcatgttcttcactaagtccaagctctttaagatagcccgtaccaatatcaataagtgaaagaacaagattagatacaaaaacattagctaaatgatattttactgagtcttcgatatttcttataaaatacttgttaccgatatgattcataagactaatcacaggaaaatcattaatgttttcgttcttcaaatcgccttcaattgaaaaataaatttgctctaatatttttatagacatatttttattggaaaatgcaaacatgggatgtatagaatagattaatgcaccagataatttagcattagataaaatagttgattttaatgaaccacttgcatggcatatagatttgttttttaaatcaaactttgaaatttctctatctatgattgaaatgatatcgtcaggtgttgttataaataatatattactgtcttttataatttcttcataattgtcatatgattttgaatttgttatttctgaagcttctttggaattatttccataaaagccactgatttttattcctttatgagtaaagtaacgtcctaaattaacgcctaccttcccaggaccaataaacccgatttttatagtatcacctccatttaaagtgatacaacatcctaatttcaatctcattcgcatagatatgagttgtaagtatattctaatgaaaaaaagtctggtatagctccataagatactacccagacatattttaacactgtatatcattttttacaataattatttaaataaaatatattttttatatttacatttttgatataaaagaccaatacttaatattctatttactatccattttttatatatgttaatttccattagatatataaattaatatggattctttattcatatctcaatgcttctataggatcaagttttgctgcttttcttgcagggtaaaatccaaaaaatacacctattgtcattgaaaaaataaaactgataattatagttattagagaaattgcaacaggtgttcctattatcttacttattattgcaccagttgaaacacccaagattatccctattgcaccacctatagcacatattataactgcttctgtaataaactgtaactgaatatgataattacgagcacccaaagcttttcttgtacctatttccctagttctttcagttactgaaacaagcattatattcattactcctatacctccaacaagaagtgaaatagcagcaattactgatattgcaagagaaactaatgtaagaattttattcattgactctgcttcattttctaatgcatatgctgatgcctgaaagtttttattgtccttataaagtttatgaaaatacttgttcaaatcttcagaaagactccttgaatcaatacccttttgaggctgaatagtcataaaactataattttttaattttgaagtctcaagagtacttgaaattgttgtatataaatctgtaggcatttcactttctgaattcattcccatactttcaaacatatttgtctgatatttgtatattcctacgatatagtagctttctatattatctccacttgtaatttttacttcttttccaagagggttttcgttatttttaaaaacatttttaacaaatttatcagatactactgctgtttttttatctcctttgacatcatcgcttgatataaaacgtccctttgttatttttacattattaactttatcataatcactattaacacctacaatagaaacatttgttttagtatatccttttttaatggttccatttgtatagttatttgaaatagatatattagatattttatttttaaaatttgatttgattttatcaatatcttcatcagaaaataaatcatcatcttcagtacttgcattccagttattatctctaggcataatacgacatattatattacttgctccaagctgtgaaagtgtatcattcaaagcagaagtcattgagttccctatagatactattgatataacagatgatatacctataattatccctagcattgtaagaagtgaacgcatcttgttagctttaaggcctgctatagcgagcattatattttcttttataaacacaatgtatcactctccctatgcctctttttgtagttcaaatttttttcatcactaattacttgaccatcctttaaggttattattctttcagtttcttttgcaagttcattattatgtgttataaaaactatagtttttccttctaattcgtgaactttatgaaatatatccataacaagacgacctgttgccgaatctagcgctcctgttggttcatctgcaagtattatactaggatcatttgcaagagctcgtgcaattgcaaccctttgtttctgtcctccagaaagctcatttggtttatgaagcattctatctttcatatctacaagctctaagagcctttctgctctttcttttctacttttattatttaatcctccatagagcattggtaattctacattacttaatgcactacttcttggaataaggttaaatgtctgaaatacaaagcctatttttttatttctaatggcagataattcgttatctttaagactgcttacatcaattttatctaaaacatatgtgccatcagtaggtttgtccaatgcgcctattatattcataagcgtacttttccctgatcctgatgcgcctactatagaaacaaattctccttgttttacacttatatcaataccttttaatatttttaattcatttggagttcctatataaaaactttttattatatttttcatgtcaataatattattcataagcttgacctccatcagccggaactaattttattatttgtccttcttcataaagtgaaggatctaataaaagattatctccttcagtcaaatcactattttcaatttctacagatacatcagtttctaaaccagttgtaactggaagtttacatactgtatatgtattatcattattatccttagcaatttttatatattttccactatcttcttctaatatgcttgaaaacggtactgaaaaaacattcatacttttatctaatattatattagcctttgcattcattccaacttttataaaatcattctctttaggattatccaattttattttagcttgaaatccttgagagcttgtactatttgttccgcttttattatcactattagaatttgtattaaaagtgccttcagaagtttttattgtatcacttatactcaatacttttccttttgcatatttatcgtcaggtgctgcatctgttgttacttcaacttcttgtcctggatttattttattaacatctatttcctttacattcaccattataatgggatcatcaagattttctattgtaaataaaactccttgagaagtatttcctactgatgcgtttactgtagtaatagttccgcttgccggtgctttaattacacatttatcaagatcatcctttttccctttaagtgatatttcatccttattgttattgtattcaattagagctgaatcatattcattttttgcattattgactgcctcttttgctttaacttttgcattttctaaacttacagaacttttgtcataatcagatttagcttgatctaaagtagactttgcattatctagatccgactgacttactgcaccattatcatataaagtctttttttgatcataatctctttgagcatcattaagtttaatttgtgctgtatttaaagcttctttactgtctgttatagatgaatctatattattttcatatatgtaagaagcattgtcataagcctgctttttaccttctagttcaattttagctttttctttatcatgttctaatgtactagttgcttcagctatttctttttctaaaactgaagaatcaagaacacaaagtacatccccttcattaactttatctccagcttggacttttacttcttttattacgttattcagtgtagaatacacatttatcttatcgttgctttcgatagtaccaagagtatttacatttttaataatatcgcttttttcaagttttgtataatcctttacaatagtatcttttggttttaacataattacacctatagctgaaaaaattatcaatataataaccataaatataattgtttttttgtgttttattttcttaaagcttatgttcttaggtttaagtttaataagttcaatagttttcatttttcttcctccaaatttcatataaataacttaccaaataattgcttttgcttctattttagttgaaacttcttaagttttacttaagttgtcattaatattgtcccaaatttatctacctaaaacctaaaataaattaagaaatattttatatgttaagattttctatataaaatatccacttttaaaacgtaattaagagactatagaaaaataatatctataatctcttattaaaattttgtaatctaaaaacattaattttatttcagactacttaccatgaatatgtgaaatcaattgatgcacttactttatttatttcatcttgagttcttcttatatatttctgcgttgttgctatgctgctatgattcaaaagttccttaagtaactctatatcaccatctgttgaattatatactgtcatactatataattttcgaaagctatgactacttatgtttgacaattttaagtaattagtaataatagaaagctgtttgtgtacacctcttctttttaattttattatatattcatcagctttaatattatgctctaatgcgtattcgtatattatactttttagatttttatttatatccctatactgaagctttcctgttttcttttctattatttctagtttatcattttttaaagttgacggtgtaagtgtaagaacatcagaaattctaagccctagatttgcttgaagaagaaatgtcattgcaagctgttcattaggtctaaattttctcttctttccattatcataatattcaaaaccgtttttgcaaagttccataatttcatcatattcctctttttctaggggccttgcagctcttttttgtttagttttaagttcttttacattggaaattgactttttagatgataacttaaaattacttgtatcatcctcataataattggatttctgcgcattattatatttagaatcatttaagttactcattgcatttattatttttgatgcattttctaacgacaataagttcttagataagagttttaatatatttttaacttttatttccttacttttctcaatgaattctagcataatatctaatgcactgtcttcatcgatttctttatttttaactgctattaatatctcttccatatgtactcccatttacttttatcttaatctgaatattaaatatataattataatatctatattttactttccttcaataaattattttactgacagtttacttatttttagtacctgtttatataaattttagtgctcattattcacataggtactttttataaaaaatatttttttctgcataaccattatatttcaaggcttttaagaaagcaataataaaaagtactcattttctatattttgagtactttttgtattatcattttaagatatcctttttatattgtaaatatactcatttatgtaaatataataaatttaatttctaacaaataatttaattttaaatcattcttatatatgcaaaataacatttttgatattttaaaatttattatttttttaaatctaaactggtattaattattatttatgtattaaacttgtagttaattttttataaaattattctaaaattcaatttttcaaattcttataataaaaacagagggagcaaatatataatcaaaatcagttaaatatttacagtaatatgtataataaataacaccaaataaaaatagagctaggttatatttcttaaaagaatttatttaacctagctcattatttacttattaagaactacatattagacattataaataagaataataccatataatttaaagatatactttatttattgaatatctgataattctatatttacctttgcattaatttcttttttaagttctttattataattattgacaactatatcattttctatttttacattaggtattttaatgacaaattcacaccctttaataacctcgtcattaatataaatttctccttcatgtgaatcaactataaattttacaatggataatcctataccgctgccttcaacatttcttctaaatgacttgtccacttgaacgaatctttcaaaaatcctgctacgaaattcaggtggaatccctattccattatcttttactcttataactaagtagtcttcattttcttcacaactcactataatttcaccatcattatcggtgaattttatagcatttgaaagaagatttaacataactctttcaatattttctggatcacactttatttccaaaaattctgtattagtatcaaatattatatttcttttttgagatttttcactttgcgctatagataatgttatatcttcaataacacgtattatttcacaattagcaaaatccattttaaaacatccagcttcaaatttacttgcatctattatattattaataagccttagcattcttgatgaattttctgaaataactttttcatattttttataatattcagataaagaatctttatccttacttttactttcaagtagttgaaatgagcatatcataatatttaaaggagttcgcaattcatgagatatattagcaaaaaattgagttcttaattcttcttcatgttttagtttaagaaattcaagtttctgattattaaaatcatctactaattttttattttctttagtcatcattattacttcccaaaacatacttataacaataatagcaaaaccacagcataatattattctatttagtacatacatcgtatatttatcaggatatgaattggacattaaaagaactctactgaaaaacataatatctgtacctaaaaatgttataaaataatttacattctttttatttacatattgtatgctaaatttaataagaattataaaggttgcaatattgacacatatttttattgaatttattagtactacatgtgaatttaaaacattgcaagtcattaaatataaatcagtcattatacatataaatgtaattatcatagataaaaacactgcatatatcttattattatgtaaatatctattaataggattttgttcataataagtaagccagattattattgttctaaaaatcgatggaagacctaaaaatattttatttacctccataagttcaaatacattaagaggtcgtgctagaaatgtcatcattacaaattcaaaataaattgatatgtacataagtgaaaacatatgaaaataatcatcatcataaacactactataaagaaaaaaactaaaaattgaaattaaccctacaacaagagttatgctaactatatctgaaattagaaaccattcataaaatcttgtattgttagcaataaaaatagccaccctgtaaagcacataaaaaattacaatgttcaatattgtaattaatgaaatttttttagaatcaatagatttcattttgtcaaaaaacatttattattctccttaaatttacgtcaatataatttatactactatttaacatttccccttaaatattataacatcaaaaagaactaatttaaaataaaatgtccatttttgtaataaagatatctaaataacatatttaggagaaattttatcaagaaatcaaatatgaaattttaatttaattcaacaatgtaaacaaatacattgttgaattatctatttttatagtaattttagccttattattaataataaatgattaaaatactatagatttcaaattttaatttatttttttacaaatctatatataaaaaaagactttatatacataaacaccatttattagtgtatattatataaagtccattttatttttctttcttatttactttttcccattataattattaaaatctgatcaattattcgcctgtacattatgttcagagattaacacatttattcttctaaaataaacataagccaaaggaactgctgcagcaatccaagccaaaggatccgataaacatattccagtaaaaccaataaatttaggaagagtaaacgccactaaagctcttgcaccaagttcatatacacctgccatcattggaataaacgattctccaattccttgaagtgcatttctatatacaaatatgagacctaatggaataaagaagtatgctgaataattaaatacttgttgtgcatatgataaaatttcatcactaggattatcaataaacagtccaacaaaatatttaccacctaaaataagtattactgctgcaacaacacttgtaattatagaaatttcagaacactttctaactcctttttttatacgtgtgtattgtttagctccaagattctgaccacaaaaagtagccattgtaactcctaatgttattgccggctgcataacaatctgaagtacctttgatgctgcagtatatgaggcaattacaactgatccaaatacatttaaagcaccttgtactatcattattcctatagctgtaattgaaaactgaagtgccattggaatacctatttttaaatgatttctaaaaatacttttctcaaccttaaaatcttccttttttaatcttaaaattttatatctttttaatgtataaaccaaacataatattgcagatataccttgagaaattactgttgcatatgctgctccacttactcccatggaaaaattaacaatgaaaactaaatctaaaattatatttagaacagatgatactatcaaaaaatataatggagttttgctatctcctagtgctcttaaaatacttgaaatcatgttataacctaaaactgcaatagtcccagaatatattatattaatatattttaacgaatcatcaattatatttgcaggtgtattcattagatttaatagaaattttgaacttaaaatacttattattgtaattattataacagcagctgcacttaaaattattgaacttgacacagctttttttaatccttcttcatcttttgctccaaatttttgagcaaccataatggaaaaaccactagtaagacctacaataaacccattgattaaaaatgccatagatcctgtatttccaacagcagccaaagcatcaacccctaaatatcttccaacaataatagtgtcaaccatactataaaattgttgaaacacattacctataagtaaaggtatagaaaatataattattaattttactggattaccagacgtcatatcttttgtcatatgtttctcttatctcctaatcattttattgccgcatatagaatatcatgtttttcaaacataataaagcagtttttattatttttatataaatacaaatagaagtttaaaattccatttacaacatatagtataatacataaaaataaagctagagttataaaactctcgcttcattttaactttaaattttatttacattttataattttgatttacatacccctatataaatcattttaactcataattattctctctaattttagaaattttaattttcttcatataattaacatctctaaatttctcttatattattaatcaaataataccattagttgaagatttatccatatccttaactactaccaataaatttaaaacaaattttattaattcaatcataatatatttcttcttatcatatcttttcctcctataattagaaaatctgcctatagtaagataaaagtttaattgatcgttaaaaaaaacactcaaaaagagtgattcaaaaattcttaactacaaagaatagaacttactcttcggcaactggctgacatagttttcacaaccttagtccctatagctttgcgtcgctagatttctctaactttgctaaaacatacttaaataataaactaagtacatatgtataatactatattatagtattattagcaagatattttaataaataatcataattgtaaattatttattttttattttaattctttaatatatattacattactcattataatatcttttttaaaaaaatccaaacaaaccttttaatatttttaaaggtttgtttatacatttatataagatgaactattctacttttaactcttcattgcttttattaatattttgtttaactattaattttaaatattcaagttgatctgcactattatcctcaatattagctatgctatgcataaggttttttatagcactacctactattatagtgaatatacccattacaacagatactataagccaaataatatttattgataataagcttataaatgcaattataaaatctataactgcaattgcaataaaccatccctgaacattatctcctgaaatcttagtattattatattttctctttgttttctccattactatttccccctttataatattttaacacaaaaatggaattatacctttaattgtattctatttctctctaatttattagaatctttatctaactaagatttttcaacataacaaaaggcttccttaaaaagaaaaccctagtaacctctattattaaaggttaattaatttaaaattgacttgcactacagcttacacacttatatttatttgtatttttcttattaaacaatatggatgcatgagaataatattctaaacttccttttgtaaatgatataccgactaaatatccatctttataattctcatcataactattataatttgttatacttatagaactatcattaaagtttatactattatcatttacaaatattaagtttaaaagtatctgagcctattctatctataaaaaatcctaacttctcaccaggctcggcattttctttatagtattcaaatatattatctatcatttttaatgcttccttttcagttaaatctttagctataacatctgcaagtctaggattatatccacctgaccctcctgcacatactataaatccagttttatcagctattagtccaacatctttactatatacacttccacatgcatttctacatccagcaactcctattttagttctgcatggcatttccatccatgtatattttttcgaaagtttcattcctgtactgattgtattaaacttttctctcttacaaaaacctgctggacacatttctacatttttaactgaatttgtacttttaacagctggttccatttgcagttcattccatataaaaggaatgtcttcttctctaaggttagttatcaatattctctgaccagatgtaatttttaatacaccattgtatttttcacaaacattagttatttttttcatagtatcaatggtaataaatccacctggaatatgtggggtaatactgtaagttcttttaccattccttattttttgaagattagcataattcatatatatccccttcttcttttatcattctactttcaatttgttttatcatatatatagtttccttttttataaaattttcatcataattcattaacttacttttagtattaaatttattcttatacttagtaaagtcattcaaaagattttttatttcaataatatatttttgagttttttcttttaaatcttctttttttaaaagagcgggatataagaatttatcttctgtattcaaatgtatctgtaattttcctgacaataatgataaatcacgtgaaaattctgtataataattctcaaagtcacttttagaaacaagtttctttattttatctaaatccttataaatttctctatgttgtcttaataaattatctattttcataaatttacctcttaaatttaatattgtaaattaattatatatgaatttataatattaatatgtaacaaaggttacatatttaaaagtgatttcttaagtaatattatataaaataaattagcatcctaaaatcgtattttaggatgctatatcaatttttatgtcttaccttccagttgaatttccaagtattgtgactgtaacatttcttacaccccaattagaacattcagattcgctatcaaagtaaacatcaattttatttcctttaatagcaccaccacaatctgcagctattgcataaccatatccttctacataaactgctgaattaaatgggattacatcaggatcaactgcaattgtacttaacccaaaaggttttctcacacatgaaataccagtagctgttactccaccaccagtatacgctgtagaagaacatacaatatccgtatttgcaactgacgtagaagaagttacagcttgtactttttcatttacaaaaacaaagttacacaataaagtacataacatagttattgtaaagaatttaagacttgttttatttaaaataaaacaagaaaatgagctgtatttttttcgcatcaattcttttctcctttaatttttataatataaaaattattatactatataatgtaagctttgtaaacttattcataaattattaacttatatatatatatatattattaattcgcatattattttatatatttttttcaaatgcattcattttaataaaaaagacttcatgatcttatgtgaataatgaagtcttttttatggtttttactctgtattttaatgttcctctactatatctgaattagaatttgaagtatctatactttcttttattcctaaaataacaggtatccacaaattaataccaaacactgctccaaatgctccatataaatagagcttcttaaacaacgttcctgaaaatgataaaaataattcatgaagttcctttggattcatgagctctatttgattttttgttattgcctttaattttatagattctattatattgcttgaattattaataaaagaatctaatgatgaatcacaaagaatatcaattatctgggatttagtattgtaattaaaaatatttttctcatttctaattaatatttcactaaaatcactaattattttagtagaattctctataaattcactattatcaaataaactagtatatttagatattaaacactcttgtgcaatagatttatcaacaatattagaaatacgtttattttttatgtagacactcattaattcaaatgttttctcttttagaaaatcctcaatttccaacttgtttgatatgttgtttaataagtcttttatattatttaaatcatattctttaaatatattttgcatttccatattatatattgattgtataacataattttctgatactctatatacatagtccgagacttctttatttttaatattctctgaaattaacccttgaattaaacagaattctttatgaaatttacttactgaagttttaataatttcttcatcaatgttatctaacacagagtgcaataatgtattaatactactttcataatattttgttatgtattcattattatttagattttcacaaattccacatataaatttgtttacattatcctcattaagcgaagaacaaatttcatttatctttactttatataaataattatcaaaactgtctttaattatattagttatttcaaagaaacggtcacttatgaaaacaggcatatttttgtgaatcataatatttactgccctatctactatgtcatcaccaccagccatggcataacccattttttcaaaaaagtttagagattctcctatctttacttttatattgtccttaataaaattttcattatctattaatagtatttttattttataaatagcaaactctgtgagtttaaataaatttttatcaataaaaacttttatctttccatttaatattgtttctattgtattttcatcctttaaaattactgatgtaagttttgatccagagttttctattgaatttataatgtatcttttgctatttttactaataaaataagaaatattatcaataattttatttgaaatttctttgttttttattatattaattacatattcacatataatgctttccatttgaatactttcaattttattaccaatattatttattgatttatttattccacgattaaagtattctcctagtttatctttcgcttctggcaaaataaactcttcaaccttatgagaacttttaattatgttttccaaatattcaaaagaaatttcctttattttctcttctatttttgctttttcaataatatcatcaatcaattgttttttgattaagttttcatttatttttgtattcattaaatgtgaatttatcttttcaattgctttatttttattattgataaaataattgaaaaatattttattcaaactcttttctgctatatttttttgagaaattataaaatctgatactattttaaaatcatttttttctgcagtttcaaaaagttttattttaatattttctttatgttgctttaaaatggaataaaggtaatttctatttaaaagatcattatctataacatttccaattgcattactcatattatctttatgggctggaatatatcctaatgcaaatcttcttataaaaggtattttagataaaaatttatttttagtatatggtttaaatagcatgttaatagctataacatttgttattattccaacaaagcccataagtaaaatagataatatctgttcactcatattggaataaaatccattaatacttatattcttaaaaaccaaaccaaataatataccgcagataaaacctaagacacctccaaacatggataaaggcttaagctcattccccatgaatctttgagctaaatcgcaaatttcatcttcatcatactgcataagattatttctaatagtaccttttacttttccttttaacattaaatctaaattttttacaagaatatctttaacaactttggttacagattcatatacttcatctttgcataaattatcatatataacatcataaacattagaatttcctttatctaaaagatttactttaacaatgcttattgtacttttatatatttcatctttagctttttcactattttttagtaaagttaaaccatttattaaataactactcatattgtggcataagatattcttattttcatttaaaatcttatttataaattcattgattttttcaatattatcagttaatgtttctttatctataatcgaagaaagtgtagactttttaaaatcttgaaaattactagatattaaagtttttagattttccaaaagaatattattaatgttttgtttatttgttattataagatcatttatccattgtttaatattacattcaaaaatttcatctaaatccctttttagtagaactttaaatgtttttgacatctgcatatttaataaattatatattatactcctaccatgaatattgcattgctcctttaaaaatccaaataaattttctatttgagaattttcaattatattagtcttctgtaagctttctacaatttcacttatcttagtgtttctaagataattaagtattgtatcacatatttcatcaatagaattttcatcaatattatagttttctatataattagtaattttttctactatttgatttttagcagaaacattatctaggaataatgcacggacttttgctataatcatcttcttaattcctggatcaaggcttcctatagcttcatcaatagaattctcaattattacatcaaactcatctttatttttatttatccactcagaaaaatatggcatcattttatgtattgaattgtttatgaactctgtaagtttcttacttgaatcctctggaagaatatcatagattgtataatccatatctttaattatgtttaatgcaaatgttgaaacctctttaaagtttgactttccattattagaatttaaatatgtcataaatacatcaaataatttatcacatatattatcaagttcttcttctgtaatataatctgataaagtcttattgtacagattcttctgaagttctatcattatagattttgtatctattttatcatgtaagttatttagtatatttaagattatttcatcatttgaaaataaattattaattgatttttcaatgtttactgttaaattcttttctactaaatctaaattctcacaacataaaatttcactaatattttcttcagaaattttaccatacaattcttttacacaatcactagtaaagttagtttttgcaacttcttcttcaatttcttgaataaatttttcacaaatatttgttgtaactttaaaagttatgtcatcattaaaatctatttcatttatcactttatcaactaaattagaattgacttttaatgtttctgtaaaacaacataatatattgtcaattatactttcgtaattatgtatatctctaaattccatattatttattaactttttaagttcttcattaaaaaattcttttacaatctcattaagtactttttcaaagttttcattattaaaattagctaaaattgtatcactattaataatatctctttcaacaagctcgcttatttcttcaataaattgttcttttctattctttattactccgccaaattttgctggcaataaaactttatcaaaaattttaaatggagtatattccttaaaaagcatgtttactgcatatttgtttgtaacatatccagaaacagctccggcaccaccttgcaataataacagtattaaatttgataaattcattacattcacctcaacagtattttataacattcttgaataattaacaaataaatttgaagctaaaaaatgtgctgtgaatttagccacagcacattttttagaaataaatatctcaaagaaacatgtattattatttggttttagaaaataatatttatacaatcaatcgtatagtactgagcagaaattatatcttaaaatattaggcaataataagctaagttataagaagtacttattttactaaaattttaatcgtataatctactttcttctacaatataaaaatacataatctctttttttgcaatgtacagttattaatataacacttaacatattatatgtcaatattttacaattgatttcgttaatactctataatacctgccatggattgtctttattttgatcaaagagcaagatgctttttattgaattttcaaccatatcacttacagcttgatctgtatagaatgctgtgtgtggagtaacaattacatttggaaaagatttcaaaatagcaaggtttctgttttctagtattttcccttttaagtcattgtaatacagcccgctttcattttcaataacatctagtgctgcacctgcaatttttcctttttctagaccttcaattaaatcttcagtattaattagcgaccctctgctcgtatttattataaatacattgtctctcatttctgaaatagtttttttatttataatgtgataattatcttcagttgctggcatatgaaatgttaaaatatcactattttttaaaacataatctaaatttttgtactctgcatatttttttacagtatctttttcataaacatcatgagcaataatattacatccaaagccacttaaatgttttattactgtctctcctattcttcctgtccccaaaacacctacagtgagatttttaagttctttcccctgaaccatatttaaagaaaaatcttgaactgtacttctatctaatatcaatttcatttttctaactgacattagtatcatcataatagcataatctgcaacactgctaggtgaataagttgcatttcctatatgaattcctaacttttgtgcattctctaaatcaatatgatcatatccaattgttcttgtagaaataaatttcacaccatattctttaaatttttttaataattcttcatgtataggagttgttattatacttatgtactctattcctttacttaaatttactgtttccatattaggttcctcatctgtaagtacaatatccacattatactttttgctgaattccttaaaaaattctgtttcatctttcctatgactatatgctagaattttcattattaagcccctcttttcttattgcaataaaattttatattcatacaagtaaagttctctttcataattatattacctatatgttaaactattaactctataattgtaatttagaaactaatatatggtttctaccaccaatttacaattatcatatatattttatcataattaaatcaatttagttatatataaatgggaaatatcacattttcaatataacttgactaaatatgccagtaattatatagtagataatgtacacaattataagggggcgtttgtaatgagttttacaaatataagaaaaataccgtctccagaggaaataatagctatgactcctctggaagagcatttaaaaaaaatcaaagctgaaagagacgaagaaataaaaaatatttttgctggcaagagtgataagtttgttgtcattattgggccttgctcagctgatgatgaagattctgtgtgtgattatgtaaatagattagcacaagtaaatgaaaaagttaaagataaattattcatagttccaagaatttatactaataaaccaagaactacaggtgaaggatataaaggaatgcttcatcagccagatcctgaaaaatcaccaaatatgcttgaaggtttattttcaattagaaaaatgtttataagagcaattaaggaaacacacctaactcctgctgatgaaatgttatatccttgtaatcacatttactgtgatgatttattaacttatgttgctgttggtgcaagaagtgttgaaaatcaacaacatagacttacagcaagtggtgtcgatgttcctgttggtatgaaaaatccaacaagtggtgatttaagtgtaatgttcaattcaatacacgcagcccattgtaaacatgactttatttataaggatcatgaagttactacaagtggtaacctttatgcacatgcaatcatgagaggttctgtaaacaaacatggaaatagcatccctaattatcactatgaagatttattaagagttgctgaactttacagtgaacatgattttcctaatccagctgttatagttgatgcaaatcacaataattcaaacaaaaaatattttgagcagccacgtattgttaaagaaattttacatagtagagactgcaatagtaaactaaagaaattagttaaaggtgttatgatcgaaagctatattgaagaaggatgtcaaaaaattgatgaacatatttatggcaaatcaattactgatccatgtcttggatgggaagaaacagaaaaacttctttatcaaatagctgaacaagcataacatgctgttattataaactgtctgtttttcaggcagtttttttaatatatgggatataacttagtcgccttgacgatttttttatctatttaaaataaacttttaagaataccatcattactattaaaaagtataattaatttgcttcatgttaataataattacagaattatttaataatatatattccaattaacaattgacattgtatgcccttttgggtgctccttgtgtgagcaatccacatttaaggtgaaaatctttacgtgatttttaagacttatatgtaaaatatttattagaatatatatacaatattttattgacagaggtgaatataatttggatttagtaagcacaatagttaaacttttaggcggtttaggattattcatatatggtatgaaactcatgggtgatggtcttgaaaatgctgctggtgatagtttaaaaagcattcttgaaaaagtaacaagtaatagagttattgcagtgcttgttggtacaatagttactgctataattcaaagcagcagtgctacaactgtaatggttgtgggttttgtaaatgctggtcttatgaatttatctcaggcacttggagtaattatgggtgcaaatattggaacaactattacagcgcaacttgttgcatttaaacttgatgaaattgcacctttattcgtatttgttggtgccgctatggtaatgtttgcaaagaatagaaaacatcttgaacttggaaatattatattaggttttggtatattattcactggtatgggtattatgagcagtgcaatgaagccacttgcaaagactccaatgtttactcaacttctgcttgctgttggtgacaactggattattggtatactaacaggtcttgctttaacagcagtccttcaaagttcatcagcaacaactggaatattaatagctcttgcaagtacaaattcaattactgtatcacttgctattcctatactctttggttgtaatattggaacatgtgtaactgcgcttttagcaagtattggtacaaataaaactgcccataaagctgcttttcttcatctcacctttaatgttcttggaactataatctttataccatttttaagaatcttaggtgactttgtagttacaacaagcactgatgtaagtcgacagattgcaaatgcccacactatttttaatattacaaacacagcgctacttttgccatttagcaaatatatcgtaatgtttgtcaataaagtaatacctgatgatgaaaatgaagaaaaacctggtgttaaatttattgatgatagagttctcgaaactcctgtaattgctgctgggcaggtaataaaagaaactattagaatggctcataaagcaaaagaaaatgttgaactatccatgaaagcatttattgatagtaatgaaaaactaatagagcaagtatacaaaaatgaagaaactataaatttactcgaagaagccataacaagctatcttgtaaaacttgcacaatgcaatttatctgaaaaagaacaaacaattgtggcatctactctacatgttgtcatagatattgagagaattggtgatcatgctgaaaacattgctgatttagcacgtgaaaaaatcaatagaaaagttaaatacagtttagatgcattaaatgatttaaacgaaatttatgaatctgttgtaaaatccctagatatttctattggtgcttataccgatagaaacgtcaatgaagctaaaacaaactttaaagttgaaaatcagattgatacatataaaaaggactatagagaaaaacatataaaacgactttatgacggtaaatgtagtgcatttgaaggggcattatttctagatatcataagtgatttagaacgaattggtgatcattctaacaatattgctcaaagtgttgtagaaaataatcaataacaataaaagcatcaataaatgaattaaataatcatttattgatgcttttaatttttatattaatatgctttatcatattacatcaaattttattatatggcttttcagcttattttataaagcttcttcagcaatatatactccctctatattgttaagttgaagaagatattctccatgatcacattttcttgcaagagtaagagtcattgtaagtccaaccatacctctttccatagtatcatttttctttacttctatgtttgatatctttgtcccatcagattttaccatatttataaagtttgtaactccacatatatcttgaagttctacgtatacttcaagtacttttgaatgagtccttgaatataaatctaatctatgcaaaaaagtcacaacagcaagtaaataaatacatgtaataattgccccttcatagaaccctattccaatagctagtcccatacatgcacatgcccaaagtccagctgctgtagtaagtccttttacctgattacgtccaactaccataatagtacctgcacctaaaaaaccaattccgcttatcacctgagctcccattctgcttgcatctgtagttattcctaaaacatccgtcatatactgacttgttaccataaccattgttgccccaatgcacaccacaatatgtgttctaaaacctgcaggtcttttcttttttcctctctcatgtcctaatattcctgcacatattgttgcaagagtcaatctcacaataattgagacagtatttaattctcttaagtaattcataagatcattatacgtgttaatcataatatagccctcctaagtctttttttaatgtttttattatataacacataaaggcaatgtgttaccattaatgacaccattgcctttatgttttcatatttctttttttatttataatttttaataagtaatctgtcatatagaaataaatttattaattcttttttaagctacaaggtatacttatttagatataactcagttaaacagttgaagaatctcgtcatcattgagtttatttacaaatacatcagcacttaagtcatcactaagtactttatctataagttctcttttagagttctgaagatcaatgattttttcctctattgttccacttgctataagcttaataacttcaactacatttttctgccccaatctatgtgctctgtcagttgcttgatcttctactgctggattccaccatggatcaaaatgaattacaatatctgcgcttgtaagattcaatccagttcctccagccttcaatgaaataagaaatatatttttatttccatcattaaattcatttaccattttcattctttcgctgcttgtcatggaaccatctaaataacagtaactcatattattttcttttaatatggtacttatatttttcagaactgaagtaaattgtgaaaatacaagaactttatgatctccttctatactttgttccaaaagttcaataagtgcatcaattttcccacttgtaccattataattatccattattacagatgggtcaagacatatctgacgtagctttgtaacatatgatagtatctctattttactctttttaaattcatcactttcaactttcttttgtatcagattctttgcatattctgcataagtttcatatacaattttttgttcatctgaaagtggaatattcattattttttcaattttatctggtaattcctttataacatttttcttaagtcttcgtaatataaatggttttaccatcttatgaatctcttcaagtatttctggactttcttccagtcttctgaagtatcttgtggtaaatcttttttcatcatataaataacctggcattataaaatcaaaaattgaccaaagctccataagtgaattttctactggagttcctgtaagggcaaatctcactctgctctttatttttttaacacattttgcatttaatgaattataattttttatattctgtgcttcatctagtatgcagtaatcaaaaaacatatcataatgttcaaggtcatttctaagcatattatatgtagttattataacatcatagtctttataattttcaatatatttttttctctcatctggagtaccattgcatattagaacctttaatgaaggtgcaaattttttaaattcacttagccaattataaatcaatgaagtgggtgcaactattaatgtttttgaattggcttttgacaatataaacgtaattgtctgaagagtttttccaagccccatttcatctgcaagaatacctccaaatccaagataatcaagagttctaagccaattatagccctgcttttgataatctcttaatttagctaaaataccataaggcatctggaatgtcttattttcaatattattcagcttaatcttaagatctttcatctcatcacatgtttttatgtatctgaagttcttattatcaagataatcttcaacgtatgctcctttacttaaaggaattaagactatattatcatcaaattcttcatttataacaagactgtctataagatttaaagcttccttaagagcctcttcctctaaatcgagatattcaccattttcaagtttataatactttacattatctctaaagcttcgtaatatttttgtaacttcatcttcgtgtatattggtaagtttaaattttaattcaaagtagtcaaattttcctttacgcacttctcctttgaagtcggattttttaatagatcttattcctttgaatctttctgaataaaatacttcaccatatctttgaagcttttctatttcatatttaaaaaatttgaatatttcatcatcatcttttagaagataaaatttctcatttacttcatcaaaaccaagattttttagaatattataaacttcattttctttttgggtatctctatatataatcttatctttgtattcttcgaaaaagttgaactcatgtccttcataagatactttatactgaagagatacattttctctctctttgtcaaagtaaaacctgaaattaactggacctgaaattattttcttccttatactttgtgataagatcagctgagaagaagtcttttgtatattaggtataagttttcttaagattgtctcctcatcattcttatcaaaaactactttccttgttttattgaatattttcaaataaggttcaagtctctcacattgttctatagatggaatatataaagatgttccaaacataaatacatcgttattatcgcttaatggctctggcataatatctaaaacttctaaacttatttcatgtgatgctgatttcaaagaaaatgatacaggaatatcaccttctattacatcacattcaagtattctgtaaaaaaatccatcacctaaaaatattctatttttcttgactatagataaaaattctttcaacattatcgatggtattgtcattagttttccatcgataattttatcttgtcttcttacacttgtattgttttcactaaatcttttcaaattgcatataaatttaatgagcctgctatcttcataagaaaatttttgttcttttatattaaaagtaaaatctttaccatattttataggaacattattaaacatagaaacaagaaagtgatttaagtccttaataacatacattttcttatttctaagacctagtttaaattcagcctgtaattttgatgaccagtgatttttacttaaaataacttcaaattttaaaatattttctctttcatctataagtgtattaagaatttcattttccatagttttattttttttattttcttttattcttccatttaaaatctcagatagtttttcatcacaagaggcattatttacgaattcataaaaacttgcagcaagatgtttacagcaataattttcttttttaaattcatttttctcatagtcagcacagctacagtatgtgccaattatatccatagtttttatgtcaaatataatcttacagctatattcactaagaagactctctgaaataacagtagactttatagtaatagtatctttatctaaagtgtttgtgacatctttaataaggtcatttctaagaacatcattagcagatctcattactgaagaagttatatttttattaaatttgtccattaatacttgtttaatcaatttcaacactccgtactatttattgacttcaactattttctttattaagtctgctgctatatattgagattttgatataccttttctaaaataccttatttgtttatattttttcccctgcatctcaaaatcaagaacatcaattctttcacctgtaaaaactgaaggttcactttttccttttaaaaaaatttgtaattccatgtttctgcctctttcatattaattattagttttatattcctcaattgcttctgcaatttcatttaagtattcccatctttcatatttttcatcaagcatactttgagtttcttctttttctttcataagctcatttagctttccataatttgatgaatttttagccatttcattttcaagagttgaaattttttcttctaattttaaaatgtcttcatctatagtttcaaattccttctgctctttaaatgtaaatttaggcttattttctctgcttctgtcttttgttccttttgctttaggcttttctttctcttctgccactgaaatgctgccttctgcattttcaatttcctttgcaataagaaaatcactataattaccattataaccttttatatagccatttccctcataagagaatatcttattacagattctatcaagaaaatatctatcatgggatacaacaacaactacacctataaatttgtctagaaaatcttcaagaatttttaatgtttcaatatcaagatcatttgtaggttcatcaagaattaaaaagtttggagattccattaatactcttaaaagatgaagtcttcttctttctcctccagataatttttcaataggtgtatactgcatattcccatcaaataagaatctttcacacattgtagatgcagtaatctttgttccatcttctacgggaatgtattcgccaccttctttaacataatctataactctcattttaggatccatgtttgtattatcttgagcaaaacatcctattttaacagtatctcctatttcaatagttccgctatctgcattaagtttgcttcttaatatatttactaaagtggttttccctgcaccgttgtgaccaacaatacctattctgtcatttcttaagaaaatataactaaagtcttttataatagttttatcttcaaatgatttgtttatattgtataattctacaactttttttccaagtcttgttcctacaaaagataattctatgtcatcttgtcttttaattgtttcagtattaacaagttcatcaaatctttgaagtcttgctttttgttttgtagttcttgctttagcaccacgccttacccatttcaattcatttcttattaaggcatctctcttttcttcttgaactgcttctgtttccagcctttccattttcttttcaaggaatgctgtgtaatttcctggatatgagtaaagagttccacgatcaagttcaattattctatttgtagctctatcaagaaaatatctatcatgagttatcattaaaagagcaccttttctactatttaaaaattcttcaagccattcaatagaatctgaatccagatggtttgtaggctcatctaaaataagaagatcacatggtgtaataagtgcacatgcaagggctattctctttttctgtcctccagataaatttccgactttttcattaaagttttttattccaagctttgtaagtattgttttagcttcactttcaagatcccacaagtttaatgcatcaatttcttcctgaatcttaataagtctgctgtttaatttatcaaattcatcgcttttagctttatctattttatttaatatatcttcatactctctaagagtttgcatttccttagtatttcctttaaatatctgttctattactgttacatcatcatgaaaatctggatcttgatctaaaaattcaattcttatatttttaccttttgttatagttccatcaaagaattcttcttttcctcctattatttttagaagtgttgattttcccgcaccatttatacctatcaaacctattttatcgctatcactaattcctagtgatacatcttttaaaagaactttttcactataggttttacttatattttctaatgtaataatattcattaatttcttactcctttgtgtctttatctattcattattttatcatacttataagataatccaaaattgaagttgtattaataaataatttcacataaaaaaatcgccaaagcgactatgttatatcccatatgctaaaagttagctttaataaaattaattttttaataaaaaatactcctctttatgatagacatttttattattttatgtgtctagcataaagggagcatatcaaaacatatacagtgctttctaaaaaacaataaatattattaatcaaatatttatataaagtaaatttaaattaaccattaattattattgtacctgaatttgtaccattaataattactgaattattataatatgttccatatgatggattattagtttcattttctttcttttcattttcaatattagttaattttacatcaaggtttttaaagaaattgattatttcactttgagtaaaagtgtatattcctgcattgctacttattgttgcatatatgtccatcccatttgatgatgcataacaatcaaaatatattttataatttccacatgtacatattactccatttgcattattaggatcactataccaagcacaagatgaatttgccccatcatagttaggtgttaatgctcctagaacttcagatatagttctatttatccccaaattagaaagtttaaagttcttaatactacttaaaagatccttattctgagaagatgacattgggatagtaccaatatatgcatcataactcacttgtgtataatttgttgtttctggtgaataatataaatttccaatactatctggggtgtttgttaactgtggagctccatatggtgccttattatttggtatacttgaatttactgcatcatgataactagttgatggtgcagttgggaatgtatatgctgatgctggtgaataattattataactctgtgcaaatactggtgctatggaaaataaacttatagcaccacctgcaataatagcttttacaactttattcataaatttcactcctttatatttttattctgtataattctaatatcgtataaaaactcaaaatatttacaaaaaatcgaaccaataatatagttcgattttttgtaaatattataatttgaatttttcaaaaattatttctccatctttatccatataagctttaaaatttctgctatcttcttctaaaaccttagaacgtttaccaaacataaaaattgtatttgaatatgccacttcagccgttacaataccatctttaggtacttctatccttgttgacactcctgcaatacttcctactgttccaagctttacatcaccttttgcagatataactccccctcttgcaacagcatctttatttaaaaattcaatattttttaaagctataagatttgtaatatactcgccttttcctgttacaaatatatttcctgtagatttaacaagagaatcttgcaaatatccaacataaatatcactttgaataatcatatcatcattataataatcaatttcttcttcaataaggtctaataaatattccaaatctttcattgttttaagattagaaatattcaatcccatgaccttgcatcgtaaaaaatcaatcaattgattatcaacttcatcatgaagctttatacacctacttattatatttaatgataatttaggaatatctttatgtctactctctattaatatccttgctatatcacaaattcttttcttactatttgaagaatcatttattttttttacaccctcaataagtttctctacttctcttttataaacatttagtatatccaaatattcctttttttcaatatcaacctgtcctgtatatatttttgaattaattacattaccgttaatatttatttctcctccagctactacagaggcattatccacatcattttttattatcaacgaatttccagcctttacagccattccaagaccaacacttccatctatttgaacatcacctaagaaattaatatttcctgatttcatatcaacattctttacgctataaacattatttacacttaaaataccatttttagatgaaggtctaccatctctagttgcgataactttattattttcaattttacatccatcaccagcttttactggtttactctttgcaccttttttcttaattatttcaccctttatatttttcccattttgtcctagcctttcagggataatttcagctaaaacttcattacattctacactacttattgaatatacatttttataatcaattttttccattgattcactcttgaaatgtgtcttatctccaatatcaaataatattttcacttctagaggcttatcatctattgggtgatttcctcttgcaactaataatttttttacactttcttccaaacttgctcttaatatattttcctttattaatccatatttaactccatttctacccaattcattcattatttctgtaacagtatacttaggtaaaaaaccattcttttcttttgtggcctttagttttaagtcacttttgaagttcatatctttaagtttaaaaatatattctggagtatagcttatatcaacatatgcttccattgaatccttagatatacttatatttatattacgttttccctctactgtttcacttacagtacgtattttatctgcttcagttacattatatttagtatcttcacggcacaattcttcatttatatagagttttattccttcacatgtcataatagtaaatggtgtactttcttcatcaaaattactcttaattataattttttcattttctactccaattccatacaagctcacattattttgttcatcatctatgtaaatatcatcaatattttctgttgtctcagatgaactatcataattattatctgcggcattatcataattttctttttcatttattactttgattatattgctaaaatgcttgtccaatgtttttgctaacattccgcttaatttaccgctcatctttttcaactcctttatcattatgttatttatattgtaacacaaacgttttcaaaaagatattcttattttgactaattccatatattataattttagccaatattataatatatgaattagtcaaaagtaacattttcattgcttatatcatacaaaattttgacacctttataatttagcataaatccaatcaatccaaaaactgctccataaaaaatttcatcattagctgttgttgtaagcatcaaatctcttctatttatatccttaggtagtctttgaagttttatataatcaagatttgttaatataatttggccatacaattcaaattctgctgcaataagtgcagtcttgtctgcattaagaccttcattaatccatttcttttcctcttgttcaagcttttcttcctcattttcataattaccagcagccttatctgagtttcttttagccattctctgcctaattatttccatagcttgattggaagctttatactctaaaaggtatcctagggcaagtataatatgtgcttgactttgggcctctaatatttccatatcctgcatatcttttattgtttcattataatattctgtattttcatcattaactttatttttatcgctttctataatatcacccctcatacttaatataatatacactataaatatttttgtgatttctagaaaatcacaaagtggcttagtcgctttttccgttaataatttaaagaaaaaagactctctcataaaatgagaaagtcttatatattgtaaatattaagctctgtctatagaaccgaataattccattttttcttttacgatagtctttatagcttcaaatcctggatttaataattttcttggatcgaatcctttaccttctaagtcttttccagcttcaatatattttcttgtagcttcttggaagtataattgacattcagtgttaacattgatcttagaaactcctaatgatatagctttcttgatcatgtcttctggaattccagtaccaccgtgtaatactaatggcataactccacaagctttgttgatttcttctaaagcatcaaaagcaagtccttgccagttttctgggtatttaccgtggatatttccgataccagcagctaacattgtaactcctaaatcagcgatttgtttacattcttgaggatcagcaacttctcctcttccaactacaccgtcttcttctccaccgattgaaccaacttcagcttctaaagataatcctttttcagcagtcttagcaactaattccttagttttttctatgttttcagctattggatagtgagatccatcgaacattactgaagagaatccagcttccattgctttgtagcatccttcgtagctaccgtgatctaagtgtaaagcaactggaacagtgatgtttaattcttctaacattccgttaaccattccaactattgtcttataaccacacatgtattttccagcaccttcagatacacctaagataactggtgaattattttcttgagctgttaataaaactgctttagtccattctaagttgttgatgttgaattgaccaacagcatattttccttctctagctttgtttagcatttcttttgctgatactaacattgtacgacctccgtatacttatatattattgtataaactataatctataagaaaaatttaatggttataagtttacataaccaatttttctttcaatgcctattatactctaaaatttcttatatgaaaacaaaaaaatgaaatttttatctctatatcggaaattttgttaatttattaactattaaaaaacactattaaccttttgttacaatttatgaatattattttattgtaatttttaaattacaataaaataatagactgaattaattataatatactgatataattatattattaaacattattatctttattattcacttctaaatattccaacattgcatccatatctttatctcctcttcctgataagttaacaattataatcttgtcagcatcaagttttggtgcaagctttttagcctgagcaagtgcatgagatgactctattgcaggtactataccttctagttttgttaaatacaagaaagcatctacagcttcatcatcagttatagccttatactcagccctttttgtatcagcaagaaaggcatgttcaggacctacacctggataatcaagacctgctgatattgaataagcctcagcaatatttccattcttatcatgaagcacatatgtgttcattccatgtataatccccctttcacctttacttattgttgctgctgtaagctctgtatcgacaccttttcctgctgcttcaactcctacaagttgtacttctttatcatctataaaaggatagaaaatacctattgcattacttcctcctccaacaggtgctaatatataatccggaagacgaccttcaagttccattatctgttttttagcttcatctccaattaccctttgaaaatcccttactattgtaggatatggatgtggtccaacagctgaacctaaaagataaaatgtttcactacaattatcagcccagtaattaagtgcttcattaactgcatcattaagagttcttgtaccactcattgcaggaacaacttctgcacccagtaattccatctttttaacattaagtgcctgtcttttcatatcttcctcgcccataaatattttacattccattccaaatttagctgcaacagttgcagttgcaactccatgttgccctgcgccagtttctgctataacctttttcttacccattcttttagcaagaataacttgaccaatagcattatttattttatgagcaccggtatggtttaaatcttccctctttaagtaaatcttagcaccgcctaaatcctttgtaatattttctgcatagtatagtgggcttggtcttcctgtataataacgtaaataatacttatattcatcccagaaagttttatcatttttagctttttcatattctgcttccaattcatttaatgcctttaatatattttctggaacgtactgtccaccataatcattaaatctacaactcatatttatccattctccattctttattttttaattgtttaatatctatatttataaaactctttgtaatttctttatataacttagctaatacttcttaataaataccataacttttctagttcttttataataatttcattctttttagtaacttttacgtcattctcatctttttaacgttagagtttttttatatactaaaaacttattttatctgattttattaataagaactttcattttatcaaatgacttcattgtcactccatctttattaatatcttcaacaccagatgaaacatctactccccatggattggcttctttgatttttaacaaaacattttctggtgttattcctcctgcaagaataaatttaaaatcattatttaaatcacattctttttttataatttccttaaatggtgcaagtgaatatgtttcaccactcccaggattacaaccatctataagaatgttatccataacacaattatttttcattctcatataatatgaaacatattcattcaaaaatattttgttatttattgaaagtgctttccagatttcaaatttatgattctcattttttttaagtaagtttataaaatcaaaattttcgcttccatgaagctgaactacatccaggttcactttttttaaaacattatttatttcaataagagaattgtctttgaatacaccaacacatttaatttctggatttaacttctttcttaaaaatttcgcatcgaatgcacttatttgtcttttgctttttgtaaagacaaaacctatataatctggttttaaaatatttaagtattctatttccttttcacatgttattccacaaattttaattttaataaaatcacctcctctttaagaaaaatatcaccattaaatattaattattttttttacttcatttttaaattcagaattatctatatttctcatgaaaaactcaccaataagtacaccatttacaccatagtcctttattgtctttaaatcttcaatactcattattccactttcagaaactagtattttgtcatgtggaatatactttttaagttcctttgtaacatcaagggaaacattaaaggtttttaaatctctattattaattcctataacatcacaatcatatttgagtgcaaggtcaagttcttctttattatgtacttcaatcaagggctgaagattaaatttctttgcttcattataaaagtctccaagttgatcctttaaaacagatgcaataagcagtattccatctgcacctaacactttagcttcataaatctgataaaaatctatgataaaatcctttctaagtattggagtaattgaagatttcttaattctttttaaatattcatcactgcctttaaaataatcttcttcagtaagtacagagaaagcacgtactcccaagttgttataacaaagtaaaatttccattatatcaaaatcttctgagattattccctttgaaggcgaggcctttttaaattcaccaattacagaaaggccatcttttaaaagtgcttccttaaataaattcttgtaatttccttttgctctttcattttcagcttttaataaattcaaggcgtgaatttttaattcagctattggtatttcactttttcttttatctactctcattttctttttttcaataatttcatctaaaatcatatatgcccccagttttaatctattttttcataaaaacctaacagaatttcaattgaagatagtcagttatattcaaatttctaatgagttttctaacaagcagtcaattcttcatatttttcatatgctttcccactatcaataagttccttagctttatttataccttcatttagtgattcaactagttctgctgcataaagtgctgcaccactgtttaacacaactatatctcttttaggtccctgcattccctttaaaatatctataataatctttgcattttcctttggtgtaccacccttaatttcatcagcattagcaagctttatccccaaatcttctggatttaacttatatattttaagttctccatctttaagttcacaaacgcttgttgttgtagttgttgttatctcatcaagcccatcatctccatggacaataagagctctatttaatccaagattttttaaaacaagacctgcactttcaagaagatttccatcatatattcccataagttgccctgttaaaggtgcaggattagaaagtggtcctatcatattaaacaaagttcttgtaccaagttcttttctttcatttgcaacatttctcattgccccattatattgtggtgcaaacaaaaaggccattcctttttcctcaattactttcgcactttcatctttactataatctgtttttatatttaattctgtaagcacatctgcacttccactcttgcttgaaactgctctgttaccatgttttgcaacctttgccccaccacttgctgcaactattgctactgctgttgaaatattaaatgtctttcctccatctccaccagttccacatgtatcaataagatgctttggatttttaatttctacaggaataaagttatctcttaatgcttttactgcaccaagaatctgctctggggtttctccatttatcctaagccccattaagaagcctccaatctgacatgaagttgcttcacctttcattatttgatttataacatctctcacatcattttcacttagtatttcttttgctcccaattttttgattgcttcctcaataatcattttaaatccccctccttatttagttaacagttaacagttaacaagtaacagttaataagcttttaagctacaactttagatgctcattggcaattaacatgtaacaattagttttattgcccctgaaaatttatatctttttaaacttaaactttaatttctttgttacttctgttcttcgttacagatattaataacaaaattgcttatgatatgctttcctttaggtgtataaattgattctggatgaaattgaagtccataaatatcatgttctttatgtttcactgccattataatattgtcatctattgtagatcctataacatcaagacattctggaagtgacatattatctactattaaagaatgatatctcataacatccatcttccttggaattccttcaaatattaatttgccctttacagatattttggaagtctttccatggtatatttcgtctgcacgtattatctttccaccataagcttgtgcaatactctgatgtccaaggcatattccaagtataggatatctagctccaagcttctgcactacatctattgaaattccagcatcatctggagtacctggacctggtgaaatcactattccttttggatttaattctattatttcatcaatggttatttcatcatttcttacaaccttaacttctgcaaattccccaatatactgataaaggttatatgtgaatgaatcatagttatcaattaaaagtatcatcttaaagcctcctttaatgccattaatttattctgaacctcttcaaattccttttctgggacagaatcaaaaacaacacctgcacctgcttgaagatatgcagtattgcctttcattactattgttcttattgctattgccatatctgtatctcctccataggagaaatacccaactgaccctccataaatatcacgtctatattcttctaattcttcaattatttccattgctcttattttaggagctcctgataaagttcctgctggaaggcatgtacttaatgcttcaaaaccgtctatattttgtaatgtctttcctgtaactgtacttgtaatatgcattacgtgagaaaacttttcaattttcataaagtcttttacttcaacagttccaatttcacttattcgccctatatcatttcttgcaagatcaacaagcataacatgttctgcaagttcttttttatcctgaagaagttctttttcaagagctgaatcttcctcctgagtttcgcctctttttcttgtacctgcaataggctttgtagatgctctcccatttttaacacttacaacactttctggtgatgctcctataacttgataatcatcataatcaattaaatacatgtatggggatggattaacttctctaagtcttctataaatttcaacgaaggatttttgtgttatacatttcatccttagagatggaacaaactgaaaaatatcacctgcaagaatatgttcttttcctatacgtacattttcttcatatttttcttttgaggtgcacaattcaaaatggacatctttcttttcttcaaattcttctatattagtaggtctgcttaaaagtgaaaatatatattctctttgattttcaactatgctttcatattccctatggtcatcatttaatatgttatcaatgacaaataccttgtgagtaaagtggtcatagcatatatatctgctgtataaattaaatcttattaaaggtaagtcaagtatatctggattattaaatttaagtcttttttcatacaaacaaattgtttcatatcccatatatcctatagctccgcctttaaaagaaaaatcatttgtactttcgtcaaaatctaatcttattgatttttttagttcatcaattatatctatactttctcccaaaatttccttatacggattttcacctaagtatgagtatcgtccaaaataattttctgtgcttccactttcaaaaatgaattttcttcttcccttaaatccattaaaaattcttatgggtgtaacttcatcacctctatattctgttattaatgaaaaaaccttattttcttttcttttttcattaaattgatctttagaaatatttatcatctaactacctcctttaattcttctactctttaaaattcataagatatatagtaaaatccatatttttatacacaaaaaaagtcacttcatctcatattgggacgaagtgactcgtggtgccacccaaattttatgtaaaaatagcttaggaaatttaaatatattattctcaaatactaaaataaaacaacgtacgtatgttaaaaaattatattatttatagtactttgaaaaaacaaaagcacttcatccttaatacaggacgaaatgctataatttcgctatgccacctatgtacatacttcaatacagatactcaaatttaatactgaatccacaataataaataatttatatcctgtcaatataacggtagacttccgtatattcctactttaaaataatttcagaatatcacctcaaagacccattcagcaatatctacagtatctgtttctcaccaaaaataacagattctctttacactaagctttattgcttacttttcttatcaacggctttttaaagcatatttactatatttgtaatatatcatacaagctaaaatatttcaatacttttttgttaaaatttgagattttattttaagttcaataatatttacagtgaatgtaaaaatactgtcatgaatttatttaatttgtatcttctatatttattacaatatatatgttgcactatgaaatttgcaattactactatgtcaatgaatatatatagtattaaatataatacatatcgtcttttcctttattcttataaccatctgaaagatcttctaatgtcattgaacagaaaaagtttctgatttgttcattggctttactccataacttatcaataagataattttccatgtcattatcctctgcttctacatcaattagcaaaagatctccttcaagtacacttaatatttgtgcaatggtgaaattctttggttcatcagttaaaaaataacctccctgagcacctttcttggctttaataataccaccttttctaagcgatgaaaaaatctgttctaaatatctttctgaaatattctgtctttctgaaatactttttactgtagccatttcattacgtgaatacacgcatatatcaataagtgcccttaatccatatcttccctttgttgaaattttcatttaatcacccttataaactcttttctatttaatctcttctttttattattatactatataatcaccattctacaataacaaaattgataactattcttatttagattaaagttcaacagatcttcttggaattttaaatcctatagtatcttctatttcttccaaagcccttttatttttaggatctacaaacatacatgtaattccgctttcaccagctcttccagttcttcctattctatgtacataactttcaggtgtttcaggaatgtcataattataaatatgagttacccctgtaatatcaagtcctcttgcagcaacatcagtagcaataagatattgtaattttgcttccctaaatgacttcatgattctttctctcttattttgagctatatcactatgtatttttgcgcagttatactttcttgatgccattactgtttcaagatcatcagctcttctttttgttctacagaatataatagccataaacggattatcttcatcaagaaccttgcataaagcatctcttttctgtctgtcagttgtttcaactacaaactgctttattgaatgcatgtcaacttcttctttttttacagaaataattgcaggatcattcatgtacctatatgcaagtttttttactgctgaatccatggttgctgaaaaacaaagcatctgctttttctttgacatctgttccattatcttttcaacttcatttttaaatcccatgaaaagcatttgatctgcttcatctaaaacaaaagtctttacagtctttaaatctattgtcttcctttctatatgatctagtaatcttcctggcgttgcaactattaactgcacatttttattaagctttttaagttgtgaatttatatcttttcccccatagcatgcaagtacatttatttttttgtcttcatttaatttatccgcttcatttgttatctgaagtgcaagctctcttgttggtgtaagtataagtgcttgaacatccttggattttggatttatctgttcaaatataggcagtaaaaatgcaagtgtttttccagttcctgtccctgcttctgcaattatatctttaccattttttattatttcaatgctttcctcttgaattggagttggtgcactaattccatttttctttaatatatcaactaattctttacatattccaagttttttgaaatccattatatcaaaccttcctcgtttatcatattctcatttatcatattgttgtcttctatagtataagttaatattagtaattgtcaaattaaaatcccatagttattagtaaagttctcatttatattattataattaacttatcacaaggaacatccactttaaattgttaattgttatttatatacccaatataggttgaatattatttctctgaacaattgcaactgaagcctttaatgcatagcataaagctacaattccaagtatactagaaatattaatatctctactcggttgcaatgaatatttatatgtgccttctgctttttgttttacacgtatattataagtttcaaatgcaatataagtagaaattaacctacttgtaaaaaatccatagacagcctgaagagctaattcatctgggttattctggagatttgttgtattatttattccactattattttcattattattattattattttccttatcattactggctgaaattttttctaataaaagttgtataccttgagatgttgaattaataaatatgctgtctgaagttaaagttataaaattagcaaattgttgaaggtacaataattgtaataaatacttatcatcttcattcatgttttcaaaatcaatattattatattgatcattattctgtgatttttctttattttcatactcatctttttcattatttaaattttcttgtgttccactattgtcatatttactatataaatcttcttcacatgtgtttttttctctttttttattagtacccttcttttttgacatcttgatgctcctaaaattgttccctagtgtataatatttgtaaataacttactttgttacataaaagaaaactataaaaatagcaaataatttttaattttaaatttttaaaaattatttgctattattaaaatactattataaataataagtttattctcacctaataaatagtgataagagcacttttcatttattattttaaaacattcatcactggaataatcatatccataaggtatatcaagtagggttgagaaatattctttataagtatggctacagatatcatattgataattaataaaatatctcaaatagtgcatacagtatttaatttcccaaataattaaaagcttatttccagtgattgtttttaatatcttactatttatagtctttggataacaattaatttcacatatttttatcttttcacatggtcttaagcatattgtaatattactagatactgatgtttgtttgaatatattatacataatgtatgtttcaaccttgttagttgataaacacatttcaattggtttttcttcaacattatatatataatcatagcaaataaatcctttattattaatactatcaatatattcatcctcatatattgcaactttaaaagtaacatctgctttttcatgacactttaaattaccaatatgcagtttttctgtagttgctccatactgagttataccatttatcttaacagaatcctttataaacaaagtttctttaggtattttatcttttaaacatatattttcaacagttttattgcttatatttgtaatatttattgtataagtaagtacatcagaaatagatgcaattactttatctacttctttcctcacactcaaatttttatcaagaataggtgttacaacacggttacttagtattgtatcatatataactggaccctcttctgaaaccttgtacctgtaattcactcttccttgattaattactatcaaatttatcatccttactacaattgcttttttctatttttataaattcccatctttacaaagtacttttttattattacaaatatattcaataaaaagtgtaatgcttataaaaacatagttacactctatatttgttattgtaacatcttctatgcagtaatctatatcataataatcttctttatttgtatcacctggaacgacaataaaagtgcttaatggaatatctttttttatataaaagctcttacttccataattaatataaaatgaagtgtgtaaatacccacataatactaattttttaccacttaatctttgtccttcataagaaacaccttcaatagtgtctattaaatttacgcatggtaaatgtaaaactgcatttttaaaatctatatacttattgtctatatattcacaaaaactaaatttatcatttacattaatttgcttaaaatatctttttttatatgtgttatctataaaattttcatttattgtttttgcaatatcactcaatttttattccttttttattaatttcactaactagtatatgattttcatgataaattgagctaaaatgtaataatttcatttaaagaataataatttaaacatacataaattacttcctttaatcttatattttaataaaatacaaaatatatatgttgcaataattattctgcatataattttaaaaatcctgtaaggattttcaccttaattgtcaattctcaattgtcaactgtcaattacaatatatatacactacttagaaatgaacaattattaaaaaatgcgtaacccctaatctggacttacgcattaaaatatttatattaaattagtaattatttttactattagcacatatctacaatttgaactttatatacaactgttataatctgtcctggtgtcattgttcctaaatcaaatccagctgatggattatagtctggataaggtgttccatttatagttgttgatcctataacaaacattgtattatgaggtgtaggatcctgaaatacaacatttgtagcattaatatttcctacattctgaatagtaactgtataagttatctgttctcctcttgttgcatattgtttattagcagcttttgttacattaagacttccatatgatatatttgttgttactgtatttgaatagcttgtatcagtgtaatatggctgttttggatctactggatattcaaaagcaataactgcttggttaatgactgtatttgttgctggaactgaaactacagttactacgaattgtacagttactacattacctattcctatatctcccaaactaaatccagttgttggattacttaatggttggcttactccattaacttttacgcttccagtcttaaatgttactccatttgatggtgtatcctggaataccacactataatcaattacattacctacattagtcaatgtgattgtataagtgatttcatcacctatagtggctatggttttatcgacagctttaagtgcagttatcttacctaaaaccacatttgttgttactgaattacttggtacatccttagttgttactgaaccacttggatcaattctataactaaagttaatattagaagtattctctacatatgctggagttggaagtgatgttactgtagcttggaattgaataagcgaagtatttcctgatatgatattatttggcatattaaatcctgctataggatcataagttggataacttactccatcaatgaccaaagtaccagctttaaatgatgcaccatttgataaaacatcgctaaagaacaactgagatattgttgtatttcctgtatttttaattaaaagactatagtttagaacattctgtattgttgcatatactttatcaacgaccttagacactgtcatgcttggttgaattattatagtatttacagtatttgattgataagatttagtataatactgaccatttggatcaatcttataacttaatgttccaacagcatagtttattaccgaagcatgtgttggtaatggaataacagttacagtaaagaccacagttacagtatctaatggattaatgtttcctaaattaaatcctacagtaggatcataatctaaatgagttgttccattaacctttacagaacctaaattgaaagttatatcgctctgaagactatctgtaaatattacattgtcagctcttacagtaccattattagtaacaacaactgtataagtcaaaatatctcctattgtagcataatttttatctacagtttttgttaatgctattgagcctagatttatttgtgttgtaaccgtatttgaattaatctgaactggaatatctgaaccattaggatcaatacgatatgagaatgttaaattagctgtattagttactaatgacggatttggtacagatgttacaatagcttcaaaagtaacaacaacagtatctcctgatattatattacctaatgtgaaactgttataaggattatatcctgtataagaagttccatttattgttactgaaccttgtataaatgtcaaacctgatggaataacatctctaaagttaacgttcttagctagtgtgtttcctgtatttgcaacacttactgtataagtcactaaatcatcaattgttgcataagctttatttactgatttagtaggagtaagacttcctaaattaattttagttgatacagtatttgttcttccttctacaaccacaggttgatttaatggatctatataatatttataatctatagttgcaaagttataaatataataatctgatggcaatgtctgaactgttacagaaaaagtaactacagagcttccatatccagctatatcatttaaattaaatcctgtatttggattataatttgaataagatgttccatcaatctttacagatcctgcaacaaaatctaaacttatttttatacataattttaataaaccatgaataaattaattcttttactattataataaaaatgaatgaactatttatattattttataagcaacatattttattgaggggggatatcttcaataatggacattaaaattgcttcaaatacaccaacactagtaaaaaaaatacttggcagcaatacttttaattcatcagaaaatggaagtgtagatacacagactttcacaatatgttccaatacttcttatacggataattcagctataacaataacaaatatagaaacctattactctgatttaggcttattaaatattttatcagatacaacatcaactgaaagattaactacattaaatctatcaaaagatatttctgaagaatcaattccttcagttataaataccattccaaatattaataaattatatgaagaaactttacaaatgatcaataatagcgctgattctaaggattatatatcaaaagaaacttatcttcttttaggacttcagaatctagtaaatatagattttactatttcagattatatttcgtgtaatgataatataaaattctgttgctgttatgattctttaaagaattttataaacagtgcatggactatcatacattctatatgcatttgtgataggtatctttattttttgattggacaatcatctataacatataactatagcttaaagatctataatgaacttgttttatcaacaaagcttttggataatactatagataatttaagcatagattcttctttcaacactaatgataaacaatcattgatttccataaaagcttccttgaaaaattatattgaaaatattgaagtttcagaaaataatattccatcttttttagactttgaaaatgtatgttcaaaaataataacttcattggatttatgtttaaaaattatttcttcatccactgtttttaactgtgatgctaattcaattaatcctatttattcgttaataaatacagtaaatcttataaaatatactcttgcagctataacctcttcttattcatgcataaatgacgattatcaaacaatagtaagtaatattaaatcagcattatcttttttaacatctattgtagcaataaataatgatattaatcttgttaataactttaattctaatataatattaaaaaagacttcatcaaaagtattaaatactgaaaatagcaatgataaattaaattctaatattcttccatcatttaattttatatctgaaaacggacaaccatttaatatagaatcatcaaatttaaagataaataacaatgaaaatatacaagaatctactaaaactataaatactgaaatatatgataataattcttcttctgaagaatccataataacaaaaagcgttacactaaatctatcattttatgtgtgtaatttaaatataagagtttcagggacaataggctctgataattttacagcatacattttctattcaaatttatataacttgagctattttggaattaatgatacaaatgttactataaatgtggatattcctgagaatacaaataaatttaatatttcagaatgtttaaatcccagtattaaggcatcttctgtcactccaaattcaaattatagcttaacatctaaagatagttttaacgcagatattaaacttgaatttactctaaatggtgaagtacttataacttctatattacctatagtcattgcaaaataaaatccttgtttagaattttatcatattctaaacaaggatttttaagtattagaaatcagtatatttgtaagcgctgatattggtttaataatgggaacctgtattgaacaactactacattcaacattatttatacataaaataaattcatttgaaatcatgtcatttatacattgagcattttgtattttagcacttattattacgtctatcttcttattttttatttcatttgaattatgaaaatttacacttacccatgttccatcctgaacaaactctaagttttctatctttttaccatctattgaagcataactttgcatatgatcaaatataagattttcacctatgttattttttaaaagaatatcataatttacatttgtatctaaagtattgaatgaagctttagcgcttattttttccccatctattgcaggaactatattagtaattttttctgctttcatatttattttaacactattaaactttatatttattagatttgattttgttattaaaccatctacaccttcgtatccctttattttaatataagccatattgctaattatatagttactttcaactattgctgcaagatcagttatatttgttgcgattgttatttcaatttctttgttttcttccactgctggattatcaatttctatctttaatgctttctcaccatcatcatattgaaaactcccctcaataatttctccttcacattttacagaactgttcttgtaattaaatgtaagtgctctatggagagtttcttcaataataaatgagctataaatttcttttatacatggtgcattgaatttaactataaagttaagcgaatgattatatacagcaatattttcttctatgtcattcaaaattcatactcccttttctttataaattttattgcggtccttatatgtatatttccaatagatatttcatataacaacaaaataattctaatagcaatttatgtattttggttttacataataaaaataccccaagataaaaatcttggagcatatctttataaactttaaagcttataatctaaattataatactttttgtattatttatattgagattatttttatactgttctgtttacaggttgaggacatggtgtagtacttgtacaaggagtgattggtgggcatactggtgttgttgttgcaccatcagtacaaactacttgtgcacctgaattagtcattacagctaatttctcagttgttgtagcataaatttgtttatttattactaatgataaatcacctgttgcaacaaatgtcgcataagttataggatcaccagttactggtgctgtataattataagttgaatttactggtcttatacagtcaacaattatacaactatcaaattcttcactaatgtttaattttgtatttgttggtaagcataatctacctgcaaaattaatacttggtgggaatcctaaattacttaataatgttggattacctaaacttgtttgagattctactgaccctgttcctattaagtttgctataaatggagttcctccaatagttcctgttatagaaatacttaaattacaaacagaaaaaacaatacctttttcaactatcttagtcattgcataagcttgttctgtctgattacagcagcatgaatttgtcttaatgcttcctgcaaattgattgtataaaggtgttgttgttggtccgcttgtacacgaacatgcagcttgagaagcagttaaagtaagagatttactatctacaaatccacttattgtagtattttgtgaacctatacagtcataactgtaatttacacctgtaatacatatttttcctgatggattagtactttgtaataaattagtctggaatactaaatttgtaggatacccagtttcatatttatttatacacatacaattttgaattacatcagcaagtacaggtaccaaaacttgagttgatacgtctccctgatttattattactggtgtatcacaaggagtacatccacagtttacttttgaaacacttccagaattactcgaaaaacaattattatttactggtgatggtgttgtaccattacaatttgccattataaaataacctccttaatttatgaaagttctatttcgataatttttatctttatagtgtatattatgataaagtaattactttgttcataaaagttatagatgatttatgctttttaatgtagaacaagtataatgttaacttaagattaatatatatattagaagaaatatttcaggggggtttaaatgacttttatgagaaaattcaacactatacttcataaatccaatgacaagattttcatgatagattctgaagatggtattaatctttcaaattttgatatgaactttaaattattatcatctagaaaaatagaaggcggcagtttctcattcattgactactggtttgacttaactcctgatgataaaatatatggaatcattaatgataaaaaaaactcattgcttttttatcgtataacagataaatatataataaaaaatgttttactgaaatataatcctgataaggtatttgtaaaatttgtttatgcaaaacagtttaatttatttacccatatattctattatgaaatagataagttaaacccatacaatgtcaaattaatacatctatttaaaaataatttgacttggaataaatatgtcgttgattcattttcatataatgtacttacaaactttttagttacatatgataacgacttttcaccttatatattttattacaagcttataaatggatttgaagaattatttgtctcaatttttgatacatcctcatgtagatggtcagatccacaaaagttgactaattctaaaaagccaaaaatctatctttcagctattaaggattctacaaaccattatcatataatatattctgaaaataattttaataaatattattgtacttacatacatggttattttgatgatggtgattttaaacaattaaataatttcaaattaagtgacacagttgcatgtacatttcctaatgtaattgaatataatgatactatatatgcccattgggttgaatatcataatttatatgtacgtgtctcacatgatggtggatatacatgggagaaagtatctatttcaggagcttcttctgcccttccatttacatgttgtaattaccatgataataataataataaatatggtacttttaattattttactttgtatatggttgatgcttctgaaaaaattcttggtttagattaactattaatttataaatattgcattatatataatatgcactaaaatgttttctagaaatcataaaggagataattaaattggtaaatacaattaaaataaactgcagtgaagcagcatatgttgataaatatcattcttacgttaatttttcaaaaagtagtaatttaatagctgggattattaataaccgtaaccttggagtaaatttatataaaacaatactaaatttcaaactttccgatatagctccagactcagttaaaagtgcttatatattcatctttgtagaaaacatgaaatattctggcaatactccaagtaatattggaatatgcggtaattatgaacatgttgatattccagttcttaattggacttcttttcctaaggaaggttctacggaaatattgaatttgagtatgcctagaaattcaaccggctcatatataaaaataaatgtaacatccatactcaaagaactttcaaaatttgatataaactacaactttatttttactcctacttcagtaaattcaagcatgataataaaattaggatcatgtaactgtagcaatcctccttacttaaaacttgaattatttgaagatgatcctatatataaacatactgaaagagaaattgatgataatttctctactgaagaagataatcttgatttaaatgaaaaagatgaaatgcttccaggttcatcagacattatattccaaaataatatatctgataatattgatgttcctgaaaacaattctaaaaattcatatgatagtgaatattctgacgacataaaaaaagaggatataaattatagaaataaagatatgttaaatgtatatgataaagttcttgatataccaacactttttactgaggtattaaatacccttgcatatcaatcagaacttcttgacaatttgaaaattcctgataacaaagaagattttgacaatatgttttcaaatatttctggtaaactcaataatgttaatgaagaaattttaaatctttataatgaattattaactaaatcttcttcaaaagatattgttcttacaaatacaatgattgaaaaattaaatcaaaaacttgaatcacaaacttcgataattaattctataaaggtaataacatctgataattctttaactgaagatatagaaaaaacaaatgatcttattttaaccttatctgataatatagaatcattatatacgattttaaatgaaataaaagaaatatcatctgcaaattcaacatctgaagaaataactgcattaaattcaattatgacactactagtaagctctcttgaaattcaaaactcggatatatcttctttaaaagaatttattgaaaacacatgtactaaaactgatgcatctgatataaattcttccataactgaacttaatacaattttcagtaatcaaacatctttaataaatagcataaatgaaactttaggacgaacatgttcaactgatgatttgaattctactaataattttatttctaatttatcaggaaatattgattctttatatgaaatagcaaattccataaaagaaactgctttaaatattccaacatgtgaaaatatcgatgatataaataaacttatttctaatattcaaaataccattaatgaacaaaactcacagcttgaagatataaaatataaatttactggtattatttcaaaaaatgatatagaaaatacaaatgctttaattattaatttaaataaattgatagataacaataatagtaatgttgatgaacttaataatactgtttctatattaaaatctgattttattaatcaaatgaaggataattcatcacttatttcatctttaaaggatatatgttccaaaaatattgaaataggaaaccttgaagaacttataacttcatctattacaaattcatttttatctcaaaatagtataatatcatctattaatgaaaacttttcaaagctatgcaattctgatgatgtttcagctttaaaagaaaatttgatttatcttcaaaataatcttgataatagtagcgtagaatttaaatcctatactaaattaaatgaatcatactacaagtcaataacacaatcattagaaaaattcgatgctaaactctcaagttttgaagctataaataaaaagcttgatttatttgaaaacaattctacacttctttctaataactttttagatttaaataaagaagttgaaaaattaaaaaatgttgttatacctgtttcggaaaaccttgaattattacaatctgatttcaatgaacttaaggataccatattaacatcttattctgctaaaaatgacaatagtgttccttcagatacttctgagattaattctattaatgaaagactaaatattatatgcgaaaacattcagaaggtaatggatgtaatatcaactataaccatagagccattagattagatataaattaaaaataataaactccaccataaagcacaatcttttattgattatatgctttatggtggagtattttttaggatattttccatattctaagacttatattatctacatttatatctgttgttcctgtattttgaaaacttatatagttgtttttaaaaggctcaactctaacaagagtagaaatataaatagttccattatccttcctataaaacaacccctgatttaaaggatattcatttaattttaattgtatgcctatataatcttcaattgaagtataaccaataaaatttgcatgaccttctaaagttataaaatatactcctccacgatttaattttacaaaacatgtaccattattataatctattacatatctatttccagacatcctattacccagttcaatgtaatctccttttggaactgtctgacagtcaaattccatagaataaaaagttgcacagtctgaatctgagccctttggaccagtaatgccttgcatacctctagattctaaattatctgctattggaatattgaaattttcaatattactattaataatctcgtttgatataccagttttagttatatgcggattaacaagtaccttttcaataaagatcatattatttggtatattactaacaattaaataataatttcctgatggaatatcttttaaaatgtatgttccgtcagctcctgttattgtagtgtattcagtagattgtccatcttcagtatataattttattaccactttatctacaccttgggccataggatcaatacttccatttctattggaatcgataaatacctttcctgaaatagatatattcgctccacgatttaattgacctgcattatctttaatatcttttattatatattttaattttttaccagtttttgaatcttctgatttattgtaaaacattattttatatctccaaattaaaaaactctcattttattatattttaaaggcagataaaatgttctatattatctgccttaacttattacaaatatctaatttattcttataatattaaagtttagattatttattcttatatcccctgtacttacattgaccaacctcaaaatattttttctattagtaccacataatccagtggtatttactaaagcttctccctgtaaaactccattttcggtagtataagaatatccttgaaggataaaatcattatttagtttaagctgaagtgcaatataatctttctcatttggagtttctaaaaattctccataacaggagtaatcaatcataaatgttccttctccatttaaaattacataattactattattctcataagaactaaactcaccattattaactgcactacatcctaaattaacggtacatcctcttttaacttcctgattatctagataaatactatttaggttattgtacgtataacaacatcctgaaggtcctggaagccctggtggccctattagtccatcattaaatgctattggtgcatcaacagtatcaacaaatgttcctgacggaacatctataagctttggagtaactcctgtgtttgttacatatcctttcgcagtaacaaataaataatcctgaggtatatttgaaaaaacagcatagtatttttgtggtattaccttatctattaaatactttccattagaatctgtaattgcagaataatctgttcttattccattttcatcatataaagttacaacaacaccagcctgacccttttctcctgggtcatacacaccatttttatgtgaatcaatccatacaaaatcacctacagatgatagtaaattacttggataaacacctgcatcaattgtcatatctattgaaccaggagttgttactgttgttataaggtcagtaaatccagttgtacgatctggcttgcttccattttgttcattagctttttgcactgttaaaacataaccatttggtgatataaattcaatatagtactcacctgggtcaatgttcttaaatgaatagtatcctggattattatttgaatcgtaagttgttgtagttgttgaaataaacactttattagaatcgtataaatttatgacagctccatttatacctacttctccattatcgtatataccattatgatttgcatcaatccatacaaaatcacctaaagttacagtgtcttttccaggaagctttacttgtattccaactttttcaggttcaacaggaagaagttttgcatcttttccatcttcgtctgtaaaagttccccttaaagcaaatgaattccaacctttaagtccttcatttacacctaacggtactacacagtcaacatatatatttagtgtctgtccaggccttattattgttccacctgttgttattattttaaaagattttgcattggtaattggtgatggtggtgtttttgtccaatcattatctcctggtattgtacctccactttcactaaatctttctggattgtaaatttcagagtaccatatttctattgtaggtgaaggatctccttgatatggaggagtaagttcagctacaatattctgaccaagatatacaggaaattctgatccacggctagtagtatttagtattactcctgtatctccaatatgaggtaatatatcaaccatttcaatatttctataatttgtattacttatatttataaatgaaagtttatataatgctggacctccattataagtatttccaacatctggccattgagtgtaatttgtatcaagtgctccctttacttttttatcagatgcatatttagtagagaataatacattattatatactgtattagtaattaaaagctgttcattggttattccatcaccatcttggtctgttgtatcaagataaggtggataagctatagatttcccttcattccctataagcatattgttttgaattgtatttgttactcctggtttaacagttgtatcaaatcttatactcattaaacttctctgtgtcaagacaaaagggtttatctcgattctcactctagttcttccagtattattataattttcatcacttgttactataatctgtggtccacttccaataaccggatttaatgttgtccaaacccactgattagaaaaatattctgcatatgaaacagatacattgcctatatactcaacttctataggaagcaaatcaactattataggatttactattggtgatgcccatgcatttataaatccctcatagtttattgtatctgttggaattacacttccacttggatgattatattttgaaccattaatttctgcaacgccatctaaataagttgtaaaatcagtctgttctggtgaaatttgatcagcataataattaacaacattaactgcagtatccgtaggttctgcagttggatcaactactccatttaaacgaggtgcgtcactttgagtaaaatctatatcggcatctggaaattcccatttaagtcttgtaaccttattaggtgttgttggaagattataatatgtccaataaggattatatccatatggaaatcctactcctatttctgtccatgaaggatttactacactataatcatctgttgtatagaataagtgaaatgttttagctggaaatgttcctaatcctcttatagaaaagtttcctggaaagaccttttctattgtaacattggctggaattgtgtctataacaacaagatttgtaagggcagtattaccattgttttgaatatatatttcatagcttattaaagctccagcataactatggttagggccatacttgcttactcctgtcattggaagaagagatgtaactttagatgtctgatttgaataatcaagtacatttccttcagaatcaataagcttaacattattagtaagatcagtatttaaagctacatttttatctatatttactttaattattaataataaattattacctgtatactgagtgatactccaagtaatgcctgtatctcctggatcttttacataagttggtgggttgggatttaaaatacctccaccttgattcattacaacaggtacaaatagtggatctaaagtcataccagctggaagagtatccttaattgtaaaattattaagtgctgctcctctatcacctaaattttttaaaaatatagaatagtatgcataccctcctggagttggattattatttactggagaagtcattaatttatctatatcccacttagctttaatgcttaatgttacagttggggcaattgcagtaaatgatggtgtatctgatcctgctaaatataactgagcattattagtacaagtacttccatttaatgttccatctttaaatttgcatattaagtctatttcataagcaatacctgtatcagttaccggtggaaagttaaaagtaataaccttgtttaagcctactgtttgtactgaataagttatcactggatctactgcagaaaaatctagttcaatataggatggaactgtatctacaagaacagcaggattaatttctggaagtgtaagtccattaaaactagcctgaatggtataggtaaaagaagtatcataattaaccgttgttttatcaacatgttttaataaaaatgccattttttctcctattaattttaagtatttaccaaattatatataatttgaatatctttttatagaatgtaatcattctttttattgacacatctactgtacatatatacaaaaatattatttaaacaataaactaatttatctgtcttatttatttaaataaaaatgtgctaaagcataataagtatactctagcacatttcttgttatttttaagaatatttaaatttgaaataagattaattaattggggtaaattaaaaatttaaagttattaataaattttttaaattagttattttctattatctctattatttttgatttacatcttccaccgttgcaacatcctgatccagcagtagtcgcttctttaacttcctcaaaagtttttgcaccatctttaactgcttttacaatttcttcttcagaaacttttttacataaacaaatatttcccataccgtttctccttttacaattgtattttttcttaacatatacgttataaaatttaatattaaataatatttttattcttctattgaaatagctgcaactggacagctatcacaagcttctcttacattttcttcattatctgcacttacttcacctgcaactgcaactccagtatcggtagtaaatacctctgagcatattccttcacataatccacaacatatacatgtattttcatccacaaatgctttcattattagttcctcctagacacactttcttagtttcttattaagataatttatataattattataattacataaatctataattaagcagctgagagaattattattactcagaacttgagagattataactttataccttgcaattagtttgattcaacatataaatcatatctgagttaataataattacccaactcttataatcattattaatcaataacgattatttgtcaatacttttttagttttattcaattatatttttataaatttaatttcataaaaaaatcgtaactaaagagaatttttttactcattaattacgatttagagccgttgaaagaaaaatgtaatgcaacaacttttttattctattataatctctaacaatcttgtaagttctagtccttgaattgctgtaactttcgcaccttttatatcttttaatccaacgcttattcctgcaatttcacaggttgtaagatcaacattttttaaacttgtattataaaatactccatttagtaaatttgtattatcaaacattattttattaatacttacttcttgaaaaactccttcttcaaaattacatccattcatgtatactttatttaatcttgaaaaagaaaagtttgaatatttaccaaggcaatctttaaataatacatctttaatcatacattcatcaaattttgcacccaagagcttgcaatttataaattccactctttctatgcttccatttccaaaatctatatttgataaatcgcagttttcaaatacagtatcaataatatctatatttttaaaaatacaattattaaataccacatttctaaaaatgcaagaatcaatattcatacctttttcttctttaccttctattatttcactatcaactattttattcattattttatcacttagtactatttcatcataaaaatcttctatatctttaaaatcatctacaaattttggtttacttatttttaaacctttgttcatttaaaacgtccccatttcttaaataaatttactaattatacaatatcacataattattatagtaacattaattattttaaaataatcaagattccaacatatttttctataacatttctattgatatgaattattcccatgtacaatatatggattcacgtgaaccatacaatgttttatttctttatcttcttctatatactgatgaactttcattgcaatgctatggccctcttcaactgacatttcagaatcaactgaaatatctacatcaacatataatttacttgcatactgacgtgttttaagattatcaatctttataacacccttagtattaattatctttcgtcttattgtctttaccttttcatcactagctgatgcatctataagctgatttacactctgcttgcatatatcataagatatttttattatgattatacaaattactattgcaactaatggatctaaaatcggataccccattcgtgctcctataattcctattaaagctcctattgatgataatgaatctgatctgtgatgccacgcatctgcttttaaagatgtactgttaattttcttagcatatattagtgtataataatacatggcttctttagataaaattgaaattatagcagccactatagcaagaaatcctggtactctataatttttatttattatgttctcaattcctgaatatccaattccaagtgctactataaataatacaattgataaaaataaagctgttatgctttcaattctttcatgaccataaggatgctctttatcagcttttttgctagaaagttttaatcctattattacacctatggttgtgaatacatctgaaaatgaatgaataccgtctgcaatcattgctgcactagttgctactattccacaaaatactttaattatagaaagaactaaatttcctatgatggtatttatacttacccttactccaatttttaatctattatcttccaatttttgtgcctcctatattctcaattgagtttatgttattaaaagtaatatattcattaatctatatgtttgtgaactatttttagtaagaataaaaaatataactcctatactctgtatatattgagtatattttcttatttcaagattatacttgtaaaattatatataaataaaaagcgtatatattatcaattgataatattattcaatactattgtgacataaatataaatgaagcataacatttctgctatgcttcatttatatttactatttattattgtaactgaatagactcaattaatataccgccacttaaagtcttgttaaagagaaatgatacttcgtctatgttacttaaatctatattctgaaaatcctttaatggtattctcacttctcccaatggaatttttgtggtccaatactttatttcttcattatcaagaggtgttactcctatctcaccgtcgtaatattttaaagcattaataccttcaggaagtgatatatttgatatcttttgcttcttatccttaagctgtactgtgaatgattgcgacttgttcttttcattaagttcatctgcactatctactgctaagtttattataagacttttgctactagtaaaatcacttgtttttggttttatagttacagtatcattttctgatgtccattttacatttaataagggttttatttttaattctccatttccaaatgtaagtgtgtctattaaagtcttatcatctttaaaaaaccatgaatctacagttgcttctattactgaaccttctgaactaacattctctatatttttcatatccacaagctgtgtaacttttccacttattgtttcaacttttacatcatatccatacattttattaggctgtggctgttcaagatcatacatagtatttttcaaatttttgcttagtgatgtattaaaaaaatctacagcaaaattttgtaaaaaatcttcttgctcttctcttgtcaattgttcttttgaatacttatccattacaaattctgcatcatttctcacaatatttctgttaaaatagttatggtttgctctttcaagaagtgtcactgatgcaagataatttctatcttctttttttaaggaatcatatattccatatccttcaaggcttgcaacatctccatcatactggggaactattattgaaatatcgtattctccaacttttatatcctcatttaatgtaggtgctatcaataaaactccctttacattattacccttacgtatctcattatttgctatttcaattactgctaatccccctcttgagtgccctgcaagacacaaatcatcaaaattaattttatttgttaaatcaatgctatatcctggatttttaccttcatttgcgttctttagcatttcaatatgcttttcagccattgggatactcttttcagtatcatcattatctccatatttccatatatatgccttgctcatatccatagatactgccacatatccattctctgcaagactttttataagataatcaaatcctgtatcaaacctctttgattcatctatattttcatgtgagccgtgtgttataaatacaactggaaatttaccttctccttttggtacggcaattcttcctcttatgttatagggcatagtacgtccccatgaagatgtgtatgtataatcaccaaactcaaattctgaaatttctgcttcgtatttattttctacagttttttcaatattaagtgattgtatttccccttctgatatattaatattttcttgtctattgctgcatgctataaaagttgtacttataatcattgatagtgataaaataccgattatagattttcttaaaaacataaacttcctccttagtacatgaatttttttaatattaataatattttttattattcttcccataacctccttacaatatataattaacagttattctttaaaaattttcaagattttattaattatttgaatatctatttatatttacaaatgtgaaatctatattattgtactattatttaaatatacataatatttatacattattacaattttttatcatatgaatatatgctacacttatatatatatttaataaggaggatattttaatgtataatattgagaattttgaactagaaattaacacattacatcgaaaaagaatgataagagtttacttaccatctgattatagtacttctataaataagcgctataaagttatatacatgcatgatggacataatttattttataaggaaacttcagcatttggtggaatatgggatattcaatctgctatgaataaatgggaatctgaaggaagagatggtatcatagtcgttgggatagactgcaatcaagatggtggaagatttgatgaatattctccatggataaatgaaaatcttactgaaatgctacctactagaaatatcagtactggtggtggtgaaggtgaactttatatagattttatagtaaaatttctaaaaccttatattgataaaaaatatagaacattgcctgatagaaataatacatttatagctggctcatctatgggtgcatttatatctttatatgcaggatataaatacaatgatgttttctctggtataggcgcattttctacggctgcctggtttaaaaaagatagtcttatagaatttttaaataaaaactttaagaaaggcactaaagtttatttagatattggaacaaaagaaacatctgatgataataacaaagattttaacaatatttatcttaacgatactaaggaaattgcaaacttgtttctgaatttaggacaagataaaaaagatttatttttatttatagatgaaggtgcaaatcattcagaagaatcttggaagagaagatttcctatgttcttggactatatgtttcaataaataaacttaagttaaaatgaaatcaaagtaatatttatgaaaagcctcttaaatcttcaaagttatagctataagaatataaaattaaaacctgacttgatgcacaataagtgttcagtcaggttttatataaactttatctaaagttatattctgtaactatgctttctcttcctgttcttttatcattataatattcgtaaaaagatagtcctaagaaacttcctgtaatattataaatattctgaaatcctaaattcccaagtgcttttgctgcattatagcttctctgccctgttctacaatgtaagtatactggaatatcttttggtatctcacttattctgtctcttagttcacttaaagggatattcactgcatttataatatgtccattgtcatattcattcttttcacgtacatcaattatatatgcgttattttcaacaagttcacgtactttatcaacatttacctgtctaaagtcaccatttaataaattacatgaaacatatccagcataattcacaacatccttagcagttgaaaatggcggtgcatagcaaagttctaaatcttttaaatcttcaacatttccaccaaattttatagctgtagcaattatatcaattctctttgtaacatcaccttttccaatggcttgtgcacctaaaattttacctgttggtacttcataaagcatcttaaagtgtattggtgatgagtcaggcattattccaaccttatcactaagtattaatcttacaacatcatattgtatattcatattcaaagcttttataagactttcatttaatccagttgatgctccattataatcaaaaacctttattgcagacgagcctatgtatcctctattcaaagtactcttattattaatgtgatctgcaacatttcttgcctgcttctgggctggacctgcaagtgatagctttgtataagaatgagtaagggaattatatacttctatggcatctccaacagcatatatatcttcatcatttgttttataattactatctacttttattgctcttgtttcacctagctcaatatctgaatcttcagcaagttttgtttctggtgctacacctattgccattattactgcttgtgctctaacttttcttccagatgataacacaaccgtatctttttcaaatttttcaaccttgtcttctaatattaaatctattcctttatcataaatctctttatgaagtatctgtaccatatcataatcaaaaggtcttaatatctgatttccagcttctacaagtgatacattataaccaccatcttgtaaattttctgccgcttctactccaataaatccaccaccgataactgctacatctttaatattattattttttaaatactggttgattttatctatatcaacaacatttcttatggtaaacaagctaacttcatcacttccttcaaatttaggaactataggatgagcacctggtgataatattaacttatcataactttccttgtatatttcatcattatcaatctttcttatttctacagtcttattttttctatctattgaaattacttcgctatttgttcttgcatcaatgttaaactgtttcttaaatttttcaggactcataagtactagtctgtcaggtgtcttaattacaccacttaaatggtatggcagtgcacagtttgaaaatgatacatgaggccccttttcaaacattataatttcatcttcttcgctgtttcttctaagtcttgcagctgctgatgctcctcctgcgactccacctattataagtattttcttcttcataattattcctcccattttctaatgatagtgtaaaattatttatactatcattttaattttttattgatatatcaagggtttcgaacgtttttttgtataatttaatttatatctaatcttaatctatatgttgcactattaactttacaattattttctttgcgaacctgcgtatgatccaactccgcctgatacatttataacatcatacccttgctttttaaggaatgaacaagctcttgcacttctcccaccagactggcagataatataatattctttattcttatttaaatatttttcaggattatctaaaagatttcccattggaatattctttgccgatttaatacttccacctttatattcataattctcccttatatcaataagttcaatctttccaagtaaattatcgatatcatttacattaatcacttttcctatatctcttttaaaaagtccaaacattctttgttcctccttgttttctctctaaatttcacaatattatagttggtttaaattttctttttatactagaaaatcttaaaatcaaatttgtctatgtattaattatatttaatattaaatagttcttctgtaacttagtcacattaaattattaatacttaatataatgaaatatcccgcttattaattgtattaaaaaagctgaatcatattaattcttttaaattaatatgattcagcatactttttgaaaaaagtcattaaactttagtatttccatacttcaatgatttctttcagtagttttatttaacacatataatattaaataatatttacattatattttttaagctcattcataatactactctctggcatatcttctgttattactgaatcaacttctgaaagttttccaaaattatatactgcatcaatattaaatctctgatttaatactaaaagataagattcttttgaaatatccataataacccttttggtatttgcatcttcaccaatagatgtacttaagtttccattttgagcatttacgcctccacatccaataaaagccttattacagtgataattttttattgaatttatagcatgagagcctattgttcctcctactatagaattataatttccaccaatatagataacatttatattatcagtacattcaactattgatgaaagtactatcatatttgtgattattgtaacttttttattgctcgatgcaattaactttgctatgcagtaagatatgcttgatgcatcaagaaatatagtatcattatcatttatcatttcataagcttttaacgctactttttctttcaaattaatatctgtgtggattctctttaaataactcacttcattaacaatctgtcttgttatttgtattgctccaccataagttctcttaagcatattctgtttttccaatgcttgaagatcttttcttatcatgctttcgctaacattaaatctttcacttaaatcttttacaaatatctttccatcttgttctaatgattctaaaatacatttatgtctttcttcaataaacatatgaatccctcctatttattcttattgtatcaatttttatattattattcaagaaataacgttgaaattaatactaaatggtaatataattaaataaaatagtaataagtgataacaaaaataatattatcaattgttactaaatataataacaagtcatatggaggaaatataataatgaaaaaagcagtattttttgatattgatggtacacttctagatacttctaaaggggtgagtaaaataacttcacctgtaaaagatgctatacgtgaacttcaaaataacgatattttagtctttgtatcaagtggacgaccttatgcatttttaaatgaagatatcctgacttttggatttgatggatacatattgatgaatggatctctaattttattaaatgataataaatctaataatttaaagcctttttataaaaataatatccaaaaagaacatttaaaagaactcatttgtaaatttgaaaattataatatggaatatattcttgaggatgaaaaatactcttatcttaaaaatgattttaaatctcagaaagctttttatgaaagcattgacatatccatgaaatatataaaacatgaatatgatattgaaaatataaatgcctgcaaaattgaaatgcactgtctagatgaagaagcttacaatttctgcaaaacactggaggatgataattttagatatacatattttgatgattttaaactatttgaattatattcaagaaaagatacaaaagcatctggaataatgagaatacttgatcattttaacattgatataaactcaagctttgcttttggagatagtcataatgatattgaaatgcttaatgctgtaggttgtggaattgtaatgggaaatgctttagatgaaataaaagaccatggagataaaattaccaagtctgtttctgaagacggggttgcttatggaattaataattatattttaaataaataacacctacttaaatctaaaaatatatttttaatcaaaaacaggaaatcacttttttgatttcctgtttttatttctattcctaaaataaattttattctttttatatgaaattataatttatttatcatcaaatttcatgtttccaagtaaagctgcaaatggattatcactcatagcttcctgctctgcttcttttttcatcttgttcattatcttatttacttctcttttatctactttgccctttttatcaaatctcttttcaaatacagaagctttttctctgaagttacagtttgttcctggacatacatatatctttccatcaccatgtcctctaagttcaagcctcttcttacattctggacatcttgcatttgtagttcttgatacactttctctatgtccacaagatctatcttgacatacattcatgacaccattcttagtttttacttcaagcatgtattttccacactctggacatttctttccagttaaattatcgtgagtaaatttactgcttccacacttaacatcttcaactaatgctacagaataatttttcatttcttttataaatgataaattatctctctttcctttagctatctgatctaactggctttcccatttagctgttaaaagtggtgactttaaatccttaggtacaagttctattaactgttttccttttgatgtaggataaatatcttttccttttttctcaataacaaaagagttgaataatttttcaattatatctgctcttgttgcaactgttccaagtccgcctgtttcatttaaagttttagcagcatctttttctatatttatgtacttctgtgggctttccatagctgatagaagtgttgcttcattgaaccttgcaggtggtgttgtttgttttttcaccttgtttactgattttataattatattatcacctttatttaaatgtggtaattcttgcgaatcttcatcatcatttaaattatcataaagaatcttccagcctttgctttttgttatattacccttagctgaaaatgtttcttttcctatatttactgttactgtagtctgctcatattcgtaagcaggaagtaatacacttaaaaacctcttaacaacaagatcataaatatgcttctcatcactgcttaaattagcaaggcttcctttttcttctgtaggtataatagcgtgatggtcagaaacctttgaattatcaacataattcttgttagccttaacccctgtatttaaaatctgttgtgctgctactctatattctccaaaggatacagcttttaatctttcaggaatagttgctactatatctgaagttacatatctagaatcagttcttggatatgttaaaaccttgtgattttcataaagtctctgcattaaatttaatgtctgctttgctgaatatccccaaatcttatttgcatctctttgtagttctgttaaatcataaagtgctggtgaatactttttcttagttgtctttttaacttctaatacttctccattttgtcctttgcacttatttactatagagtctgcaatttcttctttaaaagttgaattatttcctttttcatttacccagtttaacatgaatctatcagtcttagcatttaagcaccagtaatccactggcttaaaatttctaatttcttcttctctttgaactatcattgcaagagttggtgactgaactcttcctgcactaagctgtgcattatgtttacatgttaatgcacgagttacattaagtccaacaagccagtctgcttctgctctacatacagctgctttatataaattttcatattctttagcatcttttaaatttttaaatccatctaaaattgccttattagtttgagatgaaatccataatctctttaatggcttttttacccctgctttttctatgatccatctggcaactaattcaccttctctaccagcgtctgttgcaattataatttcatttacatcatttcttagtaactgtttttttacttcattatattgtttaccagttttctttaaaacagtaagcttcatgtgttttggaagcattggaagagtttccattttccattccttatatttattatcatatccttctgggtccataagcccaactaaatgtcccattgcccaagttactatatatttatttccttcaatatatgaacctttatttacattacattttaaaacttttgctaaatctctgcctactgaaggcttttctgcaagtattaatgacttccccattttaaggcaaaccacctttctttttctattttccaagactttttttaaacttattattactaatcctatctttgttatcataataagctttatctttcattagtaagtttaacacaaaataagattttatcatactttcactaaatatttttatgtcattatttaatttatagcctaaaaaatgatagattcatttagaatgtaccattttcaactctctatataattaattgagaagttttctttcctaagttcaattttatataataaatatgcagaaagtcctttaagaatacttgataaacaaatgcttatccatattccatttattccaaaaggcttaattaaaactagtgcaaatggaattcttaaacttgtaaatataatacttattgctgctggaatattaggttttccaattccagtgaaaaatccattagatatcatttctactgcgctgaatgcttgagaaaaagctactgcttgtaaatatgatgctgctatagcaatggtttcttcatcacttataaataatttaattattggcctattaaagataaaaaatatacctgccatagccaatgcatatgctattcctacttttaaagaacttttatatccttcttttattctatcaaatctcttggctccaaaattctgtcctgtaaagcttgcaacggctccatttaatcctccaataaccatatatgctattgattctatctgaactcctactttttgtgctgctattgcatctgaaccgaatatagcaattattttagctaaaaatatatttattattgtaaataatactctttgaaacgccattggaaatcccaaaatacaaatttcttttattttaatataatctattcctataccaaatttataatttaaaattccatttgattttattctgaataaaataaacattattatattagcaataagtgtgctaattccagctcctattacccctaagttaaaaatgtaaatacacacaggatcaagaattatatttaaaattacacctactccattaattttaaatgcaagtttgttatttccaaaactaccaagtattcttgtatatatcatattgaaaaaagcaaaaaataaaataggtgcattcaatgctaaataataatatgcatttttttcaacctcagaattatttaatcctaaaaaacctatgaaacctttacctgcaaaaattagtactatgccaaaaacaattcccataataagattaattattattccagaattaatatatttgtttacttcatcattatcttttctcccaattgcatgggctacttttattcctgttccaataacaactaatgcatttattgcatttcctatattaacatataaacttgatgaacctatgcttgcaactgcattactcccaagctttcctacccatatcatatcaattaaattataagtaaactgaagtaatgaacttcccataattggaagtgcaagtgcagctataactgaaatgactctccctttagttaaatctatttttttcatattgtctcctattttttataaaatcctataaagcgataaactaaaaacaatagtctatcgctttaattactttaattatctgctaattttgaatattgttccttacttatttcacttacaaagtttattgcaaactctgtataatggcttaacttctgcttgccttcttcctctttcattctaataaagtaatcaattggatcagtatctatagctttactaaaataaactctgtttccactatatctgatttctgcactataagtcataagataatatttcataatactaattctcctttttaatataattttttattaaatattgagttttacatgtgaagtcataaaattattatctcttgtaaaccactattagttttctctataaactaacatactatactcttcaattacttttaaaccatcctctagtattatttgctatcttaacaagtgcaagcattacaggaacttccacaagaacacctactactgtagctgttgctgctccactttcaaggccaaataaagatatggctactgcaacagaaagttcaaaaaaattgctagctccaatcattcctgctggcgctgcgatattgtgaggtaactttaataatttagctccaacataagctattgtaaatataaaaaatgtttggattgtaagaggcactgcaattaataggatgtgtagtggattttttaaaataatatctccttggaatgaaaatagaattattaaagttaaaagcaaacctattattgtaatattatcgaatttttttaagaatatattattaaagtaatcttcgccttttttctttgtgattatgcatcttgttaaataacctaatcctaacggtataaccacaaataatactgttgaaagaatcaaagtttctattggtactttcacattagaaactccaagtaaaaatgctactattggtgcaaaagctattaaaattatcaaatcattaacagcaacttgaactaaagtataggctggatctcctttggttaaatggctccacacaaataccattgcagtacatggtgctgcacctaaaagcactgctcctgctaaataatctcttgcaaggtctgatggtattaaatttttaaacactacaaaaaggaaaaatgcactgattgcatacatagtaaatggttttataatccagttagttatgcaagttaatataagtcctttaggttttttagtagcatttactatacttgtaaagtcaatcttaagcatcattggatatatcataagccaaattaaaattgccactggtattgatacgttatagtattcaaacttatttagagtatcaggtattataggtaaatactttcctactgcaattcctattactatacatgttgctacccataatgttaagtatttttcaaatatgcccaatcctcttcctttattctccaacataaatatttctcctcttttcaataactatatacaaactctacatttattagtagagccgcattataaacttatttacaattcattattttttattcttaaagcaaggtctttaattttttcttcaatgactttagctgtttttataaattcttcatcactttttcctgtaggatcatcaagtccccaatcttctgtatgctttgctggcaaatatggacatactacattacaccccatttttattgctatatctatctttggtatatctgtcagcaattttgatttttgagtttcgttcatattcaccttatataaatcttttattattcttactgcatcttgattaatttctggtttagtttcagttccagctgaataactttcaaaaacatctcctccaaaaattttaccaagtgcctctgccatttgtgatctgcaagaattatgaacgcagataaatgctacttttttcttcatgtttatcaacctttcttaacataatgttattttttttattttaataaaccaatgagattatcacctttaacttcttctgagttccaatctattattgcaaatctttctcgtgatacttcatttactttatttatccactttacttcatttaatgcttttacttttaatattttatttgtaacaccagctttatacaaacttgaattaatcacccaccatttattataaatctgcgctctgtctaaatccgctttaagccttactgcttcatatactggtgttgcttctggaagtgttacaattaccacttctgtcatactattatcttttaattttggaagtaattcaataactgattgaggaatatctccttcacttcttgaaatttctctattataattttcagttgattctaataataataatgtatgtcctgtcggtgctgtatctattactacaatttcatcatctgactttttaacaatatctgcaaaagctctaaatactgctatttcctgagtacacggagaccttaaatcttcttctatatattcaatatcttcctcggtcatattattcttcagtgctttatttaaaacttcatttttgtacttttctagttcttccttttcatctatattgcttaatgttatcccataactttcatctaatacatattttaaatgtcctgcaggatcagtagtagtcaaatgaactttttttcctttcttagctaaacctattgcaatggctgctgctactgttgttttacctactccaccttttcccattgtgaatatgacttttttattattatcataaatatcatctacaatatcattaagtttctttattgatgatacctttaatacttcttgtgaatattgtacatgatcttctttcaataatgccctgacattttctaaaccagttatattatacggtcttaatggaatttcaaatgtttcaatgttctttaatccttgtggaatttcacttaatgctttatgctgtttatgataaattgcatttgatatctcatcgtcatgttcctgcataactccattaataataagcatttggtttttaattcctaattcacttaactcaaatgatgctctctctgcttcttttaaaggtgtattctccggacgcgataccaaaataagggtagttttatctttattagctagagtctcaacagcttgtttatacattgactttttactttcaagcccagcaagctgtcctaaacaagatgctccatgtttactttcagtaataaaactgctccatgctgatggtaactgaagcattcttaaagtatggcctgttggtgctgtatcaaatataatataatcatatttatcttccacgtcggaattagttatcattcctgcaaattcattaaatgcagcaatttctatggtacatgatcctgaaagctgctcttccatatttttcaatacactttctggaaatttacctctataaggatcaattacactttctctatattcctttgctgcctgctctggttcaaaatttgctactgtaagattaggtgtttcttttatttttgtacctttattatttaaattagtattaaatacatcctgtaaattagatgctggatcagtacttacaagcattatattctttccactatcacttagatttaatgctactgcacatgctgttgaagttttgccaacaccaccttttcctgtaaaaaataaatattttgtcaaattaatattatctatattaaatttattgaacatattttttcatctcttttcaaaagtaatcattgggaattgtatttatatcaattaatttaacagcatcctcctttgcaattacacttttcacttcttttgatttttatattgctttttaaaaattctgctggtatgccaagcaatgaacagaattcttcatttgtaggataacttccatgctttacaacaataccatctaccatagttacaggcagtaccttaactccattagaatttaatatatcgctgattgttttattatcaatgaaagcctgcggattttgagatagattatatcgctctataattactcctttgttttttaaaacattaatagttgtagcaacccttaataattcaggatttacagatggaccacatacccctgttgaacagcacatagctgggtcaaaaataatcatttttttcatttttatcactccaacatatataattcatatctatttttttcgatatgtaaagtattttttaaaccatctaaaaagatggccttaaattatgtatggcatctgctatcatcacactttttattagaaataacttgtgttagctcttttaatagttcgcaagcatatttgcttccttcagagctgattgaatagtaggtccattttccttcttttctacttacaacaatgcctgattcacaaagtattttcatgtgatgtgataatgtagattgacttatattcatttgttccaatagatgacatgcacacttttctccattttgtagcatttcaattatcattaatctattttcatcacaaaaagctttaaaaactttagcattaatttggtatctattttccaaattctcacctcacatatatttttcttatatttctattatattcttcaaatcgaattttatcaatatgtctaataaatactttattcaaattctacaatattgttcctcatgttatagaaaaattattatatttttattacatttttataattattatgtaaatatgttacaatatttaattgaaataatactcagaaatgaatattaaatatttaaattaaataaggagacataacagtgaacagtataaaaaaacttgttatagttgctattacagtaataactgctggattaccaatagcatcttacgcagcatcacacgaaacattaggacaatctgttgatttacaacaatacgaaaacaatagtagcttacaaaaagaagaaaatgaaaacacttcagcaaaaaatttaaaaggctggaatacaacggatggcaataaatattattacactgatgataataaaaaagctaaaggctggactaatatagatgataaatggtactattttgatccttctggcaagttacttacaggatggattttagatgatacaaagtggtactactctgacagtaatggtgagaaaaagactggatggattactatagacaacaaaaagtactaccttgatgagtctggaatcatggctacaggattagttaaagataaagataatacatatctattcaataatagtggagatatgctcactggttggaagttattatctaataataaatggtattattttaacgaagatggaaccatgaaaactggctggttcatctctaataatttaaaatactatttaaaagaagacggaagcatgtcgactggttggcagacaattgatggaaaagattattattttaataagagtggtgctttaagaagtggctggataggtattggaaaagatattttctatcttgataacaatggtgctaaagtcactgataaagccatcgatggatatacacttgattcaaatggaaaacttgttcttccttcaaatcaaacagaacctgacatagacctatattttacaaataaaaatataaatatcaacactgaagaatgtgattataaaagtaaaaataaaggaattcaagaaagcgtatttaaaggaatagatataagcaaccataatggatatgtagactttaacgctgttaaacaagctggtataaaagctgtttatatgaaagcttctgaaagtgattactttgtagatcagtatgcagaagaaaattgcaagaatgctaaggctgctggacttaaagttggattttatcactacttaacaggtacaagctctccagaagatcaagcaagacttttttatcaatgcattaaagacaagcctaatgatcttaaaccttgtgtggatgttgaagtaagttcttcaacagcattaaattatactgtaagatttataaatgagtttaaaaaattaagtaatatggatgtttgcatatatacttatactaactttataaacaattttgactcaagcttatcatcatattcactatgggaagcaaattataatgattctccattctcccttcctggaaatagtgtttggaattcaaaagccggacatcagtatacctctgaaggatatattcctggaataggtggacaacttgatcttgatgtttttaatcacgatattttattgtaatttgtattgtttaataatttaaaatttattacaaatatatttaatttaaaggacaatgtttattaaaatatataattgaaatatatattatttacatcagtatgtagtaatattataattactacatacttgtgaaaggagtttgttattgatgataaattcatttacttatgatacagactttgggaaaataacaatatgtgaaaaagataattttattattgagacagtcattggtatttcatcctttaaagccgatagaattatagaatctcctatgataaggaaagcacatacacagcttaatgaatactttaaaggtattagaaagtcatttgatcttcctcttaatccaaagggaacagaatttcaaaagaaggtttgggatgttttgttaaaaattccatatggctctacctgctcatataaagatgttgctatcagtattggtaatgaaaaagcctgtcgtgctgtaggaagtgcaaataatagaaatccaatatttatcttcataccatgtcatcgtgtaataggtacaaatggaggtcttgttggatacggtggtggtattcagttaaaagaaaaacttttacttcttgaaaagaagaataaataataaaaactttccttaagtgtatagttatctataataataaactatacacttaggaaagttttttagttttataaatgaaaaagagcaaagacacaatctatgctttgctcttaaatatacttaagatagagaaatattaatttgaatatttattccatctacatccatctcaacacaaacaactttatcagtacttgcattagctgtaaattctccttgaataagtgtaggagttgatatatctactgttatgttatctctagaaaaatttgttgctacatttgctgtgagcatatttacaagttctgaaattgcactttgtgccatttcattgaaatcatcaacaggcattcccatcatcatctgtgaagctatcttttttgcattatctatagataatccataaataatatttcctttaacgtcacctataagtcctattattataactacacctggactttgaatattcctatcttttaaagttactcccttttttgagacttcagcaaatcctaattgtggcattatattgcctactgattctattactggatttatatgtctgacatccattcactttcacctcttctgaaacctaaatttaatgaaatatccccaaattcactttttatatcagccgaaaaattacattcaagttcagctttagaaatatttattgattctccatgtatcgtcgttggaggtgctactctaagaccaaatactttatttttcttatttattattgaacatccatttccagcaagcatatttgctacttctgaaacaacatttaaaacttcttcgttattttttgcctttcttctaagaaggcattctgaaaacttttctgcagtctcaagagacatgtccataataagtcttccactatattttcctattattccaagtacaatagatattcctgcacttgttttttccttattttcaaaactaatattagtaatttcaggtacagtttttgttaatctgttaaatatatttaaagttgcctcagtataagcccctaaatataaaatttccaattcacaaaacaaatcttcatctgccattaccctattaataagaagtgtcaattcttcagtatctacaggtttttgaataaaaccacttattccaagttttttagctttatttataagttcttcatccatcattgaacttacaactataacttttatattgctatcgatatcatgtacagcttttgtacattcaaacccatctgttcctggtatcgttaaatccatggtaacaagatctggttttgttctcttaacctcactttttacttcttcaagagacatagcttgtcccactacttcaaaaccttgttcttctagtacatcacttaataatgcgatttggaatggagaatcatcaactattaaaattctagtatctttcatacttctataccccctgattgtataactttactataaagtccaactcttttataacgcatatttcgacttataaattattgtcattataatattaattatatggtatgcatgctatattttcaacaattttcgtttaaaaatagaaatccagtataataatataataataaatactaaaaataaaaatattttcaatcatttcttatgaaaacttttacttcattcatattattgattttataatattccatcaaatattccttattagattcttatatgactaaattctaataattcatacttaatatatattaaatcttcatagaaattatgtaaatgaaatcttctactatttatagataatatatagtcaaattataactattttaaaaaacaattatgtatagattacacttaaaaattaaccatcaatttttttactcatacaaagtttttaaaactttttttgggttctttcaaagaataaagaaagatacctgtcataattaatcagaaataataactaaaaaatttctaatttattatgatcaggcatctttttatagttaacaagtaacagttgacagtttccacaggaaacctaagggtttctttaatttttattttctagaaatcttcctaatagagttcctctttaactgtcaactataactggtcaattaaattctattcttgacttgctaatctcttataagttgcatatctttccattgcatcagcttctgttttagcaaataattcttctgctgcttcagggaatgcctttgcaagtgatgcatatctaacttcactcattaagaagtctctaaaacttgtttttggttccttagaatctaaagtaaatggattcttagttccttttaatgttgggttgtatctataaagattccagtaaccacaatctacaacgctcttttctacagcttgagtattagccataccaactttaataccgtggctgatacatggagcatatgcaattattaatgatggtccatcatagctttcagcttctgctattgccttaagtgcttgatttttatcagctcccatagctatttgagcaacatatacatatccgtagctcattgccatcatacctaaatctttcttcttagtcttcttaccacttgcagcaaacttagctattgcagctgttggagtagactttgaagactgaccgccagtatttgagtaaatttctgtatcaaataccaatacatttacgttttctcctgaagcaagaacgtggtcaagtccaccgtatccgatgtcgtaagcccatccatctcctccaaagatccattgtgatctcttcattaagaaatctttatcttctaagatagctttagcaaattcgttattttcattttctaacacttccataactctttctgctctttgtcttgtagcttcgccagaatttttatgttctatccaatcttctaatacaacttttgcatcttcagaaacaccagtttcaattgccttcttagcattagcttcaattctatcccttattgcttcaacaccgaactgcattccaagaccaaattcagcattatcttcaaatagtgaatttgcccatgctggaccgtgtccttcttggttcttagtgtatgaacttgctggtgctgatgctccccatattgatgaacatcctgtagcatttgctatcatcattctatcaccgaataattgtgttacaagcttagcatatggagtttctccacatccagcacaagctccactgtattcaagtaatggttgttcaaattgacttcccttaacagtatttttgttcataggattcttgttcttaactttttccacagcataatcccaagcttcgatttgatcttcttgagtattttgtggcttcatgataagagccttacctggtgctggacaaacctgtgcacagtttccacatccagtacagtcaagtggtgtaacacctatgctgtattgtaatgtttcttcgctctttaatgctttagctggtactaatttaacactttctggagcattattagcttcttcttcatttaataagaatggtcttattgcagcatgaggacatacaaatgcacattggttacattgtatacattttgatgaatcccattctggaacattaactgcaacccctctcttttcatatgccgaagtaccatgcatgaatgtaccatcatccataccttctcttaagaatgttgaaacaggaatactgtctccttcttgtctgttcattggtactacgatatctttaataaatgctggaatttctttagattcagcttttgcttcgtgaacttcatcctttgcatctttccatgaagaaggaacttcaattttaacaattgagtttataccggtgtcaattgcatcatggttcatgctaacaaccttttcaccttttttcccatatgatttaactactgcgtcttttaagtatttaacagcatcttctaatggaattatgtcagctatcttgaagaatgcagattgcattatcatattgattcttccaccaagacctatttcctgtgctatcttaacggcatttaatgtgtagaattcaatttcattttctgcaatgtatctcttcatttctgctggtaatttactttctacttcttcttttgaccagattgtatttaataagaatttaccatttttctttaatccagctaatacattatacttgtaaacataagcctggttatgacaagcaacaaaatctgctttatcaattaagtatggtgattttatttgttctttaccgaatcttaagtgagatacagttataccacctgattttttagaatcataatggaagtatccttgagcgtacatatctgtatggtcaccgattattttgattgcattcttgttagcaccaacagtaccatctgatcctagtccccagaacttacaagctgttgttccaggcttagcagcatcaatttcaacaacttctaatgaagtgttagtaacatcatcaactatacctatagtgaatccgttctttggttcttctttatctaagttagcaaatacccctgcaatatgagatggtgttggatcttttgaacctaaaccaaatcttccacctattatttgtggtgcattagcttttccagcgtagcttcttaaaatatctaagtataatggttcaccaattgaacctggttcttttgttctatctaaaacagctatctttttaacactttgtgggataacctttaataatctttctattgagaacggtctataaagtcttactttaactaaaccagtcttttctccatgagcatttaagtaatcaatagtttcttcaattacgtctgtaactgatcccattgctatgattattttatctgcatcttctgctccataataatcgaaacaatgatattctcttcctgtaagctttgttatttcactcatatattcttcaactacttgtggaatatcatcgtagaatttgttaacagcttctctagtttggaagtatatatcaggattttgtgctgttcctcttgttacaggatgatttggatttaacgcattatttctaaagttttctaatgcatctttgtcaactaacttagctaattcgtcatattctaaaacttctattttttgtacctcatgagaagttctaaatccatcaaagaagttcataaatggcattctacattttaatgcagttaagtgtgcaacaggtgctaaatccataacttcctgtactgaaccttctgcaagcattgcatatccagttgcacgtgctgacataacgtcttggtgatctccaaagatatttaatgaagatgtagcaagtgctcttgcagctacatgaataactccaggaagtctttctcctgcaatcttgtacatatttggcatcattaaaagtaatccttgtgatgctgtataagttgtagttaaaacaccagcttgaagtgatccatgaacagctcctgctgctcctgcttctgattgcatttctacaaccttaactggatgtccaaatatatttttagttccttttgccacccattcgtcaacatgttctgccattggtgaagatggtgttataggataaattgcagctacttctgtaaatgcatatgatatataagcggcagctgtattaccgtccattgttttcatttttctcatcgcgtctacctcattttcttttgtatattttttattatacgatcttattataaggtctgtattagtaaagtaatcagtaactagtaataattaataataattattacttaatttccttttctttattatatattgtttttccacatttgaaaagtagtaattgataatttttataatactaatttaaatattactaatataggtaaacaactattaaatttttataaagagtataaaactaaaatattgagacaaaaatagtctatgaatggagaaaaaatatataataaaaaacataaaagtggtgataacatgaacatttacattatactaacggctatacttttattattagatatttcctgtgctgtttctctaatctttattgaaagacgtgattcaaccacaacctgggcatggcttttagttctcgctattttcccattcttaggttttattttatatatatgtttaggtcaaaacatatcaaaggaaaaaatcttcagtaaaaaagcaaaaattgataaaaacaaattaaaacatattcttgataaatttaaaagcacttatgattcatcagaaaatgatcaatattgtcttgatttaataaaaatgaattataatacaaatggcagtgtctatacagacaataattctgtaaaaacttatataaatggtgaagataaatttagagatttaatagatgatatcaaaggtgcagtatcctttataaacatacaatattatatttttagatgtgatgatcttggaatggaacttttaaatcttcttggtaaaaaagtttcagaaggcgttgaagtaaggcttttagttgatggtatgggatcaagttcattaaaaaagaaaaatattcagtacataaaaagtctgggaataaaattctcatttttctttcctagtatttttagttttgtaaacttacgtataaattataggaaccatcgtaaaatagtaataattgatggaagaactggatatgtaggtggatttaatgtaggtaatgaatatgtaaataaaggaaaacagtttgatttctggcgagatactcatttaagaataaaaggtgatgcagttcttgaacttcaaaagcgttttactcttgactgggaatatgctgcaaaagaatcaattgatgaaaaacaatatgttcttacaaaattgactccttctgttgatgaagcttatgttttaagtgatttatttcttgatgcaattaaacaacataaaaatgaattaatgagcaaaaataataaatttaattctaccataaattcaagtaaaagcagtactccagcaaattatttaaaaacattcaacaaagttggaatacaaataatctcaagcggacctgacaatcttgaagaatatataagaaactcatatttaaaaataataaataatgcacgtaaaaacatatatattcaaacaccttatcttgttcctgatgagcctatgataatggcattaaaattagctgcatcttcaggtgttgatataagaataatggttccagatgaagccgatcatttttttatggcttatgcattaagtgcctcaatagatacacttataaaaagcggaataaaattttacagatataaaaaaggatttattcatgctaaaacaatatgtgcagatggatgtatatgcagtataggtactgcaaatttagatatcagaagttttaaactcaattttgaaattaatgcaattatttatgattctgatgtaacttcatacaacgaaaatatatttataaatgatatgaatgactgtaaatttctttccatagaagatcataataaacgtagctttaaaacaaaaactctagaatctatagtaaagcttatttttcctcttctataaataagtccttaaactttttactgtataatttaatcttttattaaggatacacttcttattcaggaaattataatgattgtacatgtaaaatctagtgaattcaatagttttagaggatttaatgttaaaagtttctgtagaaaaacacagattttctacagaaacttttaattgttaactaaaaagcttgttaagcttttttcatatttctattttattaaaatattttttattttgtttgaaatttatttatttctattatattttttcgcatattattttatttaattttctgttataattccggttacttcatctaattttgcaaacttataaaactcatcataattatacttttcagtttccattacaagatagcttttattagaacattctattattgttttttttgtatttccatcttcaagatttattgtgcttacatccccactttccttatttatcccacacactcctataaagcatttatcataagtaaagttttttatgtacctgtctgcagctgcacctataactgctccaacttctgaattaaatgtcccccctacagttataatcattatattagtacatttttttaattccatagcaatttcaagcatatttgttacaactgtgattttgatttgtgaatcttttaatttttttgctatttcaagattaatggttgatacatcaagaaaaattatatctttctcttctatgatatcaattgcattctctgcaatctgcttttttatttctgtatttacgttttttctctcatcaacagattttatatcactatgacctctatttactattgcacctccataaactctttttaatttctttctattttcaagttcccgtaggtcttttcttatgcaatcttcacttacttcaaattcttttgcaagatctttaactgcaactcttccattcttatttacaagttcaattatttttgaatatctttcttctagaaacattatctcacttccttttattgcatatttaataataaatatcttcttagattaatttaattatatcatatatttattatttattattattttattattatttattattgtttgttattattagttcttgatttaaaggatttttttatatataatgagtagtgtaaagattccgaacataaagtggaacttgattcaagatgggcttaatcccatgtctgaatcttagttgaacttatacaatcaatgtacacctagtctagggtgtgatgctgttatatatcataaaaaagtgtgagttttacagtagctaggcatgagataaaatagcgtaataagattcgttcttagcgtaatattttatacagctatatttctatttcttcatatttccaattaagatttaatagaaatatggctttaataatatataatctaattaataattgagaattatcctttaaatatatattaaacatttcttatatttaatgtaaaataattattagcaatatacatactaaaatataaatagttatacgaggtgacatataatgataaaattaatagcaacagacatggatggaactttattaaatgaaaaaggctgccttccagaaggattctttgaaatgcttgaaaaattaaaggaaagaaacataaaatttgttgctgccagcggcagaccttataaaacactctatgaaaattttaagcctaaaagcgactacctagattatatttgcgataacggatcttatgttgtattaaatgacatgaagcctgttataaatggattaaaaaaggacgttgtacatgcagttataaaagcatgtgaaaaaatagaaaatacagttgtaattttatgtggagtaaatggagcatatcatatgccatgctctgatgattatttgaaagaaatagataaatattatattgaaaaacatgtggtagataacatttatgatgttgatgataacatatttaaaattgccatatgtgatcttaatatctcttcagaaaattcatataaagttttaaatcccctttttggtgatgaaaataaagttgtagtttcaggcgaactatgggtagatattaatggtaagtctgtaaacaagggggctgctcttaaagaaattcaggaatgtttcaacatttcttatgaagaaacaatggtatttggcgatttttacaatgatattgaaatgcttaaagaagctcactatagttttgttatggaaaatgccaatgatgatatgaaacaatatggaaattttatagcagaaagtaataatgataatggagtaattaaggcaataaatgaatatgtactaaaagaagaaatagctgaagtttaaacttcagctatttcttctttttgaatataattattaaaattttcataaaatataaaaattctttagaaaattaaaactctctacttatttatttcgtcttcagtgataaattctaaaacaagtgtacctattccatcaccttcaagctcattttctaattcataaatatctctaaatcttaagaaaatatcctctccgagctgaatagtatgacctacaccaatttgtggcctttctgtatattcataattaaaaatatcttcaaacatatcataaacctgctgtgagtcctcaaaggaatcacctttaaaagcatattcatgaacaccataaagaaaatttcccttagttacgaaccaaacattatctccatatggcattttaacaaaattcctccacaccatcatagctggtgtataagccatctcttctattcttttatcttcaaataaaccttttaataatcctggtgaaattgcattccatgcatatccattagccattccaacaaagttatcttccaaaaatccatatgcaagcttagcataagcattatatatagtattataatctgtgcttttacctgcataaaaagctataatatggtaactatgattttccatagcttcaagttcttctttctgaccataagcgcagccaactgtatattctgttatttcactaggaatagaaatatcaagtcccactattttaaatttttctccatcaatttcagcagtcccatatatattaaatgtatcttctttttctaatatattttgtatttttgcatttctatcacatattttgcttattcgactttctatttttgatatattaaactctggcttttttgagaataataaatataaggcaaacctatcatctgtattattgttattaattacttgcactgattcttctgtattttctatatcagcctcttttttatttttgtttaaaaaatcaaacattcttcataccatcctttaactcacattttttcatcttatatactttaattacacacttatgtttaacttattgataatatttacattatatagtaaataatgcacatttgtatatactttattaatatatttaacttttaaaataattaagatgtcataatatgcagacttcacttttatatgaagactttatctaaatatattattaactaaaaacattaataatatattttaatcttcaaggtattatttacataatttatacatatatataaacatatgaaaatttatttatattttattgttatggaggatttattatgaaatatatgtatgttaaatataattcaaataaaagagaatctattatcaaggaaaatgataatataagatatgaatcaagtgaatctttaaaagataagtgcaattcctgcaaagttatagatatgaattcttatatagataaaaaaaatactattttagatgataaaattacaaaattcttttttgacagtattcataaaaatcaccttaagaacagataacttctgttcttaaggtgatttactatataacattaatttcttctatacaaatatgaattaaaaaatactagttattaattaaaataaatgcaaactaaaagttaggttcatctaaataaatatatccataaagataatctgtattatagatctctctataattaaaatatgagccatgccatgatgattctgaaatgtaaatcttattgttttctattttttcaataattgcaacatgaccacaccctcctgaattaggaagtgatgacttccagactgcaagagcccctttctttggagtctgtccatacttatatttcccacttcttatattagcattccaccattcataaccattaccagtgaaaccagcatcataaggtatacgtcctgtcatttcccatattctgccataagcataccatgtacaattacctactataggttttccactgctatttgtaaatggaggtgataattttactttataaaaaatattatcatcagaataataatgtatgttattcttttcaggtccagtagttcttattgaaccaaggcttatattagtatttccagatgaattttcattattatttccattttcagtttgaggtttgtcaaaacttatccatttactacttgcatagcctgtcttattgttatattcaaccttataaaatccattattttcttttcctataactgtaatttcgctacttttaggaatagtaataacaactttagaatctgatgagggttgaagtctcatgtttaatggactactttctgttacaacatatgctttttttctaatttcttctacaatacttccatctggtatactttcttctttgtcaagggaagggtcattaactgatgaatctccttcagttagagctccactttctccaaaatcatattctttaccatcaatagttatctttcctgttgccatttcaccattaggttcaagataatatttatttccatcaagaataatccaccctgtaaccatagctccactatcacttaaataataccacatctcattagaatccttaagccaacctgtattcatagaaccacttgaacttaagtgataccattttccatcaatatctttaaaccaaccaattctcatttctccagtagtattcaaataataccacttatctccttcttttaaccatccacttgccataattccattattataaaaaaagtaccatttttcttgtataagcttccatccagttacatttattccattctcattccaataccatctgttttcagaatcctgtttccatatagcttgtacactttccagattcaaacttaaaatggtactgctacacaggaccaataataaaatattcttaataactttacttttcactggttttctccttttatctttagtatgatttgttttatttgttatattaaaatatatattttgcaagtataaatctacatacagtatcaaaactttatcaattaagctttaaatattaattgctcacaagtagtacccacaacaaattcattcagtaccgcatgtcaattttaagtaaaaaaacatatatttattttatcataaatttcatgtaattaataaaaaatatatttagtatgtataatgagaacttcatcacctatgaacttttatattttcaagatattataaattttcaattcttaatttcttgaaaatttcaactttctccaatttaattttgtaacaattaattcttttctttttattttaattaatactttatatttcaataattaccggtaataccataggctttcttttcatttttgtatatacataattatctacttcttttcttataatactcttaatttccgaccattgatttacattattacaaagacatctctctacacatttagaaactatacctttaatacctctaattaactcttctgaatctctaacatatacgaatcctcttgtaataatatctggtccagatattatacttctgctttctctatttatagcaataactactgttatgataccatactttgctaaattctttctatctctgagtacaatattccctatatctccaatgcctaatccatctacaagaactcttcctgatggcacatttccaactatttgtgcattttttttagatacttcaaacacattgcctatttctaaaataaatatatttgacttattcatacccatattttctgcaattttagaatgacttaataaatgcatatactctccatgtactggcacaaaaaatttaggttttaataatgcatggataagcctaagttcttgttcacaagcatgacctgaaacatgtatatcttctattgcttcatatattacctctgctcccttttctgttaaatcatcaataacattagacacagcttttttatttccaggtattggagttgatgatataattaccatatctcccttttctatttgaatacttctatgatttcctgaagctattcttgtaagtgctgccattggttcaccttggcttccagttgtaattattgtaattttattattaggatatttttttatgtcatttaaatctattacaatttcttctggtataaataaatatcctaatgacatagccacttcagatattctttccatacttcttccgctaaaagcaatctttctaccatattttatagaagcatttgcaatctgctgcactctatgaacacttgaagcaaaagtagctactataactcttccatctgctttcgtaaaaagattatctaaagcttcaccaacagtcttttctgacattgtataacctgcacgagtagcattagtactatcagccattaaaagcagtactcctttttttcctaactgtgcatatctttgcaaatcaataacttctctatcaattggagtaaagtcaattttaaaatcaccagtatgaacgattactcctataggtgtatgtaaagcaattgatacactatctgctatactgtgatttgttctaataaattcaatcttaaaattgcctgtttctagcatatcacctggtttaaccatgtttaatgtgcagtcactaatcatattatgttcttgtagtttactttcaattaatcctaaagttaactttgtagcatagataggaacattaatttgtttcaaaatatagggtaatcctccgatatgatcttcatgcccatgagttatgaaaaatccctttatcttgtctttattgcttaataaatacgttatatcaggaagtacaatgtcgattccaagaagctcttcatctggaaacgacattccacaatctataattactatctcttcttcatattcaaagacagttaagttctttcctatttctcctaagcctcctagcggaataacctttactttactttttattttggtcctatttatcattatatctcctaacttataactaagtacataaatatattctaagattaaattgaagttttctaatagaaatactaatttatctaattgtgtcttaaaaaaatctatcccctaaatttgtataatattatttcaagattgacttgtaacaataagtattcaatgtacttttgaggacaaaaaatagaacttagttatcacttaatttttactattgtataatattaattttctgtgttctaaattatctataattccgacgagcaatatcatcctgttaaaagttttcacttttataaaagttattttgtctaagaattaatttttcaaagattaaaaataacttacagtacctgcaccttaatattttatataataatttgactatcataaaaaaacttgaataaatacaaagttccatcatataaatttaattccttatattcattcatctttttttattaataaacatttagtgtactttaacaaaataacttctatctaaaatattaccattaatactcctatatagtcaatttatatttatactataattcacttattatattctttatttcagaataagccaaacagcatcaattactgtttggctgaaaattttatattagacatctttatatttacaagtcaatgtatgtaaagcttctatgaccatcatcttagttgtacatatattattattaaaatttactaactacataacctgaatatggtatgcgaatagcaacaccactgctgtcaaatttgtattttgtattatacagtggatcttttccttgaactaaattattccctacaagatataaagcttttgccatttcatctatattctgaactacggtccctgtcatttctttctttttaattagttccaatgcctcatctaatccatctattccaactacaattacattattattatttaaattacccatattatatccaaattcatgaagtgcttcaatgcttccttctgccatctcatcattattacatattattccttctataacatttccatatcttaagaacagactctttactacaagtttagcataatctttatcccaattacaatattcagatgctacctctaaagtgtttataccatattcatttaagctcattattacatatttacttcttaattgagtctctacattattcttttcacctttaataagaatatattgaaatacattatcattatttttatcatatattcctttttcatcccatgcttgatttattatttttccttgaatccttcccgcttctgcaccatctgcccctataaataatgcttttccatatgattttatgctttctaatgatattggttctctattaaatagtattacaggtatattgctcatttttattctatttatcactgattcagccgaatctatatctactatattcagaagaataagatcagttccttcttttaatatttgttctaactgactattttgaatactttgtttttcttctccatcataaaatttatagttaattttatctttatttttttcttgaatcttttcaagattcatctttactttatttatatatttatcatcacctttatacaaaagtacactaacgtttattatcttattaggatttattgtacttttaccacttaccatatacatacttatgaaattcataaatattgatattattaaaatttttcctattatttttcttaatattttcataatacagctccattaattcatttattttatttaatatttatcatataaaaactctttctcaaaaatttcacttcatcaaaatcattaactacataacctgaatatggtatacgaacagtaacaccactactatcaaatttatatgatgtattaataagaggaggtttactttgaaccatattatttccaatcaaatataacgcttcagtcattttatctgggtcttgaattactgtaccagtcatttccctattttttattaattctaaggctttctctaatccatctattccaactacaataacactattattattaaagttacccatattgtatccaaattcgtgaagagcttcaatgcttccttctgccatttcatcattgttacatatgattccgtctataacatttccatatcttaggagaaactttttaacaacaattttagcacaatctttatcccaattacaatattgtgatgctatttgcaaattttttataccataatcatttaagctttttattacataattactccttaattgagtttctatattatctttttcacccttaataaaaatatattgaaatacatcatcattatttttatcaaatttttctttatatttccatgcttcatttattatttttccttgaagtcttcctatctctgcaccatccactcctataaacaaagattttccgtatgattttatactttctaatgatactggttctctattaaatagtattacaggtatgttgttcatttttattttatttatcactgattcagccgaatctatatctactatattcagaagaataagatcagttccttcttttaatatttgtttcaactgactattttggacactttgtttttcttctccatcataaaatttatagttaattctatctttatttttttcttgaatattttcaagacttatctttaccttatttatatatttatcatcacctttatacaaaagtacacttgcgtttattatcttattaggatttattatacttttaccacttaccacatacatacttatgaaattaataaatattaatattattgaaattttacctattatttttcttgatattttcataatacagctccattaattaatttgttattttttcctcaaagttgtttatctcctaactaaaatcttcaacacttacagatagagaaaattaactatattcatattattagcaaaaaaatagaattaattctttaattacaatcataataatataatagttataaaaatgctgaggtgtatattatggtagataatcaatacgatttttattacaatcctaaaactgaaaattatcttattaaatataaaggaaactttaaagaacaaattgataccgttgattacgctattggaaatgtactcactgaaactctaggtattattacagtagaaagagaaaatttaaacagactattaaatgatgtaacctctattatttatgttgatataagacttatgtttgttcttcaagacatatctccaacttacatagataatataaacaacataaaaataaatccttatttaaaccttgatggatataatgtaactgttggtattcctgacacaggaattgattaccttaatgaagaatttatacgagaagatggaacttcgagaattttaagtatctgggatcaaactatacgtaatgatactcctgatattggagatccttatattggaaaaatttattcacatgaacagattaatgctgctataagtgcatatagaaataatgaaaacccttatgcaattgttccatctaaagatgaaattggtcatggaactagagttgcaggaattattggaggcagaggtgcaaccgatatctttaaaggaattgcaaataattgtaatttcattattgtaaaacttatagaatcaactaactttaaagatatgttaaaagaaaatttattagaagatgttccagtatataatacagctgaaattgttgcggggatagaatatttaaaaaatgaattttttaaactccaaaataaagctatggtaatatacttaggttttggtgctacagaaggaagccacgatggcggaagcgttctatcaagctatttatctaatattggtacaatacgtggaatttgtcttgtttcaggagttggaaatgaaggagataaacaaggacatacaactggttatataaattctaaaggagatttttcaattagtgaactattaattccaagagaacttaaaaagcttaacgttactatatggattcataaacccaacaaagcttctctaagtgttatttctcctacagaggaatcatcaaaattaataaaagtaaaaattaacagaatagaaaattttaaatttgtctttacggatactcaatttactgttttttatagaacacctgaccactatacaggtcatgatgttatcagaatagaatttaaaaatataaaacaaggtatatggaaattaaaacttacaggtgaatatatactcgatggacgatatgatatatggcttccaccttataaagttcttcctgaaaaattagtatttcttgaaccaaatccatacactacacttactttcccttctaccgctcaaaatgttatctctgtatcttattatggaaataataatcaaataatggcatcttcaggaaagggatttaccacaaatacaacaataaagccagatttagcaacaataggtacagatattttaacaacaaaacctggaggtggtgctacaactttttctggaagttctgctgctacggctgtaattgctggagcctgtgcacttcttcttcaatggggtattattaataaaaacgatataacaatgtactcaaataaagtaagaagctatttaatttatggagctacaagaaataatatttatagatttccaaacagagaaacagggtatggagattttaatttattaggaactttcaatataattgcaaaattatataaatatacaagacttcaaaaatatgattatacaagaatagataataaaaatataaaaattgtcaatgctgacttttttgaatatactgtaaaaacactatttattagaattccaagaaataatttaggagattttatatgcgagaaaatattttaaaaaataaggactactatcattttcttgttcaataccaaggaaatatagaggaagaatttcagtcatatccaatgtattttattcagattattagcgataggtatgcaatcctctctattccaagagaggatttaaaaattatagatgatggaccacctttttctacaatagtatatataaaaccaagcgctatgtacacactacaacagatttcacctcttgacgcttcacaagctggttttcttcaacttgaaaatctacctttaaaccttactggaaaaggagttactgtagctgtaatcgatacaggtttggattatttaaacgaagaatttatggatcgtaatggtatttcaagaattgaccttatatgggatcaaactatagattcagataaaaaatatgaaaatatgaaaattccttttggcaccatatactctaatgcagaaatacaatctgctattgatgaacaaaaaaaagggaatgatccttattcaattgttccaagtaaagatgaatatggtcacggaactaaaatggcaggtttaattggagcaacaggaaagaatcctgatttaaaaggagtagttcctgattgcagatttatttctataaaattaattgaagatatgtcttataaacagattttcagagcaacagttcctgtttttaacattgtcgttttatttgctgccttagaatttttatatgagtattcattaagatcagaatctcctttagttatctatataccacttggaagtaaccttggaaatcataatggaaattcaatattagatcaatttatagattttatatctattaatgcagatataattattgttacagttactggtaatgaaggtatgtctggttctcatgcttccggggaaatttctgaagaagaaataacaaaagtaattgatcttgatgtccctcctgaagagaaaaacatatggatagaaatatgggttgacgctccaaacatactatctatagatgttgtttcaccatctggagaaaacacaggtgtcgttaattcttttattaataacacagtatattataactttatttttgaaaaaacattactaaaagtaaattactatatacctgaagaatattctggtaatgagctaatacgattacgtttttatgatctccaaccgggtatatggaaattaagattaagcggggatttaattttagatgcatcctttaatatttggattccacagcagggacttatctatcctaatacgcgtttaagtcctgctaatacttatggaacactaacaaatccaggcaattcaagctttacagctacaattgcggcatataatcaaagcaataataatatattaaattattcagggcttgcttttagcgataattttgtaaatacaatagatgttgctgctggtggggttaacgctctgactgtagcacctaataatacaactgatattgtaaatggtacaagtgttgcttcagcaatagctgctggtgcctgcgctatgctatttcaatgggcaactatagataaaaattatcctcatccatatgctaaagcaattaaaacttatcttgcacgaggagtttctacaagacctggtgatatatatcctaatcctcaatggggttatggaatgcttaatatattaaacatgtttaaaaatatgaattaatataaaaaaagcatcatttcaaaatctgaaatgatgcttttttcctacgtaatgctaaaaatgaagtttaagtcatacagacatattttaacttgaggttttgtttaagtattaaacgacaattgtaatcataatttttgcaatctaattattacatgtttattgctaataataaacatataattgattattgaaaatcagtaatgtgcacaatttaaagttgattaaatgtaatatccttacctcttgatacaggatttttactctttaaatcttctctttctgagtaagatttaactttactttgtgaaaagtctccagatgtctgtattaacttttcctttttactttttgacacattcatcatctccttacaagcttagtattactcattgcaaaatacttattctttgaaaagttagacaaatatatcattttccttccatttttatgataaatattctaataataattatttttcaaatctccttcaagccagctcataaactgtcttgctgttcttggtgaacgtgcattttgatatcttgcccattttaatgcttctctgtgaagatattctttatctacatcaataccttctgcatctgcaattccatcaataattgcaagatattccttttggtctggtgaataaaaggaaacagttattccaaatctatctgataatgaaagtttttcttcaacactatccatagcgtgtatctcatctcctctttcactaaatgtttccttaattaaatgctttctatttgttgttgcataaataagcatattattagatctgttttccactccaccttcaagtattgtcttcaatgcagaataacttgcttctccttcctcaaaaacaagatcatctacaaacactataaatttcaaatttttatttttcagtattcttattatctttgtaaaatcaacaagcttgtctttgtcaacttctataagtcttaaaccatccttataaaattcatttattatggcttttacagttgatgattttcctgttcccctctgtccgtataataataaattattagcaccatatccatttaaaaattgttttgtattttctattatttttcttttctgctcttcatatcctacaagatcttttaattttacagggtctggtgagtcaacacctcttaaataacattttccatcttcattttcccatacaaatgccctatactctccaaatattcctgtaccgtacatcttataaaattcaatgatattatctaacgattctccccatccatcacaatttaaaatactaagcttaagcttatctatagctttataagaactatattcgttatttatatcatcttcaaaatccataagatttcttataatctcgtcttcaaaatcaattgccttggttttataaatgataatttcttttaaatcttctgaactaatactacatatatactctaaagctttgagttcatatttaacctgctttattatgtactcatttgaaaaattatttgtatcaatcatttttgtaaaagaattgttgtccaaaaaaattctatctattatgtatttctttaaagaactaccatttgacttgtctaaaagttcaaatataaaatcattatagtaatggaccgcttttccaatttctattttttccccatttaaatattctaataatgaaacatatttttttaatacaccatcttctttcaaatgtgtatatatgcataatgaatttatcattaagcttcctcttttaattttttcaaaatctgtatgcaactttaacgcccccaatttttattttaattaatccaattatatagtttgaattttttccactaacttataatataaattgtctactattaagaagattctcatgtccaatagataatttgtaaaataagaattttttacaagaattaattaatattataataattatatcaccttatataaatcattttcaaatcttattatggcttataatgctaatacgataaagttaaagctttacttctaaaagattttacatttcttaaagagtatataatatttctttaagaagctaggttattccaatacttccactaataaattttatttctactttatcaacttgtattattttatatacaaattactatacaagttacacgaaaatattttgtcgataggtattgtctatttttatctgtgatgttataataagtctgcgcttaggcgtgggtgggagagggaacattgaaggcgtggatgaaaggatgaataatttttttaaacttaaagagcacaatgttacttttaaaggggaggttcttgcagcacttacatcattttttgcagcaatttatataatagttgtaaatgccagtattttaagtgatgcacatatagcaatggaaccgcttataatatctacagtgtttgcatctttcacaggatgtatgatagctgcatttgttactaacgctcctctaataataatgcccggtatgggaataaatgctctggtaacttatactatagttaacactttaggtcttactttttatgaagcacttgctgcaatatttattgcaggaattttacttgctgtaatcgctttaacacctctttcaaaaattttgatggatgcaattcctcatactttgaaagaatcaataactattggaataggattgtttgttgcatttcttggacttcaaaaatcaggacttgtagtcgcaagtagttctacccttgttacaattggtaagattaatagtccagaagttatacttttcatatttataatgatattaactcttgtactatttttaaaaaatgtccgaggaagctttttaatttcaataattctcggtacagtattatctatagtttttggtcttgtagatacaagtacattaaaatttagtctaccagactttaacagctataaagatattttctttaatatgagctttaatgccataggaaatattaatttttggattggaacattttcattaacactaattcttgtttttgaaaatatcggaattctttatgcacaaacacatcagcttcttggtgctccagaaaaagcatcaaaatcacttgctgccgtatcatttgcaactataggatgtgcactacttggatgtagccctcctgtttcaactgttgaaggtaatgcaggaatgactgatggtggacgtactggattaacatcagttatatgtggaatattatttttagcatcattattttttattccatttataaacataattccgaatatagcaattgctccaatacttataattcttggatgccttatggcacagaatttaaaaaatatgaaattccaagattttagtgatttctttccttgctttgttactataatttcaataccatttacttatagcattattgatggtatagcacttggatttattttatatccaatttgtaaaatatgtactaaaaagcagaatgaaatttcaattcctatgtatataatagcagctatatttctgttatatttcataataataggtttaattcattaaaacatttagaatagcatcataatatttttagtaattaaacttaataatctactttattgatagtaattaaaaatttagtaatatatttaatcactaggttccttcgagaataatatttagcatctattattctcgaaggaaccttaacaattaagggtaaatgataatggcatcatttacccttaattgttttaataaaagacacaactgttaaatacaacaactgtgccaaaaaatgtttgtaatatatgtttaaaagacattataagtatatccctatttctattttttattcatgtgtcttctaattatatataatacttccttataaattatcaaacagtttttctccaaatattataaagttctgtaaaacaagatagcatttaatatctaaattattattgcttttaataatctctgtagcctcttcctttgatataagcattggttctatgcattcatcctcttccatgttatcacagcttagttctccttcacatgtacagaaaacaagatttacacattcatctgtcattccaggtgaaagatataatttacttttagatgctgcaatatccttaagatcaagtcctgtttcttctttaagctctcttttaactgaagtcttaaagtcttctccttcatcaataagacctgctgtaagctcatatacaaaatcatttactggaaccctgaactgtcttacaagaacaagtttatttgaaggtttatgaagtgctgcaataactactgcatcatcatcatctttattattttcaaagaattttcctttaagtacttcttcactttttcttgaagcaatcatccacgattttttatttccaaccctattttcatattctgcttcatacatacttaaaaatttagttttacttaaagcttttaaaccagttactttactatgcttcatatactttcctcctgctcttaggtgactgtcacctgtcgaattatcatgtcgaattaagattcatttatcatcaattgtccaatatgaattcttaattagaacatatctaattaaattatacttcaaatttatatataattcattaaaaaaacagtacaacacaaaccataatatcccttaaaacatttaacgaattattttagttgtttattgtactgttttttattatttacatgtattaaaatatatattctatatatggacatctagcctctagaatctttcacactcccagaatcatggagaaacagcctagtgagctgctagaacctttccgtacttactcttaataagtttcattactggaactcctactattgctacaacgacaaattcaccacatgcaacttgaagaatagataatactaaaggaagttgatacaagtaattaagttcccatccaattataaggccattgaatattactggccataatgatgcaactattaatgctttagtatcgcttttaatatattttccagttattgatatagcataaacgcttataaaagtagctattgttccgaaaactgcatcaaccattccatttggtccaagaatatttgctacaaaacatccaagtgtaagtccacctatatagaatggatcaaagaaagctaaaagtaccattatttctgatattctaaactgtatacttccataacttataggtgcaagaaataatgtaagcaccgcgtataatgcagcaataacagctgttctcacaagtctttttgttgtattattttccatgtataattcctccaaaattaaatactttattaatttttattatacagtttttaagccacacaaaatcaaactcaaggcataaatagaaagtatgttgcaattaacaatttatattaaaatcaatatttgatttctaggttataattttaaacttaatagtgcaacatatatattattagtctataactataaaatatccattacagactcaattatttaattctaaaaataaaaaaatcgcaggaaaactcctacgataaacaagcataatatagcgcaccttaataaaacgttaatgactctaaagttcactctcgcatattaaaatacatgtcataccaactatttaaccgtagttttattttaagtcaggaggctttcgaactgactataatattaatctttaattcggttatgattatatcagacaagcacatagattgcaagcgaaatttttttcttaacaatccttataattttatattccctcgttctaattctactttcactctttcaaaaatattaatactaaatatatttatataattactttctataattacgcttgttaaaatcatataaaaagctgtatgtgccaagcttttcagttgagtattctacctttaagccttaccctttcatcataatttcctatgtattaaaatataaaagcagatatgatactctttgggattttataatatctgcttttcttattattcttctacgaattctattacatccttatcaagtcttgctattcttgctaaagaataaacatcgtatcctttttcttcaagaagctttggacctggttggaatgatttttcaattactattcctattccagcaaccttagctcctgcattttcaacaagtcttgctgctccaagggctgcttctccatttgctaagaaatcatctattataagtatattatcatcttcatttatgtatttttttgataatgttaattcataatccgtaccttttgtaaatgaatgaactgttgtctgataaacatcaccatttaatatttttgatccctgctttttaagtgtaaccataggaaggttcatctgtagtgcagtcattgctgttggtgcaattccagaactttcaattgtgaatatttttgttatgttatgatttttaaagtattccttaaaatatgtacccatttcatacattaactgtgcatcaacctgatgatttaaaaatgaatcaacctttaaaactgtttctgataatgcatttccttcttctaatatttttcttcgtaagctttccatttaactttctctcctattcctattttatacatatctaaatagatttttatcttatagtttattttaacacataattctgcaacaaaaatctttttttacttatcatctctttctttaagaataatattaagtacaagagcaactattgtccctgttgaaatacctgaactaaatatcatagtcatccattctggaaggcttgataatatttcaggcctaaatgtaacaccaagtccaagacctatagacgttgctataaccaataaatttttattagttaattttacactgcttaatgtctgtattcctgctgctgcaactgtaccaaacataactattcccactcctccaagtacaggctgtggcattatgtttataagtgctgcaaatttaggaagtaatccaagtataacaagaagtatacctgccataattgcaacatatctgcttgctacttttgttaaaggtattatacctacattctggctaaatgacgtatttgggaatgtaccaaggcagcctgcaattgcgcttcctactccatctgataatacgccttttccaattctctttggatcatcctctattccagaaacttggcttatagcctttaaacaccctacagtttcaattgtagtaactaaatatgctggtataaatggtattacatatttaaagttgaaatccacaccatattgaaatattttaggaaaagaaatccaacttgcttctttcacagttgaaaaatcaatcataccaagaggtatacaaattatatatcctactatcattcctataagtatagatgctgaacttattattccttttccataatgattaagtaatattgtaaatatcattacaaatgcagcaatagcaatatttatcatacttccataatcagaagcaccgcttccccctgctgcccagtcaattgatactggcaaaagagttagacctataaggcatattacagtaccagtaacaagtggtggaaaaaacttcattataggcttaataaaaaagcttaaaataacttccactaaagcacctaagatagttgctcctataatacctggcagtcctgcaactgatccaactgcaatagctggtgttgcaaatgtaaagtctgtccccattatacatgctgtctttgatcctattggccctataccctttgattgaataaatgtagcaatacctgctgcaagaattgtagcactcataagagcagttgatgtagctgcatcaaatccaagagcacttccaataacaaggggaacaactattatccctccaaaggcagcgaatatatgctgcaaacctaaaagtatctgcattgtaagcttcggcttatcattaatgccatacattagtttaatgccgctttcgtaataatctgatgtctcttcttttaattcatcacaattttctcttgtaacttccatttttatttatctcccatgtcttttatttattagacacagaacatcgtaaatttcatgtagtttctatgaatcttaataatagctaaagtactatctcttataataatcaaaataaaaaagagactacccattaaataaatcagtaaaatactgatactgttattataatgaggtaatctcggtaaaattcttaaaacaactatattataacttataattaatagataaaatatttaagcttttacaatattacacctcatagtctgctaataacggtagcaggtagaaactttcaagccatattcctgaaaatatacgagtgtttgtgttatcgtctcagattatatcacattaatctacctttgtaaaaattttttcatataaattaccaaaagccttaatgatttatatactttccgtataaatcattaaggctttattatttttaatgctatctacattgactttcaagctgctccaaatcacttattatcatattgataacatcaatttttgattttgcagcttcatttgttggaagccattttaaaccgcattctaaagattttttcgtacttttgtactcttctattaatttactgattccttctgacatagcacacccctttaaattattaatcccttttaaataaaaaacaattttatattttccaggcatcaacctctttctcaatttttaccatagaaatattatatcacatatgtattgtcatgtagccttataaagattattttttataattaaaattttctgtaaattagagggttttcgccatattaactcataagtgcacaatttttttataatataaattacacttgtccacattaatgttgtatattaatagattttaaatgatgattatttatcaacaatcaagtcaaatagaatatcacattgctctaaaatgctcacaatataatttgcctaatatatctattattctatttattctctttagatgatacattcttgtggtcttttataagcttcctataaaaaatactaaagcatataactgtagttaaagttgctactatatctgctactggttctgccacaagtgttcctagtaacttattttcaaagaatacaggtaatatgaaagttaatggaacaagtaaaataatctttcttaaaagagcaagtattaatgaaatctttgcttttccaagtgaaaggaaagtctgctgacatgcaatctgtcctccaaatattaatgttcctataaagaatattctcatacaccaagatgttatttctacaagttcaggcttgtcattaaatatacttacataaaattctgggaataacaatacagttccacctattaacactgtatatgttatacatgatgcaagaagaagcttgaaagtttttcccactctatccatcttgtttgcaccataattataacttaaaataggttgtgctcccatagtaagtcccatcaaaggcataagcattatctgcattacactgttcataatagccattgcgccaactgcaaggtctccaccatattttagaagctgattattaagacttattaaaacaaagctttctgttgactgcattataaatggagaaacacctaacgctagtatagaacctacaatttttatgtctggcattaaatatttttttcttattctaagaatgctctttttaccaaacaggaattttaatgcccatacagcagaaccaaactgtcctattacacttgcaagtgctgctcctttaacacccatatctaatccaaatataaagattggatctaaaactatgtttattacagcacctatcaaaactgttatcataccaaactttgcaaatccttgagtatttatatatggatttataccaagagataattgaacaaatattgttcctaaaagatatattccaagatatcctgttgcatatcctattgtagcttcacttgcaccgaaagccataagtataggttctttaaacatgctaaaaccaatagtgagtattattgatattataataagcatcgagaaactatttcctaggattttttcagcaccatcattatctttcttacccattttaatagctgcaataggtgctccaccattacctataagtgcactgaatgcagatataagagtaattataggaaatgctacaccaatccctgccatggcaaggtcaccattgtctagtcttccaataaacattctgtccacaatattgtaaagaacatttacaagctgagcaataatcgctggaagggcaagcttaaatagaagctttcctattgaaccgcttcctaaatcagtatttttcttatcattcatatttatatattcctcctatgttaattatataattgaatgttatctatcacataatcagtataatattatataatttccttcttactaatatagtgataaaattcaaattggattcacaatctattatatataattttcttgtgaaaaagttaactttacaaaaatataatattttgctatatatgaattcgacaggtgacaattcgacaggtgactgtcacctgtcgaattaaatgcaaaaaatcatctattaaaatactcgtttctaaggattccataccacgaagtatcacatatccctgaattgtttttatcacaacatcttaatgttccttcatattttaatccacatttctccataacttttcctgagtgtgtattccgaggatcatatcgtgcttcgatacgtttcacttcaacctcttccataaagaatcttataacttcctttaatgcttcactcattattccactgtgccaccacttagctccaatacagtaaccaatctgaacactttccacttctttattaaaagctacaacaccaattgaccctattggttgtccaagttcctttaattctattgcccattcatacattgtattttcagtatctttttcataatttttaataacccagtttacatagcttactgacattccctttgccttatgatgtggccatgttaaaaatttagtaacattttcatcagatgcccagttattatacacatgtattccatcatttaaattaaattttcggattgttagcctatctgtttcaagggttatacttcctagattgttcattttgctttcacctcaatacccacagcttcactttatttaatacattcattaaatatttcagaatattttgttggctggaattctataatttcatactcagcaattttatttaaattaaaaggatcttcactaataatttcctttacctcttctatattttttgcattgcataaaataacgccaccattacgaggattttttcttcctgaacaaataaaattgtcagttccataatatttatttaaaaatgtaatatgctctgctaaatacttttcaacttcttctagcggtctaatatatgttaagtttactataaacattttcgtttcctccaaaattaaatctgatagcttaggatcaccttcatatattttggtgtaattacaccctatacttcaatgaaagacccttccaaataatagtagattatattttaactcctagttattttaaataaaaatttcacttatagcataaataacagcttttcctgttatctcaactctgtcaccacaatctttgcagtataaaattcctcctcgctcagaaatctgttttgcattcattttagttttgccaagcctctcagaccagtatggtattaaattacaatgtgctgaacctgtaacaggatcttcattaacaccacatttaggataaaagcatcttgacacaaaatcgcaatcgctgccttctgctgtaactataataccatcacctattgataaatctttcatcttatcaaaattaggagtaagatttttaataatattttcattttcaacaactgccattaaatctcttgaagtaaaaagttcttttatttctattcccagaacctcttctacttcttttaatttttctattttttgtggtggtcttgatggaaagttcaatgtataaaaaccatctctgcattttacttgtaaatctccactctgacttgtgaaattaattatctctttattagggtcaatataattatctattataaaagcacttgcaagagttgcatgtccacaaagatctatttcatataatggcgtaaaccatcttatatgataaacctctccctctttaactataaatgccgtttctgaaagattattttcagctgcaatagcctgcattttatcttgattcatccagctgtcagtaatacaaaccgctgctgaattcccctggaatactttttctgcaaaagcatctactatatacattttcatctatattccccccttatatattcgtttctcacattattctaattgaattgttttccattacaatctccgtttaaaatatttacacgctatcttattgcttactttaatactatttaaaattctaaagactttataaaatctttactttgcaaaatatttaagaatttagtcatattaaatgactcatatactcttataataacttcaacattaattaacgaagatttttcatctcttttactttttaaattaagtataattatctcattatcttcaaaaatgtcttgaagcaatttaatagcatctgcattatccacaatctgtaacattaatgtttctgtccttggcgatgataaaaatctaatttttccatgcaaaagtatttgtcctaatatagtaataacggtagctgctatcccaacaaaataaagcccagaacctattgataatcctatagctgctgtaacccaaacccctgctgcagttgttaatcctactatggtttgtttttgcataaaaatcacacctgccccaaggaatccaactcctgtgactacctgtgctgctatacgtgacggatcaagagacatgttcggccaccctatctgatcttgaaatccatatttagatataatcattataagcgctgctcctatagcaactatgaaatgtgttctaattccagcctctttcattctattttttctttcatatccaatagccattccgcatactgcagcaataaaaagtcttaataaataatctaattgaattaaatacaattgtttcatactttatccacctttcttttacaatcttaatccaattgctatactataacattttcttgatatgaatttcattaccgtattgttcaagtttcaaagaaagattttttattttagtttattatctaaattctacaaactacgtattatttaatttcccaatgcattttataaagaaaattattaatctaaattttttctttattttctaatatctttataatactatctatttttttatccatttcattatttctgtttataaaattctttattccttttattcctttgaatatcaacattaatagtactaaatataagacaatattaattattgtaacagcaattgtactcaaatctatttgcaagtaaaatccctcccaattttgttgtatagttatattttaacttcatttacatttaacttaattataaaatttcctttctccccattaacttttgaataatcaagagaaaaataaaagttatctttgataatatttaaatcttcactaaagagtttttccgaacttatttctccgacacctttgtttaataaaaattcatcaggaaagactattcctttattgtcattttgaagtgatactgaattagataatactacattgtcattatttccttcttcatttatataaatttttttagaatatgattgtatgttttcattcttacttcctgtatatagtatttcaccaccactaactatctgcttgtttggatatacaattataattccattacttattcttatgtctttattttctccattaaatgagtatactttgaaatattgattatcaattttatttttatataatgtggttgtaatgataaatgctataattgagataattataaaaccaattttaagttgtttatttatactttatcactctccctttcaattctactccccatttcacgttaaattattaatttgatcttttaaataactttattttaagattaagcatcgacattttcattaattataacataaatagtaattaattacatttacattgcactactaactatttcagatattagataaattttagatatatgataagattttttatataaaaaaaccttgataataaaaattaccaaggtttctttaatagatactaatctctgtagttttgatatgcactatttgatacggacacggcattatttattgcatttaaagctttttctatttcttgtttattctctggtttttcaacactactcatagcttgatttaaagcaccttgagcagttgataattggttacaagcactttgtaattgatcttttgcattcatttgcatatgtatcacctcgttatttttttgtactacttttgtacacaactattatttgctttacaatttgtttttattcttggtactttgttacattttatttatacattgtgtatattaactattaacttgcacaatataatattgatattaattatagggatgttacataatgagtatactttatacaatagcagtaattttagttcttgtaggagccttaaactgttttataaatttcttccctttcccgagtcagatatatttactaaacattttggatatggattaaagaatgtttgatttagtacttcttcattattaaatcttattgaatacatttgtagtgcaactattatagagctgaatggtgttttttcattttcatataaatttaacaagttataaaagtaatctatttcattttttattagtttatctttaaaattttcaaatatacccttacaaatctttactttacttttcttatttctttttttatttaataattcatataatttgcttttgtataaatctatatctttttcatttaaattttgtttatttgcaatagaatctaattctttactgatttttgtactatacgattttaaaagtaatatgtttttattatgaaaatctaaaatactatctgtgcatttaaaatcattaatagtaaatatttttgtcaaaaattcatcccttatattataattttttaatcttccttcattttctattggaatgtttgacattccttctattactttactcgaaaaaatacctgtagcattcttacttatactacatttttgagctttgggataaactttaacatcttttataccacaagatggagatctgctttttaatataaacccatctatgtcatctattccatttataaattcttctgcaaattcacacatttgataggtataatctacatttgattttgcttcaattaatctattaatatcactatctttttcaattcttagaggatttctaggtatagataagcctatagaagtttcagggcatacagtttctatgtctacgtaatctcttaataaagatataactttatcatcatagccttgaccatcaaatctacatttttctgaatttaagcatttacttattattaatttgggctttctcatataatgtcacctgccatttatattgtattatatttctaattagctttggttatatttttatctaatcttgtattttatattcaatatatgtaaaaacttaaaataaaccaattaaaaatataaaattattagaggtgaaattatgtttattcctaaaagagtaatatttgaaaaagattcattagaaactgaagttggtaaaaatatttacaataaaataaaaaataatcccaatatcgaaattataaatgcatcttctaataaaattaaaagtcatatacctggtgataatttatttgaacaatataaatctggaaaacagacattagttgtaggtaaacgtaaaagcttaaaattccaaacttgtaaaccatcagctaattatcaattaccattagttagtggatgtatgggaagatgtgagtattgttatttaaatacacagctaggtgataaaccttttgtaagagtttttactaacattgatgatgtattaaatagagccaaagaatatatagaggaaagattaccacagataactatttttgaaggtgcagctacatctgatcctattccacttgaaccgtataccaatgccttaaaaaagacaatagaatttattggcaaagaagaaaaaggaagatttagatttgtaactaaatataatgatgtagatactttattagatgcaaagcataataatcatactgaaattaggttcagtataaatacacccactgtcataaacacctatgaacactatacagcatctattgataaaagaattgaagcagctgtaaaggttgctaatgctggctacaaaataggatttataattgcccctatttttatctacgataattggcaaaaagaatataaggatttaattgaaaacataaaatctaaattacctagtgaatttaatgaacagattatatttgaagttatttctcatagatatacaactaaggctaaaaatcgaatactagaaatatttcctgaaactacattaccaatgaatgatgaagatagaaagtttaaatacggacaattcggatatggtaagtatatctatactaaagatcaattagcagaaattaaagaattctttatttttaacattaaagaaatatttccaaatagtataataaaatatgtaatttaattaataataatattttaaacttcaagtttcagagaacattttattaattagttagcaaaatatgaaaagtcagaaaaatagtagttaacaaaaaaggaactccttttaaatcaataaatgagttccttttagctatatttaaataaaatcaaattcagtttatttttaacattataaaactttcaattgcctatataaatcagagttatagaattacatttgttttataaattcaaacatcccttgatttccatctcccacaaaatcatctggaaggtcaggcataggatgtttttcattgaaaaactcaacaatatggaacccacatacattcacataaaaatgaatatttcttacatcaaaatatggagtgcaagtttcccaaatctttgtttccggatgtagtttttctatctgaaaccaaatacttttaccaatacccttactttgtattccgtgttttacgaaaaggaaatcaagatgattatgttgagttcctttatcaatctcgacaacggcccctccaacaaattcaccattaataactgccttatatgcaatggctcctttggcattcaaagcttcatcaatatctttctctggaagaattgtatcagtagtcttcccaaaatgtgcttcaaatcctttttgaaaagcttcctgtgcactcgctttgaattgacctaaatctctatctataattggaataagttctatctgcattttgctatttctcctctataaatttgtctatatctatatactatctaaatttttaggacagtccaatcaactatttatacttataaaaaataagtatataggcaaaaatagattgtactaaaattattgttgtaagtaaaatatttgtattctttcatctctggaatcataaatgttttttatgctactgtttgttaataacttaattatagcatctctgtctttatcagagtatggttttaatgttagcctctttgttttaataaacattattaaataatactaggcttatatttatttattaattcttgtaattcatttataaagcggcaaatatgaaatccatcacaaactgcatgattaacctgtacagctaatggtaaaatatacttacctccttcttcataatatttccccatggtgaaaatgggaagtaaataatcatagcctttttgtaaatttaaattaaatccttcaaacgttgtccaaggtatcattgatacggaaaaattattcataggcatatctggttttgccatcatcctatttacagaaacaaaatccttaatatccttttcatataactcacaaaaaatatcataatcatcagaatactctgtccatatattagaaaatgtttctgtctctttattaaatactgtataacaaggtaacatttcattaaaaattcctaattgtccatttatattaaaagatgttctaaattcactatgtctgttaactacttttgtaatgtagtaaagcattgttggatatagtttcttatttgaaattttaattttgctaatatctagcttaacagtcatactgtatgtacatggaatctctgaaaaataatgttcaaaatattctcttctatcccaatcatctttgttaataattctaaaatccattaatatatcatcctttcaatccctatctattcattagtttcatacatatttttttagcaataacatctttcgtaaaattaatttgtgtttgttcacttttttcaataaatcaatagttatactaagaacttaagttcaaaaactaaacttttagtattcgaacttaacataggtactaaatgttttaaactaattttataacaaatgaaaaagtactagatcccagcaagaatagtcgtgctttttcataagatttcatttaatttaaaataaatcatactaataacctaaaactaaaacgttctaatgattgcttagtcctataacactaagcaatcattagaaaaactcgcttttcacgtaatattttgaactttcattttattgacctccaagctttttagtgttaataaagaaattataacttagtaatagaataagtatacggtaaatttacttgaattaatatacaagtcaagtaaataattatatgtttatttagtatccattttacttaaaagaataggaaatactcttcttggtaaaagttttgataataaaactgtaaatttagttttagttccatctacaacaaatggcttatttttctttaaaccctttaatgcagttttcacaacttgttcaggttctcttagctttccaccagaagcattagattttcccgccttatcaaagaaacaagtatttgttgcacctggacatatagcaacaaattgaattcctttatctctatattcataatataaaccttcagtaaatgataatacaaaagctttagttgcagaataaacaacattataaagtgcagacataaatgagactaaggatccaacatttataattatcccttttccatatactcacttaatattcttcggtttgctttagcagtgtcatttatatatctctaagataaatacgtaaggttttctggttcaataggaatgtcattaagttcagttcccatatcaacctctattccttattattgatacaatgtatttttgcaattctttcattatttaaaagtattatttgttttctcctatcttaaacatatatattatcgtaaaatattattataaagaaattatattattttttgtaaatattatactattaaattttcaaggattaaattctaatttaactttataaatttctgcactttaacatacttttaagtttcattataaagagtagaaaaatcagcatagtactcaggttctgtatacctgatcaaaaacaacagttgaactttttatactctaaaacagtgttctttctatatatggttaaaaaaagtattacgcataaaaaaaatcgcaaatctgataatgcgattttacaatttgttatttaattttctttattcataataaaagaactttacgaattaacataagtaattattttatctatattgttctttaatgtaaaatctgctggcttatcatataaagcaagcatacctatttcatcagatgataattcttcttgtgttttattttttattttccatttaaataatgtcataagaaacttatcaaaagaattcagtttactataattaaaacctccccttagataaaaaaacttaataaatttttgttgctctgtggtaaagtttttatttataacatcatttagtacctcagttcttgaaggtgatgcccctgttgcaaaaaccactacctttttgcttttaagtttatcaatgttttttgttataaatttcactccaatgatacctaccgcatacaaactcccaccataaactattgcatcatatttagttagcatattgatattaaccttttttatatcaaaaatgtccgctgacaaatctttcgcaatccactctgcatatttttttgtaaaacctgttttagacttgtatatcactactattttcactacttacccccaaatacatattgcacattaatttactattacgaatcaattataacatattttgtaaaacatattattaatcttattttccaatgtattcataataatatctatttttttatcacctatcaacctatctgttgtaacttactcatccaccaatctttatcgtaatataaagatttaactggaatcataacaatatattcattatttacttctatcatattagatgtacctgtatatactaaatctatatataagttaaatggcttaactttccttttcatgagattttcaaattcataaatataagtataaattctttcattatctaaaccttcaaagtatgaaagtgcatttttgcctccgccaaccatttgccaccattctataaaatactgccatgactttttacaataatcttttaattcataaaatggaaaatcagaaaaattaggtggattgaacatattactcttaaaattaaatgattcttttaaaagaatttttttccctttatcattaagcatatgattaacccattcattccattggtcttttattaaagataatggttgatttaatttattaatcttacatttaggaggccaaagtctattattacttatttcatcaaattcatctatcaatccatataaacaaccagtaaaaaaagcaaaatttaactgcatatcacttgatacagttaatttccaagattctgccccttctttatacatactataattctccttacttaattattcgatattgtttaatttaaaatttaatctccctattatcactatatatgttaattatatcatataaagtaatatgtaaaattataaattattcttattttaaaaataagctgtgctatataattatgttgatttagtatttaaatgtacagatagccataagtcgtatattcaattttcaaagaacctttcattagaccataaaagaataatgagaggacattataagaagaaaaaacatgcttatacatagtgtaatgccatttatagatactcgaatccaagcgtataaaaactgaacacttgtgtaaataacaaaaagttgttaatcttgagagaggcaacagtagacgatgctaacgatattattgaatatttgaatactgttggtggagaaagtaataatttactttttggagaaggtgaatttaaacttacaattgaacaagagaaaacatatatctaaaatattaataaagataaaaactctcttatgttgttaggtataattgataatagaattgtgagtgtttctcaaataagtagtgaaaacagacaaagaataggacataatagtgaactggcaatttcagtaataaaagaatattggggaaacagagttggtagttttgttatagagcagttaataaaatttgcaaaagataataaatctataaagaatatcagtcttggtgttaaagaggataatcataatgccattaaactgtataaaagtcatggatttgtagaagtaggcattcataaaaatttctttaacattaatggtgattattatgatgaaatattaatggatttatatatataaaattattaaataaacaagcaataggtagtttaaatttaactacctattattactataaatcaacaattatatttaacagagccaaaaaataaagctgtaggaatatagaataaataaggtgctgtaaatacagctaatgaaagcgcaatctttttcttctgagcactattgatatccaactttttcaaacatagtttataattaattatataaatgcatattgctgcaatcatcacacaagcagtaacccataccatagaataaatactctcgaaaggattataattcacagcatattcaatattgttttgccaccattcatgtaaattagagttgttattaaaactgattatagtcgctaaatacatagctcctgcacctataaaatccgaaataaatcctactatccatatttttgtaataacatgtttcactttctttttaatgtccttaattttcatgaacttcattgtcaacgccacaacaattaaatctataaaaaatttgcaggtaaaataaaaatccaagttataggtattaatattaaaaaccatatagggaaaattaaattatataattttatactttttctattcattttattcctccatctatattacaatagtataaaaacattgattctcccttatcattttcagcataataatttatactattatgttcatattttttatataaatttactattttatatttctttagtatgtttttgttggaacctccaaatttatctctagagttatcaattgtaagctcaatacagtcagttcccactatcaaatctgttatatatggatcaccttcatctccatatattgttattcttatcatgtctcctacttttgctgttttattattataattttcaaaaaagttatcaagtttttgtacattatattgttccattaaagaacacactacatctccattttcttttgccaaattaaagctatagtctagtggtaaatcttcaatagctttatagctagtagtattagcttttatagtatcactacaatatttttctttccatatatcacaccactttagataagttaatcccgttacttcttctaatgtttttccatctaatgaataaactcccccaacaaaatctccatttggtacagaatatcctcctatcacttttccatcacatatcataatgaaaatattggtagtatctacattatatattttctctaaaggatgatttttcactttaaatccatatacactgatttcttttccaaagtatacatctggctctacattctgttctgcccatatatctgaatataaatccgattctatacttccataaagcatgtctttatttaatatataactatccacttgacccttgctatttattatattatatcccttgattttaatataatcagaagctattttttcatattctttaaagttatctgaatttgatatactattatttgataacatcctgtcccatgctccatttgaatctaacacatatccatctatagtactgtctttagccatagcaccattttctaacaaataataccaattgtctccatcttcaatccatccggttctcatatatccattactatcaaaataataccagttattttcaatatattgccatcctattgaccatgaatttccttcagaattccaccaacccttatcatctttcttccattctgcatttgctgatataggatttgatattaaacttaattctactaatgatagaataataattatttttatccttttcattttctacccctttatctatatcttttaccttttaattttatattaatccaaatttttctctttattttttaatgtattcattataatatctatttttttatccatttccttatttctgtttataaaattctctatttttttattcctttgcatatcaatattaatattaccaaatataagacaatattcattattgtaacagcaattgtactcaaatctatctgcaagtaaaatccctcccaattttgttgtataattatattttaatattctatatattttttactacgcagtatttacagattgttcttcaaattctattcgctaaactaaagattgtgacgcttacttatgggttgacacaatacgaactgatgaagccatacctccatcaccatacgatggattgtgtataaaatcacttgatgtttcgcttaattgtttattatttattattgaatgaataatttcattttccaatcgatatagtcttgaattagatatttcttcaatacccaataaagcatctgcaatatgattacaataactgttaatatgtttttcgataataaaccgcataagttcaagtcgtttattcatactttttacattagatgaagcaggagcagtacgatagttaatcaacggtctttcaacaattccaatatatgcttctggtatagtttccaacatgcttaaaaagaaatcccaatcttcaaaacctgaacgcatagattcatcataaccaccacattgttcaaatacttctcgtcgaagaatatgtgtcgctggacaacaattatgagataaaaatggcactacattccctccagtagggcaaacaattgcatctaaaactccaaaagtatgcatccaagatgaagttgcaaccattgctggattatcacgaagtaatttacttacatattcaatatatgtaggttcaagtttatcatctccatcaagcactaataccattggtgcttctgcttttttaatcccagcatttcttgcagatgatacaccaccattttgttgataatttatgattactggaattgataaactggaatcttcttcaattgtttttaaaacattaagagagtattcatctgtagaaccatcatctacaattatgattcttttaggtaatgatgtttgagtacataaggaatgtactgcttcaagaatcatagaaccttgattaaaacttgttataacaacttcaatatctgtgcccaaattatctttattataattcatattcatttcataatccccctacaaattactatttatgtaataaacatatactatattttacaaataaaaaaggaaaccaagtaggcttccaagaacactatgaattgattaaaatctttctagtgctaattttaatcacctttagaacaattagctgcatcaatagctattaccagtaatagacccattatttcattttcttgattaacaaagtcaagtacatatgtatcaccaaagtgaagcaactcctttgatatatgcataatttcattgttaaaattatctacaacatcataatcccattcaaaaatatcacctgtaacattccatccattatagtttatgtgatatttgggtctgaataatgtgagctgcttacggacagagccaacgttactgccatttatatggatattaaattcaggtaggaatgtaagtattttttccgatatacttcccacttctaaatttgtaagcgtactgtatacatgtattttgtgccctattgaaaaaaactcacttttcacataatattttgtatttccattttcatcataaacatcataggtatcagtccaggaaaatactctttgcttaattaataatttcataaataagacactcctttttatatacacatttttatatactaaatatcatactttgttttctaaaatagttttaaaaattcttgagtatacatcttcaatatttttttcattttcaatatcattgtataatccatattcaatactaaataatttattatcatttatatatatgcctgtagcataagatggtggattccctgcttgatcagcatcttcatatgatatattatcatatataaatggaacatgtccctttgtattttcaataaaaaagaaaggaactctacattctttataaatatgagcatatttttctcttgatgcttctgaaagattatcctttgtaataaaaactgcatcatattttttcaatatattttcttcttccaaatcttcaaatcctattttgttaaatgtaatattatcttttctgacttttgatatttcacctataataccaatatttaaatttttatcatcatatttttcaaactttatattatggcagccaatcaaacagattagagataaaattattatagatactttataatattttatcattaattacaatctcctttattaattcaataagtcccataatatttctcctttcaattcatacatataaagttattttaaataaagttaatctttcttattgaaatataattctattatgaaacctacccctgaaaagctagaaagtattgaacctgatatattcatactaataacgcttcctaaattccaagtatcgcttcttagtattattaatattcctataaggaataacattccccataataataggatgactttctttttcattttcttaacctccaagctttttagtattaagaaaaaaattataactcagtagtaaaattagaatttattactttccattctggtaaaaatactgtatatttttatattacgtttagcttaattacatatctagctgaatggcttgattgtactgacaaatcacctataacatctactacataagcatgttcacctttatctattggtgcttttataacatatccactaaactcaacaggaattgtttttctatcttcaccatctttaataacttcaaatacatctatttttgaaatgttcttataatatgagagcttaatttctaatacgtcattagaacttacatctatactatccatatcttgtgccatttcaatttctgatacactaagattgctattgcctattgtctgtccaggtatttttacttcttgccatatatattcatttaattctgctttaaactcatttccattatatttcaccttcaatttaggagggttgtctggataatttgatgttatcttatctcctatatataaaattgaaaatataattaatattacaatagttaactttttcttcaagctaactctccatactttaaatcttttactttgatatatgaataaattacattgctttgaaccataaaactcttaacctttttaaagctataattctcgaagccaattttcacaaagttttggccagattcctaccgtaggttcatcctcacccaatcctaaaccatgaggacctttagagaatacatgtaaatcaaatggtagatttaactcatttagagcttgagcaaaaagtaagttttggctctgaaaattccattgatcagtcgctgtaatccataaaaatgtgggtggtgttttcgctgtaacatgtttatgatttgaagtaaagtctataaattcatccattgtaatatcttttgtcaataacgaatctggtggcaatttttccatagaaaatggggatgtctcagcataacataaaatgattgcattaagtttacaactcgtttgatcaatcggatcgttaaaatctggttctcccaaaagcatggacataatttgcgcatttcgactatcctgttctataattccattatcaaaacgagttcctacaaaagcagtgagataaccaccagctgaaaatcctatcataccgattcgttccggatcaatattaaattttagggcatgataccgaatatatctaactgctcgtactgcatcttttgttgacgtaaatggcgtaaaaggagcaaccctataatttaaaacaaaagcatttattcctatttgatttagccattttgcaatcggttctccttcaatagacgctctaaattgaaatgatccgcccgggcaaacaataattgcagggcgtggtttctccccctttaatagataaggagtcagggtaggtaacccttcgttattcaagtccccaatagtagaaatcaagtcggcatcaggtacatttttttcccaaagttttatatcttctaatctcataaatattatcctcccatttttaatctgcggcttagatgaccgcgactttttaccatataataacggtttgcatatctccacaactttatctctaattgatggtaattaatttattaaaaatattagtcaacaaaatttcaccattatatattaattatagcataaattgtaaatacccatcatgcaattttcagtaaaacatttatatctattactaagtcatatattcaaattacgcagtatataagagttgagcacaaaaaatatcacactattctttattatttgaataatgtgatatttataacatttatatttataacatataactaaaaaagctaatactaattttctaaattaactctaaaactattatttaatctttcatttttacaagacagtcttaaaaccgccttaaacttaccattgtcaagataaatatgataatattttctttgatatttgtatctgtttaaaattatgagcatttagattataataaaaataaaacataaaagggaggcaatattaatcgacaaattggaatttatctgtgtaaatatcctttttgattgaaatagtttaagtaacggttcttctgtatttctattatttcttttgagtttacaaacgaaataaaatctgtttcatttacccatttatatgacatagtttctccattctgaagtgctatagatgttttatcacaatccgtagtgcacaagaaagtatagaaaatacacttataatcatcgtaaatgaatctgccaagttctttaaagttttccgaaacaactccagtttcttcaagtaattctctcttaacacatgccatcttgtcctcacctttaagtgcagaacctcctgctgtagcttcataatatccaccataattagatttagagatatcacgtctcatgagcaaataatcgccatccttatgttgaacaagaacttcgcataccatatgatacaaaccatctggtaatatatcaccacgaactaagtcaatattagcacgtgttccatctctaaaatatccatcccaaatttccatcatcaatcaccccttcaaattcctatttatcaatctactttacaacttgtaatttatagtatgatttatcttctaataaactccagtacttttcatagataaaactttctcataccttgttctatttttatatggttgtagtgaaattattcttattaaaaggctgtgttttaatataatgttgaaatacagccttaaaaattataggcgggattgtccacctataatactcaatataagaagatgataaattaactatagattgagactatactcattactttaatataaattcaactgcttctgaataattttctacttttttcacaacaaaatacttcttaaattccttcgtccacatatccatttcttcttctatctcttcaacttcattcattataaacacaacatatttacaatccgtttttgccatttctggaagtaaaaaagaaaatccccattcaacatctgctttattatcttcaaatccatttcttgcatcaaacacaaaattactattagaatattgtttcattaactctaacgcaaacattgttggctttctataatcatctaaacagcagaatttcttccatgttagaaatactatattatccttctcaatgtattttacattacaaaattctgaatcaaattctattttactattcattattaacctctacattatataaataattttacttcgcaatttaataaaagtattgtgaataaaaaaataacaaattcaatctcttgaataatatgatttttacaatttgctatttaattttatttattcataatataagaattttgtcagtcagaatgagcctacttatatggatttaatattgcatatacatatgtatcccaatatataggacatcctttctcatcttgatggaaagaaacatttttcctaaaatgtgcttcacgtatcattccaatcttctccattaacttccatgaaggtatgttttgaggagcacattctgcataaattcgatgaacgccttgattaaacatatattctatagctgctttgctggcatcgcttccatatcccttatgctgatatttctcatttaatacatatccaagctctcttgtattaaaacttctatttcctaaataaatatttccaataaccttatgctcttttttcaactcaattgcgtagaattcatcactttttaccctaacttcaatctctttctttgctttctggcaagtgaaatctggatatgcctcaaatttagcattaactctctgtaacatatattcacacaaatcctcttcatcactcaactcaaaattacggataattaaatcatttatctcaattttcatttctatattctcctttattaataaaactttctttttcaatttaccatttgtctgtgaattatataaataattttttacatcatttctgtatatcgttcttcaaattctaattgctaaatataaaaattaagaatcacctcaacgatagattagaattcactaaatacttgtttcatctctatttctgatatactgtctgataacatattaacattccctgttttataaaacccatgcttcttttattgaatttacttcttatgaagatattgatatcttttaacttattcggtatgtaatacacaccattaaatataatcaatagaattaattattattcattgatatcctccctagtatgcaggtatacatagtgcatattctttatttcgattatgaaattttcataacaatatatatttctttattatctaaatcagtttaatcctataataatcacgataatctctgtatgtatcaatgctctcccatctattgtttaccaaagcctcacgacgctctaatgccttagaaatagcctttgttactatatattcattaccaaagaattcatagaaattatctcttgcaaaattgaatagttcagatagatagcatgctttctcatattcactacaaatatctacacgtagaacccctgtttcaccactaaagccctctattgtacctacagcctcttctgttgcattatcaactatagaaaacctaacaaaatatttcttttggtaaaaattaatccaatagccaattgtctcttgcatcttctcctcagaatcaacataaaaactaaagtcacaattatcatcattcatacattcaactgctcttttgtcattatagcatctaaaaagtgattttctatcagactctctaataagtctaattgtaaagctctttgtttttattgttgggcattctacatatggattcattcttataatctcctttatttctatttattaattttgatttgtatgtcattattctatagacatcatatatacgctatgcatctaaattaagcgtgtttattgaattattagttttattatttctactgaaatcggttataaaaaagtcatcccttctaccttttctaaaagaagtctccacaattatatatcataattttcgaactttttttaatacttcttctatattctatacaacatcgaaacacttttatttgaaaaaaacaaatactaagtgttttataaacattctctaattggtacttatttactattattaattataacatattttgtaaaaatcatattgtttaattttcaaagatcatttttattagttactacgtcaaatctgcagaagatgtagtaagtaaattacatctttaaatattgattatacatgtgacaataatggaaacattattctattattatcagaaaatatcttttctttcataaactgtgaacaataaaacattataagaccgttattatttaccatttttaaatctgagaatggatttgatagatcatatttgtcagtatatgttttacttattcaaaagcatggaatttgtctacactaaatactgtctattcattatagtaacttccattcatcccgcgttattgcatatgcatatgaaatcttattcttttcatcttgatattcttttaccttcctcataccatttgcaatagcagtagaatatgaaccaacatttgtatacttcatataagaataaatacaattgtaatctgtattctcaaatgcccaatcccttacggctctagctgcttcactcccaaaacctcttctccaatatttcttgtgtatgtgataaccaatctcaggtaatagttccccatcaatattctgaattgatatgccgcaatcacctataaattcacctgtttcctttaaagtaacaacccacaaaccaaaaccataatttttataattttcaagattccattcaatccaatctcttgtacgttcttcatcaaacggctttggataatgcctcatggtttcagggtctgatactatctcatataaattatcaaaatcatctaatgtatactcccttaaaatcaatctatttgtttcaataatcacaatcttactcctccataaattataatttatcggtttattatgagtaatgtagtcatcagtcattttaattaaaggctatgtttaatatagtgttgaaatatagccaataataaaatataggtgggattgtccacctataatactcaatagattaatattctgaattaactcaacaattaaattggaatttatcaatcaagttctaaccgcataagaactacttcctgccaaccaacagtacgagaacaaaacccttttgggttccgcccatattctacaaatcctacgcttttatataataaaattgctgctatattgtaagctacaacattcaactccaattggacataacctgcttttttggcgcactcaatacaagcttctattaatgcacgacctatgcccaatccccagtaaactttctctatgctgatacccagttctgcacgatgcttaactttatctttatgtccaatagcttcaattccagcagttccaacaattttatcatctgtaaaagcacagatttcaatttcattatcactgttttccttttcaattagaaattgcctttcttgttctacatcaaaactattttcatcaggataagagagcaaaaactctgtttgtccatgtgttaaattaaaattatcatatactgcctttgcatccgctgcttcgcagtttctaatcaggcattgttttttattttttaatataatagtcctactgtatttcatttctactccttacaaattcaaattttgttaataacatagttctactggataaattcctgtttatacagtagtccaataatattctgccattataaacttgatattattcttactataacggcaccttctaagaattgtgtattaaaaaaatcgcaaattcaatctattgaatgatacgattttgcaattgctatttaattttattgattcataatatatgaatgttgtgtattagtgctaatatcaatgtattttgttatatatccgataataataaaatggcttttcttcggtgtctccactatttaaaatcattttggtattcattttactaaatccacatttttcaactaccctttgggatggtatattatcagtttcaacaatagctattagataatcaagttttaaattagtaaacgcccactctgtcattgcctttgaagcctcacttatgtatcccttattactatattcctctgaaataaagtatgctatttctatttcattatttacttcctccttatttccaatacctaccatgcctataagttgcttattggatttaagagtaactgcaatcattattcttgcaacatcttttgttgggttcaaataattattttgaacccaacttatccattcctttctttctgcaactgttcttttccaatcaggcatccattttaatatatacgattgactgcaaatagaatgtaattcttccacatcatttaaagtaaattctcttaatataagcctttcagtttcaatataaatactcattcttactttctccttttaaaaaaatcgttatgcacttcgtaataatttactattatgaatcaatcataacatattttgtaaaataccattattcaatttttacagaacattttataatttgctacgcaaaatctgcatattacgtattcatatagtcttttcaacctatcgctgtaatttattcatcccttaaatctatttccatctcaataatagaatcttcgttttcatcaataatttcaacagaaattttatctactattgtgctgaaactttcttttataagttccgtatctttaaatgctatatttaaatcttctctagaagtaaaattgcctattgtcatatgaggcataaatgtttcttgatttaaccaagtaggcttatatatttgtaaaattcctgtgtataacttcaaattcattttctttatttctttattaccttgctttatatctaaaaatagatacattcctaaaggattatcaactttaactatttcctgtaaagttagcctaaatggccttattccatcaagaattttttttaaatgttcgttaacttcacttgttgtaatatgtttcaccaccattgtttacaatataagaaccatttggagcttgtcttaatatattccatatatttaagaaatctatacacgagcccattgcatttaataagcataaaaataatataaactcattcaatagcccaaaagtacttagtattaatggaaatataattgataataaaataaatggcattatagaaataattatgtatctactcttcttgattttttcagtagtacaaacaaaaccaaaaagcacatttattccccaatatgtcttatctgacttcaagaaatcaggtatgaagcatgcatgaattaattcatgtattgtcatgaataaaaaagtaatagcaatatatatcagcgtcatgatatttatatttaatgtgatactaatactgttcttgctatttataaactcttctattggtgggtatataaaatatgcaatcaccatgaaaataataccatttataatcataaaaggtattgactgcaagattgcctcgtttaggtttgaaggttcttttattttcttccagcccgttgatatcaacatattactaaaatcactatctgtaggtggtattttctttatatatttcattaaatattccttcctcagtaaaattcagtattttactatacataaatttatatatagttttatatttacactaataataaattataacataaattgtaatttataaacttacttatatgcagtaatttcttccaagttattcattctaattttatttttattaattttaaatcctctttccactaattcatgtagtaatgttctaagaaaaaatccatgagtaaaagttcatatttacttccccatggcgtattattactattttcattttaaatctcctcgtataattagttttgtagttaaatcctatataaattatacatacaaatcaatttatttacataataaacacaaaaatgtaataatattgtataattataatgatatataaaatatagcaggatggagataaaatatatgaaaaaaatcaaaaaaataatagcacttatattaggagtactttccctatctacactatataccgtaaaagcaaatgctgcatgggtaaaggattcttatggatggtggaatactgaaggtaattcatggtccattggctggaaacttattgatggagaatggtactattttgatagtcaaggctatatgaaaacaggatgggttattgataatggtaagtggtattacttaaattctgatggaactatggctaaaaatacagttattgataattacactattggaagtgatggcgtttggattgaagaaaaaaatacagaaatcactactgataacacacaaagtgatagtacttctcttacaataacttcgtttttaaatgaattaaaaaatactggatatagtcctgaaattaaaaatgctgaaaaaggttttttaaagggtgagaaaaaaataataagcattggtaatgaaaatttagaagtatatacttatgctagtaatgaagaaatggaaaaagatgcagcaaacattttttatggaggattttcatatgaaaatgaaataggaacaagtatagatcttagttggaactcatatccatatttttataaaaataaaaatatgattgttttgtatgttggtaaaaatgaaaaaattataagtgatttaaataatattttaggacatcattttatgggaattgaacctagtgctagcttgagtaatatggatgatgttagaaaaatagtacttgataatttttataaaaattcaaaaaatacatttagatgtccatggcaaaaagctaagatattagattctaatgaaaattcctctgttgaagaaaatgaatatttgatttattttctaggagagtataatgatttaaaaggggttactgtagataaagatacacttgaacctacatcattttgggacatagattaaatctgttatgtatttcaaacaaatcacatctttgttgaggaacttatatatatatcttaaatgttttaaaatatatgaaaaaatcacaactattcttggtagagttatgttttttcataattttatttacttttaatttaatctaaataatagctctaaaactaaaaacattctagaaattgcttagtgtttccagcactaagcctttcttatttatgttatgtaaatttatccatctcattttatctataacttttgtatagtcttactaacttatttagttaactgatttttgttatatatcagtattagtctttgaatattttattaaatcgtcacaaaaagcagctacatcactcccagtcacctctaacacatttttctgcaattctgctccttcttcgaaaagatcaacaatgccaacaagtaaatctatgtcttctgttaactcaacaggccctgctttaaaaagatatttttgaatttcctcataaacaatttgataatcttttggtaacatttttacacgagccatgtgggctctccattctttttttccttttattatatcttttatgctcatttaatcctcctatttgcctaactttttagaaatattactgttgagctgctttctccacttatcacgaaaagacttcccgttatattccaaagctagttctgaacagaactctctcatatcttcacctaaaactacgtctacactaaaaccatcagcagctctttcctctaagaaactaagcactccttcaagaattggtatgatattacgcccactaaaatcagattcttcccaaatattagatttaattttttcccattccacttgataatcattgggtagctttttaactctaaattcaaaagacttaatttctttagttatgtcatttccagtgattttatcccaaaaattcattatttaatctcctacactatatttctttaatttattaatccttgttgaaacaaactcccactttgaccagaacttttctagttcttcatgacctgcatcattaagagtaaaaaattttctcggtggtcccatatcagatttcttttttgtaacttctaccaacttatttttttcaagtcgtactaatattgtataaactgttccatctacaacatctgaaaaaccaagtgcatttaatcttctagtaatttcataaccatatatttcttcatggctaataatttcaagaatacatccttcaagcactccttttaacatttccgttatattttccatataaataacctcataatacatatttttcagtagtaagtattacttaataccactatatagtataacttactagatattatgtcaacatacttttttatttattaaaataaaaatatcacaaaattcatttattttttgaataatgtgatatttaaaactgattatctttttatatgtttaataaattattttcgttataataatatttactacttgttcaacatttaaattgttcgtatcgattttttcaccgttaatagtacttttaaatgcttgcaaacatctatcaatctgttgctcagcccatgaattttcaaattcacctctactgattaatcgatgcttaatattgtctttgtcaacattaagaataaaatgataaaccttaacaccatctttaattaaatttcctattatttgattatagtaatctatatttgtaatagtcatgggaataattagaattccattataattgtcatgcatgtgctttattatttgataatttatactacgccatatttcaagttcttgaaaatcacctttttctttaatgcctattggaaagctatcccataaaaaatatcctacttgttctggatcatatatatgagaaatctctatctttgaatgtaataattctgctgttgtacttttcccactaccaaaagcgccatttatccatattatcattttacacctcaaaaaaatatagtttaactatttcaaatcacttattaatcctgatattaccttttctcttttaataaaagatatatattaaacaatattcctaatattacaataactccagatataatataaaataaatcacttgttttttcccatataataattgaactaattattatatacattaatacaatacataaaattataacaactgtatttataatcttattatttaatgagtttttattaaacataataataaatcctttcacttcatatgtcttaattaattagaaaacacaggtataaacaataatttaatactattctaactcactttttttcatacaataaaatcaagaatttttatctatatatattcttaatgcttttattaataaaacaagtgcataaatccctaacccccaaacacatatcataaccaacggtataatccatgtaagtagcatcattattacctccccctctctctaacataactttttacttctttctagtaaataaattcataccagataatacacatattagtgaaacacatccaatcataagccaattcatatatagtcctattttacctcctaagactacatctggtgatgtgttaaattcatcagcataaatacctagattgcaaaataatttagctgctattaataaacaaacaaaactcaatgcaaatatacctatatttaatactttaactttcataagctttccccctaatttattaagcattttatgaaatataaataattaaatctttatattccttaagtaaaataataccataaacccaaaataaaagtatcttatttttgactatacttcaatcaaaaataagatacttttatatttaccctaactttacacttaaaaatcagttgttaagttctaactcacacattaattttgataattaatatcttggtttgttaaatactcaaacttcttgatttctttagcatttaaatcttctttgttcatatctacggcatttattctgctattgttataatttttataataatatatacctttttcttgatccatacaagaagaataaagagttaaatcttctaaaccatcaggtgtaataacgccacccttaaccatcttcacataatcaagcatatggaaaaactgagttatagcttttatatcattttctatagatggcatattagctctaatatatgcaatccttacaaatcttgaaactgaagcaaaatctcctggaatccctaaagtcccagctccgatacctaatggtgataattttttatcactccagctagtatcactaggattatcgggacttaactttacatactcatttaaatttgttaaatgccaatcaaaggttggattattagtcattactcctacaggattatcataaactgcaaatttatcctttgttttttcaactactattgatttaccacttttatcagtaatcatccagtgaagtattgatactggtgttttatcattaataggcacattaactaattctagattactaagttcttctctaacttcatctactgtagaatgattagataaaatccatcctataaagtcatatggtgctatatttatttttccctctactggtttttcttcaaaataaccatatccagtaaaattcaagcctgcacatgctaagcctttttcattcataccatctgctaatgctggatgattatcaattatagttcccatcgccataatcgcatatttattagatagatattccccagtaactttattttcaatttcataatttcttggaataatcattggacattgattaaactcatatgcaagatccatatttctcccaaaaaaattctctccattatctgctttaatacttaatgctgtacacatgtttccacctcatttatatcattaaaatttctatcaaagattatgatcacatgtatcacaataaatttgataatattaccaagataaatatatatatacctaatagaatctactaagtataattccttctgttataatactatatattctttaaattaaatttaattcaatcctttaaagttttcccttaagttcataatttatattcttaaaattataaattccattttccacaccttcaagttcccagaacatcttatgtttcttagattctccttcaaactctacgcctatgtcttttttttcacgctgaagcttctttatcattatgttaagattacgtttcttccaattattataatcactttccattccttctaatactttaagtgacgtagtactctctataacaggtcctcctaaatcacgttgaagatttcttagtgtatattgattttctcctggatcaagtattataaagtagccataatcaaaagtacttcgtacaagccttccataaatctgctttaccttaatacaaagctgaggataattaaaatcctgatacatcttatgctgatatgttgtaactgctcttaaaattggatactctgggctatggttaggaagtttatcaagcattacacatgacagaccgtctccaggtacatctattccttcaaaaaatccctttgttccaagtattattgcctgtctgttcttatcatttaatatattaattgattttttgtttgtatgaacttctatcttgcttccccttgtaagcatttctagttcttcatatacaccatttcgccttatattattattaaataagacaagtacatgtccactaagcttcttacttgtttcataaataaaatttgaaattcgctttatgtaatttgcatcatcataacgtcccatatctgtaagtgcaaaaatctttgtctgtttctttaaatcaaacacaggtggtattaaaaaatcatttgctttttcctggccaagatgcttttttatcctgttaaatgagttttctatacgtagtgtagctgataaaaatgttgtgctcttaacatctttaagcatatgttcattaacaagttcacccacatttaaaggaactgtctttaatctaaactcatcatattctttatcaatttcaaggattttagcaaagaaagttgatgcttcaagaaacttatcgagcatatcaaaagttccttttaattttataatataatcatttatattcttataatcattatcacctgtaacttcatcatcaagaacaatatttgatacatatgtattaagcattttataaagaggatatatactttcttttaatgcacttatttctggctgaagacatttagtcatggtctttaagtcatcacgtggaataaaaaactcagtattgaaatcatattctccgctaacaagcctcatggttctaaaatcattcataagtatatttaaatttactattatttcatttacaagataaataatcttatctttttcaatcgtttccctgaatccaaaggatgcatttaaattcaaaagaagccctattatatttggatgtcccttatcaatcatatccaggctttcaagaaattcgctacttgtaaattcttctgcaaaaaaatcataacacttttccataagattatggccctcatctataataagatgattaatctttttcttttcagtatatggccagcatgcaagaagcgaatgattaataacagttatattttcagttggaagttcattatatctctttctcaaatagcatggctttatgcatttttcaagattacaagaatcactgtcacaagttacatctttaaaatatctttcaaggttaaagcgctttactataaaatagcttatattttctatgtcgccatactcacctttttctgcaagccttctaagaaaaagaagtgccaggtttccctcttcatcaccttcaagcctgtcgcatttatttaagcgttctatgcatatgtaatttgcctttcctttcatggcaccaaacttaagcttatcataaagacaaagcttttttaaaatatttggtatgtcacgttctataagctgattttgaagttcctttgtgttagttgatattatgaagcttgcatcatcttttcttttcttaagagaatttaaatatgtaccgattgctgcaataataacgtatgcaaaggtctttccactacctgtaggtgcttcaataaatattctttcgcctttttcataattttcacgaatcttttttgaaaattccagctgattttttctataagtgtatccaaagtctccaccattattccatatcttctcgtcctttaaaagttcctcatactttttataatcaatttttaatggctcaaggaaagtttcattttctttcttatctttatatgatacataatcgtaatcatcgtaaataaaaaatggaggctttaaaagatgtttattccatgaccatttttttagatacggataatatttatttatattttcatataaagttctcttttttcctttcttttcttcactgctccaaagtctgcacaaaagactgtttacaacctttagtgtgtttatagaatcatcaagtcctctgtgaatttcatttttattcatatctgtaacagtcttcataagtgcatttagattatattctttatgatagggttcaaggattgctgcaagttccattgaatccattattgtatttttaatctgtggaagatgatatctaaaaaacttcttttcaaaatttccattatgacatattagaggaagatcttctaaaaactgcgaaaggctttctcttacatttccaagagatggtgcactataaagttcttctttacttaaacctgtacataaattataaatgccaattggaacacgtcccctaggtcttataagagtttcaaatgttgtaattgtattatctttaaattttattgcacctatttcaataatttcactgctcgtttcgtcaagacctgttgtctctatatcaagatatattacattgtctaatatactttttaactcctctgacataaaatctcctaattaatctatttaaatctaaatttttattcattatctagtaattatatcataattaaataacttttaaacatacgttctgtttttcattagattttctatacatttaaaaaggaactgctgtgcagttccttttcaatagtgtgagataatttagcaccatttactttgggatttgttaggatcttctttatcatcgccctcaaatcctttaatttgataatgctctgttaaaactgaaggatcataagaaatatatccaccagcgcgctcataatgtttaagccccttggtattattgctttttgaaaagttcataagaatcacgcctttcaataattattgctttatttttttatttacaagttgagcaccactggttatttcccgcatcttttttatgttcttcacaagattctttaatatcataattttgtgctactgaagtccaagcattatttcctgcatcttttttattacatccacttgataattttgtatttgtttcagcttttaatgtattttgtgagctttcacaactacttattgctccagtattacagctactacaattagtttctttttgatttttcatattacaacacatcctttctatgaaactatgttgtgtaaaaatcacttttaatatgcttattttctagagtaatttttttcttctaattcattaattacgtctaaaaacatgttatacatttccacagttttatcttcgtcagcaagtactttcataccaaaaaacaatacagctacagcataaattgcgagagataacggactgagctttttcatataagtatccatataagtacatactccacttgctgtaagaccagccagaagagaggcttcaattccacaaccaccgcttgtataagaaccaagctttgtctttatgtgaattttctccatattccaatttatattttcattcatgtaccactgttcaacctttttgtacattataaataaagttttatcatgattctttgttaccttcatagtaaatttgaaacattctttatattttttaaccatctctggtgtatatatcttacaatcagaataatcaaaatttttactcttaaataatttattttttatatttattactttattgttttccatagacaatctcccatataaatactacaacaatttatccttgatattactcatgtttacaatgtcattctaaaaactatcaagttaaaatatataagaaaagtcaaaacatatagcacttactaacgtaaacattatatgctttaaatttcaaaaaagttaaaaaattattgtgaagtttttctttatataatattttaaatttttgatgatcagacttaataaaaatgaataatatgtatattatcaaaacaacttagatattttttatatattaatatttttaatatgtatatatgctgtttctaatattatattaagaagtatattttaatattgttaaaatatttaattttttctatttaaaacataatcattatggttgctatttccatagaataaagtataaaactatattttaaaggatgagagatttatggacgatttcggatgtataaatgagcttaacggtgattttaacaacctgagcaacagtattaatgatctcaacaacactcttggtatgaacaattgtgttgctaatgcttatgatgctggagaattaaatggcatgcaaagcttcggtttaatctctaaacagtatcaggccttgataattctccttataattctctactggtggactacacaatatactgcaaattactttatgaattcaaactcccagcttatgaataatgtatcatgtgttcttgacaagcttgtagataacgcagttgattgctgttctaactgcagtggcactgctggagactcagaaaaaaaacatcacaaacacaaaaaacatcgcagatgtaaatgctgctgttcagattgtgactgtgattcagactgttgttaatagtcataagcatcttctgccaagtctttttacgacctctggcagataatttttttatatatttttcaatattacataatttatttttaaaaattatacccataagcatatatactatatatagaggatgttttttcaccaacatactatatatagtgttttttattgccagataattgtatgttaaaacctctatttgtaataaacattattacttcaactttaaatataaaatatgtttctggagggtttatggattacgcatatattgaaaaccttgtattaaaatcaaaagcacatgatataaattcaaaagaaaaaattcttgaagaattcagaccttttataattagaacatctaaaaatatatttatagatggatacacctttgatgatgttgtaaatgagtgttacaaaacattgtttgcatgtataaaatcttacgattctcaaactcatagatttgtagcttatgcaacaataagcataaaaaataatattcattatcttcttcgtaaaagcataaaacgtagaaattcagagggaaaagaagctcttgttttagatgattcacttactcatgttctaaaaagtaatgatgatattgaaaatactgttttagaaaaccttctttatgattcattaaagaaagctattgatgctcttacagatgatgaaaaagaacttattaattgcatttattatgagggaaatagcataaagacatatgcacagatgaaaaatatatcctattttaacgtgtttcatgcaagaaagaaaatattcaataaacttcatacctttatgggatagataaaatcactaattgttaataatatgcttttaaacaccttttatttactttatgaagggaggtgaaatttatggatattaatgaacttgtaagccttataggtaatgttggatttcctgttgcagtaagtacgtatcttcttgtacgtcttgaaaaacagattcaaagccttacaacatcaataacaagacttaataccataatttctgcaaggcttggagtcttaattgacagcagctgtgaaactgaacaaaaataatttaaattatttttttcaaattcatgaactaaaccatatatatattatgaaaatcatgagtaatgaattttacttacgattaaacaatcaaaatttttcttaattaaaaggaggtaatgtaatatggcagttaacaaaatcgctgaaagcgcaagtttttcaatcgaagtaagaaagggtactgatgctcttggtaatcctacttacagcaaaaaatctttttctaatgtaaaagacggtgcagatcctgaaaaggtacttgctgttgcaaatgcagttaaatcagtgttatctgatgagactagaaatgtctatatgactgtaagtgatcagttagttcaagcataatattttacttaaaactttaattttaggcagatgctttaatctgtctaaaagaattatctgacttttgactcttgactcttaataaaacaataaaattcaatctgtgtacagaaaagtgcacgagatattttaaggaggaataaaattatggaatatattttaactttaactttcatgactgaaactggtaagaaaaattctcttactatctctggtgttaaggaagatgtaacttcagagcaggcaaatgcccttatggataacattcttgctaatgatatctttgaaacaaaaaacggtgcttatgtaagcaaagttgaagctaagcttactgaaagaaaaatcacaacttttgatgcagagtaatacttatcccctctcatattaatccttcctgcatataagcatttcttatatgcaggaaggtatttttttattaatttccaattgaatataccttctgaaattttggctcataagcaaatttcaatgtgcccgtccgtccatttctctgttttccaataatacattccagtattccacgatcttctgaatctctgttataatattcatctctgtacataaaagccaccatgtctgcatcctgttcaatatttccagactctcttaaatcagaaagcattggtcttttatccattctctgctcaacagctcttgaaagctgacaaagaataataacgcaaacatcaagttcttttgccatgaatttcagtccctttgttatttcacctattgcaagatctcttgtacttttttctggaatattcataagagtaagatgatcaatgactataacatctagtccatgagtctgttttattgcctttgcttttgctttaatatttaataaactctgccctggagaacaatctgtaaaaaggttatccctctttgacatatcctcacaagttttaaacaagcttaatatctcatcatcactgagcataccaaatttcatcttttcaacttctactgttgagttacttgaaagtcttctcataccaagggattctgctgtcatttccagttcacataaaaaagtcttataaccatttttaccaagtccatcaataagatttaatgcaaagagagtttttcccattgaaggtcttcctgcaataacattaagttcgcctttattgagtccaccaatatttttatcaaaagatacaaggccactcttcattcctggtatttccccagatgattttaatcgtctgtcaatctctaaaagagtagcttcaaaaagttcattatccctcattatatttgattttccaaggtttttatttaaaagaatattcaccatagcatcagttatttcatatggattatttttttcatcatatattttttcaacagcctttgtaagttcctttatgacttttcttctataggatttttcttttactatatttatatagtgggctggatttatgtttaagccaccagttattatatcgctgatataagttattcctcctgcacttttaaggttatcctttccaattgaatttacaataagagtaaggttaatgtcctttccttctgcaaagagcctgcacatatgagtgtatatagtcttgtttgtattactgtaaaaatcatctgcttcaagttcatttattacttcccccatgattttaccattgtgaaaaactgcaccgagaatctctgcttcacaacgtaaatccttgggcataacactaagattgttcatctaaaatactcctcataggactataagccgcatgatttatctttttatctacctttacttcacagtaacttctttctgtatatccaatacacttgctttgagctttatatgatgatgtttccccattgtatccttttgtcctccaattttgaagtattcctgtaagataactgtaattattaagttttccacgttttacacatacatttgctgcatccataagatatttttcaccataaatagtaatatcagcttttacaaactctgcaagtcttgaagaaataataaaaccacacttttcaaaatgctttaaaacattgactacaacatactcatctttttcaatctcatgaacctcttttaataaatttgacttatccaccaaggtttcgtttttccttgtgttattgttttttatatggtttttattatactttctctttttctctttttttatctttatatttttctctttctctggtggacaaatgtccctattttgtcccatcttataaaacgtatctttcactacattattagattcttctaaaccttcaatttcactatcttcattaaatcctttacaaaaattttcagaatttataatatctttcctcaaatcttcatgagtcttttcagagttttttatttcttttgattctattttacatgattttatttttctttcttcttcctcaaaagattgtaaatatacactatgaccagtttcacagctttcgtaatcaatctccataactttgtcgtcactatttcttataaaatttctttcattttctatcttttttctatatcttctctttcggtctccctcgctacttgtcctacccacatgatcttgaatatcaagaatgtaaatggcaccgttaccaagaatttcaatccatttaaacttctcaaatatcttaattgcattttcaactgtttcaatcctatgaccagtaattgttgatattatttctgcatcatatggaatattttctttaaacataagtctaccttcatactttaaagatttaaggctcagcttcattagtatgtcagtatataaatatccatctctcatgctttgaagcactttcatatcctcacgctcataaaaattttcatgtagcctcatataataataagtcttattgtcactcataacgcccataccctccaaaaattctatttataatgtttcattttaaaatattttaatcaaatatactgtgaataaatatcctccccttttctgtccattttctatcatatacttttattccacattcaagttcacagtgacgcataaccacaaaacccttgtccacatattttgaataaagcatccatgttccattacgcttaaattgaatcttcttatgttcgagaatattgttaagccttgcagcacttgatattccaagttcctttgcaatttctcctgttgtataaagcctttcggatttatatttcttcataataccactaatattattgtccatattttttccaccatcctttaaacttatattacggtcctccccatataaaatataattgtctttgagtatgtccttcttaacttcttcattcataatattaaattcattttcttcaataatcatatatcagtaacctcctctattatctttatacattctaaagctacttctgataatgtcttaaaaatattttcttttttcattgtttatattttattctcctttcaatttactgaatttataatcccaaaggtaaatttaaattgcatattaaaatatgctttatattttagcctttgttttacttaattgtaaatattttgaattaatttgcaaagaattatttttattattatatatttatttttcaagtttagaatatttttaacataattacaaaataacttttcaatttataaaaatattttttctatattcatataataatttctatttataaattttttggctataattttacaattcttagtattcaaattaaaaataatattttacatttctgataatttattctataatattagaaaaaaggagatgacaaatatgtttaaagagaggttggaagaatatcgaaatacacttcacttaaataaatcggaaatggctcataagcttaatgtaagtgaaggatattatagccttatagaaaatggaaaaagatatccaccatcaaaggcatttcttgaaaagcttgttgcatatagtcaactgccagaagaacactggctttatggaattgataaaaatgaatatattaatacacgagaagattttaaatccttaaaaaaagcactcgatacaattttagaaattggttcatttgcttctattgatgacttctttgatgaggaaaataatccaaaagattctcttggaaaattgctcatatcagctttaaagtcagacataagcagtcttattgctaaacgaaataatcttaatttataagaattgctaaaataccatatcatctcctaaataatctttgcaaaaaaacctttttagctgtgctttactgctaaaaaggttttaaaatagtgaattttcgttttatattcagctaatgtataaaatattatggttggataaatttaataattcaagataaaatcaaccgctttaatcacaccaccactactttttattttatctgaatatatcttgagattttctttaaatgtattctctttaataatttctctacatgtttttaaaagaaattctttattaaaattctttatgcctggatttaatgcacatcctatttcagaagctttttctgcattaaaataacgttcgaaatgctttccagggaaaataattgaaggtacttgattttcaatacattgtacagtagtattttgtccaccatggtgaatagctatatctgccatttttataaccttatctgatggaaccatctccataaagtatacattactattattgtaatttttatcacttttaaactgaggggttcctcctcctgttactataacatcaaattcagaacttttaaatgtatctaaaattatcttttgatatacatctggttttatttcaccaacgcttaaatatacgtatactagtgggttcttctttataaaattaaaatctgattttataaaattcttaggtgtcactgaacctaagtatatatactttgaactttcctctaaaccttccagttcaggtatgcttggaataaaaatttttttacaataatattcgccactaacaagttcacatatattatctatagttttcaaatttaaactttttaagagttcattatactctttttcatatccatatacagttttattagaaaagccatagtaacagaaatcttttttacttgcagtcccacctgttgaaaaatatggtatgtccatcttttttgcaactatgggcatgactgtttcaaattccccaaatataatatctggcttaaagctttgtactaattccatttcttctttaaatgtattctgtacatattcttttgatataatacctttaagccttattacatcacataaactttctatagataaattcggttctggtaaatcacctttaatacggctattgatatcttgattcaataatttttctatattaaacttaggcttatatccttgtaccacttcatatccactggatagaacataatctgcttctcttccggcagctctaaatattattctacagtctttttctcttttttttatttcatctgctattgcaattaatcttgttatagttcctaaagcttcaatagaagctattcctggagtaaataatatttttttcaaattaacctcttccttcctaattaaaatcactttattatacttatgacaaaacctaagaatactgtaactttatattttagctcaacctatgaaagtttttctatttcaaaacttagatgttatttaatactttttacttataaaacaaatatctcaatacaacaatatactctatactagtatatataatactactatattttatagtagtaggacaaaaaatatgtctctcaatatattaatttattagagacatcaacttattaattgtaataatcaaaaactttttcagaccatttttctaaaacattataaaattcgttatataaatctaatataagaaattctgaacctgatctttctttgtattgtttttcatggttataaacagactctacaaatgctctacgttcttctgccttatttttaaaattttcaatatattcttttcttttttcttcaggtaaattttctatattaactaaaaaagcattaaaatccaaataaatatttcctatatggtttgagctttcttccattagttgattgaaatataactttcctttttcattcattgaatacaatgttttttcaggcatttcaccttctttaacagttcttgaatttaaatatccattatcacgtaatttaattgtatttttataaattgacggagtactgatttttaaccacttagtaatattccatttatcaaattctttaaccatttcataggcacttttctctttattctgcaaatacccaagtattattaaatttattgaagacaatttaatcaccaccatattttatactactataaagtatagtggtgtattttttatttgtcaatataatactctaaatcacaagtaccctgtcttaattcatgtaatctttcccacacaagtctaattcatcattatatattaaaagccctaaatcataaactgaaactttaaatctcaaatccatttcatcatcatttaaataaataatatcaatttctctattgatactatttctaatcttatctgctatgtccatgatacatatcagatttattttttcagatgttaatattgcaatcaatattaacatctgaatactattgaaattcatctgttacagtgcttccaaatatgattacactattgatattattttcctaaatatatctatgaatatctctggtttaagaattttcataatctgactcttatcataaatatcattctgtgctgaatccatatctgcacctactactagtttctcatagcatagtttttaatataaattttatgagctatttgtatttaatagtaaaaacatgccagaagacactcctattttgtaaaaagaaaagtatttaattctacagtcaatgatattttgtaaagcgttgtaaaacttaatatatttgtaatcttattcgcggtttacgacacccatatgtcaatctaaaactaaatatttatttaataatacacaaaactttactgcctgattactggagttgtccattaacaatatcaaaatattcactttttaatgcttttgcattattaaagtttaatttcactttaattttagttgtgaaatttagatttggtgtacgctctatatactgctgcaatgcatttagttcaggcagtaagtaagcatttttatgacaaatccatttgcatagaaaattacattttccgctacattcctttcctttgccaatttcaatttctataaattcttcagcaaggttaagtgtagacgacacatctttgcaattaagtcctttaacattggttaagtttgaagtatttaaatatatttgtacagtaatagtttccagaaagttttcacgctttaatatagacatgaaatcatcagtaggagagtctttacttccaaatgtatattctgattttatttcaaatttatcaattgcagaatgtgtaatccagtgatattgcgaaatttttggcatattagcaatatttctatctaaaatatcaaggcttactctatcttttgctatatctaataaatctgcaactcgtagtaatatcatcatatatttttcgctgactatctctgattttgcatttgattttaatccatagatatcagtgcaattagctccatgtgcagctgaaacagcagacacaatcgctcttatcggcaaatcaataaaatctaaatcagaagtagcttttataaaacttgcactcgatgctacatgtgtatctctggaaacagattcaaagtaataatttaccctttcaaatgcatctttcataactaattttacatttgatttgttatcgaaatgaaattcatctaaattagcatcagtaaatacttcttgtttgaattttaaaaacgagctataaatctcatctgtttgtgagttgctttcaagaaaactatcaatactaggttgtaaaatcattgatatatcatgtaaataacatgctaaaaataatatataataatcaattgatttaatttgtaaaaaatcaaacattttgcatatattcacactagatctaattaattctaccgaatgttcttggttatgtaatgtgtagaaatacaaaaatcttgatccatttcgccatacacttgatacatatttatgtactaaaataagattatcaattaactcagccgattttacatgtgttttaaaaatattcaatacttcaatcaaagaaaagtcaactttttcataatttttaactataatactatcaagtatagatgttagaaaagtcacaaaattttggattgttgtacttttatttctaatatataacaaaattctaagttcatagtatttcagaggtcttttatctaacttaatgaattcaatatcattagaaacgtcaatattaaaaattgtagaaatataactattcagtatatttcgtttatatgtatttgaattcttaaatatcgtcgtattatagctatcaatttcatcaaatccaagccatacctctgtctctttggataatattaattttagtttttctactactattttttcgggcttacgtgcaaaatttccaagattagtcaaggatatttcttttagtgttgtgaaacaacaattcggatactctaagcttttagaaaaattttctgaaaaatacattgtagcatcagacaaattaggtgctaaccttttgtcaaaatttaaaagttcttctatgaaatctttcttttcatcattaggtatttcatctaaaattaatgcagcttctgattggaaaatatcttcatcaaaatataaaaaaacagattcaaaattatcaggtgtatctagtttattattaagatatttttcataaaaccactccttgatttctgaaatgtcatcaagctgtctaaattctaaaattctctttctgtaaccaaaaaatttcttgtagcgaattagtgactttagataaattttaaacgtatatgcttcgatacttgatgaacctatcttttcaatatgtttctttacatttaatatttccttttccagtgcatcatatatatttagtattttatcaagtatacttacatcttgcatttcatcagttgtagtattaatttcaaaagatactcgtgaagcttcaagtccaactcctactaaaaatgacttgctcattttaatagaactttctattttagccgaatagcttttttcttcttcatggactcgtaccatatactctatattactttttacacaaatcctattttctgtatattttgatatctcggttgcaatattgttgtttaattcgttaagtgattgtttgaatttttcgggacttgcatttttgctgtttgtataaataacagaatcatcaacatagtagaatgattttccaggaaacattttatcaaattcttttgatattggtatcattgctatattaccaaaaaaatatgattgtggtaaaccttgcggtataccaatatttcccacactgctgcctttttgtggtattcctatttgctcatccttgagcttagaagtgctgaaatattcatttatttcattctgtgtatttaagtttgaaacattaaaacacaataattttttaagtatttgcttaaaaaagcgttcatcttctccagtgtaaattgatgaagttttttctgaaataaagttataaataaaacttgggtcaactgaagggaaaaatttttttaagtctaaggcaacttcatatttgtatgtcttatttcttctgatagattcatagtttttcatcacatcttcagtgtattctttatatttaactttccaatcgtaaaaaatattttcatattcacaagacggtaaatttccataaaaattactaggaagaagttgacttaagtcagaaagttgacgtttatcatcttgttttgtagaatacatgattatatttaatatgctaaccatacatatttgtgttattaaatcagcagtatgaatgggtctaaattcaactttgtcactttctttatcatactttttggctttaaaaaacacttgaatatcaaattctttatcctttaatagaatctcatctaattttaatctacagtcttttattacactttttattagatgttcatcatatttattttgtagtttatgatacaattttaaatccttttgagataatagatttttttcgaatacatatgattccaaagaataaattgctgaaaaaatatttgtatcacttattactattctatataatttgctattctccatcattttctcctaattccgagttattctttggagccaatgcttttttcaccatagaaaataactctatttctttataagagttgtttgatttaattttttggttctcaaaatactcactttctatttctaaagaatcgctattcacattcactttcacatatcttattgaaatataatcagagtctaatttaaaaagattaaattgatctattaagttgttaaaataatcatatttatcaaaatttaatagaagtttgatttcaaaggttggggtcaatacataaagattatcaaaaattatataccatccttctaatgagtcatagttaattgaaatcttgtttttaaactgagtaattaaatcctttttctgattataaatgttaagcttttctttaaaaactgtaacagaatctgttaaatatgtaccattatacttaaaatttggatttgaagaaatgtattcgcaaaaaacatctaatagattagtatcttcgatttgatcaccagttagattgtttagcttgttgatatattcgctaaaataactattatttatcattatttatattttctccttctaacttcatatttttataaccttttatgtcatcacaagttcattttattgtctttaaaatcttgaagaatatccatatgcattataaaatcgtttgagattctcatccttatcattatgtagcaaatgataaaagtctacaaagaatttttgtgttttatcatctattaatattctagggggaaaagtatagtatgaaaccttatatcaattatgtacaagttgctttttgtattcaccagctaataacttcaccaattttacctactgattaaattcattatattacagcaattataatttttctataaaaaaagctatatatttcaaaacccaattaaattttgaaatatatagctttaaatgttagcacactcaataatacacatatgctttactcctgttatttgctggtgtttctattgccagtatagcacaaagattaggtcattccagtatgactaatactcagaaaacttacctgcacactatccatgaacttgaaaataaatatattgatttagttatgcttagatccacttgaaaaaaactttttagcaagtgctctactttactaaaaaggttttaaatttatgtcccacaataagttttataagtaccacatgatgttttaggtacagtaacataataatcattttttacagaataatcatatggctttgtaataacatctaacagttttctcattacagtgtaatcattattttttactgctgcctctaaagcttcttctacacgatgattacgtggaattactgatggattattctttctcataagttctcttgataattcttttgattctgcctgtcttataagcctttcctgccacattttataccaattattaaattcctctttaccatataattctgtatcttcagttttatccatagttaaacttctaaaagtatttgtgtaatcagcattatactttttcataatatttaacaactggttaattaaagtttcatcattttcttcctcattaaatataccaagctttgctctcattccagaaagataattttcattatataaagtaataaattttgatatttcattttgtgctaatttgactgattcatttttatcattatgtaaaatgggtaacaaactttcagcaaaccttgcaagattccatactgcaattttaggttgatttccataagcatatcttccattaacatcaatagaactaaatactgtttcaggatcatatttatccataaatgcacaaggtccataatcaatagtttctccactaattgccatattatcggtattcattactccatggataaaaccaactaactgccattttgcaataaaatgagcctgatgctttattacttctctaagtaataaaagatatttattttcctcattaattaattctttaaaatgtctttctatagtgtaatcagctaactctctaatttcttcaactgaaccaaattttgcagcatattcaaatgtacctacacgtatatgactttttgcaacacgagtcagtattgcacctttcataagaccttctcgaattatattttcacctgttgtaactactgctaagctacgtgttgttggaatgcccaatccattcatcccttcactgataatatattctctaagcatgggtcctaaagatgattttccatctccacctcttgaatatggagttttacctgcacctttaagctgaatatctactttttcaccttctggtgtaatatgttctcctattagaactgctcttccatcaccaagaattgtaaaatatccaaactgatgtcctgcatatgcttgtgaaattggtgtaaatccttctaaagtcttatttcctgatagtatctctactccttctttactttgtaatacttttgcatccaagcctaacttttctgctaatgagtaatttaatacttctaagtgtggtgaaggtacatgttcaggattctgtatcgtaaaaaatattgatgaaagatttgcataactattttctaacttaaatccagcttcttttgatatgtttatatgtttcatagcgttatgcctccttttattctctaattatagttttcctaaataaatagatacaatactaaaattttaagtatattctttcatctttgtctttaaattaattttataaataaaaccttttttctctaaaatatattatcagagacaacaggtttcattatgcataatatctttaaatagtatttatctttatcataaaaatttagttgcaactccatcagaatcaaattcatatccataaagaactgtatcacgaaccataacgtcattgttgtaaataagataaatttagccgccacactgctgaacatcatgttccataaaataatctccacataccgaattagcctgcgacactcttgtaacgtaattagtagaaattccaaaccctgtataacctaaagactaaaggaactattattattgtataatttgactcatacaataataatactactcaatatacttgatgtattatctacaaatttaaaaagttatactctagttcctttgcaggtaatggtttgctaaatacataaccttgaatttcatcacagccaatatcttttaaaatattcacctgttcataattctcaacaccttcagcaattgtagctacctttaaagatttagacattacaactattgcttcaactatatgattgttgctacaatctgttgaaatcttatcaataagctctttagcaatttttaaacggttaaatgagaattgttgaatatagcttaatgatgaatatcctgtaccaaaatcatctattgaggttgaaattgacaaatcatttaaagatgcaaatattttctctaaaatcttttcacctctcatggctatattctctgtaatttcaatatctagccattttggttctaatttataggtatcaataatatattttattttatttacaaaatttatatcaccaagctgtttaggtgaaatattaattcccatcttaagatctaatccgtattttgtattccactcgtaaatttgtcgagaagcttctttcattacccagtcacttatttcttctataacacctatttcctcagcaatttttataaatttatcaggtctaacattgccttttataggcgaattccatcttattaaagcttcaactccaactaattggtcattttcaagatttatttgtggctgataatgaagctgaaattctttattgtaatcagcatttctaagtaacatctcaatttcatgtttctccaaaattatatcattcatataagaattaaaaaatgaatatttattatatccttttgattttgaattatacattgctatatcagcattttttataagaatatttcgtgtatcaccatcttcaggaaaagttgtaacaccaacactaatagttactcgaaattcatacgtaccaatatatataggttcattacaacagtttatcatatcgattactatattttcaatttcgtccttactataatttccagatatcattaatacaaattcatccccccctagtcttgccaatatgttatctttgttatttgttattgcaagtctttttgaaatttcaattaatacttcatctcctacatcatgcccataagtatcatttattgatttgaatctatcaaagtctatgtataaaactgtaattttattactgctattttcactatttatcatatcatctaaagtatttttaaaataccgtccattataaaccttagttatagaatcatgatttgaaatatactcaagttctttatttttaagaataagttccttggtacgctcattaattttttcttcaagaataagattcatatttttttctttaattaaaagtttttcatttttaattacattttgtacataaatgcttaaaattttataaaacatataagttagaattagcaaaattaattcagtatattggaaacctttaaaaattatgaatataatagggaatgtaagcaacaagaaacttttcttacttgttccactattttcaaattcacaataaaatttttttacctgtgattcatttttttcctttaatactaataatgctccatatgcaattaataaaaatgataaaatataccccgaatctattatagaattaggaacatataaatcgtaaaaataatcatatgaacacagcaaatctataattgagtaaaatcctccagcaaaaaaagtaagataaattccgcctggtattcttccttttcgtatagataaaactaaaagtgctacactgcttattataatacaatcagataccatgtatagaaataatattaaattatccaaacttctaataaatgcaataaaactattgtgcattaataaattccaaaaaataattatacttgaatatgatattgctacaatatcaagtaaaaactgaattctattgaattttttagatattttaacaaaaaacattaataccgaaattaaaataaatacattaggaatgagatacagaaaattaaatatcttaatatttgggggatttacgactaaaataagttcacaaattgcccacgctatatctgacatggtccaaaataatgcacttagacttaaaaagagccatattaaatgcataccagttgattttttataaacataaaataacattataaaagcaataatggttcctactggagagagaatatctccccaaaaactagactcatatactgttgatataaaataaatattaaaatatattattatagcaaaatgtatcgaaatttttgatttataattcataataatttatctccatgtaaaaatctaagagtatcaagctgcatatttacatttttatttataaattctagcaagtctttaccattttctatactacttttaaatgcttgttgaacttttgaaatagtattttgaattgagttcacagcctgtgatgattgttcggcaagcttttttacttcttctgcaactactgcaaatccttttccttgttctccagctcttgctgcttctattgctgcatttaatgcaagtaaatttgttttttctgatatgcttgcaatagtatctgccataattttaatattgtctacaactttactgtcttaaatagctttcaacattttgtcttgcttttgtttgtatagtatgccggtctcctcaatagcttttttgctattgtacttaacctttgttgctttttctttaaatttataagaattgttacttccttctattgccttattagaaagtgcattaattcccgaatccatttcttcaaccgctgcactaatttcttcagaagttgtacttgctccctccatctcttgtgcaatattatttatagcttcattaatatttatagctgttgctgatacttcttcaactgttgctgataattcttggcttgatgcactcatatcatgtgtttcttgtattattattttaactaattcatttacatttttttgagctctatttaaagctacacctgtttgtccaaattcatcttttcttgttataaaaattggtactgaaaaatcatatagagctaaattttcagcaaattttttaatcttctccagtggtttaattatatctcttgcaattataattccaagcataattgctaataatattccaaaaatatttaatacaagcataatcatccttgattttatgtaagttgagtgattactttcatttgctgcatttgcataatttaaatttgtttccactacattgttaatgctgtcaaacaccttttctgttattgattccatttcgatatattgattttttgcttcctgcaaattattagaattaacagcataaactacaccttttctaacatttctatatgactctaaattatttttaaattcttcccactgatcatattttatatctgaaattatcttatcaaattctgttatatatgtatcatcctcttctacaagaagatacttccaaaagaattttttcttcataccgccttatttttaatctttctaataatattaatcataatagtcttaattttctttgataaaaaattaattaataaaagacaggtttaatagcctgtctgtttacttactttcaatgtaatttttataattgggatgctaaaatttttatactgatattaaaatggatatcaacgtcagtgtaaagtaagttttacttcatagaattagaactcataactttacaatattcagctatatcattagctgctttcatagcactacttaaagccccttgtacccatccgtggctaactgaaacatgctctccagcaaaatatactctattatcatattctggtttagctgatgcatacaaaaaaagtttttgctggcctggcttattataacaaacacctccataaaaccccttttctttatcccaaagaacagttttataatcttctactatgctatctaattccccttcttgtaagccatgaacattttcaacttgtcgctttattaattcaaaacgtctgctttcttctaaattacctaaacgaatagcatcttgattcaagttataggatgataataaaattcctctattattacgataatttttctttttattaaatttctttctattttctatctttctactatcatcataaaacggataccatatacttccaacaacttcatctgtataggatcctccaccaattatcttttcatgaggtcctccacgttgccaaaacctttccttacatacaaatgctgtcttttgaattgatgcatagttaagttcttttattgcttgcattttttcattactaaacataggatatatttccacattacgaagacttgaaaatggaatagtacaaattacaaaatcgaattcttcatttttaacttctaacgttctctcatctttatatctaagaactaccttattatttttatctgatttatatattccaataactgtttttccatttttcaaaaaaacttttcctaaatcttctgcctttatattagaatattcttttggatctttttccatcaaagaattataaaatgctagtggtattttcacatatccatttactatctcatatctataagcataattcactgtatactcatcttgaagattttcaaaataactattgtagtaaaaattgcccaaaaaagaattaactcctgagagcatatcaattgcacctttacttaatcccatttcttcaaatacttctctaatatttaaactatcaaaatattcaagtatacgattatagttttctttaatctctatcaattcttttcttatagacggacttatctttaaaagattccttgatagtgtatatttaagcatctcttgccaaggtgttcttctttcttctggtgttaaattaaattctggatatattttttccataacactttttccttctaaatcatttcttgctcgtttatttctaacataaataaacgtattttcatcattctgaataaatggtcttgtttttaaattaaagagatctatatagtgccatacggtttcatgacttatgggtattctcatagctccaagttcaccatataactttttacgtttatcaaaataataagtataaatcctacctccaattctactatattcagtttcaaatattgtaatattaaatccaagctttcttaattcaaaggcagaagctaggccagctactccaccacctattattcccaccttaattcctttacactttcctgttgaattaatgttggtaatatctataggaggagcaagtaactctactaaattatcaaaatcttcaggacggtttacttcttctaatgcaatttttaacatttttaatctttcttcatatttgggattaattggtggtatatattcattactcctgaccaaataatttcatctccttaattatcgctaaaataacctctatatatttatactctctaacggttaagtaaatacttttttataaaaaatcattagtatatgttaattatattatgattataatttcctaatattcgaaaaaaattcccaaaatctaagtcttgggaacatataaatacactattaaatattttatttgtaatatcgctcacaagttccataccaacttctaaaatttcttaacattcattatacttttgctgcaactccatcataatcaaatttatatccataaagcacagtatcatgagccataacaccattactgtaaagaaggtataatttacttccatcttgaagccaacctgttgccatagacccatccctatttagataataccattcatttttatattttatccatttagactgtaccatagcacaattatcattaaaataataccacttgcttgtcttactgtcataagcccattcattttggcgtgctcttccatcattatcttcacctaggtaataccagtttccatctggattttcccattgtgtcttcatatatccttttgaatcaaataaaaaccaccctaaattagaattattattgccaattggtaacttagcccatcctgttggccatgttccatcagaatacttaaaccaccatccattattatcagctatccatgttccattgccataaaatgtactctgtcctgtaagcccttcaacaatagctgatgcgattatttctgcattataagccttataatctatttcattgtcaacaaagcaacattcaataagcattgcagccatagaagtatgatttaatacgtaaagtccactactagttttataccctctatttgtaatacctaaattacttgcaatagagcttgaaactttttgagctaaacttgaagctgatgatccatttgttgtataaacttcacaaccagttcctccccctgcattaagatgtatttcaacaaaatagtctccgccttctaaattagcctgagaaactcttgtaacataatctgtagaacttccagagtctatctgaagcttaattgctgtattccctagagattgaagcttttttacaaccaaaggagctatttctcttgtacaatttgattcatccaataaccctactgctccgcaacctgtctgtccacttgctgtatgccctacagaaattaaaaatttgctcatattctatcaatcccttcattattataatacataatatgaaaaagtaaccctattgctactattactaaggctacaataaggacactattttaaatatatgtttttagaagagatttttaaaattttctctacctattaggtaaaataagaaaaggcaataaatttttaatctttatcgccttttaatttgctagatactatttatttgtcttattcatcctctttattgacatgaactacgccacgtttatgatgaggtggtgcatagatagagtatactttaagtggtttgtcacctgtatttataatgttgtgccaagtaccagcaggtatcattattgcaaaatcatcttcaaactttttttcaaaatcccaattatctttgctttttcccattttgactattccttgtccgtcctcaatacgtataaactgatcagtatcttcatgaatttctacacctatatcatcattcactttaatactcatcaatgtaacttgaagatgatttcctgtccataatgctatacggaaattattattttccttagtagcttcatcaatattaactacataaggctttggaccataatccttaatcatacttgtattactctctatatcacctctaaagtcacattttgctccatcaaaaatcttattctttggaacatatataaaccaagaaccgtcatctatatacttatcattattactcatattatttaatccttaatattaatatcacaattatagtatgcttctgtttttgtaagtgttctataaagattttttaactatgagtatacttatctactatatctttatactttttatatcttcacacataaaaagcttctatttaactctttcatattttatgaacaaattaagcaaatataatattataaagcatgaaataaatgcaattacagctactaatgctagctttattacatatacttcaatttctaaattaatttcatttaaaattatcaatgatatgaagcagctaataaatacacttaatccagtagctatcctattattctttttatattctgcactacaactagagcaatgaatttcattatattgtctattccaagactttaatctctctttatataaaaatttagtaccacaattaggacaatatttcactgttttccccccctgacaataaactttcattgtcttaactttttaatataaaccgtgtaaaatttgttattgtaccaactatcaatgcaggtataaatgctattataaaacatacaataatttcttttaattgtgctggtgctgctaaattaaatgcaaaaatagctaatactactaaataagatattatataatttaactttctaatcttcatttttttctctccctatcaactattacgttctgttaagttatatacacacattacttttttaataaccaaagtcattaattttccaattgcttcttttattttcccttattaatatccaattataatctgaataaattgtatctgcatttaaaacaggattatcccttccacttattaagaattaactccacaaaattatactataccccattcattctactactataatcaatagcccatttactcaattcttttaaaatcggcataagacttttcccatcatcagttagtgaatattctactttaggtggaacttgatcatataatattctattaatcaatttatcttcttcctatcaaatattttaatttttaacatcatcattaccaaagctgataacagttgcccccatatcgtctggcgtatccttgctgtcacatatagaatatctaatgccatcatctagaactgtttttgttatttttgctgcatatattggttttcctcctattaattcatttttatcagaagacacatcatacgatgtagttttaatatatttaccatcagtttcatattcatctaatttattcaatataaatgtgccatctaattttaaactaccttttatgacacgtacataagcttcttcaccagaattaaatgaatcaataaatttatccaaatttgatatattgtatatttcgtgctccctactattatcttttgaaaacattatcacactaccattttttaatgataaattaaaatctttagcatcttctatactaggtttatctaaattaattaattcgttaaatgataattttttattttcctcttgattatttttattaaaattactttctacattagttgaattaatttcatttaaggttccttcctgattgtttgtatcattatgaccacttctatttgctgtacatccattgatatttagaattagtgttataataataattgacaatgtccatcttttcatactacctatcttttcctttcttttatatcttttctctaattaccctaagatgatgtatattaattttttcacctatatcttatactattcatgattattattactatttttaaatcaccattataattcactttaaatattgttctggatttcgtgatatttcttctacatctgaaaagaataatgaacagtgatatccatctgcaactgcatgatgaacctgaattgttaatggcataataattttattgttttcttcaaaaaactttccccatgttaccattggaaataaaaatgggttactgccttcattgtttacattaaaagatgtgtaattaaaccaaggcaagcatgaaacaataaaaaaattattttgaaaggttgtcgtaaatttattgtcttttttataactatttaaagaattttccatatatttatagaattttataaatacattatcaaatgatgtatataaatcactcatcactttagtcttatcatttaatacagaataacttggcccaatttcatcaaaaaatcctaatctaccttcttcatcaaatgacattttgaattctttatatttgtttataacttttgaaacaacccatgtaaaagttggatagaatctcaatttgttattttttatgtacttataaagatttgtaatatcaatatttacagttatactgtatgtacattttgcattattaaagaaatgattaaaacattccctcctgtcccaagtattcatatcaattatattaagccccataatttactctctccccatctagataaatttaatattttcttaaactttcactatattacatataaaaatactttaaattgaatatagtcattcatttattaattcctttatgttctgtatataaatcatataatattttaacatattttagaaataaataacaattaagagttattttaatggacttaataaaaaaataaaatgcccattatagaaacagttttttattttaactgtctactataagaaggaacattttatttagatattcttcatctatggcatcataactgtatctattacatgtatcactccatttttagccataatatcagtaattataactttagcaccatcaatatatacttcattattttttacttctattttagctttctccccatttgacattgttaattccttaccatttaactttaatacatctgctgcagtaagcttttgaggtgcaacatgataagttaaaatcttaacgagagtatccttattttctggttttagaagatcattgactgtattttgtggaagctttgcaaaagcatcatccgtaggtgcaaatactgtaaatgggccttcacctttaagggtatcaactaaccctgaagcttttaaagcggttactagagttttaaatctgccatcttcactagcaatatcaacaatatcttttgaattattttgttgttcttgtgttaaagaaataacttgggtttgagcataacaatttacccaattaatattaagtaacaacaccattacttgcaacattataaatattctaattttctttttcatgatataactccttttttgtaattattatttatcaatattaatatgcacagttaatgtaggatttattaattaatgttaacttttattttttgtaaatttagtaattccacaaaaaaataccctgctttatttttagcagagtatcttttatttgcttatttaaatgtaattttatgcttgaatatatactttaattctattaattctcttttcttttatttcatctatttttaatactaaattatcatgctcaacattatgttcattatcaacacttgaaggaattctacctaatttatcgatcacaaatccccctattgtatcataattgttagcttcgatatttgtatggaatttttcattaaattcatctaagggtattaatccatctaccataaatatatttgaatctatttttttaatagttgatacttcttcatcatattcatcttctatctcacccataatttcttcaatcaaatcttcaattgagactattcctgaaaatccaccatattcgtctattaatatagccatatgtttcttacaagactgcaattctttaaataattcatcaatattcttagtctctggtataaagtaaggttcttgcaatattgacctaatatcaacattatcaaaaccaaattttctagcttcaataaagaaatctttcatataaagaatacctattatattgtcagtatcaccttcataaactggtactcttgaatacctttcttcaatgagttcatctatatattcacttaacggaatatctatattaattaaatatacattagttcttggagtcataacttcataagctaatttgtcatcgaactcaaatatactatctatcatttctttttcagtttcatttattacaccatgttcttgtccaacttcaaccattgactttatttcttcttttgatactttttcatctaaaccatctacattaaaaccaaataattttatcagtagatttgtagataatgataaaagttttataaaaggcaatgtcacctttgatacaaataaaattggtttaacagaaaacatagcaattgcctctgcattttgcaaagcaattctttttggaaataattcaccaaaaactaaagttatataagatagtatcacagtaactacaactaaagctatttcattgctatatggaataccaatgctttttaataattctccaaaagtccctgataatccagtagctgctgatgcacttgaaaagaatcctgcaagagttataccaacttgaattgttgataaaaattttgtaggctcttccattaattttagtaatatagttgcttttttgttaccttcctcagcaaggtgtttcaccttatttttgttaattgatacaatagccatttctgctgaggcaaaaaatgcattaattaatgttaaaatgactattaaaataatttgagctgttacattcgtaggcccgggttcggtttccattatttttcctccatttaataaaatttaaattaataatatcacaaatttatttttaagtaaatatatgataatttctggttcattattactgctaatactttaaaattacccaaaccatagaatatctggatttatttattctctattttcaacattaatttaaatcatatctatttattaataaaattattattcaatagcaatatatacctccatgtaatcactaccatttttattatattctttttcgaaacatgaaaggatttctttattttctttatgatgtagtccattcacctccatataacgcataagtgttttgtatgcgttaggaattattgtaaatggtgatttaaatggatctttaattgtaattattgcataaagttgatctgactgtgtaatttttttagaacattctatttctgaatatttaggtattataagtgcagctacgtatccatgcatatggtatacatttatttgttcctgagaagcaaaggggaaatcccaaccaataatctcaggctgcttaataccagaattaatagcccaatcataaatatgtttttttgcatcttcttctggctgaggactaatcacttcatattttacatattggaaggaagatactttttctacacgaatattagtataagcttcattatccaaatctatatttcctaataccatttcatctaaagagcaagaaaaaagattgcaaagtgcaatggccttttccatttctggaaaggcacagtccatttcccattttgatattgtttgcctagatacattcattttttcagctaattcttcctgcgtcatttttttatgcatttttctaagaaattgtaaattttgtccaaaactcattttgttaccctcctctttaattcatatctaaagtatagctgatgaaaattcagaggtacaccaacttacattttctattttcgaaatatacgcaaccttaagttgctgtatttaatatagtatattttctataatttaaactattattattacttaactcttctattagctcaaatatatataatatttcaattgcaataccaattcataaattttaaaagtcatatttaaaatattctttaacaaagttagccatagaaaaatctttatcttctttacctatataatctaaatcaaaatcataaaaatatagatatgctatactatttttttcatctgatgtacctatgattccaaatgatttaggatattcaatattactactctgagtatcatctattactctaaacttataactatttattgaaaattcattttcagtaatatagtattttgtctcatcgaatttcgatttaacttctttctttaaaaaaacataatcatcatccaatttattcttttcattttcataagtatcgtcatcataatttacaataagagcaatagaatcagattcaaataacaccattgatctatgagtacttacatattttatatcctcatattctggcaaagactcaagactcggcattacatcttttgcttttgaatcaattttattatccctactaagatattctttaatattagaatttgaattactacatccaacgctactacaaacaaacattaatataataataattaaatatttttttataatatccacccctttattacctataaattatattcattaaccgaaaaacttccccttataaaagttctcgtttccaagtttctttgctgtcaacctgaacataacacaaccatctgggcatacaaattccttgctatattttccattcccacctatgttctctaaatctccaccacttcggacagcttccatgattggaaacaaaatcatcattacttttgaacaaataccctgcccttctgtatttacaggacagccatatgtacagatgtacttatctcctacttcttcaccatttctacaataccgctcggtgtgatcactgttaagaaatcctattacctcaatttcaaattcgtattcctcatcataccattttttcattgttaccctccaatttcaatttgctatttacttattataccatattttacaactatcgctttacttctcatgcataacagcattatagtagccaagtttatggaagttataccattctatgatgttattctctggtacaacttttaaagttaacattacttctttagcaaattctaaagctgctgtaccatttgcagtaataacgtttttatcacttacagcttgctgcataatatatttttcttctcctgtataggactttcctgcccattcctttaagtcatttaaatcgttacttgtatgatttacattattcaaaacccctactgtaccaagaaatgctgaagcatcgcaaatacctcctatcactttgcctttcttaaaacactcttctactaaaggttttacctgtttcgccttttcatttctccatgtcattccaccaattaaaattaaagcttcatactctgaaggaattgatttaatatcataatcaggaactgtatgaaccccccctattgatgcaatactttcattagttaaagatactgttttaatttcataacttccatctcctagcatattaatacctgatgatagataagctgcttcccaatctgcatactgttgtaatataacaaataaaatagtcttcttcataatatctgttctcctttaaataattcttattttcttaagtataataaaataactatgacagctgtatgtcatagttaggaaaataatatcttattatttatctaataagttcataatcaatagaagattctatatctgttttttctattttaaaaataacaggtcttattccatcgttacaagagcatattgcaacaccttctttttctatccaatcttcataataaaacttttcagcaccatgggatatagcaaatacatattgatacattgccttccatgcttcatcacacaaaccctctggttttgaataatctccatagaacagatctcctaccttatgcataggacactttccaatgtttttacaaccatatttttttgctaaatcttcatgaaaggttgtttttaatacctctatcttacactttttcataaataatcctctccttacatctatgttttacttatatcagtatatgtgttattttatattcaaacaagtatgcacttttaggtaaagtactaacattaaagttagtattaagttgtaggatggtgataaaatgagtatgaaaaattttgaaaaatctgatttaactgacataaaatctacaccatttggatatacgctttcaattataggcggtaagtggaaaatgattataatgttttggttaatagaacatgatgtattaagatatggcgaattaaaaagatgtattggacaaataagcgataaaatccttaataaccagctaaaagaactggaacgtgatggtattattacaagaaaagaatatcctcaaatcccacctaaagttgaatattccctttccaaaaggggcttatcattaatgcccattttagaagaaatgtgtaaatggggagaacaaaataaaataaacttataactaatgtcagcacaatacttgctgacttaattataactttaccttgtaatattctccctctcaatatgcatagtttttgcagtaagaaattgttcaacttagaacaaatactccatcatcttttcaggattttctaaaaactttcttgttatcatgtaattatggatttatgtcaatatagtagacagaaaaaatcgaaaatttatgcaattttccttgctaacgcttcgcattgatttggagtcatataatttatagcagaacgtattctttttctgttataccatccttctatatatgcaaatatagcatagctttttttaatatttcattttcctctttaatacgtgccatttctttttttaatttcataatttcatttacagtaataacttcttcataattaactttgatttctttacctatctcagtaactgtcattccttatttgtataattcaactatcatatctttatattcttgatcgtagcacttgcctttacccatattggacacatcctttcttaactaaatattattttacttatgtccactattttatactaacaccaggcgactttaatatagccaccaagttttgcttttataaaaagaaaaacggcagctttgattgttatttcaaaacctccgttagactactgtattttgttaaagcgcataaaaatcctgccaccacaacaacggtttttttattgccgttgggcggcatagcttactaagcataagctaccaagcattaaacattctattaaaacaaccttttcccatctgaaatatttatatcaagctcttttgccaagctagtttgcttaaatggatttattttttccactacgttgtcatgtttgaaaagcgagcctgtatttttgaaccaaaatgttacatctgcttttacgcattgttcacggatattaagcacccaatcataatcacaaacacgagcttctcgccctgtttcaccgccaacagtaacatggtctacaccattaaggtatggtgttaagtctatcgcctctagcagtggggcacaagcaataaaacgccgctttatcggataggataaaaaaagcggaagtctataatcggcaagtgtttgattttccaccgtacagccaatattcacattatcataacctgtaccccaatcagatggaagtgatacaaggaaacggtcaattctctttgtcaaaatcaaaaaatcaatatctgctctttctttgatgatagaccaaatctctttacgccattcatctgcttcaggcaagaaaaagtcagtcgcaaaacaggttgcaagaattttgttgcctttaatattgtactcgccctttgcggttttccttatcggccaatcgaatttatctgttttttgtatggtgttttgaccgtaacgtttcgcatgtggtccataaaaatagcaatttgtacagccgtcactaattttgtaacagcctgtccaaggctcccaattcatagatgccctcctttatttagagtaaaatagcggctttgatttaccaaagccaccatgtgtcatagcccaaagctcgacgcgtaatgttttacgacttcgatgggaaacattgtgcgtgtagaaatttcttctggcgacattccttgattaaaaaaacgtttgataaccgtagtcatatcctctgcaatctctacaatatgtttgtcgggatcatatactcgaatgtcacgttgcccccacggatactcttttatttcatgtacccattgcaggccggatattctttttagttcggcatacacttcatctaagttttctacttcaaaatagacttggaagctgtgtgactgctctttcaagctatctactgatattccaacgagttctgcatatccttgttgcagcgaaaaaccctcataggtcacatgcacgccaatatccatgactgcattttgatgaagtactttttcataaaaatacttagaagtggatatatccttaaccgctaaaagacaaccttgatatttcatttttcaatcctcctttgaggatattatatcgtatatctctgttccgtcatagtaaaaatccgacattgttttcagatatttttgaggtgaaacaccgctgatagccttgaaatctttataaaaatgggcttggtcaaaatatccggcttgttgcgataatgtcgcaaaaaggcaaggcgatgtttgaatgtgctttaatacataattaaagcgagttaagcgtgcatagcttttaatattcattccaatttgtgtaagaaataatcggtttagctgtcgttcgctataatgggattgtcttgcaacttctttcacttgtatttgtccacaattatcagaaatcactttggttgccaacagtaaagagtctgaaacaacatgcctttccatgcgtctgtacaaaactttttcacaagcatttgctaaatcagttgctgttttagacattacgaacgcctcaaataatgactgaaaaagttcgctgtcaatatccgcaagagaaagacgtttgcctgcaaactccgcttgactctgacgtgtgatttgatacagcccgatgggggaaagttggataagcaaaagtacacgatacccatttggctctacacctaacaaaacaggggttaaagatgctccccacagttcagcaatgactgtatttccatcaaatgcaagtgacagcgttccgcatgcgttaggcataagcgtataatgtgctacaaacatatcattcgacggaaatacgatgttgtaatattgaatatatttcctaagccctacatgggagggaaacatattaaattgtttgtcattcttaattatcaatttatttcctcccttgtttttcaagtaaaacttcactacattcattcaacattatcatttcttcaattctctaagtctgacgaatcttttatcaacaggtctttctgtatctttgaatatcatatatgcgacaatcgtccatttgctctttttatctataattatatgcaatctgagtaataatagcaattggtagtttgtaaacaatgtgctctattctgacctacggacagttattttcaatatattttaataattacataaaattatactccctgtaattttatatgattaaatacagagtttaaattgcattttatgtaaaatataaaaaatatgtaagcgttggggttgtggacgttacaagtgtatgttgtcaacgtaataattatccattagctttcagatagtattcactgagattagaatagtaacatcttttaaactatttatatctggctctaaaaagactatatattacaacttttttgccttttaaaaatttaactgcacctattaatttattcttcttatctttagtacatgaagtacctaaagttattatccagcaataagctattgaaatacatagatacatcatttttattttactttcctcatttcccctagaatagcaatcttttagttcttgagatatattagataaaattaccgaacgtgaaactataattcctattattacagcaactaaattatttaagcgagttgattttaaaatcagcattttttctagcacttgttttaattctgtagtaatatattcttgatcattgatcataaaaaaaaacacctttagttaagattgtgttgttgcaaatcaattttacactaaaataggtggtttttttatcttttcaaattaaatttcttcttaaaatatgaatttccaattatatagctattaactgtccgtaggtcagccctctcaatatgcatagtttttacagtaagaaattgtgcaacttagaacaaatactctatcatcttttcaggattttctaaaaactttcttgttatcatgtaattatcagtcttcttgtacggagttttcacaatttcatcattatcaataacaaatatatccgcatctggatacgccattaatataggagaatgagttgcaataataaactgtgattttttctttaccaattcattaataatagtaagcatagccatttgctttattggagatagtgctgcttccggttcatccaatatgtatattccatttccgccgaacctgttagtcataagcgttataaaactttctccatgtgacatattatgtagagatgtaccaccataactatctataattggcctccccatagaaccttgtgaatcaagattttctatttctgaagcaacattataaaaactttctgctcttaagaagaatccatccttaggtctatttatactttttactacgttaatatatttatataaatctgaatgagtttccattgatgaaaaacagaagtttctcgttccaccttctgcattaaatcccatgttaacagcaatagcctctagcaaggttgatttcccactaccattttcaccaacgaagaatgtaacattacttgataaacacaatctatttaaattttttactacatgtaaattcttaatatagctttcttctttataaatttcttttttgagtccaatttcttttatatacaaattatcatacaacattaatttgccacctcatttatgtcttgttctaataagtaattagctcataagaaataaaaattattcataagttattacatgtttgattccaggctgtaaatttcctatttcttttttaagaaaagatggataagctgtgtatttatcaatatccttaataggaatccagtgcatttcttccctaacaccttgagtatagctattgctatttaattcttgtgaccctcttggcttcattatataatacaatgcaatttcatgacatttcattccatcaagagatccatccccatcaaaaaaattttcatgtataaatgcaagtctatctacttcatatgcaacacctgtttcctcaaaaacctcacgtttaactgcatcttcagctgtttcacccatgtgaactccaccacctacagagtaaaaatacttatctcttgtgtttcttacaaaaaggatactgtcgttttcaataattattgcagctgccctatatctaaaccaattattttcttttgtaaaaccacaatcgtatttcataattgctacacctctactaattataaattttaatatctctctaaattccctgaaactgcttttcttaaatctgaaatataagtatcctgctgtttctttaaatacatacctacaaaaggtttcattatccatttctttggaattatattttccgtaaaacttatctccgtcttaccatctatctttgagaatagtcctatccaatgtccagacatattatcgttctccatatcaaattcatatcgtttcataggctcaattgcagtgattgtaaaagttgtagcatacccgcttcttgtatactctatgaatttttttccatcttctaaaatttctattttacttaagtcacttctccatgaataataataaagagaggtgactatttcccacactctttctatatccacttgtaaagtcgcttttacattcgatattgccatttaatcctcctgtaaattatactatttcaatgctatagtcaatataattactataataatatctccattacttatttcttctaaagattataggtataaaattcacataaatactactcaaaagtgcacttactataatacttaagtaattgagctcatcataaatacacttcaataattgttttccatattcaattgaaaatacaaatgatatgaataataaaatgaaaatgaatttaacatacttatgtttttttactatggatttattgaataacttattatgaacatctgtttttctaattatcaaatcaaatatagcataaaaaacaacaaaaattataaaaagaacaatcaatgtacttttcctcctgtaaaaactaaatatacttttcaaacctgcattgttcatgaatctcttttcccaaaagagtaattgctttttgaggacagaggcttatgcatctataacacattgtacatctatcttctgcaactgcctttttattctttattgttatatttttcattggacaactcattgaacaaacaccacagccaacacaatcattactaatctttatcttatctgaatatccttttgttttaccataaaaccaaagtctttgtgccaaaagaccagctatatgatataaaatatttattccttcttgtggatatattcctcttttaattgcttcagcagtctttcctatctttttatctgcttttattacaatcttcttatttttttcaacagtcttttttaacagtttaacatcacacactgaatctggcatatgaatatgtaaaccaccaagtattatagctccatacttttttagcaatcttacgctacatccagccccatcaccactaaaagcccccattgttgcaacacaaataacctttttatctttccaaatcatagaatttcttcttataaaatccctaaccataaatggtgaattagaatactgaactggatatcccagtatgactgtatcattttttttaatttcttcaataacattatcatcctctaatggaatagtctttgatttagaatccattaaatacgctaatttttctatacagtgttttgtattgcctgtaccacttaaatataccccaatcatctatttacacccctacaaattcaaatttgttcataaccaattatagcatattttgtaagtatatcttagctaccggattttatttcatatccattgtctttaagaacattaattgccctatcaaagttctcttttttagtaagaatatagtcagtattatatgtagatattgcaaatattccaattttattttctgcaagtaaactagatatttttgataatattcctataagggaaaagtccaatactccctctattctgaatgctttccatccattgtcacattcaattatattttctggtactaaatcagtactacatactaatgaaaattcctcatctgtctttcctataaagcaaaatttatcagaataatcaatctgtgataaatccttgactttacatactgaaaaatcttgatttattatttttagttccatttaattccctccaatttcttaaatcgtaaatttattatttgcaaaaaagcatccatttgcacatcttctaagacctaatgatgtacaaatgaatgctcgctacattcttacccggtggtaatctttaattcaatatatcacatttatggaaaagaaatcaacttgtattccttcttccatacaaaatttgttgtttactaaaaagctccctacataattacattaaatctgtactacgtggttctctcttaatcttgctaggaaaattcttttcaaagctttcaagttcatcatttcctatgtaaaagcatgaatcaaaatcataaataccacacatatttttcaaatatccatcttcaagttctcttaccataaaaaattcagcttcatcctcttctgacattcctggaagcagtattttgtatttacttgcacattcaaatccaaatttattataataatttgaatctcctgttattaaaactgctttaaatcccagttcttttgctttagccatagtataattaataagcttctttccaataccacttttctgatattctggatgtatactaattggaccaaaacaaataatatcttcacacatctttttatcagttccaaaaaacattctactgtatactatacttcctataatcttgtcatcttttaatgcgacatagtccaattcttttataaaagattctgcatttcttaatttatgcaaaacaagatgttcattacagccgggtctataaacatcccagaatgcttctcttgttaaattctcaacttcaaaaaaatctttttcattttctaatctaaatttcatttagttttcatctcctatagttaaatccatatggtataatccaagtataacatattcttagagtctttattttaaaaaatttctgctactcacctcttattaattcagataagcttatatatggatttctatatctgtttttgtttactgttgaatttcctatatttattgctttcttaggacatatgttgatacatgccatacaatctatacatttcccattccattttggtttattatctataattgaaatgttttctgctggacatatctttgtgcatattccacatccattacagttatcattcgaattaaattttttatctttattttttagagtatccttaaaaaatctatactcatattttcctagaatacttacaaatttgcaggatttcttctgtctttttcctataacctctataaattcttctattttatcatcatattttgctattgcatcttttaaatttttctctgacgggtttgtccctaatttcaaataattagaagtatatttaatcgaaagacagttatcaatatttcttccaataagtttattaatctgataaaaacttgtattagaagatcctcctcctgaaacacctactgcaaaaacatatgactcactctttatttttaatttagataaaaaatcatacattgttattggaactcctgcgtaatgtattggataaacaaaacctataacatcatcatctaataccatttccccttgttcacttattttaggtatacaaacaagttcacaatcattaattttctcctttattctttttgctacatataaactgttgcctgttgctgtaaaataaaaaatcttcatatctttcacctttcttgtaaccaaaattataattttgattatgaattttatttttatattctcttcacaaatatatccattctatattttgacaactatcgaattatacagccataaatgactataataagtcatttatttattgctatctaatttaagcatgtcacatgcttcatctactaaatctttattaatttttgcaattacaaacttgccctttttctcagtaaaaatcaacccggcatttgtaagttcttttaaatgatgagatatagtcggtgctcctatattaaacttgcttattatatctgtaagaaaacactcacaacaattatcatcttcatatgatttttctgtacatcttaatatctccatatatatctctaatctattttcattagatagtgctttaaatattttcgctagttcttttgaattcatatttcctccaccaaacaatgatgttctttttctttagaatcatagcatattgctgctataaccatctttctatcttcattttcttttataaacttctgtgcatattctttattttttatctgctttattgcattttctggagtatcatctttttttaattctaaaataaatgctgtatcattttttcttcttggatgaaatgcgaagtctacaaaaccttttccgctcttttcttcacgttctattctataagtgtcccttgctgaaagatatgccagtgttacaacacatgccagactattctcgtcattatactgcaatataggaatttctgaattatgaacatcatgaagtatttctgccattatttcaatatctccattaactgtagctttaagcatcttctttgaattttcaactatctctgaaacatatccaaaggactcatcctttaaagccttttcaaactctttcataagttctttattaggtattcttaagtatccatcataatatgataaaaatccaagaactatcattgccgaatatatttcttccttagttcgtggtgctctttgccccgctctgaattcttcatcaattataatatcaatttcatttccagcaaccatttctataacatcttctctaatgtcatgaatgttgtactttagatattctgcaacttcatccattgctcctgtatttgtccagtaacttctgcattttctatttacaagagattttacaacagatctaggattatatactctttctccatcttcattcatatatccattataccattcactaatttcattaaagtatggtttatcttgtttactacaaagttcaaaaacctctttttctaaaaatccaaaataatctccatactgcaaatcatcaagcattgtaaactcatcaaacatattaagagctgatccacttgaatatttttttattggaagaactcctgtcatatatgctaatgctacataaggctgatcttttagtaagtttctcaaaaattctagaaaatcattttgatgttcttcaaacagattattgttaaaaatataatcccattcatcaaatataaatataaatctttcattagttgctctaagaacagtactaatattatagaaatcacctatatctatctctgggtaattatctgaaatatccttttttattgaattcttcaccataccaatataatcttcatatgtattcatatgatcaggaatttcattaaatgaaatatttataacattgtatttatttaagttttcttcatatccatcacatctgcctatatttaatttatcaaataattcttttgaatgaacttcctttgaataataggctccaagcatatccgctacacttgattttccaaatcttcttggtcttgttatgcagacataacaatttgttgtgtctattatttgatttaatttatttataattaagcttttatctacaaaatatggtgtatttacaagcttattaaagtttatatatgacttatcagtatttaaataaatatttataattttcagctccttcctgtattgatatatcattttttcataaattattggttacattatatcatactttaaattcttatcacataatcattttattatacttctataactatcaaattataaaactatattattccgttcttagaaaatagtcaagataattttaaaaataagattctgttggtctaaattgttgatatatatactctaaaataggtagtccagttttaacttaaaattagactacctgttaatacataatattaatattgtatattagtgctaatatcaatgtctttatcataatttacttaatcaacctcaatatttaataactacttcatttaattttcttctgcccattttctgcattgatttatcttaggttttggatcaaagccttcttcaacacccatggaagagagcatattgcaaggaaattgtgaacacttgccacaatgatttaattctctttcttcacagcattttttcacaccacattctccgccccagaatggtttttccatattaacacaaccattacaatttaccttttctcttctttcgcaactattacaacatacaccgcatctagattcaaacattttcttacctccagttattatttttacaacatatccattcaaataatctgatatacttagtctcctattatattttcattagtgatacttacacttcataatacctattattaaaatattcaatatatcttattattaaaaacccattgcttcctttacaacttccatttcttttttagaagttaatttttctaataatgcaaatgcaactccagaggcagtagatagacaataagatgtaattacattcttatcaataacaattggctcattaacaacatttttaaagatatattaaatttgtacaatatgtttattaactttgattcccgttacattaaatcatactcttctcttaaaatagaataatataatctatcaatatatttattttcactttctacataaaagaaatcccttaaagttccttcatacgatgcactttcacattaacaaatgccttcccattctttcataatctgttctaattctctttctatctcttccttatgaatacaaagcttaccagctttttcataatccgctcctgcctcaatcattttcctttcaatttcttgaagcttttcctctaagctgaatattttttcctctagtttctttactctgctttcactcaagcgtttcttcttctgttcttcttttttctctatccattcatttgaaacttctttttcaggaactacttgaattttttctttaacagattctaatttaactttttcatttttgtaataatcatagtttccttcatagttcttaaatttcttgtctttaacttctattattctgttgctcattttattaagaaaatatctatcatgggaaataaataagattgttcccttaaaatctcctaaagcttcttccagagtatctattgaatttatgtcaaggtgatttgtaggctcatcaagaattaataaatttatatcatagtaaagcagttcacttaatttcactcttattcgttctcctccagacagattcttaatcttcttgaatacatcacttccaaagaacataaatttcgctaaatattctcttgccttaccttcaagcattgatacattattcctaaactcatctaagattgtcatttcttcattatcaaatacgatattttgaggcaggtatgcatattttacactatccccaatgataagagttccgctgtcttgtacttcttcaccaagaagaatccttaaaaaagtagtttttccacatccatttgatccaataatacccaccctgtccttataacgtaccatcaagtctgcattatcaaacaaaactttattattgtattttttgcttaacccttttaccttaataacttcatttccagatctttcagtttcattgaaatctagtcttacggtcgttttatcaaatttcggcttttccaacctttggactttatctagtgctttctgcatgcttgcagctcttttaaagaatttttcattatctcctctggaagcccagtcccttaatttttttattgctttctccatagcttcaatttttttctgctgttctttatattgattgaattgaatcatcatattttcttctttctgtttagtgaatgaagaataattcccattatagctttcacacatcatatcttcaatttctataattcttgtaaccacattatctaagaaatatctgtcatgagatacaataataatcatgcctttataagctcttagaaatccttcaagccattcacatgattccatatcaagatggttagtcggttcatcaagaagcaatatatctggattttccagcagtatttttccaagcattaaagtagtcttttctccaccacttaattttctgaagctgctttctaagaatgcctcagttatcttcagaccagtgcatatcctacttagtttttccttctgctcatatccgccctttgaatcatagctttcctgaaggctgctgtatttttttaatgctctttctaactccattccatctagtgagctcatcttttcttctaattcttttatctcactctcaattttctttacttcatcaaatgccatatttaatatatctgctgcctttaaggcgccaggataatcaggaatctgttcaagataacttatttttgcatcccttggaataaagatgtcccccttatcatctcttgtcaattgtataattcctgcaatcaactttaataacgtgctttttcctgtaccattatctcctactatcccaactttttctcctgagtatattttaaaacttacatcttcaaaaacctgagtcgaatccaggtatttttttaatttattcactgctaatttaaacatttttcttctccttttaaattatcctaaccattatcactaaattacactttatttttaatttctccctcataatatgtaatcttctcatttaatttttccaaatgttcattaagtgtctctatttcttcttcaagcttattcttatgctgtgtaagcataaccattctttctgtcatggtagactccccatctgagcgtaattcagcgtacttctttatttctttaataggcattccggtatctttcaatctttttataaattgtatccatattatatctttctctttgtatacacgtcttccattactttttctatctggtgttattaaatgctcactctcataatagcgtaatgtatatatacttatttctgtaattttagaaaattctccaattgaataatccatataataaaattcctccaaatatgcttgacctctagttgactctagataatataatccaagtatagcatattttaggaggtattattatgaaagaaaaaaataaatatacacttattacaggggcaagctcaggaattggatatgagagtgcaaaactttttgcatctaaagggaaaaatttaataatcgtagctcgtacaaaaaacaatttaatagaattaaagactgaaattttgaaggagaatccttccttggacattgtaattaaaaatactgatttatcagttgtaaaaaatgtctatgaactttataacagtttgaaagattataatattgaaacattaattaataatgctggatttggtaattatgataatgtagtgactcaaaatttaaataaaattgaaacaatgcttgatcttaatgttaaagctgttactattttatcctcattatttgttcatgattataaagatgttgaaggtacaactcttataaatatttcttctgccggaggatatacacttgtaccaaatgcagtcacatattgtgcaagtaaattttttgtaagtgcatttactgaaggattagcacatgaacttataataagtaatgcaaaacttcaagcaaaagtgcttgcacctgctgcaactaaaacaaactttggaaatgtagcaaataatatttcaaattatgattatgatgaaagttttggtacttaccatacaagcagagaaatggcagaatttttatttgaattatacactagtaagagcattgttggattaatcgatagagacacttttaagtttaaacttactccaccaatgttccctgattcttataaatccacacataatcaaaatttatgataacaaaaaagctcaatgcctattaattatctggcattgagcttttatatttaaagatatcttaaatttcatagtagctattattaaaatactcaatatctgataatatacacatcagacattgagtattaatttttaaactaaaccatatattcttacttccagcgtgctgtatcttaaatatttcccttaaatttcatgtttataaacttattttctgcaataaatttcaatggctttagccataaattctgctgttccttcaccgttcttatctatattttctttaaatcttttatcacttacatacatctgtccaagtcccttaagtatttcttttgtgcatttataataatattttgtaatatgattctgccacttggctacaagcttctgaactttatcctcttctggatttaaatttatgttattataaaactctttcataataacggtatattcaatattgattttttccttatcttcatcactataagatttttctttctttttactctgctcatattcttttgtatttccatacagcttttgggcttcctctgcatatttcttcttcactttttcaatttcgtctacattaaattctttaaaactcatgttgtcttctccttttaaactattatctataagctctataatctttctaagacgcttttcttttaaaatcaaaagttctttttgcttttttaagattacaaatttatcataatgaggctgtcttataaaatttgaaatatccttaagtgaaaactccagctccttgtagaacaaaatctgctgaagtatttcaagagattctttatcatagtaacgatatccggattcacttatttctcttggctttaaaagtcctatctcatcataataatgtagtgtgcgcacacttacaccactaagttttgctgtttcacttatgcttaatttcattctgctcacctcacatgttttataatagtctatcacgttacgtaatagtcaatactttaatttaactctccttaatatattctatcaattcatttttactccataaaatagtaattcaaaaagaccatgattttattacatcacagtcttcactttaaaattaatatttaacaaattatataacttcagttaattttccttctggatcagcaatataacatgttcgctgtccccatggttctgtaattggttcaaatactgatactgccccattagaaatcagatcattatatgttttatctatttcagacaaactttctacactatttatctattctaatataaacttttctattatatttaacatcttaaatctgtaatctccattttttctggcatgtttaaatactgtttctaaatcatttcctatgtatgactcatagcatgttaattttaaatattgttctacagcatttattaattgcaattcatctgttctttctattgttttcatatttatcctctccccctgctttatacaattaaactcatcccaatgcgaacatatgtttattatattttacgctacatctactattttgtaaagtaataaatttcaataaaattccagtttacttgtaaatagagtcaactcttttgattaatcatcatctgtactagtaatccgttatttaatacttgtaacaatacaatattctattataggatcatcgaggcatgtctttattattttcctactcctaattatgtggtagactataatataagacactaaataaatttaatattttaaggataagttttatgaggaaaaaaaataataatgatgatataattaatttcttactacagactatagagtatataaaatatatattatttgttgtgggtatatatattattgtaggattagctgctgaatttaatgatattgttataaaaagctttttatgtatagtagctactgctgtatattatcttatatataattggattgatatatcttttataaaaacagttaaagcgcaacagaaaagattaaaagaaaaacagttaaagaaaaacaagtattggtatatactgtttataattttgatagctttattgattttaacaaataattcaagatttgcagcttgtatttcatattctattttaactttaaatatgttcatgctcatatggttatttaaataagtaataatcttgaaactatttcattaatttaatgcatacttaatattatttattaaattaatgaaatatcaagctgcttttatgtcttaatattatcttttatgaagataatatgtaatttttgcacctcccagtatatctgaattttctaagaccataactccaccatgcttttcaatcatttttcttgagatgtataatcccataccataatgacttttagaatttctgcttttatctcctctataaaatttttgtgatgctgatgttaattcttccttagtaaattccctacctgaattttcaattgtaataactattttttcagaatcttcacatactgaaaatattatttttccatctataggagtatattctactgcatttgaaataacattacctattgctctttttaatgcatatttatctgcttctattacttctggtatatgacctctccttgtttcaaagcttatttttttatttacacacattgattctgcttgatttattacttcacatataaacttatcaaaatttattgttttcttttttaatttcatttctttatcacacgtcattatttcaattaaggtttttatatacccttccatattttcaacttctgttaaaatattttgagtaaacttatattcctcatccgataactttccttcatctatcagctctgcatttccttttattattgttaatggagttttaatatcatgtgccatagccgcagtctgttctttctgaattctttccatttcccatttatcattaagggaatttttcagttcacttttcataatatctaatgacttaataatatcatttatctccgctattctagaataggttacctcaaaatctaaattctccatttgtattttttttgtagtttccaaaagaaacttcatttcttttttaattcttttcttaaacatatttgcaaagattaaaatttctacaacaaatataatcaatactactatgtaaataaacatttctggatctggtatatatttatttaagattggattcacaaaagaaggttttatctcatatgccacaatgcatatatcttcttttcttggtattaccttataataataatttccaacatttattttattattttctaccacttgccatacatcttttgctttttcatttgtcatatttccacttaatacatttccattaaaatcatataacgaataaaaacatctatctggtatcaattcatctattgattcttcctttgaaattttatctctattactctcaatcttctgctcaaaataattagctggatacattatatgtgcattaaatgccaagccatataaaaaaattgtaattgcaatgaataatatatttgttatacaaaagcagataatatatttcgcaaaaacttttgatatactcttttcttttactattctttccacttgtatccgatcccccatactgtctcaattgggtttattccaatcttcttaaatttatttcgtatatttttgatatgttctactatagctaaaatatcactttccccatcaaatccaaatacattttcatatattttttctttagaaaatacctgtccatgattcaaagcaagatattcacatattgtatattcacttttagtaaatggaattatgctttcattaaagcttatttgtttagaatacaagctgaattttatacctgaaatagaaaatgcattttgtttttctctatgctctcttcttaaatgagcatcaacccttgctctcaattcctttatactgaaaggttttgatatataatcatctccaccaacacttaatcctgtaacaacatcttcttccatatttttggccgtcaagaatattatgggacaatccactaaatttcttattcttctgcacaatgaaaaaccatctatttccggcatcattacatctaataatatcaaatcatactttagatattcattatctaatattattgtcggattatctaccatcttaacattatgacctgctttctccaaagcactttttataatatttaatattccaatttcatcatctattgctaaaatatcagccataatttcatcctttcttaattagatctgattataatactattcacaattactaaattcaaaataatcaaaccacatctttaatgcaataccccctacaaatgtaattataatacaattaataaatcctgcagcgcactgtttaatccaatatccagtacctgctaaagtattaaatacatctgctgttccagcttcttttacaaaaaatccatcactaaatcttacagcaaaactacacggaacatatctccatataccatcaccaagacctgttatgaataaccctgaaatcatactttcaaatatacccattccaattgatactccacttccaaatcttatgcttagaaatacatgaaatagatataaagatatctgcgctataaatacaactactgctatatttatatagagatttattgaaaacatattttgttttaaaaaatattggaatcctacataaaatccacttactgtaattataagggatattgcaccgcatattatcattaccataagcttactaaaaagacatatccccctactattttcagtagatatcatttctttaaattttcctgcttttttctcctgttccattactaaggcacatattactcctataataagaggaaatgcaattgatattgcttcaaaaaatccatttaattttgatattgaatttatttttgaatatgagtaatatagtaaaaaagcagtaacaacacttattggcacaaaaatatggatccaataaaatggtgtatgctttaatttcataaaatcagcttttattaatcttaatacctgcatttattatcttgcctcctgtttctcataccattttgctgtcatgtaagtaaatactgcaaaaagtataattgatacaacaatagcaaatggaatttgtgatatttcaagaagttctggtttaaatgtctgactgtccttaactgccatgagaccattaggtaaaatcttaagtataggacacataagtcttgctgtatatgaaagtggatttacccaccaccagctttcaactgctgttataatagaaaatattcctgcgcacatacttataataacagatggaaataatcctatcttttttcctatataaaagtatactggaataagccatatacttgtaagaatcattactataaatgctaaaaatccatttataaaattaatattacttatactttcaaatggacttacataaataatcgtctgcgctgctacaaaaatcaagaagcaggaaatagtaatattttttattgcaactaccactttagatacccaaactttttttaagttcacattaagtgataaaacccctttatttttattcttttcatcaatattcaataataataaacattcaacagccagtactcccggaaatattattgtataccaccagttataaatatcaatttgaaaatatggtcccgccattaatgttgaaaaaacaataatcataaatggtgctataaacataagtctttttgcaaaagtccttttaattttcatattttcagaaataatatacttaaacatagactacatttccctcctatacttacttgcaatatccataaataatttttctagattttcttcatttttaagttctccttcataacctaaaacaccagctgatataatgccaatatggtcagcaatctggtttacttcacttaacatgtgacttgataaaatcactgtaattcccttctcagggaatgattttataagttctctaagctcctgtattccaaatggatctaacccattagttggttcatctaatattaaaagttctggattatttaaaagtgcaattgctattccaagccgctgcttcattcccattgaaaactggcctgctcttttctttcctgtattctcaagttctactatttttaatacttccttaattcttgaatctggtaaatttaatatagtagttcttactttaagattttcttctgccgttaaattttcatataagggtgcttcttcaattaaagaacctatacttgctaaatcctttctattccatttgtggccattaaaaagaatttcaccactacttggcttaagcattcctgtaatcatctttaatattgttgatttccctgctccattaggcccaagtaatccataaattgaatttctatttacctttaatgatatatccttaaccgctgccttttctcctttaaaatttttacttaaattttttgtttctaaaataatgttattcatctttatccacctcacaattaacatgataaatgttaattataaggattttataaggaaaacttatttttatattttgaaagattattttttactctctacatctatttttagtggttataattcaaaacataattaaaattaaactaaaaaagctcaatgcctattaaattaatggtcattaaactttttttgatttctataaattatctattattatgataattacctatatcttattattcaagtataaaatttcttagaaatgtaattacaattttatttttcctcaatgcttcctgttatattccaaaaattctcaactaatattctgtagatttttttgcatttttacaaatactattaatatagttttatcatagaaaactatattaatagtattaagaaagaaggccttaatatgagcaaaatgaaaagtatccaagatttaaccaatgtccagacaaaatcatgtacaaaatgtgctacaaaatctaaagaaccaaatgatgggactttcatatcttatgatccaaaagatagtttcagtgctaaaggaaccgtaagatatggagaagaacaggatgtagatgacttataatccttactccccatatgatttatcaaatttcactgaaacttctatttggggatgagcactacaaaactgacttattacataatagcagctgggacatggctcccatctgctatacataacaagattacctctatcatcaagtttcttttcttcaatctgtttatggatttcctctaatattttcttttcactatcataaaatctattataaccaattccaatcttcccaagtctattaaccctgcagctttcaaatactgtttcttctttttccattgccacgcagtaatcatctacttcatcacttccgcttacagctttaaattccttttgattatagactgccacagctatatttatagaatcctgaagagctttgctttggttaatctcacaaactgtatttccttcttcatcactggttattttcatatatttatcaagattttttatgagacgctttatacgtggtatatttcttgatatatgttcatgatattcaatagatccttctaatggctttatataactaccattcatattttccggtatatctatgtatattctcttgttacatgtaaattcatcatatgtattcttaactttacctttatctttaataatcattttttttagtaattcaatatctttagcatagatatagttttcatcaattcctgtctccaattcatataatctcaatttttcatattcatctatttttccacacatagtattcttaacatttttaattgcattaagcatatgctctacatcttcttgaattgatggttttctatcatattcaatcctatctatatggattttatctactttacaaattttcttccaaagtattttttcatattccttgatttctgtaatcttttccatataatcaagaaaatcttgaacattattagacctataattaatctctctttcacactgactcatattagaataaatatgttctgcaacactgggttttatattgaataaattacaaatttcacttttaaattcctcaatatttaaattttcaaaactagctacatcataaccctcatttttcatcgccttttcaagttcatctatggtctttatattaattcttactttttttctacctatttttatttcagtctgcgtcatttatacctctactataataactaataaatttatatgatttctaaaattaattcaaaaatatataattccaattgttaattggaacagatatgtttattatatctgagtttatttctttagtaaaactttattgttactacatatccctcacaaaattcaattctaataattatataaattaaaaaaacagcagaaaaatcatcttcttatatgattttcttgctgtctcttataaaaaattgtagctactaattttcacttgattcactatttgatacctgctgtttttcacttgcagaatttacatttgtatcacttgatgatgaagtgcttgactgatttgcttttgtattaccagcagtatttgttggcgtactagtctttgtactttgatttgctttctcatctgctgactgtttgtttgtattattattgtttgcagtagatgatgaactatcctgatttttttcatttactgtttctttatttgcatctgtattcgatgctgatgtacttttattttcttctgaatttgcattagttttattatcagatgcttttccattatcatatgatgaagaatcttgtccctttacttcattactgataccatcttttgaagatgattttgtacttgagttttgattttttccattattagatgtattgctacttgaatttttagtcttttcatttgatgaggtatctatagaatttgatttctgctcagtatcactttgaatactctcatcctgtgctattccagatatacttttataaagtccttttcccaaaaagacaatacataataatgaaattatagatgctgtagtaattaaagtcttcttattcaaaatactcttttctattttattcttctgaatatttcttctattcttctcttctttatttgaaaataagctacatattttttgtgaagttcctgataatacagtaaaaaccccattgttttctccatggcctatctttttaaaattctctggtgatcgtaaagttataactggcttgctatgttctccttgtacatcatccacaaatactttaactgaaaactcatcatttttgctcaaaaaaggtatacttacattaaaattattatattcaccacatatatcaaattttaaccctcctgttatttgggcatcgtccattttcaaatcgttgtggtgtccttgtacattaacagttaagtcatgaagagtcttatttgatatgttttttactttaagaatatatgctcttatttttttattgtttatttttataggtacacattttcccatagtacatgatattttaggtgctaaatttttgtaattatctagtaatactcctgatataaatgatattatgattgttataattgcagttttaataacacttagcatattaatttcgcttccttttttttcatttttacgttactaattgtaaaatatacttttatcaatgtcaatctgcaaatttagctttagactacatataatctatgtatataatacaaaaatgtgtttatgaacaagacttaataatatttgtttaattgtcatttaaatataaaagctctcagcaaattaatctgagagctttactattttcttttaaacaactatattatttatccatactccttttttaacaagtacataacctattatgcattttattatacttataagctggcataataaatatattgttactattccaattgatgtaaagttcatgagaatgtaagcaaatggaattgatattacccatattgaaacactatcaaaaagaaaagttataaatgtctttccacctgaacgaagagtaaaatatgatgcattcataaatgcttcaagtggcatacacattgctattattagtataaaatatgatgcataatgccttacttcatcagttgtattatatattttagggaagaatggcgaaattaatgacataaataatccaaatcctatacagcttacaactgaaaatactataagttttgtgtcagtatctttggcttcttccatctttcctgctccaagaagctgacctacaataatcgaaactgaacttccaagggctatatatacaatattaaacacattggatactgtatttgaaatattaagtcctgcaactacagcaaggcctccacgagaatatatagcatttaatgctgacattcccattgcccatagtccttcattcattaaaagaggagttccccttaatataatatgttttgtaagatttttttcaattttaaaattacgatatgctcctacgataaatttatttctttctttgtgtctatgagtccatattacaactataaaacattcaataaatcttgaaataactgttgcaatagcagcaccatatgcaccaagcattggaaatcctaacttaccaaaaatcaaaagataattgaatacaagatttactgctacagctacaatacctgctttcattggtacaatagtttctcctgtttccctaagtgtacttgagtagcattgcattatagcaaaaggtataagacctattatatcaattgctatatatccgcttccgtatttcaatgtttcagaaatatttcctgttacacttccctcatgaagaaaaagtgaaattagttcatgcctaaatgtacccattataaatataccgataacactaattattccacataatataagtttaaatctaaaggtttgtcttacaccttcatgattatcatttccataaaactgtgcactaaaaatccccgggcctgatatcgcaccaaatatgaaaagactaaatataaatataaactgatttgctatagcaactccactcatagcatctgttccaatctgacctaccataatgttatcaagcatacttacgaagtttgttattccattttgaatcatgatagggattgcaattgttaaaaccattttataaaaacttttatcccctacgtatttttttagtttcatttttcacctctaatatttattctccataaaaaaataatataaattcttataataattctttaaatatatatctatataaattttttatcaaagaatattatagcacactgttctacaatattagattaatttgcattcttttgttaaaaaagcttttataacccatataaacacatattaacgttgatattgctgctgatgataatatcatgaaggtaaccattatctgatactttatagcaacaattggagatgctccacctagaatcagtcctgtcatcattcctggtaaagatacaatacctaaagtttttgctgaatctattactggaacaagacctgtttttatgctttcttttaatatatcatgagaagcttctctaatatctgcacctaaagctaatttaatctctacttccatttttttatcattaaactcattattaagatttctataagcaagtcctatagccaccattgagttgcttactatcattcctccagtaggaataatatcttgtggtttaaattctaaagaacctgataatattaatacacttaatgttacaccagtacctataatcatggctatacaagaaataaatactgctttctttaactttccaaacttttttcctgcgttatatgatgcatttataatcattataagaagaagaattactgttataaacttattatctacttcaaagaaaaactcaaggagatatccagctataacaagctgtattatagctctaactatgcttataagtatgtccttttccatagataatttttctttatatgatataaaaactggtattccaattaaaactgatgataaaataagtgattgtgtattcattaagctattacctcaactttttctatttttccattggatatttctattctcttattaaatatggattgactctgttcattactatgagttatccaaagtacagttacgccttcttcattaagacttttaataaatttttctatatttttagtatttttttcatcaagtgcacttgtagattcatcaagtaaaagtacttctggtatatatatgagacttcttattattccaatcctctgcttttcaccaccagatagatgatttatatctttataaagaatactttcatcaagtcctgttatttttaataaataatctattcttgttttatctagttcttcaccccttattttataaggaaattcaatattatccattactgtatcaccaaaaagatatggaatctgagtacaataactaattttctttctaagttcacaaggattatatgtacaataactttttccattaaactttatttctccttgtgatggcgtaataagatctgcacataatttcaagaatgtactctttccacttcctgacggccccacaatagatatacagtctccttttttaatttctagtgataatccgtttaaaattggcttatttcctattttatagtgaatattttttatttctaaagcgttgttcatttaattctccctttaatcttttcttcttacataattaaacatttttattcaatatcgaactctgatatcgtaatccgatattatcatataaaataaaaaaagtaaaggaagcaaaacaaaactcattttacttcctttacttatgtaacatctcttgttaattcctttaagttttcctttaactctttaagaatttttataccttcatctgtagctttatagtatttacgtattttcccaccaacatttctctcttctttttcaagaagtccttcttcaaccatagattttaaaattggatataaagttccagggcttacatgatatccatgatgttcaagttcttcaagcatccatactccatatataggttcaatttctgcatgatgaagaatatgtatataaatgagtccattaactattttcctcataatcacttttttcataatctcaactccatattttcacttacatatctaaaatagcatattatatattttatttcaaataccttaaatccatagatatcatctgcaaataaatataaagccttcatctattattagacaaaagctttatatttaattaataaagtatctacttattttttcttaagtaatcttacatacttattattctatccatgctccatttgatcctaaattatatccaccaacattagtatttacagccatagaaccgtcagtatttaaataataccactttccatcagtatcttttaaccatccagttttcatggaaccatcattatttaagtaataccatttattattaatatatttccaacctgttgccatgtatccattattatcaaaccaataccagtttccatcaacaagttcccactgtaattttggataagaattatcagctcttttcagccaccatcctatattatctttaacccattctgtttttttatctataactgaatctacattattctttgtaaatcccatagcttttaatactggtatcatttcatcataccatctattattctgcctgtcataaaactttgtatctgaatttactgcaaacggtatattagccttgtccaattcatctgatacaaactttgcaaatacaatctgttcttgtactgaataattatttccatcattataatcaccagccatccatgcaccaacccatgtaggaatacctgttttcttttgccaatctagtgctagatttatcttatctattattatctgtttttctttatcagtaccagttgtccataatttttcactattagttttacttggaccagaagcataaaaatgccattcagccattaagtatccattatgattcgttggtatttttaaatcatttaaatattctggattagaacgaactctaggtgatatcattaaaattctttttgaatttgtttttctaacttcagttacaatttcttcatatatttcatttaatcgttctggctcttttttcaattcatctgtaacttcaattattaaatcgaatgacaaaaggtatgagtaatctttataatgctctgcagtttttccccaccatttaactactttctttaaattcttatctgatggatcattttttaactcatctgcctgatatgcaataataggtattatgttattatcaagacaatccttaatttgcttgtccaaaagtttaaaagattcatcagtcatatcatctttaattcttattctaacatgttttattcccatgtcactaaaatctttagctgtttgtgagttatacgcttctttcccttcttttgtttttgaccagtcaacatctaacccttttccaagcttttgtgcataatcccatggtttaattggaacatttgccgcaaaactcttcattggaagtattgaaaagaacaaaaaaagtaaaagtagtgctgatatttttttcttcatttgaaaaattctccctttaaatctaatattatttttataatctttttatttatatcataacagatcataccatctcaacggatttattacattattaagattaatttaaggtatcaagtaatataccacatatttataagtatgatttctttaataattaagcataatcttttaatatattaaacaatatttattaaattttcataatcaaaataaaatcaatagaatgaaccttctaattgattaatcataaaataattatatataatcacacaaaatttatatatcaaggaggctaatttaatgactaattgtgaaaaatcaactgcttcttcacagcaaaattgcttttcaaatgatgtatcatcaagaataagcaaaataaattgtggctgtattccttgtgacactccctcaataataatccaaggggatccatctaaccaaatatcagttcctattttggcaaatgtaattcaaaactgtgtttgtacaaataaatatgaggctgcatatcctaattatttagtaatagaaactaacttattaaaatctccagcatcaggatcaactgccacaataccttatggtaagatatgcattaccaatattagttattcatattcatgtattggagttggaccttcactagtagcgccatattccaccaacacaattacaggaagtattgatggtaaacagtttatactttctccaatatcactagaatgtagctgcggtaccccagtaacaaatttatatactgatttttcaggaaatgtaaaaacatcatcttgttgctgtaatcaggcatcacaaccttatgctcaaaataaaatagttgaaagaaatatatcattttatatttgtaatttgagtatgaatgtatctggtacaataggcaatcagccattcactggagtaataaaaggagcaacaacacctgaattagttgcaaatccaccactagctgtaacagttttccaaaatgcaactccaatatcaaatggtttaggtttcccaagttctttcaattttgcagaagtaatgtgcttacctacaaataccaaattaaaactaactgagaatttcgatatatgtttctctattgattgtgtaaaacctatgagttcaagctattctgttaaagatgatccaactactagtccaacatcatctataccagatacatcgctttatgcaaacttcctagcatctgctgatttaggattaattataaataaaactatgtatgctacaatcattgaaaaattagctgtattaacaaaccaaggttcttcagtagtatgtaataacaacgatataactcctcagtgtcctagccattcctcttgtttaaatgctacaccatgcccttctccttcaattatagattgatagttattataacaaattctatttactgtaatttatgattgcagtaaatagaattaagatttataaattgtcagtataaataatagtgatataaaatctctgtatattattttaatttacatcttttctttcatataaatgtgcagtaataaaatatgatgctgttgttaaaatgactcctacaattgcaactattgtttccattattcccattgatatattaatattaaagaaatcaatttttgataatgcaaaaacaattgtacttgaaaaacatattggcattatagctaaaaatattagtattatccttgctttattaaaacctacaacaatagctatgggattaactatatctacaataatcattcctactattattactgctatatttataattccaactggaatatcttgttgtgatatatagttaaacatatttaataccatatataaaacatcagcaaatataattgaaattattacgttaataaatccaaatatatatttagataaaacatactcttttggctttactggaagtgaataaataaggaaatcagatttactgttactttcataagctaaagaattgtagtttaaaaccataaccaacaaggctgctccaaatggaagcattgacccatcattatttgatattgtcataaatactgcaagtgccaatattataagtgctgttttctttaatgcaaaaattgaactgtaatgtagtttcaataaattttttatattattcatatctttccctctctaatatcattaatatttctttcccttttagttaataattaatattcaaattaaatttgttatctatagattattacttcttattcttctttacataatgtactaatatatcatctaaagaacatttttcataaatagcttcctccccaaaaagttcgtaggcttttcttttgtcatctataagtccttcatatccaaattcatttttacttatagagataaactcattttctatttccttatcatacaaatcctttttaaatttgactaaaacatgattttctaaaatctcgtccttttcaccttgaagaaaaacttttccattatatataaacacaacataatcagcacacttttcaatatcagttgttatatgtgatgaataaaatgtacttatttcttcgcttaacatatgttcgcttattatttcaagaatttcatttcgtacaataggatcaagatttgctgtaggttcatccattattaaaactttaggatgatgtgaaaatgccattgtaagctgaaattgcttctgcataccctttgatagttctttaaatattttgttttcatctaagttaaacttatccatataacttttgtacattttttcatcccaattgggataaaaaggtgctatgctgttctttatatatttaagtctactttcctgaagaaaacctggtatatctcctacatagcctacatcttctttaacttttacatcttctaaaatattcttacctaagactttaatttctccctggtcaactttaagcattcccattatggaattgattgtagttgtttttcctgatccattaggtcctataaaccctgtaacaaatccagatttaatatctaatctgtctatatttaaagtaaaatccttataaatctttttcaaatttcttatttctattgcttccataataaaactagacctcctcatataaatttttaaaaatctcaatacattcatccagtgtaagtcctaatgcttttgcagaaataataacatcttctaaacgtccctccatttctgccatagctgcttctttcagtctttcagaatttgcattggaaacaaaggttccctttcctactactgtttctataaacccctgcttttctagctcctcataagcccttttagttgtaattatgctgactttaagttcttttgcaagcattcttatagatggcaacatctctcccggatttaaacttccatttaatatattatttttaatggaagtttcaatctgttcatatagttttacttgagaatcattgtttatcaaaatatccaaattgtacacctccgtatctaagtgtgtatattctctatatacacatattatcaccatattttgtttttgtaaatactttataattaaataagtgtctacaccatgctttttagttgataattcataggggaaagtttaaagtttccaattaaaagctttagtttttgcttgtgtataaatttccttcatatggttaatccttaactataaattttcaactctataggatttcctttacaaaaacgaaaaggtagaaaacaattattctaactcaattgttttctaccttttattaaattcatttaatttattggaattaatgaaccaaagcccctcaaagttatatgaaatttagtttccatatatttcatatgtctctaatactttttttatttctttatacgaatctaatgtgtctatatccattaattcaatttcattgtctgcatatactaattcaacatcctcaatatgtttttttagaattctctttcctccaatatcacctttaagtgataacaattcagaaatataattcttagaaaaaatcactggatttcctataacataactcttatctgctagattgtctttattacaaatatcatgaatttctacttgtttcctcatgccaagtgcaacaattcctttattagtttcctcaaatgtttctaaaatcttctctaaagtttctttttttatgaagggctgatcgcaaactatgaacatatatccatcagcattcatatcataactaattcctagctttatagaattagaaactcctaaatcactattgttatttatcaacacatttatatttgtatcttttaaattttcttctatctcttcatattgagttacacatattattttattaatatatgttgaagataaatgcttatgagaaataatttccctaactgtgtcaacaatgtacatgtacaaaggtttgtcatttaactctgtaagaagtttatttccattgaatcttctgctaaatcctgatgctagtaaaataagattaattttcacctttcatcattcccatagctattttttcagctgttattggaagagttcttacatttactttagttgcattatatacagcatgcgcaagagctggtgaaggtgtatttataactatttcacctattgattttgctccaaatggtcctgttggttcatagctggcttcaaattcaactcttattgttccaacatcaagtcttgatggaatcttatattgtaaaaatgaattattcctcatcataccagctttattatatgttatatcttcatataatgccattccaataccctgtgcaattccaccttctgtctgaattcttgcaaggtttggatttattactgttccacagtcaactactgcaacatagtcaattatttctacctgaccagttgtcatatctatttcagtttcaaccattcctaccataaacggaggtggagaaactggtgaataattagtttcacttgcacttattgtttttatcccagcaatataacttctatttgcaaaatcttttaacgtgatttctttatcatcttctaatgagaatatttttccaccttcgaattcaagattttctcttttacattcaagaagttttgatgcttcatcaagaatcttttcttttaatgtttcgcatgtttttataacagcaccaccagttatatatgtggtacttgatgcataagaacctgtatcatatggagattgatctgtatcaacaccgtgaacaattatatcatcaacatcacaatctaagcagtcagctgccatctgtgcaagaattgtatcacaccctgttcccatatctgatgcaccaatcattaaagtataaaaaccatcatcatttaattttatttctactgctgctgtatcaacatttgaaatacctgacccctgcattgcaagtgcaactccaacagaccttacttttccattacccatatccctgcatggatatttattatcccagtctatcatttccttagctcttgaaagacatttatcaagtgtacagctgttagctttttctccatagtaagcaggcattatatctccttctttaaccatgttcatttctctaagctttatagggtcaatatttaattttgcagcaagttcatttactgcagattcaagtgcaaatattccttgagtcgcaccatatcctctataagctccaccgcccattgtatttgaatatacaacatcaaagtcaaacttataagcttttggtgtactatataaaggcattgacttatgtccagataacccaactgttgtaggtccatgttctccataagctcctgcattggataatgtatatatgtgaattgcctgaattattccattttcatcagcacctaaacgcactttgatttccatttcatgtctaggacttccattagtaagtgtttctgctcttgtaaataacatttttgcaggttttccagtctttaaagtaactatagcagggaatacttctgcaacaacactttgctttgcaccaaaacctccaccaattctaggtttaattacccttatctttgattttggtatttctaatgcatttgctaaaatacgtcttacatggaatggaatctgtgttgcacttgtaacatttaatcttccatatgtatcaagttcagtaaatgttctaaaagtctccatcattgcctgactattagcctttgtatgataagtttcttctattacatgtgcgcattttttaaactcttcttcaacatttccatgttcaaaaccaccagttgagcaaagatttctcttgttatctgctccaacatcacataaagccttaaaatcttcttctggatgaactaaaatattgttatccttagcttttctaaaatctaatactggttctaaaacttcatatttaacctttattaaatttaatgccttatttacagccttttcattttcacctgcaacaattgcaacaggatctccaacacatctaagtcttttatccaaaataagtctgtcatatggacttggttctggataagactgaccagccattgtaaatcttgactttggcatatcttcatatgttaatatacactcaattcctggaaccttgcttgctatagacgtattaatttcttcaatcaatgcatgagcatgaggacttctaagaactttaactataagacatgaagctggtgctaaatcatcagtataaacaggcttaccagtaactaatgccatagcatccttttttcttattcccttattaacgaatttcatctttagtcctccttaactttattaagatactttttaattgctctaagctgactcatatagccagtacatctacataaatttcctgctaaatagtactttatatcttcttcacttggattatgtaattcttttttcattgcaataacattcataacaaatcctggactgcagaatccacactgctctgcaccttcatctgccataaaagcaccaaattcttcagcttcttcttttagtccttcaagtgttgttacatgttttccattagcttttgctgcaagagtactgcacgataaaactggttttccttctaaatgaactgtacaaagtccacagtttgctgtttcacaacctcttttcacactaaaaaatcccttgcttcttacaaaatcaataagcatcatatcaggttcaatattatctatatatactttatcatttatccataatttaatttccattggttcctcccacactagtctacactttttataattttagtctaaaatatattttcaaaattacacattccgtaatcttttttattcattatataaatttatcaattaagataatgtttcattaatagctcttaacactaaagtttttgcaagaagaactctatattccatactagctctcatattgctttgaaatttaacattatttactatatgagatattaaattatttttttcttcttcagtaggaatatcacttaaaaattctgttccatctattaatatagctctttgaggtcttgcacctattacaacattccaagtaaggtttttcttagatacagcaatagctaatgttggaatatcagttgcactattacgcatagttaagtatgagactcttcttttatctttttttattattattctaactaggacatctgtatcataatccatatctttataaacttctaaaggaattattcctcccttatatagttcaacatatgtatctaacgctaacaaacatgttaaaacatctgaaaatccaaatcgtgaataaacacttcctcctattgttgcacaatttctaaattgtactccaacaatatgtattaatgatttttctattgcaccatcaaagtatgaatttaaattcttgtctacttctaactgccttaaagtacacatacatccaattttaaatgattcatcatcttcttctattgtatctaaaccaagattagataaatcaatggctgtctgtatatttctattccccatcttaagccaggctgttcctcctaaaataacattatttttcttttgattaagctcataagcttgttctaaactttctgcaaccacataatttttaattgtaaacaaatgcttctcctcctgctattaaacttcatacttatattatacaaaaatccactaccttttctatataagcagtggatttctttttaattaatttatacttgtgcagacatttcttgagcttcatctttgtccttaggtaatactaagtttaacacagaagctataacaaatgtcattattattccattttgagcaaatatttgtccaatgaattttggtaattgatctaatgcttctggaacattaccaattccaactccaattccaattgctaatgcaactatcaatccatttcttccttctaatccttcattcaacaatgatttaagaccacttacaaatatcattgcaaacattataactgcagctccacctaaaactgactgtggcattaccgataataatgcactaagttttgggaaaaatccagcaaggattaaaaatactgctcctgtcattattacaaatttatttactacttttgttactgcaaccaatcctacattctgactaaaagaagtattaggtgctactccaaataaagctgctataaaactagatacaccatcagccataacaccgcctgctaattccttatcagtagcttctcttccaagtcctcctactgaaattgcagatatatctccaattgtttctactgtagtagctatatacattatactcattgaaattattgcatctagtctaaattcaaatcccattacaaaaggccttggaaggcttatccatgaagcttccttaactgctgtaaaatcaaccattcccatacatactgctactatatatccaacaattattcctattaatattgctgatgttttaacaaatcctttagtaaaattctgtaatactattattactaaaattacaactgttccaactaataaatgtttaggagaaccaaaatctgctgctccagctccacctgcaaagtattttactccaacaggaagtaatgatagtccaatagaaattaccacaagacttgtaactattggtggaaataattttctaagaggtttaataaaaaatcctaaaataatttctaaaattgctcctattaaagatgctcccattattgcgctgtatccataagcagcaccaattgctttttcagttcctataaatcctgagcttgttcccataacaactggtagaccactaccaaccttaaatacaggatataactgaattaatgtagctatacctgctataaacatagaattttgtataagcattgattttgtttcaagtggaatgtttaataatccacaaacaatgataagtggtgaaacattacctaaaaacattgctaatacatgttgaattcctaatggaaccgcctgtcctaatggtactctgccttctaattgataaatacttccttttttcatgttgtccccctaaacgctattaccgaatatttttaatgtttatcaataaaacatacgtatttctgaatttattgtatcacactttttaaaaattgtgtagacttttttcttatattgtatattctttatattttttgttttaattttattcacatgatataattatattatatatatttatttcacattatatatagacgaacgtacatttttaatatcaatagaatgttcatatatattacaattgaaaattgacagttgagaattgacaattaaagtgaaaatccttacaggatttttgaaattatatgcagaataattattgcaacatatatatacaaaattttcatattattttcaaattctaattataaaattcatagtgtaatatatatactaggataaacgtagtacacataacttttaaaggagttaatataaatgaaaaaaacaattaaattaacagaacttacaaagacttctggatgtgctgcaaaaattggtgcagccactttagaaaaagctttaaaaacactgcctaaatttcacgattcaaatcttttagtaggctttgatactagcgatgatgcatgtgtatataaactaaatgaagatactgctataattcaaacagtagattttttccctccaatggtagatgacccatttacatttggacagattgcagcagctaatgctctcagtgatatatatgcaatgggaggtacaccaacacttgcaatgaatcttttatgctttccatcatgccttgatccagaaataatgcatgaaatacttgctggaggatacaataaagtttcagaagctggagctgtgattgctggcggacatacaattgcagatgctgtgcccaaatacggactttcagtaagtggatttgctcatccaaatgatatcttaacaaatagtaattcaaaaactggagatcttcttgttcttacaaaacctttaggtataggaataatgaatacagcatccaaagcaggattactgtcttacgataaaatcaaggaagtttctgacataatgactactttaaataagtacgccaaagaaagtacaaagggccttaaagtaaattcatgtacagatattacaggattcagtctaataggtcatagctatgaaatggctaaaggaagcaataaaacaattgaattattttctaaagatgtgcctataataagtgatgctctaacttatgcttccatgggaataattccagaaggtatgtataataatcttgaatacttaaaagataactttactcattcctcacatataaaacaagaaacaatagatgtattgcttgaccctcagacatctggtggacttctactatctatgcctgaacaagatgcagtgaagtatgtagctagaatgaatgaatttactccatattgtaaggtaataggtcaaactaaggatacatgcaagaagtatatagaaataatttaattttataatattaaaattatatgtaaaatatgaattaaaactttaaacataaaaacattaaaatttcacttaaaaaaatagactgcattgaatgaagatttttatttcaatacagtctatttaacatatacacgttatttttagatattatatattttctgattcaaatgctttccaaggaatgtttacagattcaccagaatttataatattgtctatctgaattatcataggaaagtctttaatatcaacaatccctttttcagcctgacatcttataaatttagcagcacgttcagcaataactattgattccaacgtaacaccctttaatttttccattgcttctttaaatgaatatccttgacctaataaagttcctatcttacgagttcgtcctccaaaaactgttacataaagatcccctccgaaatatataatattttcatcttctccaccaactaacttcagtatacgtctagcttcttttatactttctccgaaaagagctgcttgtgaattataatgttctttcccacttccatcacgtccaatggataatcctattgctagagatacacctaatgcatatgcattttttaatgctacagcacattcaactcctacaatatctttggataaacttatgtgataatatgatgtttcaaacatacttttaagcattctaagggtatttatatcttctccacaaaatactacttctgaattatccttatctgcaagttcatagcttgtacacggacctcctactgcattaatacacagatgcttattatgtggaagttttctcaaaaagtattctggataatttatcatttccccatcatcttttgttatcatgccttttgttattgaaagaactggaatatcttctggtagaataggtaatatattatctgcaaaccattcaacaccaaaactacttactccgcagataattacatcggctttatccagtgcttcttctatttcttcaatttggtaataatcaatccctctggaaggcaattgacgttttaatgttatgtgaaatcctgtatcttttgctttattaataatctctctatctaatggagtaccgactaaacgtacattattattattttctactgctggaaaagttaatgcagatgccatctggcctgcacctataatggttatattactcacaattgttacctccttattaattaaaacttaaacaacctatatttttatacactaactctatatttttgtaatttacacttttttcaatttttcaccaatatccttaatagatgaaaatacataatcagcatgtatatcagaattcatatacattttctctgatgtttctccactcaatacaagtatacttgttatacctgcattttcacctgtcttgatatctgtataaagcctgtcccctactattgctacttcctctttctctaagccatacttttccataactgcatctactatatacttactaggctttcctataatcaatggagaaacttctgctgatgcttcaaacatttttatcatcgaacctgtatctggcatatatttattattttcaagtggacagttaaagtctggatgagttgctataaacggtattccatccctcaaataatcacaagcagtccaaattttctcgtaggttattgttgtatcaaaaccaagaacaacataatccggtttgtcctttttatctttaacaagtaaaaaacccgaattttcaaattctttccttaggggttctgttcccattacatacacacgattgcccttacagtattttttcatataccatattgttgcatctcctgatgtataaatcttttcttcattaatataacacccaagatcaaaaagctttttcttatatacacttttgtttttcgatgaattatttgttaaaaaattaaattccttgttttgctttttcaagacatctaaaaaatctaatgctccatctataagtgtatttccaagataaaacgttccatccatatctagaagaaaacactttatatctcttaaatctttcattgctacctccagatcaaaacttaaattctatcatgatttttcagttttatataatttatcagctattaaatatgccatttcataggtcattccaatatcatcaattaaatgtacgataccataccttgttcttatgtctttggctgcaataaaacttctaatgaataaatttttatctattcctaattctgatggatgccatatacatccaccatcattcaatatcttttttataagctgtgagcttggcactattgtatctgcaattttaagaatatcattccatacatcttcaatttttttagcattttcttctctcttatcagaatccaattctattgcatcttttttataattgattatattatctgcaacgttaccaaatacgctctcaatattttctctccatttcttcaaatcataatccctaaaattttttttaaccataacatctttaatattaatattcttcaattcttcatataacattgccattactactgttccaacacccacaaaatttccatgcacccatttttcatcactattcatacaatgaaacattatttcccatccatgagcaatatgatgttcagaccctgatgctggtcttgaagatcctgccattcctatggttatacctgataaaactaatgcttcaactatattttttatagctttatcatctcttttaacaattctaggagcttcatttgcacacttctcaactgcagtctttattagatctgaaatagtttcacaaaaatattctccttttaatttttttgaaagcatccaatctgctcgtgctatatattttcctaacacatcaccaagacctgaacaaatgagatacataggtgcatttttcataatatcaatatctccatatataccataaggatatatagccttatgagactctttaaatccatctgtaataagtggtgatacaacagatgcatatccatccatagatggtgcagtacatactatggcataaggaatattaactttatacgcaacatacctgcacacatcatttataacacctgaacctatccctaaaataagtgctgtatcttcctcaacttcaataagaacccttccaagtgcatactcatcaggcagtaaatgattttgtttaaatacatgggtctttaatttaaatttatcttcaagaatttcttcaactttttctccagctgctttgcgagtattaatatcttgaattattaatacttttttatttgaaaactctttcaaataatctggaagattatttattatattttttccaattttaacagaattaatttctacactatgttctttaccacattcacacttaaaattaattcccaaaatctcttctaaacttaagtttgttatatccaatccaatcatcagcctttctataaaaactaaacaatttatatcatttaataattattattcaaataaaaatacataaagttccccattaaagaatcacaaaacattctttaacaatcaatctatttaaccttatgcaaataactggaatatcttaattattatccaattcaagaagtttcctcccatatctaaacttgaaatagtggatgctccttctggcattgtaaactgagccattgttgccatttgagtgtgaaaagcagaaatatttgttgccatcaacaaaacaagtgccattactattgtacctgctattatagaatgaacaatattaccttttgctgctcctactataaatgcaacataaaaacatattgttgttaaatctccaaatggtaatacttgatttcctggtaatactactgctaaaaatagtgtaattggaactaatacaagggctgttgcaattactgctggatgtcctactgctactgctgcatctaaaccaattgttaattttctatctttaccaaaatcctttttctgcaagaattccctaactgattcagacactggaatcaaaccttccataagtattcttaccattctaggcatcaaaaacataacaccacccattgatacaccaatttgaagagtttttcctaaatcatatcctgcaagaataccaataactatacctaagacaagtcctatcatcataggttcaccaaaaatcccaaattttttctgaatagattctggatctgcatgcaaatttttaacccctggaattttacttactgctttaacaattggaatacctaaaagaccacatgctgctgtggaaccagttggcaaagatacaccttcaagtccaaagaactcctgaaccattggtgctgttttatcagcaattttaagaactgcaatttcatataaaatacctgctaaaatagaaaggaaccagttaccaccagtcaacacatatacacttgcacctgctgcagtaaaatgccagtaattccatatgtcaatatcgactacattggttgcttttgtaataagcaataaaaaatttactaacattgctattactatcattattgctgctataggagaggcccagcttattgaagctgctgctggccatcccacatctattatattaagatgtaatccatatctacttaccatttcctgtgttgctgctccaagatttgttgtaagtaatccaattactaaattaataccaacaaatccaataccaattgtaatacctgacttaaatgcttttttaaatccttgtccaaatataattcctataatagtaatagttaatggaagtataactgtaggccctaaattcataacatactgtactatttttaataacatgccactagatcctccttatatttaattcataattttttattttaaagcatcaataatttctttatctactttatcaggatttatattagttaaataatttactgcctttattactggaatcttataatttgatgatgaaattgtagttgttaccaaaagatcagcttcatcttcatatcctggaacttctgaaattttacactgtataatccttgcatttaaattattagccttaattaaatcctctactctcttacaaacaactgttgaagttgctattcctgtaccacatgctactaatactaatttttgtttattcatatttatgcctcctcaaattttaacttatttttttctttaaactcttcaatgttataaatcttcctagttataggccttgtcaataattataagtatcctttaaaaggtatttttttatgctccttataattattacttactcaccactatacttaaactttgaaactatttcatatagttcatcactattatctgatttcatcatattttctaatatattttcattttgaataagctccataagctgctgaagcattaaaagctggctatgtggttcactaagtgccatagtaaatactatatttaccttaacctgtccacttccatccatacaattgaaagtcactggatttttcaatgtacaaataactatagctggtatttttatattttcagcatctgtatgtggtatggcaacattatattttataagctgtaatcctgtaggaaaatttttttctctattaactaatcctttaaaaaatgactcttctacaaaacctttttctaataaaagttcagatactttcttaaaaatatcacaagatgattctgcttcaagattacttattactaaatcctttcttaaaaaatccctaatgcatttagtcatttttattccctccttttaatttatacgttttcatatttgttatcacacaatatttatgcagcaagtatcatgccaaaaaacatgttgaaatagtaaatcctagtattatttcttataaatttcaattctaaatcttatatttaaaaattaacgagtacatctaaaatctctttggctgaatttgcctttcttatttcattaagaactccttctacggatattgtatcgaataattttctaactatctcaccatcactttctttaactgccaacataattacaatatcaactttacaatcatagtcccataaaacaggtttgcttaatttaaagatagctaatgatgatttttctataaattctgataatccatgtgggataccaattgttccttgaaataaagtcccgcccattatttcccgtttatacacactaatagtaaattcatcctttactcttcccttatctataagaagtttacacatttcatctatgatttcacttttatcaaatacatcatcccttatttgtatcaactgttcatctaacacatgtattaaaggatttatcttatgatctaacccaataatattcataagtctcactttaccagacttttttaaaatatcttgaaaggatataaatggtacattttctatatcaggattaattgttccaactactgcaattacattattattcttataaacatccataatttcattcttaccattacttatattagcaattccaataggtataatattaagactagtttttgattctccaagcattccttcaatgtatttctttatatttagagcacttccttcaccagttaaacatactgttattattgtttttaagtacttctttacacattgttctccttcaccaaacttcttatctccttcaagttctttatatatttcatataggttactattttcaatcaatgattttcttacagcttctaaaaccatcattgtatccactcttccaattacctttgtcaaaataccagtttcttttgttatgatatgtccaaaagaaacaagggaccccatatcaaccaataataaacagccttttccctcatcaaaatttcttacagcttcaatagttctttcaagcataattttagggctttcatctaattccatttctatacctatggcaagatttgtacataaaagtttattggctacttctgccattccacaggcaacatggccatgtgttaatacaataacagccactctgcttacttttttatctttttcagaaaatgttttaagatacattgttataaatcctatttcatcctctggaagctctatatttaaattattgtttatttccttagttagtatttttgcaatttcatactcttcagcatattccgtttttatataatctatctgtggattttttataacctttcctttccttaatctgtcatatgttgaattcaaatgcatggctatacagtagtaaaaattctcttcaatatctttcacatacctttttgccatatcagttactttttcaaccacatttaatatattttcatcaattatattcttcaactcttctttaggatacattatattggattcaatatttttagcatatttatttaaatcaaattccatttttccccatagcattttattaatttcatctttgtttaacccttgtctctcaaactcatagtacttactttctatatttttatatatttcatcaggaaacttatatctatcatactttaatttaggtgttaaataatcatcaggattaataataagatcttcattaaaaatatcttctgatattaattttgattcttggtttcttaatatctcaagtggaacctgtttaggcaggtctttcatataaattacaacctcatttgtattattgcttaatgaattaaaaaagccttttgcacatgcaacctgtatatcgcttctcaattgacctatattacctggacaattatataataataacgaacgtataacttcataatgtacaattatttcttttccaactcttgatgattcctgggcaaaaaaacttttaataattaagtatttttcactaattggcctattgtttatagatggcagttcaattatcataggtattcttcttctaaatgtaagtaataatgctgatttaggatcttcagttgttgctgcgataaccattacatttgaaatcctgttattttcagtttcacctaatcttctatactttcccttatccaatagataaaataatatttcctgcccttcacttggcagtctgtgcacttcgtctaaaaataatattccgttatttgctctttcaacaaggcctactttatcactatttgctcctgtaaaagatcccttgctgtaaccaaaaagctgagataaaagtagctggggattgtctgcataatcagcacagttaaatattatgaatgatgcattattttcgaagttagtagttttaacagcaaaattatacattgcctctgcaaaaaaactctttccaacgcctgatggacctaataaaagagtatgaagcccatgtggaggatataaaattgcagcttctgcctgactgattgcatttttcaatgaaccatgataccctatgatttttcttaagctattattatttttttcatcctccattggattttgcttttcccttttgtttattttatcttcagtatcttttaaataaagctcatcttctttgaagtttgattcaatatctccaacacttcctgcctcattaattatttctatatgagataatacatccttttttatctgagatgcagaatatctagaaatatcatatccaagaagagataattccttacataacttcctgtctgaaatactcctatctttaataattatcttctttatgtcactatataaaattccttcttttctttttctagaattatctatatgtttttctgttctaaattgagttatatattctcttgttgtatttactaatttcgcaatatcgttatcagtcaaaggatttctcttgtcctcattttttattaattccaatatcctttcttctatcacacatttcactcccatattaaatttcctcttataatattttattgtaatatagtttactttttactattcttatgttaatattttacaattaaatatattattataccatttaaagattccgttgttattatctaatatatgacatataatcttctaagatttatattctataattataaaatcctgtataaactctttttatcttctgtaccattatcaacaccatatgattatccatttataattattaaaccagtctaattccttaaatttatttgctatatagttaataaaatcataataaaaaaatgacatataaattgtatttaaaagtcaaaaatacaatttatatgccaacgaataatttattgatatattattataaaatcctgtgctaattataaagtaataaccttatcagtagctttcatagcattagttatgtcatacatattacttatcttaccaacttcaagtttttcttcaagattgtaaaaattaagacatgctccacacactaatatttcaacacctctattttcaagttcctttaaatgttctatagcctgttcattatttgtaggcacttttacaccatcattcataaaaagtaaatattttggaatatcatcactttcacttaatgtatagaaaaacattttcataagattttttccaagttcttcacttccagagcctattatttcttttccaacaaacacagaataatttcctactgacgtttttttatctaattgtgataatatttcattacatttttcacagtccttattaaatacaactgaaaaatttccatttttttctttcacatttgtaaaaaatccttgactattggctagctttttaagattttcaactgcaattgaattatcaacttcaattataagttcttgtgcccctgcatctatttcctttttagccattataactggcattggacagtttttaccttttgcatcaatcattttgctcattacttttcctactttctttattatgttttaaaaaaatatatatgttgcaataattattctgcatataatttcaaaaattctgtaaggatttcaccttaattatcaattgcaatatatattacaattgacatatgacaattaataattaatgttgaaattacaatatgattctaaattataattgtaaaatttatagcccagtgtatatattacacattcaacttttctcacgattttcattgtccactatctgttaactatgaattagaacttatatactcaaatagcacctttacacttccaccacatgccattcctaatttagaagcttttgaattagataaatcatatgtttctatgtggcacttctggatttttataagttctatggctttttcataaacagcattttctacactaccaccaccaactgttcctattacgcctccatcttcaataatcaacatttttgcccctacaccccttggtgttgatccactcttttctacaatagttgcaagaaccatattttcagatgaagaatctaatttatctattatgctgtcttcaatattacaggccatctttttatttttcacttctattatttctgcaaagatacttacagctatttcttctggagtctgtgcacctattttcaaaccgattggactatatactttttccaattcttcttctctgtatccctctttaatcatagcgttaaatacagatgcaaccttacctctgcttccaatcattccaatatatttatgatcagttctaataactttttcaagacattttctatcatctttatgtcctctagttacaattacaatgtatgtattactgtttactttagcttcttcaattgcttcatcaaaatccatgcatataatcttatcaacatgaggaaatctttctttgctggcaaattctattctattatcaattacagtaacatcaaactcaagcatctttcccattttgcttaaaggtagtgcaatatgcccacctccacatattataagctttggctttcctacaatatcttcaacaaatatctcttcattaccaattttacatatatgtgtgccattttttaaatctacatctttaattgagtcttttaaaaatttatcatatttaatttcatctacatcataatcatttatagaatcattcaaattcttatttactataatttttttacctatattttcattctggcttatgacagttaaggtcttaacaaatccattttcatttaattctcttataacttgtttatataatcttttccccatacatattccccttattttttattttgataattgcttagtcaatgttagtacagcttctaatactcccccgcctattgaacgtgccttatctgatattgtaaagcaatgctttttttcacatcttggatcaatatccccacttttcattcccttatgtacttttacaccttcttgaagcattcctctaactatacctgatatttctgcaaaaacaggctcactactatcatcacactctaatgaattaactacccttgcgaccacttgtcctttctcaacatgttcaccaatttccaccataggcttaataaaaccatcaccagatgatcttattattctctccacagtatatcctcctatattccctggaatacctgtattagctattgcagatcctttataaattgttcttcccaaataatgtcccctctgagtttcaataacacaatgacaatcaattccagcttcaaaacctggtccaactgcaattactataggtgcatcatttatagttgtattgccacagttcaccttgcttatgattgaatctacaacaatatggggtttcaattcctttataagttcagcttttgaatctataactatcggtatgtttccttcttctataactttaatggctccatttacatcactgactaaaattcctttaacaccttcaacctcagcaattccatcaaaaacagcttgagaaaaagctactgttcttcttacagttgtaggcatagctatttcagtcattataacatcaaaaccacaaacttttaatctatgtgcaattccagttgctaaatctcctgctccctttattaatataatcatactttcatccccttgtttactgtcaggtaacattatagtaatattgtctacctaacagatttttatttaaaacttgtaataacactatttatatttttttcatttaataattcactaattttttttcccttatctatgagatatttattatcacatttatttattgctgcaacataatttacacttccattaaatgattctatgtatttcatctgccctttattgctggataataaaactccaatatcttcctctgtaattatgtgagattcatcaacatttaaaatattgcatacaacttcctttctatggcatatatcttttattgattttcctacagaatcaattccagctacacctattacaatattagatttatcaattataacaggctcatgatcatgtggtgcttttaatggaagccttcttgaaccatcagattctattaataaaaaatcacatatttctataagttcatcataactaacattagttaaagaagtaaacttgttattgcctactggtgttcctaaaaccactattttagatttatttaaatatttcttaatttcaactaaatcactgctgtataagaagtatttttctgatataaacatattagtagttgttgttataataacatttttcccaagtttcattaattcttctgccatattataaattaatgttgttttcccacctgctccaacaaatgaaattacattctttttatttatatctattgaaaatccttcatataaatattctttttgttgaagcttattattataattaaaaactttcatctgttgtatcttcctttaatattctattgatgttctataataacatttaaattataacaaaataaatatagatagttaactttaatccagatttaatttaataaatcattaatctgaaattattgcttctatatttttagtgtcattaaatgaaatttttatctgcccttttgaacttttcccaacaatcttaaatctgtattcgcccttttttaattctatatttttatttcctgttgcactttcttcaagtatattttcaatgtgtttatcaggacttaccatgacaagcttaaaattaccacttttaatatttaaatcataattcaatgttattgtgctgtcttcacttacttttaatattaatattgtatcgtaaccagaaaaaccactgaattttaaatctaagtcattatttgatttttgacttcctattttatcgccataactataagaatcaccttgttcagctatttttttatcgtcattatatatatctttactacagctgctaaatattaaaattatagctgaaaataccactaaaaatatacatataaaaaatatgcttttctttttagctcttctatttaaaattcttctcatactctccacctttattttatattgctaaatgaatataatttactgatgtatcaatatatctatttatttagagaaatattcttaatttacctataaaatattatattttgaaaaactgccttatcttcatttaaatttttatatgtatgatttttatctgccataaatttaattgagcatccctttttcaatataaaattttcttctccaatggtcatctcaatttcaccttcagttacaataatgtattcttcaactccactgttatgtgaactggattcatgaatacatcctttttcaagttctatggtaaatatctcaactcccctattaggatcaaaaggaaatatcggatacaacttcattgtactatcttcttcaattaccggttctatttcatctatatttataactttaagttcttctttgctttcatcaataaaagatgaaaatgacaccctaagtcccgttgaaatcttccataatgttgagacagtaggatttgattttcctctttctatctgtccaagcattgctttactaacacctgtcaattctgccacatcatccaaacttaaatttctagaatttctaatattttttaatttatttcctataactaaagttaaattttccatattcaacactctctttcattacatttttaaaattgtgtctgttataacatattttattctaacttattgtttttgtaaatcccatgttgtataatatactatacttatatatgttataacatacatttaaattttggaggtttatatttatgaaaaaagcatttatgctgggaatttgtgcatcattcttttttgcatttacctttatcttaaatcaacagatgcatctttcaggtggaagttggtattggagttcatctttaagatatatctttatgttaccaatgcttcttattataatgatttcaaaaagacaattaaaggaagtaattattgatattcgtaaaaagcctttatcatggcttttgtggagtactataggatttggctttttttatgctcctttaagttttgcttcatcttatggtgcatcatggcttgttgctggaacatggcaattgacaatagtagctggtggtcttatgtcaccattattctttaagattataaaaacagaaaaaggtatagtaaaaatacgaaataaaattcccaaaaagtctcttctcatatcattactaattttggtaggaatagccctaatgtatattgaagaagctactgatatttctttgctaaatacaatgcttgttattattccagttataatagctgcattttcatatccacttggaaatcgtaaaatgatggagatttgtgatagcaatataaatactatacaaagagtttttggaatgactttatgcagtataccattttggataataatatcacttttaggaatttcaaattctggacttccaggaaaaagtcagttaatacaatcattcatagtagctgtcttttctggaataattgcaactatattattttttaaagccactgatattgttaaagataattctcataatattgctataatagagtcgactcaagctggcgaagttgtgtttactcttcttggaggaattcttatatttcatgatacagttcccacaacactaagccttataggactcattatcgttgtccttggaatgatattaaatagttttgtccgttcctaaatttgaaaacattcaatctatgaatttaattattaataaccctgtttataaattaagttaatcttaaacaaatattaagacttaatctattgacgcctcccccatgtaataagctaaaatagtattaagttttaaaaagtaataattgaagttttagattattacttataaatactaatttattactggagataattatacatggaatatttaaggtttattcatatgatttatgaaccaattgtttttctaatcaaactaatgatgataattttaacatcaatatttattcttggaatatttagtataaaagaaaaaatcgttccttatacagtagcttccaacaaaataaacaatgatttaaaaatagttttaataactgatctccattcttgctattatggggataatatgaatacacttattgaagacataaaaagtcagaatccagacttggtgcttcttggcggagatatttacaacgataaaaaatctgataatgcaaatactgacacatttttaaagcagataagcagtatttctaaatgctactttgtaactggcaatcatgattcaaaaactgagactttaaaaaatacacaagaggttaaaaaagctactgaaaaatacggtttaactattcttgatggtatttatgatacccttgaaatcaatggtcaaaaaattaatatatgtggtgttgatgacccgactattgcaaagaattctttttacaaacaacttgataacacaggcaaggcatgtgataatggtaatttttcaatacttctttcacatagacctgagttaattgataaatatcgtaaatatgattttgatcttgttttatctggccacgcccatggtggacaatggcgaattccaaaattaattaatggagtaatagctcctcatcaagggctttttcctaaatatgcaggtggtagatatgactttaaagacaccacattaattgtaagccgtggacttgctagagagtctacaccagtaccaagaatattcaacaatccagaagttgttgttattaacattacatctatataaataaatattgcaatatgcactttacaattactaacaaggaatacctacactgaacataacatgtcaatttcaatgtatataataaaaaattaaacttcagtaataatcttgtgctgaagtttaattttaaataatttttttagtattcttgattttatcatatctttatcttacatgcatttcaatctattctctatgtaattgttaactgtgtctttaggtatgtttaaggcaattgcaagctcaccgcttagatattcttgagctctctttagatagtttgcatcacttacagatagttttttcccatctgaactgtattctcttttcttttcaattatagtctttattatctttacgaatccaatgcaatcataatgttgtattatatccttaaattcatggtctctttctttcatattatcaatccaatttacttctacagatggaatagttccaataagatcatctgcttcctgtctcgttagtacctttctcattacaactttttcattatcaacaggtgcaaatattctcccattttcatatacaggttcaagagtataatattccttttcactgtcaaacctacttatttcaggaaccccaacatcagtcaccttacagacaccattgcccccataaataacataatcatcaattttgaacatttttactcctccatttctttgataacgtttacacaccctcataaacaaaattcaaattataaaaaccatatttttatgaattataacttcatttttttaataaaaaatcaacttattaattaaaatttatttaattcataagcgcatgtaaaggcgtgttttttagttctaaattctattatatcagaaaaaagccttttaggtaagtaaaacttttaatataaaaataaaagaaaccatattcataagaataaatcagtatgaatgcagcttctttatatatatgtggaattaaattttctaatatgaaaatgagttctttccacatttgtgggtgtgctaccctttttaattatatcatttttaaaaatttgacaatgtaaatttttttagatttttatatcacttttttaagatgttttaatttttttaggatcttttgaaaactatctgtgtaaaagatcattactattttttaaaatatctttatatattgtatccatcattggattttcactacttctttttatttgtgcaaccttatcagccttataaagcccttttgcacgttctatcttagttttatttaatccaaatggctgtccagctcctccaatacaacctccattacatgccataacttcaacaaaatcaaaatgctcttttccactttcaatactctgtataatcttttcagcatttgcaagaccacttactattcctatttttaattgaagtccatttatttctatttcacacacctttacaccatccataccacgcatgcctacaaactgtaaatcctttaatcctttctgactttgatcttcatatatggtacgtataactgattctgtaactccccctgtaactccaaagataactccaccaccagaatataatgaaaatggtgtatctaaagattccccttctacttcatcaaactttattccactttcatttatcatgtcacacaattcacttgttgtaagaacataatcaatgtctttaatatgatctcttgtaaattcttctctatctgcttctgcttttttagctgtacaaggcattactgctactgaaatggtttctcttccttcctttaggtccctttccttaaaatattcctttattactacaccaaacatttccattggtgatttacatgaagatatatgtggcataagttctggatgtttagtttcagcatacctgtaccatgcagggcagcatgatgtgaataaaggatatctaatatttctacgattttcaaaaaattctttttctatattcttattatggcagtctaccacatctaaatctttatgttttaaatcattattgatagaaatacatccactttcgaattttattttttctaaaaattccttgctttcttcaagtgtagttaaatctgctccaactgatgtatcatatatttcatcaacaccaagtctcctcattactgcaactattttatccattacattttcaccagatttaattttaaattcttctccaagtgcaacccttactgctggagctatctgcataacaactcttttatctttttcatatatggctttccatacgtcttttacacaactttttattgtaattgcacctgtcggacatactgcagaacattgcccacagcttacacagttagtttcagacaagttcttcccaaatgctggactaaccatcatatttgaacctctaaatgcaaaatctattgctcctacattttgaacttcactacacatgcgtacacaatctccacataaaatacatttgctagaatcaattactatggcctttgaagaattatctattgggagctttttctttgtatttttaaatcgtattttatcaactccaaatcttaatgcaagttcctgaagtctacattttccactttttctacacactgtacaatctctgcaatgggatgctaaaataagttctagtatcattttcctatggacataaagtttcggtgtattagtcttaatcaccattttatcctttggaggcgacgaacacgaaaaaattatccttcccttttcatcttcaactgcacacattctgcatgcaccataaattgataattctgaataataacaaaatgtcggaagatctattcctgcttttcttactaaatccaaaatgttcttttccttatcaaattcaacacgatttccatctataatcatgtatttccccataaaatcctccacctcacctagactacttctactgcattaaatggacattctataatacactggccacatttaatacatttttctttatcaatttcaaaggtttttttaatttctccttgtatagcctgaacaggacaatttctcgaacattttgaacatcctctgcatttatccttattaatttcataagatattaaagctttacatactccacccggacattttttatccactacatgcgctgtatattcttccttaaaatattttaatgtacttttaactggtagacatgcactttttccaagtccacaaagggctgtagctgaaatggtatctgaaagctcttcaagcatgttaatatgttcatttgttcctcttccttcaactatatctgtaagaatctcaagcattctttttgttccttccctacacggaacacactttccacaagattcattttgagtgaaattcataaaaaatcttgctacttcaaccatacagcttttgtcattcataacgacaagccctccgctgcctatcattgcacctactttctttaaagaatcaaaatcaagttttaaatcaagatgtccagcattcacacaaagacaacctcctgaaggtcctccaatctgaactgctttaaattcaccatctttaacacctcctccaatgcgaaatacgatttctcttaacgatgttcccattggcacttcaataagacctgtgtgtttaacatttcctgttaaggcaaaggcttttgtcccataattattttctgttccaatagtcttataccagttagctcctttaagaataataggtggaacattacaaaaagtttcaacattattaaggacagtaggctttccaaataatcctttttctactgttcttggtggctttacacggggcattcccctgcttccttcaattgatgttgtaagtgcgcttccctcgccacaaacaaatgcacctgctcctttgcttatacgaatattaaaatcaaatcctgaatttaaaatattattacctaaaagtcctttattttcagcttgttcaatggccttttctaacctttcaactgcaagtggatattcagctcggacataaatataacccttatgagcacctgttgcaatgcccgctattatcattccttcaattattctatgaggttcaccttccatcattgatctgtccataaacgctcctggatcaccttcatcaccgttacatacaatatatttgtcattttcattttgtttataaacctgactccactttatcccagtaggaaaaccacctccacctcttcctcttaaagagctttcactgatttcatctataatattacttggagtcatatcaaaaagtgcctttgtaacagctttataaccatctagtgcaatatattcatcaatagattcagcatttatatgtccacaatgttctaacgctacacgagtctgatttttataaaagggtatatcttcttgtctgctgtatcctttttttccatcactataaattaattcttcaataacttcatcatttattatgctcttttctactatttcttcacagtcactctccttaacttttacatatagaattcctgcaggctctattcttattaatggtcccatttcacaaaatccatgacatccactctttttaagacctataatctcattctttctattttttattgatgctgtcttattatcatcattactgctatcttctttttctccatttttagtattaatttctattggaggatgttctatttctttttcaagttttaattcaagcttaaggcccttttcctcaataattttcttgaatttctcataaatttttattgatccacctgccatgcatcctgttccagcacatacaagtatctgcttttcctgactatttaaagcttttctataatcatttcggattctttcaagttcttctcttgaattaatcttcataagatatatcctcctttgaagttaggatttttgctttaaaatcttttttaatatcatcaacaagtaactttacttttgcctttgtcatattaggatatacttcatcattaactgtgcacacgggggcaagtccacatgcccctaaacatgaaactgtttccactgtaaacatcatatcatctgtagtagatttttcttcgcataatcctaatatatttctgaactcttctaatatgggaattgattttctaacatgacatgcagtgccgttacatattttaattacatattttccttttggtttaagagaaaaattttcataaaaagtagcaactccatatatttttgcttcgcttatcttaagtttttctgctatatatgataatatctcttctggtagataatgatattctttctgcacgtcctgcataattgcaataagaagctgtctattataatcatatttttctagtatggaatcaattttatccattctataccttccttttgctataaaattctcatttatatttatattcacatgataaattattagaacttatgtagataacttaatagtcaatataatataaggtcataaaagcctcttcagatgccaaaaaggaaccataatttttttatgattcctttaggaacttctcaaaacatgctctccaaacttacattcttatattacaataagtttaaatattcattaagtttattttattgcacctttagtaactccacttattatccatttttgtgcaaacaaataaaataataaaattggaattaacgctaataaatatgatgcaaatgctagattgtaattagttccaaattgtgattgaaagataaattgaaccagtggaattgttgcaaaatttggatcactcaatattacaagtggaagcataacatcattccaacaccataaagctgtcataattgctactgttgcatgcattggtttgcacattggaaatacgattttgaagaatacttgccaagtacttgcaccatctataaatgctgcttcttctaattcttttggaatagcttttaaaaatcctacatataaaaatacattggatgataatccataaactatatatagtaataatactccaaaaatgttatccatattccagctactaacttgctttacaagaggaagcattataattgggaatgggacaaacattgcactaataaaatagtaataaattgctttgtatgatttcttgtgtaaatttcttgcaatggcatatccaaccatggaattagttacaactgtaaaaataacagttgttattgtaataaataaactattttttaatgcgttaaagaagttagtcatttctattgcatttttaaaattttcaaaatgaaatacttctggtaatgataaaactccacccatcatatcttgtggtgattttaatgctattagcacagttataattaaagggaatatgattgtcactgttcctattaacattaatatagttaaaggccaatttgatttttcatctttatctttaaattttttctttaatatttttgttgtagataattgtcccattataactccatctcccttttttcaagaatttttagttgtagtaatgatattgctacgactactataaagtatataacagagtttgctgattgatatccgaattggcttccttcaaatccagctttatatattagtacagcaatagattctgttgagcctgatggaccaccacctgttaatgatattatttgatcaaacacgtttaagaaatttttcatagcaagaaccatatttatagtaaagaatggtgctattaaagggaatgttattttcttgaattgaacccacttacttgctccatctatagaacttgcttcatatacatcttctgaaatagtttgaagacctgatatatatattattgtattgaatgctattgcttgccatgccgcaacaataactactccaatccatgctagattaggatctccaagtatacttttacttaatacttcgcttccaattgcttgtccgaactcagttaatatgaatgtaaatatatagttgaaaatataccctactattaatccacctaaaatattaggtataaagtatatagctcttaatgtgcttttaaactttatcttagaattaagtcctattgctaatcctaaacttattatattaactattatggttgcaaatattgcaaacttaattgtaaacatatatgaattaactattctctcatcagaaaaaatactaaagtaatttttaaaacctacaaaatcaaaatctccaaagcctctccaatttgtaaaactataagatataccttttaataaaggtaatgtatgaaatacaaagaataatataactgctggtaaagacattaataaaaatactagttttctttctttcacatttatcactcctatatatctggtgtacttacttgtacactaattcaatttattttatctttgagctctattccatctatcatctaaactatttaataacttatctatgtcattatcaaataaatatccttgtgctaaatctgcaacttgcattgatgaaggataatgatgatctgggaaatctagtacttttccattttcaaaatatggctttaagtcttctacagttttatcttcttgatacatatcctttaatgctggaattgcaaactgctcatttgcatatgcttccatactttctttctctgtcataaatttaataaattttattgaatcttctttattttttgcttctgttggtatggaaaataacaagtccactcctgatactacattgttgtttttaatatcattatttacaggtagtacaaacattcctatatttgcatcaggatttaattttaatatttcaggaataacccaatttccttgtatcatcatagctgcatttccttgagcaaaagatacatttccatcattatatccaataccgaaattatcattatgaccatattgtattaattgagatattttctctgctattggtttatatacttctttaaatgtatttttattttctctacgctttgcaaaaaaatcaattggctgtgtattagctgttattgcattccacgctggcattgcagtccatgaatctttcaatgagaaagaaaatggtactataccttgattttttatattttctgataattgtataaattcatcccatgtactaggaatacttaaaccaagttcattaaagatatccttgttgtatactactccacctgcattgcaagcgtatggaataccaaatactccatctgtattttcaaattctaaactttttaatacttctaaatatgctggttgtattctatctattatttctttttcactagataaatcttctaaaatacctgcatctataaaatctgcataatttaactccccagccatagttattatatctggtatatcattttttactaatcttgttttcaaaacagtcatagcttgagctggacagtttatggttacatcaatatctggattttcttcttcaaatttttcttcaaattttttaaaagttccaatagcttctgctttagtcaaaaacacttcaacttgtctttttccttctttatttatattatctgatttaccacaaccaaatagaattgacatggataaagtacatagaattgagtaactaataaatttttttagattttttttcataacaactattttcatacaactaacttttataaacgtcttactaaatattttattaagtgtcttttttatttttagtttcaatatgaaaatagaattcacctcctaatatttttattagaaattacttatactttttttagaattaattaggcatttttcttataaaactttgctgtttttcaaattatataaactctacattcatagggtcttaattttatattttctaactgttcatctatacaaacatcataattacctataagcaattttttagaattatactcaacttctgatggtaagttaaaggtagtttcttctttagagaaactacaaattaccaataatctttcattatttaaagttctcatatatgaatatatttcttcgctttcttctaataacaaatcgtatttaccataaacaacaatttcattatcttttcttatttttatgagttttttataataatttaaaattgaatcttcattgtttatctcttcttctacatttatcgatttataattaggatttaccttaatccaaggtgttcctaaagtaaatccaccattttcactgtcgttccattgcattggtgtacgtgcattatctctacctctatcatatataccttgcatcatctcttcatgagatctaccttttttaactactaaatcttcataagcatttaaaatttctatatctttatagtcacttaacttctcaaaagctacattagtcataccaatttcttccccttgatatatataaggagttccttgcatcatatgaagacacgtagctaacatttttgctgatttattccaatactttttgtcatcaccaaatcttgatacaactcttggctgatcatgattattccaatacaaactgttccaaccattgttctctaatcctttctgccatttagtcattattctttttaattcagtaagtttaaatgaatttttatgccattttccaaactctccattaccaatatccatatgctcaaattgaaataccatattaagttcatctctatcttttcctgtatataaatttccttgttctacagtaactccaggcatttcaccaactgttattaagtctttttcttttaataccatttgtttcatttcctttaaaaactcatgtattcttggtccattcatagcataagggccaaaatcaccattttcaccatttgggaaattttgatctttagatatgaaattaataacatccattctgaagccgtcaacccccttatctaaccaccatttcatcattgaataaatttcatttcttagttttggattttcccaatttaaatctggttgttttttcgagaataaatgtaaataatacatctgtgtttcttcatcatattgccatgctggaccactaaatacagatccccaattattaggaggttgtccattaattccttctttccacacatagtaatctctatattcattatttttagattttttactttccataaaccagctatgctcatctgatgtatggttaacaactaaatccatcattatttttatatttcttttatgacattctctaagtaattcatcgaaatctttcattgttccaaattcatccattatattttgataatcacttatgtcatatccattatcatcatttggtgacttatatacaggtgaaagccaaattacatctattcctaaataatttaaataatctaacttttctataattccttttaaatcaccaataccatctccattgctatctttaaaacttctaggatatatttgatatactacacattctttccaccatttcttttccataaatcatttcctccctttatataaaattatttatagttaatcggttacgtaaaagttaatagctaatttataatatagttaatcgattacttaaaagattttagttaaccgattacgtaattttgataaataaagtggttattttaaccaccttactgtttccctctcaataatactatgattcataattgtaccatccatagaatctcttccatttatcatatctagtactctaataaatgctttacatcccatttcatacaggggttgagccaatgttgttaatggcggtatagacatctctgctgttttagtattatcatatccaataatcgagagcttatctggaactcttatttttcttctataagttgcatttaatactcctgctgccatatcatcacttgcaacaaatactgcagtaaatttctttttagtatccaacaataaatcaatgcacctaataccactttcgtaagaaaaatcaccatattttattaattcttcatccacttctaaattatgctcatttaaagcatttaaatacccttgcactctaggccatccagctatcttatcttcttttgttccactgatcattgcaatatttttatgccctttatctatcaaatatttagttgctgtatacgctgccattgtatcatctacccttatataaggcatattgtgtttgaatgacattgtagatattaatatatatgggatgttcatagattttataactttataatattcctctgttatttctatacttactataattatggcatctaatttacgttcttctagaatttttaaatattctagtgttcgctttccctcagtacctgcattgcatattataacactgtaattattattatgagctacatcctcaattcctcttataatttctccatcaaaatttgttgacacatctggtataattattccaattgttctagtaatgttagtagaaagccatcttgcaatagcatttcctctgtatcccaattcttctacagcttttaacacattatttttcgtcttatcagaatatcctcctagatcatttaatactcttgatactgtagcaaccgaaacatgtgatgcttttgctacatcctttattgttactgtcattatattctcctttagttaaccgattactcaatttaaaaataacatattgtgtaaacaatgtcaatgcatatattcttaagtagctataggtaatcactaatacttaaaacttagatttttgtatattctgatgttaaaaaaatacactatttacttataccataaagtagctgtatcaaattgaagttcttttaatttgatacagctactttgaaatttcatttttaattttctatactattctttaaataatctaaaaagtaattttcacttgcatcttttaaacagttggattatttattactcctaaaaacaaaggagtattatctttatcagtaatagcaaaaataaatggtctatctagtgtcatatcataagattttgcatttggatcataaacacatccatccatttcaatttctgtatatgcagcagcttctcctccatcttcatcaatagatactgttgcttcctgagatatacttgaaacagctaatccacctttttcactgaatttagaaaaatcagcagtttttccattaaatatattttcaaggcctaaagtttttgcacaattattcaaatctagttttgatgaaaccttaaacttaggaaccttgtaatgtacatcctccatgattacatttttatctgataatgaatttagagcttcattaaatttgtttttatcatttataatatcatatacagatgttcctttatccggaagaataaacaccatttcattaccattttcaaatttaagacttgaagatttatatccattattgctttcataaattttactgtatatattattagacataaaatcacttttaacttttgatccatcacttaaacaaaagtctttttcttcagtaagattcctactaaatacatctgcccatttatctttaaagtaaacagaattaataatgttcattactgctccttcatcacttataaagtcagaaggatttccacctaaaagtcctcctgtatgttctaaaagccagttacttatatccttagctgtattaaagctttgaagatctcctttaaatatgcctgcattataatcattttctattttgtttaaagtatcttcattaaattttacatcattgttatcatcatcaatccatacagaatctgctaatatacatttgccatacttagagtcgaaactttctttttcatataactttctacactcttcacttaatttttcttcatcatttacattcaatccatttagaatttcagtctttgtattgttatctgaaccttcacttaatactgcaagagccatgtaaaaacttaatggtgagtacgatgtatttagctttttatcttcattagctaagatcattgcacctgaatctagacagaatttattaagtccttctgtaaaagtataattctttttattttcaatataaacaccatttgaatttaaagtatatccatcaataaccgtatcatgagccatagaaccgttgctatttaaataataccattgattatcaattaacttccatcccttagccatacttccatcatcatttaaataataccagtcgcccacatccttaatccagcctgttttcataactccatcattatttaaatagtaccagttttcatgatcatatttccatcctgatatactattcccattttcgtaatagtaccagcttccatttattttttcccatccattctttgaagttccgtatgcactacttggaagtaaagtcataattcccataattccacttaaaataattgatatttttttcctgttcatgtcttttcaccactttcaccaaattagtcaaatattgcttatgcaagtataaaattgtgtttcaaagtcctaaaatacaaatttattaacataaaactactataattattaattagcccataaacatagtacaaagtgttttttgttgttttggtacttaattccatttaattagtatctaatttcataatccttactttaaatttggatgtatcatttactttaataatgatacaaacttgaatttaatttcataagtttctatttttacaaaacattaattctacttttcctctctttaaaattaactctttgttaaaaaccctctttgtatagttagatgtgtttatgctataattgaaataaacgcttgtaaagtagaggtgatcaaattgaacttaaaggaaaatataaacaaatccattctattacttaaagattttaacataatttcagtctacctttttggttctgcagctaagaatcaattaaaacctgaaagtgatatagatattgcttttttaagttttttagatgttgatgagtatgaatgttttatgaaagctcaagaacttgcagaaatatttaaaagagatgttgatttaatagatttaaaaaaggcctctacagttttcaaagcacaaataataggtactagttcattaatctactgtaatgatgatgtgaaacgagcatactttgaaatgagagctttaaaagaatacgccctcttaaatgaggaaagagctgaaataataaaaaatattcaaaagggtgataaaatctatggttaatgatgttattttaaataaaattgctagtatagagcgttgtatcaaaagaattaatgaagtatatgcttcaaatccatctaatcttgatgattacactaaacaagattctatataattcttaatatacaaagagcttgtgaatgttctattgatttagctatgcacatagtatcagaaaaaaagttaggaattccacaaaatagtagagatgcttttgaagttttagaggcaaataatattatagataatactctttctaacaaattaaaacctatggttggatttagaaatattgctgttcatgactatcaaaatgttaatatgaaggttgttcaaacaattatagaaaaacacttgattgattttgaagaatacacttctgctataaagaaaatgatattttaaattatgcttgaatgacaataatttcttcaataacaacaaaatcctaagtcatttattactgactcaggatttttcacttgatttttataaattactatccatttatatgtaatattaaattatttatcaacttatggataactcggcctttaacaattaaagcaacttaaaattgttcatcgttacatctcaatcttttttaaaatttcatttaaatcttttaaaatgcttattttacctctttcaagtcttatatatccttctttttcaaaaagtttaagctttctacttaccacttcacgtctagaatctatttcaaaagctatatctttatgagtttcatatattatgcttgttttcttatttaaaaaatattcaacaattcttgattcaacagatttatgatttttatcttcttttttttcaataacaactgtgaatttttcataaatgtctttatacatataacttaaaaattcactgctttcaagaaggactttctttactatatccattggaactatacatatttctgacttttgaagtgcaatccccattatatttaatggtttataactcaaaagacaacttaaagcttcatgacaaagttcaccttcaccaatattgtataggtttgtttcatcgccatcttcatttattctctttatatttatatttccatttaatacaaaaagaattccctgacacgtacctttacctttactggatatatcttcatctgcttgtaaagtcctaaactgtacattgttctttattatgccttcatttttttcttcaatcatcttcaacacaggatagacactaaatagattttttattttgtcttctcttatttcttcattattttttctattcataaaaagctcccatagtatttcaaatttaaaactctatttaaatattatcatttaatatatattctaatagatattaaactgaaaatcaaaatatgttcttaatatttttaatcatcaaacaatagtaatttcaatgtcctaattttgaaaatctattcatcaagtacaattttattatttaactaaagattttatatataaataaagagctctaatttataaccttagaactctttaatgtatctttcatctaatatacttttcctttattcaaaattaagtttttatcaaaaacacttttaatgcttcttattatatctatattattttgagattcatgacataaaaaatattctcttttatcaagtccaataccatgttcacctgatggaattcctttaaactcatgactttttccataaagctctaaaagaaaattatgagaactgtttttccatacttcttcagtaagattacctcttactacacataaatgaatatttccatcaccggcatgtccaaagtaaattacttttatattatgctttctacctagaaaggatgcatactctgcaaaatcacatatttttgtaattggaacaacaatatctattggaatctgctcacttcctgctgtcactgcactacataatgcccctcttattttccatgtatcttcgcattctttttcattaagttcaacaaaatcaatagcatttttcttaaaaactgcatttctggctttatctttattaatatttattgatgtttcatctccatcaaaagtaagaagaataaatgcctttccaccatcatatggaagttttaaatcaagatatctttctgaatttgataccacatctctttccataaactcaattgctgtaggattgctgccagatttaataagttctgttacacattcaattccatccctaagatcattaaaaggaacaagaatacttatacatttttgtggttttggaattattttcaatactatttttgttattacaccaagggttccctcagaacctattataagattttttaaatcaagtccagaactattttttattgtcctgcttccaacagtcacaagtttaccatctcctgtaacaatatttagctctcttacataatctcttgttacaccgtactttactgctctcattccacctgcattagtacttacatttccacctattgtagaagtcttttcacctggatcaggaggatagaaataatttttctctgagacaaatgactgaatgtccttaagaagaactcctggctctacagtaatagtcatattttcttcatcaatatcaataattctattcattcttgatacatcaagaattatccctccataaattgggattgtagcacctgtaagtcctgtccctccaccccttactgttatattaatattattattatttgcatattctataactttttttacttcttcttcattttctgcaaatacaagtgcttctgcttttccatattttataccaagaccatcagttaaatacttattttcaatattatctccgagtataactgcattgttgccactgacaatatttttgagttcttcataattcatttttcaaacctcctttaacttatgcttatctgtattaaccttttctattatcttctgttagatttctttgctataaaatctccacttatctgaataaattgaactagaacaactaatataacaacagttacaatcattactccggtttcatatctataatatccatatcttattgctaaatctccaattcctcctccaccaacaattcctgccatggctgagaaaccaataagacttatcaaattaacagtaacagctcgtattagacttggaagagcttcaacaattaatacgtcttttaatattagggcaaaactagcaccagatgctattgctgcttcaattacacctttgtcaatttcattaaatgctccttcacttaaccttgcaaaaaatgctatagatgcaattgttataggaactgttgctgcttctggtccaattccagttcctgtaataacttttgtaagtggtattaaaagtaccaataatattacaaatggaagagaacgtattatatttataataaaacctgcaacacaatttaatgtcttattcttaaaaaataatctgtttgaagtaagatataaaataagtccaagaattcctccaataaaaaatgaaattatcattgctgtaattatcatctgtaatgatgcaaaaacagctgtacctaactctgcttgtaatatttctattgtattttccatctaaaccacctccaaatattgatttataactctttcagtataaaatgcattttcctttataaacttctttgctttctttatttcatctttctctcctaaaacatttattataagagttccaagaggttttcctccaatataatcaatctttccatgaattatgcttatatcaacattaaaattctttactgcctcagaaataataggcttaagactttcatcccctttatagcttacttttaatatttctccattttttattaaattaaatacttctttcggaagttctatttttgcatttctttctataagtgattttgttacttggtgtacaggatttgcaaaaatactgtacacatcatttatttcaactatttccccattactcatgactgctactttgtcaaataatctttttgcaacatccatttcatgagttataaacacgattgtaatattagttttttctttaatattctttaaaagagttattatttcatcagtattttcaagatcaagtgcagatgtggcttcatcacacaaaagaatttcaggattatttgcaagagcccttgcaattcctgctctctgcttctgacctccacttaaacttgccggatacgaatctcttttatcttttaagttaacaagttcaagtaattcttctatcctgtcttttctcttttccttaggataattatctgcttttaatacaaattcaatattttcataaattgttttcccacttattaaattaaaatgctgaaatatcattccaatcttaagtctcttttttctaagttcatttgatttaagatttgtaatattttccccatcaattattacttctccctttgtaggcttttgaagaagatttatcactcttacaagtgtactttttcctgctccacttaaacctacaattccaaaaacttcacctttatttatatttaaacttacattatcaacagcatgtacaatttgtcctttatctttaaaatccacactaatattttttaattcaatcatgtttatgccccctttatgcttattgttttatttccaccattctggtttagaaaaatctttaaatttgctactttcaattgcagctttaaattcttcactttctattatttctttgaaatctgttcctaatgttttatctaaatcagaagtttttactgctacaacattcttataattttctgttaatggttcgattgctaatgctttagaataatcaagacctgatgcatatgcataatttcctggaattaatgaagcatctgtactttcaatacttcttgcaagttgtgctccttctacttcaacaagctgaatattttttgtattttcagcaatatcaagtttacttgcctttgtagcatcaacattatctttcaattttataatattatgaacacttaacacatttaaggctcttgctagattagaagcatcatttggaactcctatttttgcaccatctggaatttgatctattgatgtatacttatttgagaacattcccattgcaagtgtaggtactgtttttactgcacttatttcaagattgttatctttgctgaatttatttaaatattcagtatgctgcattaagtttgctgaaatttcaccattatttaatgcttggtctggctgaatataatcactgaattctttaacttcaacagtgtaacctttcttttctaataatggtgtaaatatttccttaaccatatccccataaggtcctggacacaccccgactattatatttttaccatctgctgcatcatttactttctttgaagtctttgacccacacgctattagacttaagcctatcactcctgtcaatgttaatattgctaatctctttaaaattttcatttttattccccctcgaatatgcttattactttatttaaatatatttaatattatcaagttactctgaattaaaattgcataatgtatgcctcactatgaactttacaactatactctagaaattacatattaatttcaaaattaattgaaaacaaatttactaaagaaaaatacgccagagaataaactctggcgtaatacatacacacaataattattctctcatctaccagtttaaacaaactgcaggaattagcaccgtcacatatagtaaatgaactaaatgtcggttgccgggtttcatagggccagtccctccaccactcttgataagttgtctctattaagttgataaacttagtatactttccattttcaaccttgtcaacctttttttatatttttatttaaatagttgaactttctcatttaaatttcaccttgaaaaatatctgatttcaattgcaatacacatctgttaatttatatactccttaagcttttctaatctttttaaagtctctttgagtgtctcttcctttttagcaaaatgaaatcttatataattatttacatcttccttgaagaaacttgatccaggtactccagcaacacctatattttttataagccatactgcaaaatcataatcacttttgtgtccaaactgtgatatatctaccatgacataatatgcaccctgtggcataaaatattttaatccaattttatcaagtccatctaaaaataattttcttttgctatcataactttctgttaatttatcataataatcctgatcaaattgaagtcctacaactgctgcttcttgaagtggcgctgcagctccaactgtaagaaaatcgtggacttttttgcactgctcaattatttctttagatgcaataacatatccaagtctccatcctgtaatagaatatgtcttagataatgaactacatgaaattgtacgctcaaacatacctttaagtgacgccatgtatgtatgtttgtatggtggaaatacaagatgctcatatacttcgtctgttattacaaaaacatcaaattcaattgcaagttttgcaatataatctaactcctctttggtaaacacctttcctgtaggattggaaggattacataaaataattgctttaggcttctgctcaaaggctcttctaagttcatccttatcaaaattaaaataaggtggttttaaaggtacataaataggttctgatcctgaaagtattgtatctgctgtataattttcataaaatggtgaaaatactataactttatcgcctatattgcataaactcatcattgcagtcatcatagcttcagtacttccacaagttacaactatattttcatctggatttatatttacccccataaatttactttgcttttttgcaagttcatttctaaaattctgtgctccccatgttacagaatactgatgtggtccttcatctgctacttcttttaatctatctgtaatctcctttggtggatcaaaatctggaaatccttgagataagtttattgcgttatattcattggatatccttgtcatttttcttattactgattctgtgaatccgtctagtcttgtacttaattttggcatgtctattccccccattgtcttattgctttttattatgtataagaaattatccatcataagaactaattaaataatcttccaattccttatagaattcttatcagcttacttggttttagttataatactttaaatttcttattctgtcaatacttaccttagttctaataaaataattattttcactaaataatttcattctccatgaccttttaaaatttttcttgacaactctaatcataattactaaaataaaattcattaatcccaagtaaacaaataggaatagtgtgcatacactatgaatatgaattattgattgatataaatacataaacttacccaacaaggaggatttaaatatgaaaatagaaactttattagtccatggagcagttgatggagatgaatttactggttcagtcaatgtacctatttaccagacatcaacttataagcagcaaggtcttggaaaatataaatacgaatattcaagaactggaaaccctactagagaagcattagaaaaaactactgctcttcttgaaaatggcattggtgctcttgcatttggcagtggaatggctgcaattacagcagttctttctctatttaaaagtggcgataaaataataattccagataatctttatggaggaacattcagagttatagacaaggtatttaaaaattttaatattaattatgaacttgttgatatttcagacttatcaagtataaagaaaatttttgacaaagacaaaaatagtcataagattaaggcagtatttgttgaaactccaacaaatcctctaatggatattacagatatagaaaatgtaagtagccttgcaaaagaatatgaatctttgactattgtggacaacacttttatgtcaccatatcttcaaaaaccattaaatcttggtgctgatattgtaattcacagtgccacaaaatatcttggtggtcatagtaatgtagttgctggacttgttgccgttaaagataataaagaaatactagataaactttattttattcaaaattctactggtggcattcttggaccatttgattcatatatgcttcttcaagggataaaaaccctaggagttcgtatggacaagcataatgaaaacacttccaaaatagcagattatttattagcaagtaagtttgttgaaaaaatatattatccaggcttaaaaacttcaaaaggctatgaaatacaaaaaaagcaagcttctggttttggtggaatgatatcctttgtaacaaaagatattattgactataaaaaatttcttaaatcattaaaacttataactttagctgaaagcctcggtggtgttgaatcattaatatgtcacccatcaacaatgactcatgctgcaattccatatgaaataagaaaaaaaacaggaattgttgacaatctcctaaggctttctgttggaattgaaaatgttgatgatcttatagatgatcttgatcaagccttcactaaaagtattctactctaaaatttaaccatatattgttatcttttgttaaagaaataattataaatcctagcactacaattcaataatattaaactataattttaaagttaaatatgcaatttacttattttattagataaaataacgttcttatacaattcaataaaagaggaggattatactatgcattatataaatgatatacgagatattattggaaatacaccactattgaagttaaataatatcacaccaaataaagatataaatatttttgcaaaacttgaatatttaaacccaggtggaagtattaaagacaggattggaattgaaataattgaaactgctgaaaaagatggccttttaaaacctggttctacaataattgaagcaactgctggaaatactggtatcggtcttgcacttgctgcttttgaaaaaggatataaactaatcatagttattccagaaaaattctctattgaaaaacaaatcctaatgaaagctttaggtgctgaacttattataactccatctgataaaggcattgaaggtgcagttgaaaaggctgaaaaactcttaaatgaaattccaaattcatttatggcaagacaatttgataatcctgcaaatcttgaagcaaataaaaaaactggaaaagaaatatatgatgcattagatggaaaagttgatgtgcttgttgctggtgcaggatctggtggcacaattaccggaattgctcaatatttaaaatctaaaaatcctaatataaaaatagtccttgctgaccctgtaggatctattttaggtggtggtgaatctggaacttacaaagttgaaggtattggtaatcactttattcccaaaatattcgattcttcgttaatagatgatgttgaaaaaatacaagatgatgaagctatgtattttgttcgtcttctatcaaaaaaggaaggggtgcttgctggttcttcttcaggtgctgctgttgctggtgctgttaaacaagcgtataaagcaaaagaacctataaatatagtggttatacttcctgatagaagtgatagatatttcagccagcatttatatgattttaacatgaaattatcagatttcagatttaatgcattatttgatgactgggctgatgaatacgatgaaacagttgaatctaaagaaggtgaatacaatgaagtgtttgataactataatgagatattaaatgaaacagcaaagcatatttcaaagtataaatatgcaaaagttctggatattggtgcaggtacaggtaatcttacaaatatagcatcaaaaattggatataatattgtaggagttgaacctaatataaaaatgagaaaaatagcttctgaaaaatatccagatataaaatttattcctggtaccttcctttcacttcctatagaaaataatagtattgatgctattattagcagctacgcatttcatcacttgactgatgatgaaaaagaggaagctgtgattctatttaaaaataaactaaaaaaagatggagttatggtcattgcagataccatgtatgaatctgaagaatctaaaaagaacattttaaaagatgcagaaacatctcattgcttatctcttcttcatgatttagaaactgaattttattcaacacatgaagtactaaaagacatatttgaaaaagaagattttaaagtaagtttccttcaaatgaataaatatgtatggatattaacagcaaaactaaactcttagttttcaataaattataataattttcttcagatgctaaaaagaccctaccataaaacataaaaattggtataggtcttttttactttgaaacaaaaactaatttttataatcttatgactttataaattttcattacaaattcttataataatttctaaagcacatggataatataaatacataatatttattacataaacagcaatagtattccttatattctctttgatattaccttgactttaataccccacagaaaggaaataactttatgaaaattttaaaatactttttaatatttgttcctataagctttattgccgaatttttccatgcctctggtacaattatgtttttattatcatgtggatcaataattccccttgcaggtttaatgggagaaggtactgaagaaatttctttttactctggtccaaaaattggcggatttttaaatggaacatttggtaatgcaacagaacttataatatctttttttgctctaaaaaaaggattattcgaagtggtaaaatcatctattgcaggagcagttattggaaatatactacttgtaataggggcaagcatgctggctggtggtttaaaatataagactcaaaaattcaataaaaaaattacagaagttacatcaagtatgcttttgtttgccgttataggtctatgtattcctgcattatttacccattcagttgatcctgcacttttaaatacaagatatgaaggtttaagtatatttgttgctatagtaatgatgataatttatattttaagtttatatttttcatttaatacccataaagacatttacacacatgaatatgaagaagaagaacataaggcaaaatggagtttaaaaaaagccatttctgttctcgttatatcaacaataataattgcaatagaaagtgaattcttagtaaatggaatagaagatattacagcaagccttggatggagtgaattttttgttggtattatattaattcctattataggaaatgctgctgaacacagtacagctgttattatggcactaaaaaacaaaatggatgttggacttgaaattgctataggatcaagtcttcaaataatcttatttgtagctcctattcttatatttataagtcttttctttactcctatgagtataatatttaatacatttgaacttatagctcttattgcctctgtactaattgcaaatagagtttcacaagatggtgaatctaactaccttgaaggagtacaacttttagctgtttatcttataatcgctgcatcattttttatcgtttaaatcttctaaaataaaaaataaaggatataaactactatacaaatttatatcctttatccttaaaaatactgtttactaactaacttcattaccagcatattatattctatttttaatcaatatcttcttttattattttaagcatttcttctttttcattaatattttcattaataattctagttgcttgcttcatcttcacattttcaaaatattttcgtacaagacgtccatttccaaaatttcttcctttattttctgaaagttcttcaaaatcctctttaagttttttatatgcattatgagaaattttatacttttcccttttgcaaagagatttaaatattttaaaaagttcatctccactataatcattgaattgaatattaaatttaattctgctttcaagtccaggattaatatttaatagttctttcatttcttttgtatatccagccattattacaataagtttatcacggttatcttccatttcctttatgagagttcctattgcttcacctccaaaatcattttcacttccgctgtttaatgtatatgcctcatcgataaatagaatcccaccataagcttcttttattttttcaagagtctttggacctgtctgacctacatactgaccaacaagatcagaccttgttacttccaccatgtgtcctttttttaatattcccatggctttaagtatctttcctacaatccttgcaactgttgtttttcctgtccctggatttcctgaaaaaatcatatttaaagagacatcttcacaatttattcccatttccttttttctatgtataagttctacagtgtttaatatgtcttttataagactttttacattatccagtcctacaagactttcaagttgtgtttcatattcttttatactatctcttgcagtaaattttaaatcaactccaaaatcttcacttgtaagtgttgtcaactcttcttcacatacggtttcatcaccagttctgaaagccttttctctaacagcttcatccataagattacgtacaacacgtgcatttgcaaaattttcatcaactttttccttctggatcctttcaatgaaagccttttcaccatcttcactaagtttataatactcttctttagcaatatttttcgcaatatgtatcaattcttcatctgtataatcatcaaaatttatcataagatttattctgctttgaagtcctggattcatattaattaaatttctcatttcttttttataaccagcaaagataactgtaaactttcctctgttatcttccatagacttaaggagtgtttcgatagcttctttaccataatcattactattttccccgccttttgcaagggaatatgcttcatctataaacagtattccacccatagccttatctatagcctttttagtaagttttgcagtttcgccaataaattttcctacaatatcacttctatctacttcaacaacatgtcctttttcaagtattccaagatagtaaaaaatatcaccaataagtcttgcaactgttgtttttccagtacctggatttcccataaaggcaaaatgatacgataagtttatctctttatttattttaagaacttcatttctatttttagcatatttaataagccttactattctttcaatttcctttttaacatttttaagtcctgtcagtgaatttaatttttctaatgcttcttcaagtgtatttgaatttctttcaccttcattagacttactatttttctgaaactctgatgattccttcttagttaaatcgtcttctttctttgcaggcttttttttatccatttttttatcattgtgtttatctttattttcagtgcttttataagagtctacattatcatatttagatttgctaaaatcagatttatattcatcactagtttttttcagcttataattttccgtattttctaaagcttttattatagtatctatattttctataaatcgattggtgcttccactctttttgcagctttttaaatagctatcatgttctactgtttcagtatcttctgatctgacttcataagaagattgagattcctgtatattttgaacatcctgcacagacacgctaaaagttcttgttgatatttcattaacatatttatttattgccttggctacatagcctgtacaattttctaaaagcgatgtcctacattctttaagacactgtacataattttctgttatatataaaactttaattatatcaagactaagttcataatctacacccagctctcttgctctgtacagaattttcaaagtatcttcttcttctactcccatagcaatataaattttgcttaaaagccttactgcgcagaaattgcaatcatcaaattgtactgccataattccatatgataatgattcctcataattatttctataaagttcaattcttccaagagttattacagcatcaatatcctttttgttaatttcaagtgctttgtaagcataactatatgaattttccacatcatttatttcataaaatatacaactaacaagtcccaaatacctattactctttttatcatatgtaattcctttttggaaacattcactacctttaatatattcattacacttgaaataagtaagagcaagaagatagtatagacctggatgacatggaaaacagcttattgaattttttaaaatagctgtcgactgattaaaaagcataaagtcattgcagtactgtatttcatgcttaaatttattaaattgttttatattaaataaatcagtatattccaaaaatcatccactccctgtatattatctcaaaactttatttatattccttgaaaactctgtatattacacttgagtaacctcacagtcaaggtgatttgtatcgtttaatcctaaaagagccggtttcatatcatcgttaaatgttatagtatttacgcatgtattacctagtgctattttatggtacatgctcatgtcccattcaaaaattcctataagacctgcctttattattcctccatgagctacaataacaattttctttcccttatgcttatttgctatttccataatacaattttttgctcttatggatgcatttagagtgctcatatctccaccacagaattttccttctctcttatcatttctccattcattaaatatatctggatacttttctgctataccttttacagtaagaccttcccattcaccaaaattaatttctctgatttcttctgctatactaacttgttttccactttcatcacataatattttagccgtttcgtaagctcttttaagtggacttgaaaatatataatcaaaatcgctttttaatctttccttaagcataaaagcctgtctaattccttcattagataatggtatatcagtacttccttgaaactttccaagtatattccattcagtttctccgtgtcttattaacattattgtagtcttcatatgtactcctttcaaaacctagcctaactcttctaatattgtaacatattttaacatacttatataaaaaaacaaaaagaaactcattatatttaacaaataataagtttcttttacattgcagtaattaatgaaataaaatcataatacttataaactttctactgcaccatgaagtttatttataaaaatatcaaacttgctatataagtttttgcttattggattcttactatcttctgttaatttaagtttatttattatagtcattgcagccttatccattttgtttaatatatcctttaaaagttctttatttttggtctcttccacatttataaaatcagcccaaaataaaagtggtagaactaaaaactgaattaccatataactcaaagcaaatgtttcctttatcttgaagtatttaccataagtcatcattattaaaacactacctattattttaattatcctatcacttgactgctttttgcataatactgcttctatgccgcttataagtccatcaacagttattgattttaaatcatctggaagatccgatacaagtgaagttgaaaaatcatttattatttttgcaaatatactcctactggtctcgtctctaagattaccatcatagtcaagcattatgcttcctttatgataaaaaagaggattaaactgaaatgatgttttaatgtaatgtgtttctcctgctacagaattaaaaagacaattcacataatcatatttagaatttactgcaataattttttctttgttaccatcaataagtttcttatatttatttataaattcattggaaaacccttgtccatttattgatacacattttataactttaggagaacgtactgttgtgtactgcgccttatttcctcctttagaatgtcctgttacaattatcttatcagaatcgatgctattaacataattaagtgcataaatctgctgctccgtatcatattcatatgcaccctgaccgttgtcatcccattcttttattgtcgttgttcctctgaaaaccacaattacattttcatcagaatccttaaatgctgctgtcctcattccacttttatgattttcaacattaattataacaagttttggaagattaggtttagttaaaatctgttcaagggttctttcccattcttcttttgttgatgaaaccacacaattgctcatcttatccataagtatcttaagattatcgtcctttaatatatcaagtacaagttcctctacactttcatcatcatatgcatcccattccaagtatatcaattcatctaaaagtatgaattcatcattacttagcatgcacacttttctctcatctcctaatttttattacgctcttataatcacgtttatatatgatattttattcttcatatgacaaaaagagactactttaatttattttcctttatttttttcttaatataattttttgcagcctttgcagtataaaccttaaggtttaaatcgtctgaaatcttccttgtatactcctcattttttattgcttctttaagctgacttatatttcttacttcatcatcaaaacatgttctaacacatccaagcattataggatagtgactgtcactccccgtaatatagggaacattgatgttttttgacagttcagcaacttctttttcaacagttataagtcctcttttgtatatatccttgctatttaaatcaagagcatctagacgttttaaatttttttcactctgaagataaagtttatgattttctctgtatggatgacttcctatagtaaggcactcactttcctctgccatatcaagaagatcttcaaaatgaataaagtctgctttttttctgcaatttttaagattttcttttatactatatacttcctgcctttggccacatacaataacatgacctccataccttatatcaacttccatacctacatatacataaaatccattaacatcatatctgtcgttttcataaataaaattatcttcaagaaatgaaaaagaggagtcgatatctattgcattaaaatgctcacaaaggactaatccatgtagtccactatttttagcaaaattaattccctgtataaacaactcctcatcaaaattcagcttcttactaagaattccatgaacatgaaaatccatattcatatttctactcctaaaaattaatctattattagtatattctgaaatcttgtaatttttccacaaaatatattaataatctatatgttcaccattaaagagaaattttttcaaatatatctttgctgtatttttccatgtcaagaacactaatcatttcatacttatcttttacacctgtaaaatatactgacaatgcatctttgcttataatatcagtttgttcttctagatgtgtttcgcttttacaattcaacatttttttcctagcaagaatccaaggtgcttcattttcaaccatcttttcaagtatcttaccactataacagccataaaatttcaaaacaccttccacaatattcttttcaatatctaaaagatttacttcttcattattcagtatttcattatttatatattcaaaaccatagactttatatctttcatatacactttcaagtaatggtcctctatcccctgccttaaaatcttcatcaaataaaaaatgttcagtaaacacataataaaaggcctgtacataataaatcagtttttgaatcattaataaagtaacatcatcacttcttgtaagtatatattttattactccatcaaccttactttcaacttttcctgttgtcatcatgaattttactgcttttctacttctgcaatattcataagcctttattttatctttatttgtctcaagcattaaagaatagtactgaatatttttatatatcttctttaaaacatttgaatcatgaacagataccatgtctcctttaagataccttgaaactgcatcatttgataatcctaaaataattgataaagattcttctgatatatcatatttttttaaaatgatgcttattttatcattttctataaggtcattcttttttctatattcactatataatgtctctaaattttctctgcatatatcatttacgaatatttcatttctacactgacaacagatagcgtttttaccatcatatgaaatttcttcatcatttaaagttgttgttatatgtatgtcatttactatatatggctgcatctttatacagtattcacaaaaagcatattgtttcatacttttttctcctcttctagaactgttatttacttaaaaatatatgtaataggtttatttcttttatgtaatgaaacaagcattctataaggttcctcatcactttgtatcatattaaatctcatgtaaatatcaacactttccttttcacccttaatattgtagagatcttttacaggacaaaatacataaagatcattatgtactacaccatcttgcatattcttaagtccataacagaaatcttctttaacaagttgtgataatatttccacgagcttttcttcatttatgttatactcctctataaattgaagattttctaccctgcttccttcaagagaaattgtaatcttatcttgtaacgcacattctttaataatatctattaaatttgtaatcatttctttagtataatcttttaatatcaagttcctgccacctcataacttaatactgaacaattctatcaacatttttaaatcctgatgctttctgatgtctcatattgcatataaaataatcaagagcatctataggattaacagttttaatattcagcttatttaaagtttctctgtcaaatacaattgataatattgttatatcgttcttagcacctttatcaatatcaaccacattatcaacagcatgtactacaactttatttacaggtataatgttcataatattcttagctacaaaaagtatactgctacatacatattcttctatcatttcataataagtgatctccacttcttcatcatttccagatatctctttattaaatctgctttttggaattactttttctgaattcaccttaaattcaacttccatagactctgaatcatttgtgccaatttctacttcgcttcctaattttaaaagtctatcaaatggtcttatctcatctataacctgaaaatagcaatccaaatctccatttaagactcgaaggcttaactgacttattttttcataatccccaaaaagggctttgtctttcatctctgcaatttcaatatcttttaataattctctcttttttttctcttctaaaaatttaaagattctaaaaagaaatcctggctggaagctttcatatttttccaaagcatctatcttattgggcccatctgaatttatatcaaatggtggttttatattatttataccttgccaatttaattcatccaaacaatattgatgcatacttttaatttcttctaatgatatattttcactttttaactcttcatctttacatttagtcttattatttttattgttgtttttatttgcattttctaataaatcttttagttttttcccaccaagatcaactcccacacctttcttatcaagctccattctgctttctaaagaaattatagaagttcttttaacacttaatcccattttaccacctctatttaaagtcattttttctgttttccctaaaatatattataaatttttcgttatttcactgtcaatcttctattgtagaaataaatatgcaaatacaaacttgaaataaagtacccagtgatataaaacatttacatcctgggtacttttttatttttacctatcttaattctgataaaactctgtcaataaactcatttttatcaagtgccttaaaataaatttcattttcagtaattgggataaatgaagagcctgtaaattcatattcttcacttatcctttcaatacactcagtaaatagaccttttccatttttatataaagttatataaatataatttatatctatcatagaatcacacacaaaatcattagtaagcttaagctctattatatcttcatctagcctaatacttgcaagaacttcattccacgattttatttcagtattatatacaccctctgcaccactaaacatatcatctactttcttttcaagctctttaacagtagtgcatatacattcctttaacataaattcaatttcttcttttgtgtactgggatacatatgatgtagctttttctttatttttacccaactcctcatcaatactgtattcatcttgaacatagctgaatctctcacatacttcatcataacttaaacattcatcattatagataatattttgtcccattcacaatcacattccctttacaatattcctaatatcaatatattgcaattatcactattatataactgtttaaagaacatttattttgttaaatattacacaaagtcttattattactcacattaagaaaaattctttaatatacctacagcaactccaaggatactatattcctgttctccattaagtattattggatcatacttatgattttctggttttaagattacatatttcccctttgtcttaaaagtcttaagtgttgcttcaccttcaatttcaactgcaactacatcattagtacatggatatttattcttattaataagaacatgatcaccatcatttatatttttcattaccattgaatcacctttaatttttaatataaataaatctttactacctcttatccatgatttaggaatattgcagctatactcaacttcatcattcataagaatagggctccctgctgctatttcattaaagacaggtatggttacaacttcttcaactctattcttaaaattatcatctgatgtgtacacttctccacattcataaaaatcagttataaattcatgacatacatttctatttaaatctatatattttatagtttcaaaatccatcatgatttcatctgctatattcccattaattttattagtatttaatatattgttttcactattaaaaatattattactatcatgatctgtgcacttttcaatatttgatagatcgaaagataaaagactataagaatactgtttgtcatcgttcctattatgttttttcacagcctttggctttttatgaacatttaatttactcaaaggtttttttgcatcgtctttcataataaatttttcttttaaagttacagattttccttttacattatatccaagagatgaaaactttctctttttatttatccatccacaacatttatccagtctatcagtatcaagtaccaaagtcagagtagaatacatttttttattatataaagtatctattatttgaagttcaattctagtaaatttttgaacttcatcaacaacaatatgagtatattttttattcttctcatttttacattgctctgctgcatacaaagctgcatcttcaaaatcaacaagattattatctcttaaaatcctgttatactcagtcattatattaaaaatacacttcctagctttagaattctttcttatttttataagtttttcttcttttccatacttaatattgagtcttgaacttctatcacattcataataatcattttcttctgtaaaaatacattctttaatccattttatttcatccataaaaaattctacatactcttcattaaagaattttatatttttgtaaactgaaccactcttttcttttactttctttatagcttcttttaaagcttctctgcacaccttaatatctgcaattgaataatctgttttgtgattttcattatgtttactaaaataggataaaataatggaattaatattattcatttcaagtttctttttattctcatcatcaaaaaaacttttttgtattattgctttgcttaatatactttcgtgaatactttcaagggcttttagatgatgactatcttttgcaagtattaaaatatcgtcatctttattaacacaataaaactgctgaagcttaaaagctctttttattgctgaaactgtcttaccgcatgaaacttcaccctttataagctttattccattagctctagcgtttattatccttttctgtgctaaattaaattccattttacttccctcttcttcctagcaaaaataatacaaattccgtgtcttttcattataattattctactataatctgtccattcttgcaaaggctttaaattcttaacaacaagtatatttttcatattaataatataatgttaaaatatttgccattattataatataattgtaaaatatattataatatgtaattgctttagtctaaatgtaatttaattttttaagcaatcaaaccaataccatacttaggaggaacaaacaatgaattttgaattttcaaataatctaaaatactttcagacaggaatatttaatgttttaaacgacaaaaaagctgaactcataaagcaaggtaaaaaagtgtacaacctttcagttggcacaccagattttgaaccagacgagcatgtaaagcaagcacttataaattgtgcaaaaaactcagagaactggaaatattctttagatgatatgcctgaactaatagatgcattaatttcttattataaaaatagatttaatgtaaacttaaactctgatgaaataatgtcagtgtatggttctcaagaaggacttacacatataggtttttccttatgtaataaagatgatatagtccttgtacctaatccaggatatcctatttttgaaataggaccctatctttcaggcgctgaaatatcttattaccctcttcttccagaaaataattatcttccagacctatacaaaatagatgaagatattttaaaaagaacaaaatttatggtagtatcttatcctatgaatcctgtatgtgctaccgcacctttagaattctatgatgaacttattgtctttgcgaaaaaacataatataataataatacatgacaatgcatattcagacatagtttatgatggagaatgtggtagctcttttttatctcatgaaggagcaaaagaagtgggtgttgaattctactcattatcaaaatcatttaatataactggtgcaagagtatcttttgtagttggtaatagtgatataataaagcacttcaaaatgcttcgttcacaaattgattatggtatatttaaaccaatccagcatgctgcaattgctgctcttactggaccacaagatagtgttaaactacactgcaaggaatatgaaaaaagaagaaatgcattatgcagaggcttaagtaaaataggatggaatgttcctgacagcaaaggaagcatgtttgcatgggctccaattccatctaactttaaaagttcaagtgatttctgtatggagctcatggaaaagacaggtgttatatgtactcctggaagtgcttttggatctcttggggaaggttacgttagatttgctcttgttctccctgttcctattattgaagaagcagtgtcaaggattgctgaaagtggaattttaaaaacaaaataattttataattataaaaagtacctaaatcttagaaacactattatacaaatagttataagatttaggtactttattatatatttactctactataagctttgtaattataatctaaaaatcacttggttatttcaacatcaattgtcatatctcaatttcctactgtcaattaatatatatgttgcaataattattctgcatataatttcaaaaatcctgtaaggattttcaccttaattgtcaattctcaactgtcaattgcaatatatatattattttttattttcttttttctacaaattctcttattaacttagttaattgaattgctacagtaggcataaatgcaagtacgtgaattgtaactatatcatttagagctaatggagtaacttcaaataatccttgaagtcctggtacaagaagtacagcatttactaaaactatacctataccaaaagccatccagctgaatctattagagaaaagtccaatagaaaatattgattttttccctctacagttaaatccgtggaataatcttgcaatacataaagtagcaaaagccattgtcatagcagttccaacagaaccctttgataatccaatatgataagctatcattgtaaataatccaataactaatccttgaagtgtaatacttattataaagtctttagtaagtattgattctttggcatttcttggtttgtctttaagtacatccttttttgatttttccatacctattgcaattgcaggaagactgtctgtaattaaatttataaataataagtggactggtgcaaatggagctggaagtgcaaatattgaagcataaagaacacttaatattccagacatattacctgataataagaatttgattgaattcttaatatttgagtatatatttcttccattagtaattgattttactattgtagcaaaattatcatcagttaatatcatagatgcagcatcttttgatacttctgttccagtaatacccatagctataccgatatctgcctgcttaagtgctggagcatcattaacaccatcaccagtcatagcaacaattttacctttattctgccatgcctttactattcttatcttatgttctggagatactctagcataaactgatatatgttctaatgatgcgttcagttcatcttcagacattttatcaagttctaatccttccatagctatatcatctttttgcaaaattccaatttcttttgcaatggcagatgctgttattttatgatctcctgtaatcatgataggttttattgaagcctttatacaatcagcaacagcagctttagattcttctcttggaggatcaatcattgaaataagtccaaggaaagtaaaatcattttcatcatctaaattaagttctttatcttctgctgtttctttatatgcaaatgcaagcactctaagtccttgtgtcgataaatttttgttagcagcatttatattatctgcatcttcctttgtaaattctcttataccagacgaagtctttatatttactgttctttctaaaagcacatctaaagcacccttagttatcattaagtattttccatttatattatgaagagtactcattaattttctatcagaatcaaatggaatttctctaagtcttggataagtttttctacattctatttcatttattgagaatttatgtcctaagtttgttaaagctacttcagttggatcaccaatttcattgccatctactgaaacagcatcactacaaagaatagaactatttaacaaaaagctttctaactcatcatttatattaatattttcactatcaattgtcttattatcaacaaaaatcttttttacagtcattttattttgagttaatgttcctgttttatctgaacatattacagatacacatccaagaccttcaacggctttaagcttcttaataattgcattttcttttgccattgattgagttcctattgcaagaacaattgtaactattgaacttaatgcttctggtatagcggctactgctaaagctacagcaaacattaatgagtctaaaagtggagttcctctatacatacttaagaaaaataccaacgcacatatacctataattccaattgccaatttttttgaaaattcatctaaagatacttgaagaggtgtagctttttcttgagtttcttccattaaagaagctatctttccaagctctgtattcatccctgttttagtaactaaaacagtagctcttccatatgtaactaacgaacttgaaaataccatgtttttttgatctccaagagctacttcagttttatttataatatcttgagttttttcaactgcttcagattctcctgttaaagaactttcattaactttaagtgaataattttctaaaattcttccatctgcaacaactaaatctcctgcctcaagaagaagaatatctccaggcacaacgtcctttgatgctatttctacctttttatcatctcttatgacttttgcattaggtgctgataatgcttttaaactatcaagtgattgttctgctttaacatattgaactgtacctaatactgcgtttattaaaattactgctataataacaattgtactttccaagtttccagtcaatgctgaaataatagcggctgctattagtataataaccaaaaaatctttaaattgctcaataaatacagaccatatacttttcttctccttttcatttaaaatattttctcccactgaattcaaaagatcagtacatttttctttcgacagaccctccatagatgaattcaattcttttaaacattcatctgtggtcttactaaaaaagttgttcataataatcttcctctctaatatttagtaataagttattttacaagtcctaattttaataataaaaaaagagacctttaatataacttcaatatcttttaaagttatattaaaagtctcatcaccatttaggtatataacaccaggctaaacacgccgcggctgttgatgctatatttttgactactcccctttaacaaatccaatatttaatttaatatcagtatacttcactagtaacatgttgtcaataaaaataaataacatttttatgcatatatttcatatttttatttaaaacacataaataatccatatatatcttaaactataaaacttttataaaaataataaaagctacatattttttaattactttctataataatttatctccaaatatcttcatttaataaataaactattatagaaattaaagctgtatgtatgaaacatataaaatcacatttcgtacatacagcttatataaacattataatatattttttttatttattttagtaaagtgatattgccacaccactatcagctaacataaatccatcaacagtagttccacttgccatagaaccatctttatttaaataatatgcattgttattatctacaacccaacctgtttccattgcaccattattgtttaacaaataccacttaccagcatccttaacccatccagtagccattattccatcagcttttaaatagtaccagttattattatctctaatccatccagtaactctgctttcgccatttgaatagtaccaatttccattttcagaaatccatcttccgcctgatacagtattaggtaacacttctttatctttaatttcacctatataaaatgaatttccatcttccttaattgagtaatttaatacgtccttatagaaatctaaggatgcataaacttgtccacctaaagttatcattttactttcatgttttgtaccatttaatatataagtattttctgcaaaatttattacaagcatcatattattttttcttaaataatactcagttgatatatcaccttcaagtctatctcccatttttaaagttacagtttctagtggtaaatacacttttccatcatatacttttacaccaaagtctggatatttatcagagttaatatatatttctggattaagcatcatagcatcatctattaaatgatctcctgacaaattaacatttacttctccattagcattttcattatattgttctgatccttcgcctatataaatacagtttccttcgtatcccatattatatcctaaaacatcgcttaaaaatctaatcggtacatatactgtattatctacaacttcaaatttcacattactttctataccattcactctgtatttattgttttttatgtccatatttatcattttatcactttttctaagcatgtatgcatcttcatatgagccttctagtctatctcccatgctaaaagcaactttttctaatggaagatatgcttcactatttaatattttaacatcctctgaattcaattccttattattaacaaatatttcaggcttaatcatgaaacctggatctatttcatcttttatagctgattttgttaatccagttccatacgcttctgcatgagcagatataactggtgtaatcattaaacctaaagctaaacaaaatggtattcctctaaataaattttttcttatcataataaattcctccttgaagttaaataactaatttaataaaattttcattaactcttttaatattctcttcaaaacataaattgtaattttaatatttttagtcttaaatagttcttatactattaacacaatcagcaaatataaaatgttgcacattatataaaacttttttattttttaatttttattaactataatacttgccaagcaagtattagtaaaatttatatcttgaaagtgatccttaaaaattctttttaaattaataaaagcctagtaaatttaaaaagttcaaatttactagacttttaagttaaagccaattatatgttttacataaataaaattcttagcattatataactgctttttacggttaattcgacaggtgacagtcaccttgttttatttgcataaatcaattattgcttgtgtaaatatctttccactaagcattaattcgtcaataacagcaaattcatcatttccatgcatgttattatcagtacctggcattgaacatccaaatgctactccattttctaaatgatgtacataagttcctccaccgattgcaaggcattctcccttttgtccgctataatcttcatagcattttagtaatgtacgtacaaaatcagaatcactgcttacatgatgtgctggatttaatttatcagattcttcagttcctaatacaatcttaacatctgccatattctttcttaaagcttcagttaaattttcatcatttgcacatattggtgatcttgaatcaaaagttccctttaaagatgtagtattatattcaaaaatagtaaatgccatacttaagcttccacttaactcgtcactcatgttaactccacatcctgcaccaacatggtcattatgtgggaacaatttgttgacagcacataatctttcaaatccttcactcttagcacatggcattgaagttaataattcaattattgctgtaattgcattgtctccattttcaggtgttgaagcatgtgctcctttaccttttgcatttattgttattacagaaccatcttctgtaacactaaatctaacaccagttttttcttctgctttcttgcataagtctgaaacaacatctaaagtgaaaccttcaacttctgcagaagccttatctggaacaacattagcctttactccaccatttactcttataactcttggcagtgccttatcttcagcatattcacttgtaaattctgctgctaaacgacctttttctatatttattaatgggaattcagcatcaggtgaaaatgtcattggagcttctttttctactgcatagtaatgttcaatatcagaacttccacattcttcatctgtacctaatattaatcttacatttttacttaatggaatattcatatccttaacagcttttaatgcatacaatgcaactatagctggacctttatcatctgaacttcctctaccatatatttttccatctttaattactggttcataaggctgagttactgtccattcatctccagctgggacaacatctaaatgtgctagtatatcaagtcctttttccttatcactaaaatcaacagttccaacataattatcataatttttagttttaaatcccatgctttctgctaactttaaagcagcttcaagagctttagctggaccttcaccataaggcatattttcttttgcttcacctctgtcactttttattcttatttgatcacatatatcattaagtatttgttctttatttttttcaaagtactcttcaatttgttttttatacataatttatacctgccttcctaaaatgaacgtattaatgtaaatactgtatttctttatattataactcaaaatacatacttttttaatattttctcataaatattaaaaataatactatatttttaattattgtttcatgtaattttataccaaaaagaattgctttcattaattctaattataaattattaatgaaagcaattctataaattttttattctatatctattattgaattgtttgaatattcatgtcatcttcagaatctatatattctgaagactttgtgattttatattttgtaataatcacacttataatatacataatcaatcctataggtatccaaaatagcgagtatccaatactttcttttaagtacggaagtattatatcccatccaacgccttttaaattaagattctttaaaggtactgctacctgtgcaagtggtgatataaacttaataaagaattcaacaccagctggcatcatataaaacggatatgccacaccagatgtcatcataaaaggggttgagcatacggtatatacaaaaacaaaataatccattttacttaatatggacgcaaatacaagtccaaatccaatgagattaaagaaaaatgctatcattaacactgcatatatccaaagttctcctttcattggtagcgaataaaatctttttattaaacataatccaataaatgttgctgtgattactactaaagcaaataatgctattcttataattatatctagaagactaaatataaattcttttgaacgtattttcattgttgcaaaatcttttttcttctttatgaacatgggtatgaaaaattcacataaaaaggccatttgaattacaagaggaacaactgtatatgacatgttcctaatatagcttccctgaggatcatataatatacgctgtacatatgaaaatgttccaatagccgttttagctaccgatggatacattccatttccttgaagcattttaagttctgttccggcacttaaagttcccataacagatgctgcaccgcttaatgcatttcctccaataagcatgttagttccatcgactattatctctgctttaggggattttttcatactaacatctttactaaaattttgtggtattattatacctccatgaacagttctcgctttaacagcttgttctaggtcagattctgaatcaaaaaaatgatctacctttaacgacggacaatttgataactgttcaattactgttcgtgataaagaagtattatctaaatcaactataccaaaaggaatattttctacgtatacattactccaaacataagataatagaaacaatgtaattaaaggtgatacaattactcctattagacggcttgattcttcttttaaaatggataaaaattttttcactcctaatttaaaatagttcatcattgtacccctcctttattattgacttttataagttgtccattatttgaatctatttcatgtatatcttcaataatcttttttttatccttatcttttaatttcttttctcttttaggcattttacttaatataaactgcaacgttactaaaacaaacattaacagaacaaattttaaaagccagctcacatgtggtaaaacatcactatatgtaaagcccaataaagatatatctcttagaggtgttataaaatgagtatttggcataaagttcgcaatcttcgaaaagaattgtggcattgcaaggactggaaatgtatatcctgaaaatagcatagtcattgatacaataccacatgaagaagccgcctctactttatttccttttttactataattaattattattccaaaaaaagcccaccctaaattacataaaagagtaagtaatactccacccaaaacagttcctctgtaaggaatattaaaatatttaatttgtgtgtacatacaaattaatgatgataaggcacccagtaaaccaatgatagttccttttcctataagtttgatataatttttcttttcactaataaaagaactagcaatagcaactgctatctgcatacagttcaatacaattccctccatcataaatatggacatattcttagttggatttcctaaaaatctataattatatcccataggtgaaattaaattctgagcattttgtggtgtcattccaaatttcccctctgcaagcttcattagatatccacttttaagtgttcccaatgtttcagatatagcaccttttgctgcactagatggtgatgttacacttccatcaacaaatgataatatagttgcttcttttccatttaataggttgtcagaaaaatcttctggaataatcaaacctgccattgcagttccgttgtcaatatacttttctatatcatcatcatcattactatgaataacaacatcaaaaacatcattatcttctatcatctgaataagactttgtattgtagatgaattgtcatgattaactattattgtaggcacattgtcaacaggatttttacaaaattcaagtcctagtaaaatgctaaggccaggtggtaataccaacaatatcactattggtattatcatatatttatgttttaaaaggtgttcatatataaaattgtatagttttctgaaaaactgacctagtttgttattatatattgaagtttttctaatttcttcttttaaattctctgtttttttattcaccgaatcttttatatcaactattttatcaattccgtatattatttttgatttcatatataatcacactactttccaaaatcaacaaatgttgtcatgttagcacgaagatttattcccatatttttaagttcttctaaatcatcaaattcaacttttactccatatgataaaatatcaaaatctccattgtcattagttgctttttttgtagcaaaatcagcatttttattaatattagttacttttcccttaaatgtttttccttcatatgcaggaagctttattgtcacttcttggtctaagtctactttatcaagatcagtttcttttatattgcaagttattgatggattatttatagcagtaactactactgctggcattcctgatgatactaaatctccatcttttacatttaatgttgtcacaactccatcaactggggatattaaagagcatttttctaaagtgatttcaagttgctttactgacgcttctgcttgttcaactccagcttgcgcttgatcaatacctgcttgtgcctgtgcaacagctgcttgtgcctgtgcaatttcttctgctgttgcaccttttattgctttattgtatttttcttgattaatatccacatttgattttgcgttatctaaagctgtctgagcactttgaagacttacttcttttccttcaagttctgcctgacttgcagctccagaatcatataaggtttttgttctatcataatttgtttttgcaacatcataagcagactgtgcactttctacattagaattagcaatgtcaattgctgattttaactgatttaattcttcttgacttgcaccattttttgctttttgtagtgctgcttcagcttgtgcctttccagcttctgcttggctctttccggcctttgcttgttctactcctgcttctgcctgagctttttgagccaataatgaatcgcagtctaatgcaactaatgcttgtccctttgttacagtatcaccttcacttactaaaatttctgaaatctgtcctcctgttaaagaattaacattgctttcatccatttttatgttagcctgaattactaaattattcgaattaccagctactatttgatcacctgttacatgagcaaaaggtaaactacatgccataaaactatttgctgttataactgctaaaagcagtaatgatactttcttaaacttcataataatcctccttgtacgtataaacgtgaatttatagtataacttttttctttaaacatatttgtaaaacgttgcaatcagcaatatatgcacccaaactagttagcacactatgtatttatttgttatccacttaaacttttagttatatttatcattattaaagggataaaactaatattttttacttttctataacaaaatatagttcgtactctatgtactggaactaataaacaattataaattcttttttttataatgtcaatatttactttatagtatggaataaaatatattttttaagttttaacattatctttacgaatattttcaataattgaatttatctacttataaaataaatatatattaaaatttagtgctcactattaaatcaaaagtctctttattaaagggtactatatgactaatatcttgcataaatgtattcaagtacggtaaaatacacttatacttaatgttaaatgaataggagatgtactcatgaactctgatttaaaattttccatgctctttggtactattcgtaatgtatttaaaaaaatcagtgataagggtttaaaagaaatgaatcttacttcatcacaaatgaacatcttgttttatatatctactaatgacgacattgaaattaatcaaaaagatatagaaaaaaatctttatttaaaaaattctactgttacagatatacttaacagattggaaaacaatggttttctatatcgtaccgccagtgaaaaagatggacgatataaaaaaattgttttaactgataaaggaaaagatatttatgaaaagatggttgaaaaagccttaatatttgaaacatattttacaaaaggaatgactaaaggtgaatctgaaatactttttgaactcttgcaaaaggtattgaaaaatgtatctcaagaatagcttaaattaaaaaagattgaaagctcaaaatattcactttcaatcttttttattcctatataattattcaataacctctcatactaagaaattttattattttctattaatttatctataacatcaacaagttcttcaatctcaggtttactaagttgtgcattagctttaaccgactcccccttatgttttaattcttcagttattaaggatgagaatataacaacaggtagttttttaagggtttcatcctcttttatttttcttgttaatgttaaaccatcaagctgtggcatttcaatatctgtaataagaatatctacatcctctaaaaattcttctcctcttctgtccttaagtcctacgatataatcaaaagcctgctttccatcattaaaaactgtcatgctcttgaatcctgctttagaaagggtttctttaagaagtcttcttatcaatgctgaatcatcagcaagtacaagcttaatatcagacctgtccctataatcaactttaacaagtctatcttcacttattccagctcctggagcaatgtctgttactatcttttcaaaatcaagcattatgattaccttatcatttaataatatgttacctacagataatgaattttcagataaatcatcaggttttcttatgtctccccattttatacgatgtactccaactatatcatcaatattaaatgctaccttaaccttattaaactcacagattataacctttgacccaagatttcctgcatttctcttacaaagaatatattttaaatctattaatgtaagaatttcatctctacataatataagccctgccacttctggctttggatctggtaatgttgttagtgtttctttaggcatttctattatttccttaaccttaacaacgtttatagcgtaacgacaattatttgccataaattcaattacttctaattcacctgttcctgattctaataatatattattattcatgttctcttccccttactttttaaatttattttatttaatgttccctattaagttaatattaaataaatttcatcaaactacaccaatttattgttttctatacttttattttacactaaattatcatttttcaccagttttaataatgtaggttcaaaattaaactcgtttactagattattcacttccagtaaagatttttctttcttttcttttgtaatatttccttttgatgctcttattaatatatttttaggtgaatgtgcaatatctataaattcaagaagctgtgtcctatatccgcatgcttcaagtatattagcacgaactgcatcagtcataagtgctgaaaccctctcctgcacaataccatatttggttaatatagataatgaatcacttttcatcatactattaaattcatgttgacagcatggaactgaaaaaatcatctttgcattccatttaactgcattatataaagcataatcagttgcagtatcacatgcatgaagtgttattaccatgtcaactttattattatatttaaatccatttatatctcctagttcaaaatgtaaattatcatatttataggcttttgctatttcattacattttttaattacatcttcctttaaatcaagacctatcattttaacattaatcttttttattttaacaaaatagtaataaagtacgaatgtaagatatgattttccacatccaaaatctaaaatagtaagttccttataatcatttttctttatttcatcgtctataatttctacaaacctgtttatctgcttatatttatcgtactttgaattgattacctttccatctttagtgaatactccaagatctattaatggttctattatcataccttcttgtaatatataattctttttcttattgtgacttttttttgctattttatcattgtcatccattttctttccaagatgaacctttccctttttagaaattctaagatcatatgtaacactatcagaccaagctgaaacctgcttatatccaattgctatattctcttcaaatttagatctaaataaatctaaatctatattttcatgaaaaacctgcttatctgtatatttttcaatctgataatactctttatttttgctttcctttaataaaaatactattttattatattttgtttccttattaatcttattacttattactacttttattattttctctttagtaatttcttctattgcattttttaattcttccatgtttaacacaccttatcatttttattattaaaattttaatttttatctgttttcttcttaattatcactgattaatttttttatgtagattatttttattatatatgtcttaataaaaataatctacataaaaaccatttttgaaaataagtcataaatttagtgtgtaattttataatttcttaaattttaatatgtaagttttgttattacttcaatcaattaaagctattattattttaccaaaaataataatatcgttttctttaatccactcattctgtcatcatatttaaaatgctgtcgacttatgttaaactttatatataatacaaatattaaacaaaaaaagcaattcatgcttgtaatttgatatatttttttaatattctgattataaatatacttaaaatttttgaggtgaattatgatagctcctaatttgaaaataaaaacaaaactacctctgtttgtagcaattctttctgtgcttccaattttattactttcatttattataatggaagttaacacaacttctgcaatgaaaaattatcaaatgataatttctaatcaagcagaatcttctgcaaaatatatatcagatttttataatacacaaaagaatgcacttatttattcttcaaacctttcagtttataaaaaatatttacattcattaaatggtactgattcagctctaaattcaagcttatttaatgatataataaaattacagcaaaccgcaatttcaacagataatagaataaataatatttttcttacagatgctgacggaaaaatagtagcatgccctgataaaacaaaattaggtatttcattagaacatacaaaagcatataaagatgcaaaagaaaagcgtatggatacttttcaaattattgatgaaaatgataaaaaagaaattttaattgcatatccagttatagatgatgatggttcagttataggatccatctttcgtttaataagtattgatgaaattgacaaacacgtaaacagctccaaaataggttcaaatggatatatttatatattagatcaaaattataatgttctatcttgcaatagcaatataaatatcacaccttttttagaaagcgaacaatcaaaaaaatttttaaaaatataaaaaaggatgctctatcgtataaaagttatttctttgaatataatttagaagatactaaaactctggcatcatatcatctaattgctggatgttcttggattgtcgtagtagcaattccacattcagaaattaatcacagcagtttttttataaacaatatcattatattagcagctacaataacagggattgtttccctagttcttagtctgttatttgtaaaaggcatcacaaatcccttagaatcacttatagataatattgatgctgttgcaaatggaaatttatattgtaattatacatatgaaggtaatgatgagtttgctcaagtttacaaagccattaatgtaatgtccaataaattagatattagctataaaaaattagaagaatccgctaaaactgatatactgacaggtcttccaaatcgtactgcaatttatgatattatggatgaaaatattaattgcaccaatcaggctacaatgcttttagatttagatggatttaaaaatgttaatgatagttatggtcatgattttggagatgcagttctagtatcagttgctaatatcttaaaaagttttcaggataagcatatttatcaagctcgacttggtggagatgaatttctgatttttatatcacattttgataaaccagatatggttgaatgtttagctcaaaaaatatttgaagaaataagcaatattaaaacagctattggtaagcctatttctatatcagtaagtatcggcattgcattttctgatgaaaatgactttgataagcaaaatttaataaaaaaagctgatttagccatgtataaagttaaaagaaatggaaaaagtggtgttttagtatttaatgatactctaaaaaatgaatgatttgtataataatatttataacaaattaacataatagcataacttttaaattaatttgttataaatatgatcttatttttttaattctaagattcttttattggatatacaactttaaattcttcacagactaccatcatattttctgtaaattcttttccaatacattttaattcctttgtaaaaatttcagagtgaatttttctccaagattccagtgttcgttcaaactcaccttctttgtacgcgtgttcttcacttacttgattaaatggtattgtatatacctttaatgtttctgtaatacaaacagcttctcctttggtatttaatataatattatatccacctaatggtggtaatggagcattttcataaagataacaaggatatgcactagctgttgctgttttaattcccttcaatactaaatctgctaaaaaatcaggcatttcaggtgtatttcctccaaatgaccaagcctcataatttttggcattcatatttattttattatattcattccacatttctatttctgtcatattgttcatccccactcattcattataatttataagcaaatttatctataataaattcaactttatatttatccttttataataattcaccatatcgctttatatagatttttttcataacagttgtaataagcatataaagaattatagttactgctagccaaaagaaaaacacacttggaaatggatacaaaccaatcattcttccaaaggatgtaaatggtataacagtaagtactgctattcctgtaaatgtcaatgatattactggaaaagaggctctactttgtaaaaatggtactttttttgttcgtatcatatgaacaacaagtgtctgagtccacatagattctacaaaccaaatagcctgagccatcattatataagtacttcttactgccacttctgaaactggaatagaattaaatgttctcccatctgcccctggtacaaacattggacatataaagaagtaggataaaagataagttgtaatatcaaatatggaactagtagggcctatccaaatcataaatttaccaatactagaagcatcccacttctttggcttttcaatgaactctttatctacattatcccatggaatagctgtacatgaaatatcataaattaaattaagcaaaattaattgtatactcgccattggtgtatatggaataaatgcacttgctactaacactgaaaacatattcccaaaattagagctagctgtcatttttatatatttaatcatatttgcataggtttttctaccttcaataattcctttttctaataccatcaaatctttttcaagaagaattacatctgcactttctttagcaatatcaacagctgtatctactgaaattccaacatcagatgccttcattgctgctgcatcattaattccatctcccataaatccaacggtatgtccattttttcttaataaagaaacaatcttagccttttgtgatggggaaagtttagcaaatacagttgttgtctcaattacttctgataatacgtcttcttccatgttatcaacatcagaacctgttaaaatataatctacctttaatccaaccattttacatatgcatcgtgttacacgttcattatcaccagttaaaatcttgacaccaacaccatattcagctaatgcctttatagctatttctgtagattcttttggtggatcaagaaatgctaaatatccaattaacaccatatcattttcatcttttacagaaaatgcaccaacaggtgaaggattagtcttttgagctacagcaattacacgcataccatcatcatttaaattatcaactgttttaagtacagtttttttcatgtcatctgtaagattaatcacttgtccattacgttctacataagagcaaatagatagcatttcttctactgctccttttgtaatcatttgtctttttcctgaatcatcagaaacaacaacactcattcttctgcgactaaaatcaaatggaatttcatctaccttttgatattgcttttctatttctcttaaagaataattctcatcactttcttcttttacacgattaattacagcaatatccataaggttctttaatcctgtttgaaaataactattcaaaaaagcatgtcttaatactctgcagtcttcgtttccatctacatccatatgatattctaaaattactttatcttgtgtaagtgtacctgttttatcagtacacaaaatatcaattgctccaaaattttgtattgaatttaagtttttaacaattgtcttttccttagacattgctacagcaccctttgcaaggcatgtagtaactatcataggtagcatttcaggcgttaatcctacagcaacagatactgcaaaggtaaaagcattaacccaatccccttttgtaattccatttataaaaaatactattggaaccattataaacataaagcgtattagtacccatgatacagcatttacacctttttgaaaactagtaacagtcggtttttcttgaatatcttttgccattgttccaaataaagtatcatctccaacagctactataattcctgtagcagaaccgcttataacgttactccccataaaagcaagacagttgcaattagaaattgactcttcttttataattttttgtgaacttttttctacaggttcactttcaccagttaatgaagactggcttataaacaaatcttttgcattaagaattcttatatcagctggtaccatatcccctgctgataaatatacaatatccccaactacagcatcatcaagtggaatttccatttgatgaccatctctcttaacagtgcatgttgtctttattaactttaacaagctttctgcagcatttccagaacgtgtttcttgcacaaatcttaaaattccacttataaaaatcatagctgtaattataataactgtagttggatttttttcacctggttctgcaagaatgatatccatatatgctgaaatgattgctaaaaagatcaatatacatgtaaatggatttataaaagcttccacaaatctttttattaatgattctttcttatgctttgttattttattacttccatacaaattacgattttcttcaatctgttcactggataatccatttttactactttccatgtgtgctagtactaaattttcttcttgcatagcagagataattagacgttttttaacattatccttttttaccatgctttcctttagatcttgtgttattttcatttttttattcttgaacattattctccctccatttcttatgtttgttttagtagtactacagtttttagtatattaaaaagtatcttttaaacccatggctaaaatcttgcgatttccttgcattttagcaagaaatgtagaaaacaggattatatcatcttttatgatacaatcctgctttctataattaatactattcttttcttataaattatcattaaacttatatccaactccccaaattgtaataatataaataggttcgtctggatttggctctattttttttcttaatttccttataaatgccataatgttgctatcagataaaaaataatcttcatcccatacagcattatatatttgttcttttgtaaacaccgttccttgattttgagccaaaaaatataatatttcaaattcttttggagtaagtacaattgcccgaccactttcctgtaccgtcctatttttcgcatttatttctaattcattaaatttcaaaacatttgctgatacagtataatcttcatctaactcatctgtatttaatattaaactacttatttctccctgtaataactctgatagctcatcctttaattcctttaaactatgtaggctatcattgggaacctgactcatcttttcaatcaaccattttattgaagaagaatctattgttataaagcttgcattctttttcacatatatttcctccttcttagaatagttttttatattttttaatataaaaagattttgctaatgttgttataagcatatacgaaactacaataaatattaaataacagtaaaataccaaaggtaatgctgttaaacctaataaatttgctactggtaaataagaaaatccagtaaagcatattattccaactattgtaacaaccataactggaattgaaggagtgctttgaataaaaggcacttttttagttctaagcatatgaattataagcacctgtgtccacatagattctataaaccatccactttgaaatatcatcatatatttgatttgtaatgatacatcacttatcatatgaaataactttccatcgcataatgctggacacattataaaatataaaaatataaaagttaaaatatcaaatatagaacttatagaaccaaaaaatagcataaatctagacaaatgctttcctgaccattcattaggcttcttatataattcttcatctacattatcccatggaagtataatacatataatgtcataaaataaatttaaaagtataagctgtaacgatgccataggaagaaatggaagaaaaatacacgcacatacaatagagaaaatatttccaaaattcgaacttgctgatatatgtatgtattttgtcatatttgaaaatgtctttcttccctctaaaataccactttctaaaacatttagatccttttttaacagtatcacatctgcaatatctttagcagcatctacagcactatctacagaaataccaacatctgcttcacttaaagcaggaacatcgttaactccatcacccataaatccaacaatgtgtccattgtcacgtaatgtcaaaataatttctactttctgatgtggagtcaattcagcaaaaacattatttttctcaacaatttcatttagcttttcttcagataatgactctaattcttttcctaaaataattctttctgtattaatgcctaacctttcacatacagatgctgttacttttttattatctccagttagaatttttgtatcaacagaaagattttgtaattttcttaatgcttcctttgcagattttttaggaacgtcaaaaaaagcaagatatccaattaaaatcaaatctttttcatcttctacagttatattatttttatcacgttgaatattttttatagcaacagcaataacctttattccatcttctaatatatcatcaacaactgcatttatattctttcttttatcatcttgtattttaatattttccccattaaaacgtacaaaactacatttatcagcaatttcatttatatcacctttaattaccataagtttattttcattattatcttctaccaatatactcacacatttacggttataatcaaatggaagttcatctcttttgctccattcttctgaaatattcagaaaatgttgttcatgatttggcatgtttctgcatttcaagattgcatcatcaacgggattctgcgcaccagtatgataaaaactgttcaaatatgcataatcaagagcttgagaatcttcatttcctataatatccataaagtattctaaaacaatttcgttgtttgttaaagttccagtcttatctatacataaaacatccatgcttccaaatacctgcatagcatttatgtttttaacaatagtctcctttctagacatagaaatagatccctttgcaagacaggttgtaattaccattggaagcatttcaggagtaagtccaattgcaactgataaagcaaatagaaatgattttatccagtctcctttagtaactccaataagaataaatattaacggaagtaatataatcataaatttaattaatactgaagcaatagatgttgatgatatttcaaatctacttttacgttctgaattataaatattaaaatttccatataatgtttctttcccaacagctaaaacaagtccttctccttttccacttataactgtagttcccatgaaaccaaggttttcataatcaattaatgagtatgactttccctttttcaaattattatgcgttttctcaaggactgagctctcacctgttataactgcctgtgaaataaataagtcagatgtaaaaacaaaacgcatatctgctggaattctatcccctgcagacactttaatataatcaccaacaactaatttgtcagcagaaatttccgtaaattttccatcacgtaaaacagtaacatgagaatttactaatttcatcaatttactagctgcattttttgaccttacctcttgtaaaaaacgtaagcatccacttattaagatcataatccctataattggtgccgtagttattgaatgtgtttgttttacactataaagaactgtatctgtaaaaaatgatataattcctaaaataaacagtatagtagtaaatgggtttataaatgatcgtcttaatctaaataaaaatgtatcttctttttttacagctatgatatttttcccatatctatatttcatgttttcaacatctgaatcagataatccctgcttttttatgttaaaatcttcatatatttgtgaaacattttcacaagcatacttttccatacgttcatttaatatggataatttagccacttgaattcctcctccttccttttttgtgattatatcataatttataatgaatattatcaataatatttcttgcttttttcttgttttaaaatcaatctattatttgaagttgccatcatatcatattgtaatttctattatttattgaaatgaatatcctatatttaaaatatatagcaaataccataccattttacttatttttaacttaaaattatttatttagttaaattctcctcacattttgtgtgtatttacaaaaataacaaattaacccttaaatacccttttatttttttgtaaaatattgttttttttcttaaacatgttattattatttttgtaaacatttatatgtttatactaatttctataaataaatttatacattgaatgggccctcaatatataagtgtaatttttattattttatgaaaaaggagtatcaacaattatgaagaaaaaattcatttcaaaattgataacatttatccttgtatttaatattgcacttttaccttctgataaattaaatttatttagcaaatatactggccaaatagtttacgctgctgattctactacactaccatctaacacaaaagatggagtaatactacatgcattcgattggtcttttaatactattaaaaatcaattaccaaatatagcttcttctggatacaaatcaattcaagtttctccagtacaaggaactaaggattccagcaaggatgcaagcaaatggtggttgttatatcaacctactaatcaagcaattggtaatagtcaactaggaacttatgatgattttaaatcactatgtactgaagctgataagtatggaatttcaataatagtagatgtagtaatgaatcatatggctaataatggtaattcggatcaattagatgcttcagttgattcttcatttaaagattctagtttctatcataatcttggacaatgtagcaattggaatgctagatatgatattacacaaaaaggtattggaatgcctgatttgaatactcaaaatactgctgttcaaaataaagctataacttttttaaatcaatgtgttgatgctggtgctgatggattccgtttcgatgctgcaaaacatattgaaactaatactggcttagattctaatcaatcttgggctggaaactattggactaatgttttaggtaatcttcataataaatccaacttatttatatatggagaaattcttcaagatggtacagtagacaacatctcatcatatgaaaatttcatgaatgttacagctagtaattttggatattctttaagaaatgccgttaaatcttcaaatttaagttcaattggcaatggtttttccggtatcgattccaataaagcagtagattttgttgaaactcatgatacttatcaagatggtacaagcaaaggactatctgatacacaaagaaaattaggttgggctatggctgcatcaagagctaatgctgttccattattcttcgatagaccaacaagcagtattggaaacgaaggtgattcattatggaaagatcctgatgtagttgctgtaaataaattccacaatgcaatggctggtcaaaatgaatatataagatatacaaataataatcaaactatgttaatagatcgtggaactattggtactgtaattgtaaattctggttctaacacttcaataaatagttctacaaatctagcaaatggaacttatactaatcatggaagtgcaaactgtacattaacagtttcaaatggaacaatttcaggaaatattcctgcaaattctattgttgtactttatggtacaagtacaaatgataataacaataataataatagtacaactactgtctcatgtgatccttctactgcagttgcaggtaactctataaaaataacttataacgcttctggtagaagcttacagaattcttctactgtaaaagttcactggggatatgacagttggactaatccaacaaatactactatgacttcttcaggaaataacacttggactacaactttaacagttccaagtactgctacaaaagatttagatttttcttttacagatggaacaacttgggataataataattcagcaaattggactattcctgtaaaagcaaattcaaatgattcatctaatactactggctatgcacctacttctggttataaagtagattatgatagcagccaattattacaaggaaaaaatcttactatttattataatggttctttaacaaattctagttctgtttctttacactggggatataattcttggacaggtacaacagatgttcctatgactaaagattctaatggattctggaagggaactatagcaattccaacttctgctactacattgaattttacttttacagacggtagtaactgggataataatagtagtaaaaactggactttaccagtatggtcaagcactgtaccagttaaactttctccagcgcctactgctggaaaatctgttactgttacttataatggaactttagcttcaagttcatcttcaattacattacattggggaaataattcttgggcaacaactacagatacagcaatgacaaaaaattctgatggaacatggtcagcaactattactgtaccatctgaaagctatctacttaatatgtgtttcaagaataattcaaacacttgggatagtaataattcagctaattacaattattctgtagctaaataattcattcatatactctaatataatattagagtatatttaaaatttatttctacttaaaataagcaattaaattacattactaattgcttacaaaaaatccatagtagattatatttttaataactcactattattgaagttaaattataatctctatggattggtttaataatgctacgccaacaaatcaactgatatttttaatcaaatttacagtaattttaaaaataattataattctataaaagagttattattcatttataaaatatctttgcttagttatattatatattttttcatcaaaagtctttcctaaagattcggacttataaactccatctgcataaaattcaaatccacacttttctataactctttttgatttaagattaaaattaaaatgtccacacaatagtacatcaacgtttaattcttcaaaagcatatttaattgctgcttttacggcctcaggcattaaccccattccccagtaatctttacttaaaacatatccaatctctcttttcacatcagatttattttctttaaattttgttgttttatgaattcctaaagatcctataaccttatttttttcttttaaaactagtgcatatacttcatccttttcaataaaatcctttaaaatttttttagtactctctatatcttcatggtgtggccaaccagcattctcccccactcctggaacctttgcatattcatataaatcatctaaatctgactctttgaaatttctaagtatcaacctttctgtttctaaagttttcatatctaccacactcccttaatttcatataaaagttattaataaattacaagaatcactactgattctctttacacgtgatctcttctacttcaagttttataactgcaatctcttctatgattttctcattaaaactccaattatctttatctgaataatgtttcattaataactgtaacccatttattttttcatttaaatctgtaacaatagtaataattcctgtcccaattatactttgatacttaaatgaatatttacatgcttcttcactttttttaagcatatgatttgtatccatttcaaatcctgcatacttatttttatttattaaatctattttttttcctatcttacttccatgaaaatagaaaagttgcttgtcaccttcatttatatatgcaaaattcaatggtataatataaggtttatctttatcaactaatccgattctacagcaatcacatgattcaattatctgttcaattttttctttatcaataatttctttgtcttttcttctcatactatagcctcccaaaacacatttattagtgagtattataacacaaaaagtaactaattccatatttttcttttgaaactcttaacatgtaaaaaacttctacattctaccgtgaatatttagacaaaaaaaatcgcatcattcaaaatatgaatctgcgattttaattaatatgttatacttattaaatcattttttcttttaattcatcaagttaacagttcatcctataaactactatattaaaataatttacttgttaatattaaaataaacattaataatataataattaacgataatataaatccttgtttagctaaataattctccttatatttatatcctataaacagtgctataactaacatgactaacgatattccgttaataggtaatgatatacccattagctttaaaatatgctccccaaaatattttccattaaagaaagtaaaagaaaacatagtcgcaaatatagaaagaattaaagatacacttcctattccccaatttttagaattgtttttctccttcatattcccatctccataaatatatctttatattttagaataatataaactcccttgtaattataccatattttttctttattaggatttattttccataaaagatacatacttaatattaagaagaaatggatttctgattaagtatatttcttttacaaaagtctataatcaacatttctactatcacctgttatcatattttttatttttacttctttcatttctacttcatctgcaccaattagtatcacattattaatatctaacttatttgcgtaattcatttttttctttaatgaactttcttcaaaataaactgtaacctttttcccattatattgtaaataattcattacttctatgcaatattcaattgtatcacctattggtattattaaataatctaatttatttttcatttcatatttatctataaatccaatttcttttaaaacaaagaatagtctagttaatccaatagaaatacctactccaggcaatatattattagtataattttcagctaaattatcatatcttccaccagagcaaatagaaccacacccttcatttcccactaatatagtttcaaaaactgttccagtataatagtctaaacctcttataatctttaaattaatttcaaactcttcctcattcacacctaatattgataatgtataacatatcgtttttaactcctctattccttcaataaaatatttattttcaatattaaactttgaaagttcttctattttttctttattcgtaccatttaagtctaatactttattaatataattgctcttttcagtacctataatattttctaactccttagaaaatacatctttacctactttgtcatatttatctattaatatcataacctcattaacattatctatttttaattcactcaatatgccttttaagatctttctattacttatttgaaatctataatctattaaacctattgatctaaaagctttagatgctaaacttataacccatgcatcattgcctatgctcaatttttcttttcctataacatcaatatcacattgataaaactctctatatctacctttttgatttctttcacctctataaacttttcctatttgatatcttttaaatggaaatactaagtcgttataatattgagccacatatctagcaaatggtactgttaaatcaaatcttaaagctaactgattttttcccttttgaaaattatatacctgtttttctgtttcccccccggtctttgcaagcaatacttctgctttttctattattggcgtatctattgctaagcatccattatcttcatatacattttttatcttagaaaccatgtcatcaaatatttcttgttccttaggtaaaagctccataaatcctggtaatatacttggttttataatattcttcttcatttaaatcactcctatatattttcttatgcaaaaaagccatgtaggcagatatcccacatggctgtaaataaattatgaattcacttaatttatcattacctagagatacaagcctaatgctgatagacttgtatctgttttttacagatcaagtctctagtaatgatgatgtattttgttttcattattaatattaagtgtcctcataatttccctcctaaaataatttatttacattatacaattataatgtttaatattcaaatagtattttatagtcggtcgcataatttccatggatattttcaagactcccaattttaaaatgctattttatatttaatttcctttttccttaagctttctgacaagatccacataaaattcacacacatcgtaccctcttatatcctgtcttgttaagtcaaccatatcaccatgagaaattcctttctttcctgcagtcagtgtgccaaggaaattgccccacttagctgaagaaacttcaaccagcccgtcattctctccatcgaaaatctttgctaatatatagccaatatttagtggaaatcctgatgaaaacatatttttcattttagaagtcacactttgatataaaacaccttctacatcttttacctttatgttaaattgtgaacatttttctaatgtaaggtctgctactcctgctaaaaaatcaggatccttatctccaagctttacaaatgttctattgtactttttcgccacataattcttaaatttatcaggtgctttatctaataaaaaatctacatatttacagcctctatgtggtgtatttacagtagttaaagatgctacatactttgaaagtccgagacagcttattgcatatcttgaatcaagtccacctttagaatgtgcaattatatttactttttcacacccagtatcatttattatctttaaaatgttttcttttaattcctgtgcacttttacatactgcatttgaggactgctgttttccataaaatatttgtgccccatttctcatgagttcctttggtattctcccccagtaattaataaacatccaatccctgaagaatattccatgaaccattacaattggatatctggttctgcatacttcattttcttttctaacatcatttcttaattcctttgactgttcataaaaatactcatatcttacttttttacagcatccatttaaaattatgaaatttaaaatcggagcccaccataaaagaacaattaaaagcctgttaacaactcctaaatttcttgatgtaaacatcattctcataaatccgtttataacaggaattatcaaaacacaaactgctgtaattccattaattataaattctttagaatttattgtgagattatctgtatttaataaaaaaatatacagtattatttctataagtactgccaaagaactgtcggctatgagctcatagcctgataccataatgcacactcttttatttaatttttttaatcttaatggaattatgtttatatatagatataataataaaactattattccaattatatagcatagaattttcgtcttcatgatattaaatataaatatcatgttcataagcaaagtaaatataataatatttctaatcctaaaataaatccttttatcattcatgaattatatccccttttcttactaatgatatgattaatttaaactttgttccttttttatttttattctattttttatcgatacttttaataaatactttaattttacaattaaacaaatttatgtattgtacgataataatcatagattttaaaattttatatacaaaaggaagtactgattatgaataactttttaattaacaattcaaccaattacactaatgacaatttaattaatattgattctactaataaaataacaaataaaagttcttctgatgaaattactacatctgaactaagcagctcaattaaactagatcctgataaaaaaaatattataaataaaattaatgcaaatcaggcatttaagaaaacttccgaagatatggaactatcaaaagaagaagaaataaatttaagacttgaatatgcaagaataagagatcaaatgcgtgatcatggattcaatgttcctgattttgatttaaataattctgatccaaaaacatcttcatttttaccctttatttcagaaatgaaagaattttctaaaacttatttctctaccggtgatcatcttgttagttctgatgcttttttaaatttttgtgataaattcgaagaaaatttaaaaaagtatgattgtttttaacctatctttaaaaatgcagaaatacatattctgaaacagctacaaaataagggtattacaattaatttatgtaataccctaaatattttctactttattcaatttagctaaattattatctcctattttcttttaaaatataaacaaatgtactattcattccatcctctaatctaacttattcacttatgtcactttttgctggcaaatgtggcttaagacttggtgaaaccatgggagtaaaatggagtgatattgattttaaaactgctaaaataattaatcagattatgtgagtatttcaataaaacgcattcaagaaagtactcacatttttgttaaatttgacttttgacggattttttacgtttccatttaattggataataccatggattaaaataccaaatatattttaatcctaatcataaatacccctatgtaacatagccttaaattcatcaaacggaaccatcttagctcccatggattcaaggtgttcggtatatacctgacaatcaatgaattcaaatttctgttcttttaatacttctgcaagagttattagtgctatttttgatgcgttgcttactcttgaaaacatgctttcgccaaaatagcatctgcctattacaacaccgtaaagtcctccaacaagctcatcatctaaatatgtttcaacactaactgcatatccattcttaaataaatttatatatgcatctttcatatcatcagtaatccatgtaccttcattattctctctcattgatttacagttacttattacaccttcaaaatcattattgaacgttactttaaactgactttttctaattatctttctcatagattttgaaatgcgaatttcatcaggtttaattataaatctaggtctagggctccaccacattataggctcgccttcattgtaccaaggaaaaattccattactgtatgcaagaagaagtctctccatagacaaatctcctccaaaagccagaagtccatcctcttcaccaagctctggatttggaaaaataagttcattactcaactcataaattgccattcttatcacctcgttaaatcttaaaatacataaaccatattctgtggttcatagaatgacaaaccatgctttttagcaagtttcattacaacttcatttataaattctgcattttcaaattcagtgcttataataatatatcctctacatttattacacttcacagcttttgtttttttcataagttcattataaaattcatctattatttctatatcacctacaagagattcatcaccttcacataatctctcatataaaacttgtgctcctattgcactatttactttatcactattaaataccgcacaataccattccataattatgcctccttataatttacaattaatcaacccaataaatattaattatatctaagcttcaattaagtacaaattttccctttaaattttttaacatataaatattattcttactatttattaaatttcaatatatgattttctcataacattactttactattaaacttcttttacttgtaataataatattacatattacctgtcattagtattttatagcaattgtacaataacattcaacacatattgcaatagttttttaattattcacataagtgtgtaacacatcttgttatgttgaatatattatcagtatagaaatattaaatttctaaggaggtatcttcaatgtcaaagaattgttgtagaataaataatcaatgttgcaacaacagatgtaactgtaattgccgcggatacaataattactgtggatataataattattatggatatggaaattatggatatggcggatttggtggaggctgtaactggtttttccctttattattacttttcttattgtaaataaaccttagtcctgtcttatatcattatcttattattaaataaacttatattacactaccttataaacccaacaaaaaatataaagccagagccccatcacactctgacttattattaaaaattaataggactgaaactaccctatcagtcctattaattattttttatttatatcacttattttctgcaaacattttataagtattcaatctttcctctgcatctttttcagtttttgtaaataacttttctgcttcctcaggaaaagcttttgcaagtgatgcatatcttacttcacccatcaagaaatctttaaagttagattttggatctttgctatctaaagtaaatggattcttctcacttccctttagttctggattatatctataaagattccaatatccacattcaacagctttcttttcttcttcttgagaatttgccattcctatttttattccgtggcttatacaaggtgcatatgcaattataagcgatgggccatcataatttgctgcttcagttatagcctttattgtctgatttttatctgctcccatagctatctgtgcaacatatacatatccataactcattgccatcattccaagatctttcttctttgttctcttaccacttgctgcaaatttagcaactgcaccagtaggagtcgcttttgaactctgtcctcctgtattagaatatatttcggtatcaaatactaatacatttatattttcattgcttgcaagtacatgatcaaggcctccgtagccaatatcataagcccatccatcacctccaaatatccactgtgatcttttaacaaaaaagtccttatcattaaggattatttttgcaaattcgctattatcctcttctaacacacttataactctttctgctctttctctgcttccctccagaacatctttattttcaagccattctttaagaattatttttgtatcatcgtctatatcttcacttaaagcaagttcaatattgtgagctattctttcataaattgtttttgctcctacatacattccaagtccaaattcagcattatcttcaaataaactattagcccatgctggcccatggccattagcatttgtacaatatgcagatgcaggtgtacttgctgcccatatagatgaacatcctgttgcatttgcaatcatcatcttatcaccaaataactgtgttacaagtttagcatatggtgtttcaccacaccctgcacaagctccactatattgtagtaatggaacttcaaactgacttccttttacagttgatttgttcataggatttttattcttaactttttccacagtataatcccatacttcaacttgatcatgctgactatcctgtggtttcattataagcgcctttccaggtgctggacatacctctgcacagtttccgcatcctgtacagtcaagaggtgatactccaatagtataatttaattgttcttcactctttattccttttggaattacagatttaaacccttgtggtgctttatttttctcttcatcagttaataaaaatggacgtattgttgcatgtggacatacatatgaacactggttacactgtatacatctatctggaatccattctggaacatttactgcaacacctcttttttcataagctgttgtaccatgcataaatgtaccatcttccattccacaatttacaaaagctgatactggaagattatcaccttcaagtctattcattggtgttactatcttatttataaattctggatattcaaatttctctttatcgcttttatcaactgcagttttccaatcacttggtatatttatctttactattccgtttaccccttcatctatagcatcatgattcatttttacaacattttcaccttttttaccataagccgttactacagcttccttaagatatttaacagcatcttcaacaggaatgatattagttaacttaaaaaatgcagcctgcattatcatgtttattcttccaccaagacctatgtcctgtgctattttcactgcatttatagtataaaaatttatattgttttgtgcaatatatctttttatattagctggaagtctttcttcaagttcatcaagattccacaacgtatttaataaaaatacaccgtcttttttaagtccctttgtaacatcatatttatctacatacgcctgattatggcacgctataaaatctgctttatctactaaatatctcgattttataggatttttaccaaatctcaaataagaaattgtaattcctcctgatttccttgaatcataatcaaaatatccctgagcatacatatctgtgtgatcaccaataatttttattgcactcttgtttgctccaactgtaccatctgatccaagtccccagaatttacatgctgtacatccttcaggggttgcatctatatcaagaggtcttaatgatgtacttgttacatcatctataattccaattgtaaatctatcctttggttcgtcaagggtaagattatcaaaaacggctgcaatatcagatggtagaggatcttttgatccaagtccatatcttcctccaattatacatggtgcattttcttttttgtaaaaagctttaataacatcaagatataaaggttctccaattgatccaggctcttttgttctgtctaatacagcaattttctttacactcttaggaataaccttgagaagtctttctatacaaaatggtctatataaccttaccttcaccaaacctgttttttgtttgtttgcatttagataatctactgtttcttcaataacatcattaactgcacccattgaaattattattctatctgcatccttatctccataataatcaaaacaatgatactctcttcctgtaagttttttaatttgacccatatactcttcaacaacttctggaattttttcataatatttatttactgcttctcttgtttggaagtatatatctggattttgtgctgtacctcttgtaacaggatggcttggatttaagcctctatttctaaactcttcaagtgctttataatctacaagatttgcaagttcttcatcatcaaatacttcaactttttgcaactcatgagaagtacggaatccatcaaagaaattaacaaaaggaactctgccctttattgttgctaaatgtgctactggcgataaatccattacttcttgaacattgtcttcacaaagcattgcaaatccagttgcccttgctgccataacatcctgatgatctccaaatatacttaaagaagaagttgcaagagctcttgctgcaacatgaattacacaaggcagcaattcccctgcaatcttatacatattaggtatcattaaaagtaatccttgagatgctgtatatgttgatgtaagtgctccactttgaagtgaaccatgaagtgcacctgctgcgcctgcttctgattgcatttcaacaacctttacaggctgaccaaatatattttttttaccctttgcaacccattcatcaacgtgttctgccattggagatgacggtgtaataggataaatggttgctacttcagtaaaagcataagaaacatatgctgctgcagtattaccatccatagttttagtttttctcatgtttcatccctcgttttctctaataaaataagtttaatcaaatgaaataattttttatttgttacgaacctttcatatggctatatttaaaatcaatgtccataacacatcaagtcattgtaaatagcttaacactttgactttcatagtttttattgtttacaagttaacttaatgttatgtatttaaaaactcgaaaaatcattaataagttatatttttaattgtataaaacaaaaaatctgtaattgaattattttcaaaattacagatttttatattttagattatatttttctccaactataactatttgaaatttcatagggtatactttcaataatcttaccgttttcaattttatagatatcagttccaccttgatttgcaagacagtaaacattatctccacttacaaaataccctaacaaatcaatttctctatcttgtatccaatacatatttccaacaatatctggaacatcccagtattcattacaaatttcttttaaacttacattttcatcagtataaaagctccactgaatatctttaaatgtattatctaaataatctttatcatttttaattatctgctctataggatatggtgcattctctatccaaactccatcactgtttatataatatccatcaattatagtatcatgtgccataaagtttgtatccttataaaaataataccactctccatcaatgttattccatccatcactataaataccatttatcatatatgaccatcccatggtaccatttatccatccattcccctcgcttgtccatgcatatgcaggcaaagttgtaacacatgttattgtcataaaaaaacttattataaatttctgtattcttctcataataatataccttccttataaataaatttcatttatacattctatgattgaagaactatttctataacaataacttaacttattttttattagggaaccttttggggatataaaaaatactgcatcagagcaatcaataaaattacttctgatacagtattgtatatataaagactaaaatgagtgtgctatttattattttttaattggcttttttaataatgctaataatatcattccaattacagaacctgcacctactgctgcaagatacattaatggatttccaataacaggtactacgaatattcctccatgaggagctcttaaagtacaattgaatatcattgaaattgcacctgctgttgctgaaccaattacacaagatggaataactcttaatggatctgctgctgcaaatggtatcgcaccttcagttatgaatgataatcccattatatagttagttattcctgattttctttcattatcagtaaatctatttccaaagaatgttgtagcaagtgctattgcaagaggtggaaccataccaccagccataactgctgccattacttcatagtttccacttgcaagtgatgctgtaccaaatacatatgctgccttattgaaaggaccacccatatcgattgccatcattcctgcaacaacaattcctaaaagaactctgcttgttccacccattgaattgagtacattagtaattccaatattaattgaaccaaagaatggatttacaagtatcatgattagtcctataagacctattccaaataaaggatataataatgttggctttaagccctctaaagcatctggtaataaatcaaagaccttctttagaccaagaactaagtaacctgctgcaaaccctgcaaacaatgcacctaaaaatccaccgcttattggtgaaatacttgaatcaaaagcacttgcataagtagttcctatctttgcaagaactccaccaacaaaaccaactgcaagacctggtctatccgcaatactcattgctataaatcctgcaagtactggaagcataaatccaaatgcttcaccaccaacagtctttaaaaatgctgctaccggagtattcataccaaaattacttggatcaatgctatagtcgtctaataagaatgctaaagctattaatattcctccacctattacaaatggaagcatatgtgatacaccattcattaaatgtttataaatttgacgtccaatactttcatcactacctgaatctgaagtatcttcacttcctccttcatgattataaacatgggcatctccacttgtagctctattaattaattcttcagccttatgaattccatctgctacttttgtctttatgactttctttccattaaatctagccatttcaacatttttatcagctgcaattataatacattcagctttttcaatttcttccttagttaaaacattttttgctcctccagaaccattagtttcaacttttatagaaactcccatttctttacctttgttttctaaactttctgctgccatataagtatgtgctattccagttggacatgcagttactgctaatactctgtaagaaccacttcctgatttaacatctttttgaagctcttctgggaacttttctgcttccttttcatctattaattttaaaaattcatccttattcgtacagtttattaacttctttctaaactcttcatccattaatatagttgaaagacgtgctaatacttctaaatgtaaattatcactgttatctggaacagctatcataaagaataaatttgcaggcattccatctaaagaatcataatcaacgccatccttacatactgctgctgcaagacttgcctttttaactgcatttgtctttccatgaggtatagctattccatcacctataccagttgtacttaaatcctctctagcaagtattgcttttttatattcttctttattgcttaaatttccagttttgtccataagatcaacaaggatatttatacattctgctttagaagatggtttaatattaaggttcattccttgtttatgtaataaatctacaattctcatttttcttcctccttaaaataaattactaccttaaattgatatcgattaatgataaggtttactataattgtaattttaggtatcacgcattttatgcatgacacttaaaaattcaaattcatataaaatttactttatgcttaacttatttcatttgtaataataaattttctacttcttcttttgttgcaagttcttctgagaaagcactagcacttcctgttgctattcccattttaaatgcttcatctaaatctttattttttagatacccacataaaaatcctgcaaccattgaatctccggcacctactgaattttttaaaattcccttaggtacttctctctttattggttctccattttcaggtaataatattgcgccatctcctgccattgatattaagacatttttggctcccatttcctgaagtttttttccatatgctattatatcttcatcattttttaattccacattaaacatttctgccaactcatgatgattaggctttattaaaaatggtctatattttaagacttttaataataaatcttttgtagcatctacaataaactcaacttctttatctaaaagacttttcattattctttcataaatatcatctggtacactctttggaatgcttcctgacaatattaaaaaatcaccttttccaagcttatttatcttttcataaagagattctaaatccttttcgcttatgtctggacctgcaccatttatttctgtttctccatcacttttaagcttaacatttattcttgacataccactttcaagtttaacaaaatcacagtcaacattatgatcttttatctgtcttaatatttcatcacctgtaaatcctgctacataccctaatgcagtattatcaacgcctaagttttttaaaacaattgatacatttataccttttccacctgcataaatttgttcactgttaattctatttaaagcatctgctttaaaactatccactttaacaacataatctaatgaaggatttaaagttatagtattaatcatattattccactcctatcactttagtatcataattactattcccgtttgttttacttgttattagtgtagaatcacttatatttgcaaatgttataaagctcacttcatcaagttttgattcatctgctagtatgtaagattccatacatctttttattgcttctcttttaaccattgcttcattaacatcgggagttgtatatccacttttgttacttacaccatttgtcccaaaaaaaccttttgaaaaattatattttttaaggtcgtccacagcactgcttccaactattgcttcagttacagctttaacttcaccacctaatatgaaggtctttactcccttttctagaagtttttttgcatggactataccattagtaactacaagaatcctatcactttgaatgtaatcaatcattgcttcagtagtagttcctgcatctaaatatattacatcatcattttctataagactgcctgcgtattttgcaagctgatgtttttcttctgtattcaaagtctttcttacattaactttataatcatgtttagaagtgttatcaccaattgaaattgctcctccatgaatttttttaagcattccatcattatgaagggaattcaaatctcttcttatagtagattctgatgcatcaagcagctcaactagttcagttactgaaacaatccctttagcatttaattcttgaagaatgatattatatctttcctctgtaaacattatcaccactcctctgatataataataaatcattttttaaaataaatcaatcattttctttcaaaaataatcactttttttcatttttataacaaaaacacatagttcttaatcatttaaattaaattttatatttcatttatctttaacaacgtaagtattttaggcatttttcaagcaataccccctctttactaggataatcatattggctacttattttcatgcacttttccacaaacgcgcacgaacattcacaactcttcaacagctctattccattcatcaaattccctaatagaacagatgtgaaaatatcacctgttcctggataacttttttcttgttttaaactttctattatgtcaatagaatcatattcattatcatatacaacggttccaattaaatcccccttgcctagtggtacacttgttattattattttgttacatccaaaacctgatagttttctacatatactatataaatcatttttttctaagcattcatgaatttcttctcctgctaataaacatgcttctgtataattaggagttattatttgtgcaaatttaattacttctcttaatttatctgaataacttttattaaaattgctataataccccccattatctccaaaaataggatcaaatataactattgactcttctttcatttctatattttcaaaatagtttatacattcttctacattcttaatactacctaaataacctataaaaataccttcaaagtttaaatcaagttcattataatgattcatagctttttcaatataattatctaattttatagttactggttttccaagtccacctgtatgagaagataatattatagttggaattggacatgtttcaatttccattgttgataaaactggtattatatttgtaagtgccgcttttccaacaccacataaatcatgtatgactgccgctctttttattggctttttcataatatatcacctctttgattacttttttcattcttatttaaataaatctataattcatcataaaatagtacactcatagataattatactacattatgacatttaaggtatttcataaaaaaagaatgtctaaaatttattcagacattcttctctttcaaaatatttatatacttcaataatactttagttcaataaaaaaattaatatttaagttttagcatttctcagatatatcttttgcaactttagaaatatcttttttattgaaagctatattccttaactctaaaatcattttcaacatctataatcttatcatcaattcttttattgtttatagacacattcttaaaaccaattccttttatattctgtaatacagcatcacccttaactccatttaaatatacatcttcaattaaaatattttcaattggcgcatctttaaacccttttaaaaataatgcattatttgcatctatacttccaccttctacagtttttatattagataaagtaatatttcttagtattggcatataatttccattagttccttcttcatagaagaaatctgcatggataactgcaatcttagatttatttaccacactgttctttacataaatattttcaagctttcctcctctttcagcattggtcttaaatctgattggataatcaagttctgaactatcaaagtaattatcgtgggcaaatatatcatttactcctccagaaatttcacttcctatagttattcccccatgaccatcttcaaacttattatttctaattattatgttttgagaaggaacacctatgtttcttccttcattatttcttcctgactttattgctatacaatcatcaccagtagtaaaatgacagttttcaattatcatatctctacatgattcaggatcaacaccatcattattatataaatgactatcaactgtaatactatctatttttatattttcacaaagtacaggatttacttcccaaaatggtgaatttaaaattgttatatccttaataagtatattttttgatttataaggctgaataaatggtggtcttattgttgaaatttcatcattgaatattcttcttgttcttacacaagcattttcctgacccaaattaaataatctttccctttgaatctgctgatcttcttcattaaaatacccaaacttccaaggcatccagttaaattcatctgcacatccatcaagaacgccctttccacttatagcaatattttcagcttcatagctatatataaaaggggaaaagttcatcatttcaacgccttcccatcttgtatatacaagtggataaaatctattagatttatttcttaaaaattttataatagcattttcttcaatataaagttctacattgctttttaaagttattgatccactataataaattttaggttcttctttagttcctcctggaattataacttttcccccaccatttttattggcatcatcaattgccttttgtattacatcaccataatattttacaatctgtatattttttattaaagatttacttatatattctttatcatttttaagttcttttttatcacctttataaggtccatctggatgtgtaagataaacttcttcaacattactaataaattttttatatttttcatcttcaatattatatttgtccatattttcaaagtttattatattttcattaactttcttttcaattgaatcatatagtttttgattccactcaaattctttaaacatataaaaatcctctcttccatagatgaacttactaaaaatgcagcagtactcttacaaatctcctgctgcattttatatagattattatagatagtaattcaattaactaataatttatgaattaagtgctgttttttcatgatatccaacattattgttaccaaaacagttttcataagcatatccagttaattcttctatagctttcttagcctctggagtaacagctgctttatctccacctgctttaattctattaacttcatcaactaataatttatgagattctttagttaattttaatcttctagctgctaagaagcatacaaataataatatcattggaaccgcaactgtcattattgtaatagttgttacagctgattgtggctgtacagcttcacctttaataaagcctgaatattgtaatataacacctaataagaatgattcaacagctcctgcaacttttgataataaaccgttagttccagtaaatattccttctcttctctgcatagtaactgcttcatcaatatcagccataaatggtaattggaatactggaatataatctaaagcagcccttcccatgaagtttgcaacagcaactacaactagcatagttactaacattgaagaaccttcaaatttagttaatccaacaaatcctaagcaagttatacaaacaacagctgcaccataattaaatgcttttggtccaccaaatttataacacaatccaatagtaactgtaactgctactatagaaattatttgtgaagcacctgtaatatatcctgcttctacttttgataaacttaaacaatacacaacaaaataagtgaatacaccagctgcaaggtttttgtaaatacctattaatagcatcattgcagaatgtaatctgaatgattttatttgcattgctgaaggaatatctgcaagcattttcttcattgtttcagcaaaactcttagtttcagttacatgaacatctttaggatctctttcaaaagtaaatgcatagaacactactaaagataacaccattattgcagcataagtaacacctgcaaagaaataagctcttggattatcatcacccattcttgctgcaaagaatgctgggaatgcagtagctataccacttgaaaattgtccaaaatattgttttgcagatacaagttttgttttatcagctgcactagtagccatttctgctggtaatgttgtacccgtaactactactaatgtaaatgttaattcccaaattaaattcattacaaagtagaatgagaacgaatgacctgttgtccataatattgggaaaattacaattactaaaggaatacctatcaatgtaaatgatcttcttctaccaaatcgtttaccaattgcagttttaccaaagttatcacttatagatccaactaatggatttaacacagcatccattaatcttgtaatcgtaaatattgaacctgccttaagcggatcaatatcacaacattgagtatagaaaaacattaagaacgctgaaataattgcttgagatccactacctaaaaaatttatacatgcataaccaatcatattcataaaagttatttttcttttcattgtttaccctccaaatatttgtacttaataatgtacataaatttatttatttctataaatttcaattcaactttaacaatttctaataataaatagtcaagtataattcctaattatcaaacaattttaagctagtattactacttttaattaaaataataagtcatctttaaatgtatacttttacatatatactgtttgtccacattttacttctactatgttcccatcaacactaagccaaacagattgaattgatggattatatacaaaacttgcatccatagaaaatttcaaattattaaatgccttcatataatctataatttctttattagttgcataccaaatatcatctctatagcccatttttttaccaaaaccttctatatgactccagttatcatctttaacaaattcatagctatgtctccatacataaaacatgtacatgtattgttttttaataaccacattcatcagcaataataataatttttattcttccctcaaacttaattccattatgaattatgcttgtaaaattacacattctcttcttgcagtcacagtcaacacaatatccaagttcagcacaaggagtttcatgttttattctctttgcattcatcggtgcaatttctcgtattcttttcattgctgagtccaaattttcaactatcttatttactccagaaacaataattacatttttagcaccaaatatcataggtgcaatcctgttccccgtgcaatctgtatttactagctcaccatttttagttattgcatttgtgctacttattaaatagtctgcactcaaagactttctgtgaatttctattatatctggatcaaatggtaaatcttgatatctatcaaaaaatttataatttccatttcttaatgtttcaacaacattcatttgagttaatgtagttgaacctccaagggcgacactgcttccttcctctatcatgctaaaaagcagtttttttgcttcgtctatagtttcaacatactgagctttgtaatgctttttatttaatatttcaactatttctttagccttacaaacattatgccattttttcacttcatccatagatgctaattttcccactgttattctcccttcttaaatactgcacttttaaattcttgtaattatttacatggaatattatagttattatcagtttcacaagatatgtattatgaaactgataatacaacactgttacagtaaattagcttcagatgcagctaagataaatggtccaagcccctttggttcattacaaactataggttcactgatatagtatgaaaaagatccatctctcttaccatggcagttatcctttcctccaagaccagctacaaagcatattttattaagattaattaatccaagaggagtttctaatataaattcatcaattaaccctctatatgattccttagcaaactctctcaattcttctggtaaatatccaagtcttactcccttaaatagtgcatatgcaatcattgaagaacctgatgcttcaagataatttccttttctatcaccacaatcaagtacttgataccaaacgtgtgcatccttgtcagcaaccttaattaatgcattcattgtatcattaaatatctgtaaaatttcatttttatatttattatcttctggcaattcttctaatgtatcaacaagagccattacaaaccatcccatagatcttgaccaaaaatgctttgataaaccagtttctttatcagcccatggttgttctctagcatcatcataagcatgatataatagtcctgaattaggatctattgtatgatttcttgcaattataaattgttttgcaatatcatcaaattctgaaacatctccgaattcgtttacatacttcgcatagaaagttgctcccatatataaaccatctagccatatttgttcaggataaatttctttatgccagaacactccttcttttgtccttggatgtttagctatttgagttcttaataactctaatgcttttctatatttttcttcatgagtttcttgatatattgttaataatatctttccattatttaaatgatcaatattatattcatcaacactatatcctcttattgtgccatcttcatttacaaaagtatccatacactctttaatatattcaaaatacttggaatctttagtttgtttccaaacctctgctataccatctaaagttaacccaaattcataagcccagtaactagttaaatcagtttttctagcaatgactgaatcagccatccactttgcataatctttcattatccatcctcctaatataaataagtataattcaaatttcgtatgtttagtagttatcaacaacattgttgttatcttttgcacacgtgcacatttcatgctcttgcacacgtgtgcttaagactataatattattatataatgttatttaaacaatttcaataccttttttgagaaaattgaacacgttttccaaattattttttaatttatatatgattgaattatttacattcaatgtattatatcttttccttaaataatgtctattctgcattctgcattaacaaaatatatgaataaactagaacttttttggtaattctaatatggcatatatttttataaggagaatatttttatgaagttaagcaaaagattaaaagcaatctgctttatgatactatcatcaatattttttacgacaatgaaccttttaagcaaacttgcttctgatgtctctctttatcagaaagcttttatttctaacagtatagcttttttaataatagctattgtaatgctaaagaacaacatatcttttttcggaagaaaagaaaaccgtaaacatcttaacataagaggtttatgtggtactttatcactagcttgtttgtattatacactagaccatatgattctatcagatgccacaatgctttcaaaactcggaccatcttttgctgtattgtttggatgcatatttttaaaagataaaattaacaaaaaacaagttttatttctcattttgactctggctggttctattttaataataaaaccaagtttctctttcagcataattccatcattaatcggtttatgcggagctgcttgtgctggaactgcatttacaatgatacgattaataggcgacaaagaaaataaatttactattattttttataatatattttttgcttgtatagcaagcttaccttttatatttataaatattagtaattttaaaaataaagaatcagttgtattcatgatccttgcaggattttgtattgcttttggacagatcagccttacgctagcatataaaaatgcacctgcttcaagtattgctatgtatgattatgtaggattaattgtttctgctctttacggactcgttctctttaaagaaattcctgatattttatctattttaggatatataataatttcaggaagcgcacttgttaacttttttattactcaaaaagaatctccataaaaaattttatttccctaaaagcttttcaataaatatataagttctataaaataagcttgtgataagtttttcatcttttcacaagcttattttaaactccttatcttacaagccaaccgccatcaactgtaagtatatgtccatttatataatcagatgctctacttgctaaaaatactacggctcccatcaagtcaaaaggctcagcccatctttctgctggaatcctatctagtatttctttatttctcttttcgtcatctcttatttgctttgtattagctgtttttacgtacccaggcgctattgcattaacttgtatgtttttgcatgctagttcattagcaaaagcctttgtaattcctgcaacaccatgtttacttgccgtatatggaggtacaaactttccgccttgaaaagaaagcattgatgcaatattaataatctttccactgccttgttctgccattatttttgcaacatcttgacttaaaaaatataaagaatttaaatttatatctattactgcattccaatcctcttctttatattctaaaagaggtgctcgttttattgtgccggcattgttaactaaaatatctattttcccataaacttgcattgaaattcttattatattctctctatcttctctgcttgttatgtcaccttgaataaatgtaacttgtcttcctgtctcttctatgagttttcttgtttcatcccactcctttccatgagttggaattataacatttgctcctgctttagccaaggctattgcatacgcttgtcctaaccccttatttccacctgttactatggccacttttccttttaacgaaaaaaagtccattgaaaaacttcttaattcttcactcatttacatctcctcctaattttacaaataaaatattatagtatatttatattttttgctttattttatagtgttacgccctgcttaagtatagcaatttctttaaatttattaatttcattattcacatgcttaccattagcaacttcaattacaaatttcataaaatcttcagtagtttcttctaaagttttatcttctacaagacatcctgcattgaaatccatccaatgtggttttaatttatataatggtgagtttgtagatatcttaattgtaggtacaaatgtaccaaaaggtgtgcctcttccagttgtaaataaaaccatatgacatcctgctgctgctaatgctgatgcagcaactaaatcatttcctggaccacttaaaagattaaggccatcagtctttagagtttcaccatatttaagaacatctacaacagtagcatttcctgacttctgagtacacccaagtgatttatcttcaagtgtagtaattcctcctgctttatttcccggtgatggattttcatatattggctgatcatatttcataaagtattgtttaaagtcatttattaaatgtacaaccttatcaaatgtttcttcatccttagacctattcataagaatagtttcagcaccaaacatttctggaacttcagttagtattgtagttcctccctgtgatactaaaagatctgaaaagcttccaacaagaggattagctgttattccagataaaccatcagacccaccacattttaagccaatttttaattttgatataggaagtgtaactctcttgtcacttttcatttgaaaatatagttcttttaagattttaacgccttcttcaatttcatcagaaacttcttggcatactaaaaatttaattctattttcattatattcacctaatgattgtataaagtctatcatggtgttgttttcacagcccaatcctaaaactaatactccacctgcatttggatgctttgcaagatttccaaggatagtttttgtatttacatgatcatctccaagctgagaacatccatagttatgcttaaaagcttcaacaccgtcaattccttcaaaattcacttcttccttaaatttttcaattattctatctgcaattccatttacacatccaactgtcggaactatccatagctcattccttataccaacagatccattttctctttcatatccttcaaaagtcaaatttctttctggtatatccaatttattcaatgactggttgaattcatactcttttatcccctttaagtttgttcttatattatgtgtatgaacccattgacctatatttatatctttagttgcatatccaataggatatccatattttatggcatcacaattttcctttatatcttcaattgcaattttatgacctcttttaatatcctcttttaaagttatttctttttcgtcagttttgattgtttcacccttattaaaatctttaagagctacaacaacattatccttattatttatctttataaaattcatcattttttctacctgcttttccttaaactaattgctattttttaatcaatttatttagggttaagtgtaaccttatatattttaaaattacacttggtattatgctgcttatgaactaaaaacaaattaataagcagctaaaattaaagtagtttaattttatcagtttataacaacatatatatccattttatatttaagttatctatcaattaattaagttgttattttttataataatgagtaataggttattaagttgttgttattttttatctaatatatatgttattacttctaatataaattaaagtactgatttaacagcttctttcattcctgctttttcaattaaaattaaattatcagttacagcttgagttaagccttcaatttcatttaagtccataccccagtttctatcatatgcaagaactttagtaaccaatgtctttaatccactttcagatccatcacattctgaccataaatttttatataattctaatatatgctcatcatcagcaagcttaatatcttcattccctctctttcccttataaaattctattaatgctgcaagagagaatactaattttctaggaagttctccttttctctttaagtattcagttaagcttggtaagtctcttgttttatatttagacattgaatttaatgcaatgctcattaaataatgttttacatacggattctgaaatctttcaattatatcattaccaaattgaactaattcatcatgtggtaaatctaatgttggaactatttcatcaaatattaattcccttacatattggcccataatctcatgatctacagtttctccaactgtctctaaaccataaagataagcaactggaaccattgcagtatgaggtccatttaaaattctaacttttctagttctgtatggtgtcatatcatcaacaactttaacattaagacctgccttctctattggtaactcttctttaagacattgtggcccttctataacccataaatggaatacttctcctacatctactaaattatcatcataacctaattcagctcttacttcttcaattgtatctcttggatatcctggaacaattctatctactaaactgcaaaagaatgtattggcagtattgatccaagtaataaattcatctcccaagttccatatttcagcatattttaatacaatttctttcaatttttctccgtttctatcaattaattcacatgggataatatttaatcctttatctaaagctccattaaatgtcttaaatctatgatataaaagagccgttaattttgatggatatccattttgacatccaccttctaatttatcatcattttcaaaaacaatcccagcttctgttgtatttgaaattataaatctaacgcttggaatttctgcaagttctaaatatttattataatctttatacggatcaactgctctatctatacaatcaattactgtatgcgtcttagttgctttaccattttgaattccttgtaaatataatgtatataaacaatcctgttcattaagcatatgaatcaatccaccttctaaaggttgaacaactgcaacacttccattaaaatccgcttctttattcattttatcaatttgccagtcaacaaaagctcttaagaaatttccttctccaaattggattacttttactggatatgatttatgatttttatatgattctctatttaatttcatttttactcctccaaattcttatctatataataatttaaatttcacaatactatacaactatataaaattgtattgtcaaatttaaattataccaagaacacgttaacatttttgaaagccaagagttcatataataattaatattttcaatacaaactctctactttctatttaataatcccattatttatgcttatctatctactccatgctttttcccaataaactccataagttgttcaaaactcggataacctgtcatgtccccacttgcaagagtcgccatagctcccattccatttgaatattgtccaatttcctctaaagataaattatcaagatatccacaaagaaaccctgctgcaaatccatctcctgcaccaacagtatcaataattatatcagatacattgtatcctggtaccatacaactttcttctttactttttatgtagcatccttcagcccctagctttatagcaactatttttgcattctttcctaaaaagtaatcacaaatttcatctttatccgttaaccctaaaagaatctctgcttcatcgagacctggcattacaatgtcagctttattagcaatatccaccaaaatttcttttgcttcttctaagtcccataactttaatcttatattcggatcaaaagatactaaaatcccatttgattttgctatatctatcgctttataaactgattctcttgcacttttggataaagcaagtgttattcctgttagatgaagtatttttgcacttttaatatattcttcatcaatatcatctggagaaattgtacttgctgccgagttttttctataataataaacattaggattacttctttgataatattccttaaatattaatccagtattattattctcatctaaaataactcgtgatgtatctacaccttcagctctaatagaacttataacatctcttccaaattcatcatttgataattttgaaaaccatcctacagtatgatttaattttgaaagagctgttgcaacatttgattctgctccgcctattgttttttcaaatgtatgaacatgtcttaatggtccatgtgattgcgggctaaaaacaatcatcgattctccaaaagttactacatccatttttaaatccccttcgcttctctatatgcatccataaatcttctagcctctttttctactgcatcataattaccagttgtagcacctttagttaaacttccacctgttccaacaactacagcgccagctttaaaccattcatgtaagttttcaacagttactccacctgttggcataaaatctccttgtggaagaggccctttaaatgatgaaattactgatggtccataaagatttgctgggaatattttaacaacatctactccatattccatagcagtaatcgcatctttaacactcataacacctggcataacacatactttatatctgttacataattttaatgtatccacatcaaggcttggactaacaataaattgtgctcctgctaatatacaagctcttgctgtttctgaatctaagactgttcctgctccaacaataatgtctgtatctttgtattgctctacaacttcttttaaaaaatctacaggatttggaactgtcattgtaagttccattacttttattccacctttaactgctgcttcaactatcttcaggccttgctctttagagtttcctcttacaacagcaacaactccagcttcttttactcttcctaatacttcttctcttttcatttcttcacctcaataaaaatttttactattctctctaatttaaggcattataaaaaaatgccaattcaatctatctgcctattttctctcatatgcctaattgaattaatatctatataaaatctcattattttaaaagcgcagctttcaattaattgtatgattgtaaataaaatatggtatggtttactcaatgttatcaaggtataaaggataatttccaattaacagaaaactgctgctatattaataaataaatatttattaactacatattaaagtaattcttagcattgttataacttatatcacttactatttcacctaagaattcagtatcatttggtaattcaccattttcaacccattccccaattacattacataatattcttctgaaatattcatgtcttgtataagataagaaacttcttgaatcagtaagcattccaacaaatgtacttaacattcctaagtttgctaatgatttaatttgtgcttccattcccaacttatggtcattaaaccaccaagctgatccatgctgaatcttcccttttattccatcgccttggaagcagccaagtaatgtacctataactgcattatcattagcatttaagctatatattattgttttagataatgctttttcttcatttaattcatttaataaattagataatggaacagctacttctgtatcattaagagcatcaaatcccgtatcaggacctaatttattatacattgtagtattattatctcttacacaattcatatggaattgattgacccatcccaaatcatagtataattttccaaagaactttaatatataaactcttaatttattttcatcttcaaaagatacttgtccatcttttaaaacatgtgcaaaaatctctcttagttcttctaatgtagcctttcctcttggaacaaaatctaacgcattatctgcaaccctacatcctacactatgaaagaattcaactcttgactttaaagcttctaaatattcatcaaaattagttatttttctacctacaactgactctaactttgtgaaccattccttaaatgtatctttattaatacctaaagctttatctggcctaaatgctggtaatactttaacatggaaactcttgtcctcttttaatgccaaatgatattctaatgaatccacaggatcatctgtagtacatattgctttaacatttgatcgcttaattaatcctcgtactgtgaactcatctttttgaagcatttcattacacttttcccatatatctgatgctgttttcttactcaatacttcatctattccaaagtatctttttaattctaaatgtgtccagtgaaatagtggatttccaattgcatgggaaactgtatcggcccaagctaaaaacttctcataatccgacccttcaccagttatatatttttcatctataccataacttctcatagctctccatttatagtgatcgccataaagccatatttctgttatgtttttaaatttcttgttttctaatatctcttttggatttatatgacaatgataatcaataatcggcattttttctgaatgctcatgatacaacttttcagaaatagaatttgttaataaaaaattttcatccatgaattctttcattttacaggtccccttattattatatttattgttcacgttaacaattgagtgtgcaagtaatagttaacgtgaacaatttgttagtatcattaactaaacttattataatcttatttcaaagataatgcaagtccttttttgttaacgttaacagattttttcgccaaataatattatttttttatattatttggcgatttttttcaaaattaaattcttttaacagaatttctttcaacgagatatgattctataaatattttctcttgatttattaattttttatttattatatcaagaagattaataccccctatttcactcatcgtaagagaatctttttttacactagtaagtgttggtgtaacataattacagaaattactgttatcaaatccgataattgatatatcatcaggaactctaagaccactttcaaatattgctttcatagctccaacagctatatcatcatttgcacaaaaaactgctgttggtttatcttcaatatttaaaagttttttcatgttatgatatccactttcaagtgtatactttccacttaaaatataatcattgttaacgttaatattgttttcctcaagagccataatatatcccttttttctatatgtacttgattcaaactctaagttaccctgaatcattcctatctttttgtgattattatttataagatactgtactgcatcatatgaaccctttgtatcatttgataatacgtttataacaccatctacactaatatctctatttataacaaccattggaatatttttttctattattgttttaataaactcatcatcatttttgctttgacttacaactataattccatcaaaatttttattgtcaataggatgagaatgttcataattatcaatccctcttatgacaagattatactccttgtccattactttatttacacccttaacaatttcatggaagaacgtatctgatgttccttcgcttattgatgagaagaatacacctattacataagatttaagcaaaacaagacttttagcattataattgggaacatagttcaactccttagccaatgctttaatctttgctttagtttcttcatttatatatgggctattattaagagctcttgaaactgttgtatgagaaacattagcaagttttgcaatatcttttattgtcacactcatttttaacactccttacattttcttaatgtatattttatcatatattcctactttaataaattttaatttatctcatactattatattggaataatcatctaaaaaaaatatatgtacatatactatttatcttaattatacactttataacacaatatatacagaaaaagcggcattatctataaatgccgctcttttgtaaatttactatacttcttttattctatttacaatatcaactatcatatttactcttccaaatggtgttataaagtataatccatcacatataccttttaattttttgcccattgaaactgcaatatctataccaatattctgaccttcttctctattcatatcttctgaaaatctatttaaaatttcttgtggtattgttacccctggaagctcgttatttaaaaacattgcgtttctataacttaccactggcagtatgcctccaagtatcttaacatcagttctttcttttatactttttaaaaattctaccgcagaatcatcataaattggttgtgttaaaaagaatttcgcacctctttcaacttttttcatcattctaccatattcaacttccttgttaagaacattcaaattaagcgcaccaccaataaatatatcatcacttgtgaatacctcattattcatatcattaataagttctattaatttaaaagaattcagattaaatacacttttcgtctcaattctacttgcatcacttatagggtctcctgtaatagcaagaatatttcttatttcttctatatgacctcctataaggcttgatcttattgcattagtattcttatctctgcaacacatatgaggcattgcttcgattccaatttctctttttatttttgatgacattactactgaatcagctctaaccttagacattggagaatctggaactgttacaatatcaatattattgtctttgcatactttagctccagtcattatcttatttatatctgtatctactggtgcacttaattcaacggcaataacaaaatctccattctttactttttccttaaatttattctttattatatttttttcattatatgtttcatgttcatatcttttaattttatctccagcttctggcttattatctattgtatctcttaatttacttatataagatggatttgttccacagcatcctcctattattgatacacctagtttttttatttcctttacttttcgtgcaaaatacacaggattatttggataaacagtcctctcatgtattatctctggaaagcctgcattgggaagtgatgatacaatatcatctcctatgtctatcttttttattaattctaaagcatgagtaggaccagaaccacagttaaaaccatagctatctatagtatttatcttttttacttcgccaacaattttggatacactatacccatctcttgtaaatccgtcaggcttcacagcaaattgtgtcaatataaaactttcaggttttttatttttaatatatgtacttacttcttctaaataatccaaattacttaatgtttcaaaaataaatacatttatattattatctaaaaaacaatcaactataaacttatattcctctaatacttctacaacattttcatctgctccattttctcttataggacctatacttgcacctataaaaacttctttgttatatacagcctcttttgctatttcaattccactttcaattatatccttaagtgtttttctagaaactccaagttcttttgaatttgcactaaaagtatttgttcttataagcttagccccagcttctatatactcttcatgaattcttcttattgtattcttatcgtttaaattcccaaattcacagtaggatatgtcatttcctgttttttcagaataatatgttcccattgccccatcacatattaatatattattgtttaaaaattcttttatcatgtatatctccccaatttttcttaataattctattgtaagtatactataatttttttttctagtctttaattttttatatatttattaaaatgcccttccatatctaaacgcaaaatttaactatatttaatctttcatatttatgaaaaaaagatgtagacttttcatctacatcttcataaattaatttatattaccttgttttggtttttcaacactactatctggcacaacttcctgaactttattatcttcttctaattttcctgatgttgtgttattttctataacattcttatctggatctataacagtgtttttatccccatcctgattattgctactattttcaccttcagcaggcttttctggattaagttccaatactccattattaatttctgacttatcattattctcttcactcttatcagaatgtgctggagttttttcatcagatggagctacaatatcaggcttatgatttgcattattcccgttttccttagtctccttagttgtagcattatttgtattactattattgtctgctggtttgtctgctggtatcatattgattttatcttcaaccttttcttctttaggtgcacttacatcttcagctttatcttcatcagcattatagtattttacattttctttatctttaatttgctctgtaatatctttaactggagcacttactatttttttctttgtttcttcatcaactactttagacgcttcatatctacctaagcttataccttgttccttagcttcttcaacatcattcttatcgtctactttaatgtatgctacattttcagtatcaaatgttgttaaaacagcatctattatattatcttcataagcagtcttatcttcatttttaacaaatgcaaatccaactaatacatctttattatttttcaaatactctttttctacaagaatgtcttttactgctttaataccatcatttatattacatcctttaacactagaaaaatctatactctttccatcatcattcataccttcaacattaattatctttttattatttccaacttctaactgtatacttggattaatatcaagactaacaactgcataagttttgtttacatgtatattataaaaaaacgtaaatgcaattaagaataatgctgcaatagatccaaatgatttcataaatacattatatttaaatttactttgagtcgtcgttgaaatttttacaatatcttcttcaaagtaaaatattttttgtccaactaccatctgtggcttaactacgattttatccatactgccgtcatcatttaacataatggcatattcatctttaatttccattattaaaccttttttcataaatatcacctacttcctgatccaatttttcaaggcgctaagatttttgttaataattataacaactgctattataaattttttacttcgtttaacaactttttccgtgactccaaatctaagaactattttctttattggtagccttctttttaaatacatgaatgatataaattcctcttcttcacatatctgtttcgataaatttatagcattttctcttgttgcctgttgttttggtgcttcttccattaaatcttctaaagtaaaaccaaaggaattgatttcagctttcagcatttcaatctgttctactaacaaactattgtcttcttcctgctcaaagttttcatctttaaattctaaccccatctccgtaagttcttctagagatgaatgttgatgcttattttcgcctttcaaataattttttattctacttgaaataacaagtttagcataagataaaaaatgtcctttttcattatcatatctctcaattgcttcgttaaagccaagtagaccaacacttagttcttcatcattttcacatgatacatatctccctgtaacatctgaaatactctttattatgaatggcatatgtttttctatcagcctgtcaactgtagtttgtccttcaatatttaaatctattaaaacattttcgagcatacctgcgctcccttcctcggtcattattatatacaaaaaaagttatgtatttcggtacctttttattaatcttccaaaattactacaaaacttaattttttcctttttaacttgtccacatattaatattaacatattaatcatatttaattaacatttaactgtaaatttatgattcatttaataatgtactattaatagttatacaatatttaaattacatctttataatattataatcgaatatcttttttagtattttatacggtatatgtttccatcaaaatagtaatatatttcatatatttataatataagatatattactattaattaacattgaattttatactgttaatttatttgagaaggttaatcaattcactatttgttactaaattgaatacttcactatcatttaattcatttgtcaatacatcattgattagatttcttttatcttcttgaagaagaactattttttcttctatggttccttttgctattaacttaattacttcaacatcccttttctgacctattctatgtgcacgatctgttgcctgatcttctattgatggattccaccacggatcaaagtgaataaccatatttgcacttgtaagatttaatcctgtcccacctgcttttaaagaaatcaggaatactcgtttattcttatcattattaaattcttctacaagcttaattctagctgctgatgatatgctaccatcaagatagcaatactgtattttttctttatctagttttaaagctagtttcttgagagcctttgtaaattgagaaaataacagaatcttattttctttttgatctttctttatgatatttaacacttcgttaaatttcccactttctccattgtattcattagtaactaacgaagggtcaagacataattgtctaagagttgttaagaatgaaaagatcgttatattattcattttttcactattaatcttatcttgtatttctttaacacaagcatcataaacatctttttgttcttttggcatattaaccaatatttttttctcatatttttcaggcatttctcccgctgcttcttttttggttcttcttagtatatatggctttattagtattttaagttcttcaaggttggattcattttttacaaacttttcattaaacactttatatgtatataagtatcctggcataatgaaatcaaataatgaccataattcattaagattattttctattggtgtacctgtaagaatgaatcgattattagctttaagtttttttactgtagtggttatctgtgctttataatttttaatattctgaccttcatctaatattatatttttgaattctatattttcataaagatcaatatcatttttaatcaatccataagtagtaattaaaacatcataatcacaataattttcaatatttttttctctttcttttttctcaccattgataatacaaactttcaaacctggaataaattttttaaattcatcgctccaattatataaaagagaagttggtactacaaccatggaagtcccatttttctctgaagcaagaaatgctattgtttgaatagtttttccaagacccatttcgtctccaagtattcctccaagaccaagatcactaagatttttaaaccaattatatccttcaatctgatgatctcttaaattacatttcaagtttttaggtatttcatagacattatcttgttttctatgaagtgcatctattaaatccagtattttttctctattcttaaatactattacatcatcttctattttatcttttaaataatataatttatcaattgaaaggtaaaatttatcctttccactcataatatctagatttaaagtatctataattttcataattttttcaatctctttgctttttaagtcaacatatatattattatcaagttttataaaatttttcttttctttatatgcttttactacatcattcagttcatatggtgatatattttcaaactgcatgtaaaattcatacattccttttgaattttctttaattgacaaatccttaaatcttccattatttaatttaaagtaatctatatatgatctttctgtaaatatagttcctatactctttatttcatctattccattctttaaaaacaaataatattcttcatcatctcctaagaattcaaaattctcatttctataataaaatctatatttatttaaaatactttcaatattcattaatttctttgaaaaattgaatttatcattatttattttaatagcctcagaatagttcatatctataatattatttttgattattacatcacatactgattttcctttttttcttgaaaaattaaagttaattctaacatcatcattcattttacttattattgcttcatcataaaatatattttgagatatagatgttaatactttatttaatacaccaaactcactattatttatatcactcttaaaaataatttttttgtcttcttttatatatttatataaaatcctatataaatccacttgttttaatgagggaatatatatatttctatcatataaaaatatatctctatttttacttaaaggtatcggaagtattttcttagtacttagaacataatctccatttattttcttcatagtaaatgttaatggtagatcagaatttaatatgacacttgtataactttgataattatagttaaatttaatcttcttattatttaatttttcaagaaattttttcaataattctgaagatattcttataaaacttgtgctttcattatttctactaattaatataatttcatatatatatttaataaattgttcatcactttcactaaaataatacttgttcttgtcataaacaagaccttttcctatacaatactcttcatcttttataattgaacatacacagttttttatatttaaaattggatacatatgagtattcccaatatatatactcacatcaaaatcattactacattcttcttttacctgttttattgatacattaagaacaagcttttcttttttatcaaataccttttccttctcatcactgtgaatcaaatatatattttctaattcctttattatttttttgtcaattctctcttcttcaattctttttagagctaattttttctttattccttcaacaaacttcattgctgctgccactagatgttcacacatataaatcttattttctaactcgccaccctcaaagatattacagttgcattttgtaaaagatatttttttatttttcatatctattcttaagtgaggattacactttttaaaattattctcacttttaaaattaccataaatattataaaaattatctaccttatgaacgtcaatagtgaatgctttatcatctaataactttttccctcttgtcatgtttattttagatgtatttcgtataattatattttccaaatcagatattttcattttatcaccaccaaaaattgattttcagctttttaatatgctcaaatattatatcactttccaataatatgacaaatttatttatctgcatatataatacaattatgaacataaaattgttgcaaaataaaaagatattttaaaatatctacattttaaaatatctttttactctgcattataaaattttaacacattccgccattatttccaccaccaccgccacaagcattcatattatttgcagcagctggtcttaccccttgatttgcatatttagttgcatattctataattctagcctgaagagtgttcatactgcttatatattcagtattgcctggatctagttctaatgctttctttatataatttaatccagtttcaaaccatcctttttgaacacaaataaaaccttcaagataattccactcagcattgtctcgttcatttatcatattaagtttagactctgcaagtggaaaatttttaatttctattaattttcttatttctgcatatatattcttggaattcataagtaaatcataagctctattaagttcttctaatttttcctgtgttgtttcatcttgatttaaagtgtattcttctgctaaagattgatacttttcttttatttcatcttctgaagcattttcttcaattcctaaaatttcataaggattcaatataaattcacactccttatatcattatcttctaatccttattattaaatatattttaaagataaaatattattacattagcagtttataattctaataatattagttccaattaatagggtgtgtctacaaattattttaagctaaaatacaatgtttcaatataacagctcttatactttcatattttgtatatttaggcagagctttttttaaatctgatattttttcaaaaccaacttcatttattgcatttaaaatggcactttcttcttcttcattataaaactcttcaaaatttatattaaacttaatttctccaaattctttaatatattcagaaacatacccaagtatagttgaaactgatagttcaagtttttcagatacttcatgaatatttacattttctttaagcatatctaccgcaatttgatcactatttcttgtttctccatcaattatcacttttcttttatttttttgtatccatacatgttctatattattttctaatatataattatttactatttctattatttcatcaccataagcttctatctttttaggtccaaatccacttatatcttttaattcttcaatactcacaggatatcttccacttatctccttcaaaatattcatgtgcattatagattgaggatacgcatttttttctttttccgcccatttttttcttgcttcaaataataaattatataatttatcatctgtttctatttcaagcttcagatcattatcattgttagatgttattatttccaaagtaccttcgccagaaatttttatattattatcttcagaatattttcttattgtgttttcaaatagctcaccatatttactgtatttaagttcaccaactccagtaatattaagcattgcttccttataaactggatatttaactgacatttcctttaaggtaatatctccaaaaataacatatggtggaacattattttcatgtgcaatttcttttctaagttctttaagaatttcaaataactcattattgtcacgaacttttttgtgtgctgcaaattctttaagcattactttttcttcacccacaaggatttttcttgacattgaatttaaggctaaaataggatacgttccttcaacaactcttatatatccttgagatacaagagtatttataaatgttttcagttcatctgctgaaaattctttcattattccataggtagaaagttcattaaatttaaattgcaatacttttttattttttgatcctcttaaaacatctactaccatcccagaaccaaacttctgattcattctatatatacatgataaaactttctgtgcatctactgttttatcaacaacttcaccttcattcatacaattactgcaactgttgcaatcatctttaagctcttctccaaaataagctaatataaatttcttataacattcattactgtatacaaaatctatcatttgttggagctttttatattgtatattctgtctttcaggattttcaattgatgtttcaattaaatacttctgaatctgaacatcctgtggtgaaaataataatatacattcacttttatcaccatctctacctgctctacctatttcctgataataactttccacatttctaggcatattatagtgtacaacatatcttatatctggtttatcaatccccattccaaatgcattagttgcaaccataatatttgctctatcatatataaaaccttcttggttctctcttctagcttcttcacttaatcctgcatgatagtgcacaacactatatcctttagaacttagtaactcataaatattatctacttcttttcttgttgaagcatatattattcccgaaacatcactgttattattaatataatctaaaagataattctttttatctccaccttttattatatttataaaaagattttctctattaaatccagttataaatatcttaggattctcaagttttaataaccttataatatcatctcgtacttcttctgatgctgttgctgtaaaagcagtaactgtaggtcttttattaagaatacctataaagtgtgatatttttttataacttgatctaaaatcatggccccattgtgaaatacagtgggcttcatcaactgcaatttgtgatatgctgcatcttcctataatattcaaaaatcctgatgagccaagtctttcaggagctatataaagtattttcacttcatttctttcaattttatttattatgtcattctcttctgctgaacttaatgtactattaatatattccgcttcaactcccatgtctttcaatgtgtcaacttgatctttcatcaaagatataagaggtgaaataacaattgtaagaccttcaagcataagtgcaggcacttgataacatatggactttccaccacctgtaggcataatagccagaacatctctaccctgtactattgaatttattatattttcctgaccttctctaaatgatttatatccataatatttttccaatacactttgaggtgatttatttatcattaacaaaaactctcctttacgtatctcgtatcaaaaatatagtcacaattttacaaacatatgtttgcatgtttaattgaattattgactaatatctaattttatattcatataacaagtataacacttaattatatgttattttactcatgtcatcaaattaaaaacagtaaaagattaaattttaaataaattggaaaaagctatcttaaatcaaaattgatttaagatagcttttttatttaatatacagtttttatgcttctcatagtacatgacaatataaaattaattataaaataacttgctgcaattgttccaaataacaagaatacctgagttgaagtagcaaaacttcccatcaaaatcataccttttcctgtaaactcctctattccaactgcccataaatatgatgtatcctttattacagtagaactttgagataaaattgtaggtatgcagtttttaaaactttgaggaagtataatatatctcagtgtctggatctttgaaaaaccttgtgaatatgatgcttcatactgtccagcgttcacagaattcattccgcctctaactatttctgctattgctgctgttgtgaaaagagtaaaggataaaattcctgaatacatcggttttataggtataagaaaccttatagaaagtatccataataatgatggagtatttctaaatatttctatataaattgcagctaattttccgaatatacctttagaatagtttcttaaaacagctaaaattgtaccaaaaatcatactcaaaaaaatagaaataaccgctatggtaagggtaagcttaagaccttgaaaaagaaataatatatttgtttttgtaaaaatcatatccatattacacccccccttcaagacctgctaaatcagctttttgatttgcctctaattcaagctttggtaacttctttttcctaagttccatctttcttgcaacgacagaaagaggataacataatacaaaatataatattcctgtgacaacatatgctggaccgtaaaacatattctgacttgaccatgagtctgcattatgcataagatctgcacccgcaatcatagctaaaacagatgtattttttattaaattaacaagctgatttgtaagaggtggtattataatctttatagtttgaggaagaattatatacctcattgtttcaatgtgtgagaaaccttgagaatatgatgcttcaaactgtccctttgatattgaagtaattccagttcttacaacttcagatatatatgctccatgataaataccaactccaagaatacctattaagaatactggaagtactatatttatatatggaagaccattaaataagaaaaatacctgaattactaacggtgtattttgaattatttcaacatatactctacttattattcttaataatttaattttactagtagacattacacctgaaattgttccaagaactatagctaaagccagtcctaaaagtccaacttctattgtaacaattaatccttccaagaatatatggtaatcagtaaataaagcttcccatttgaaccatgcaaaaggtccattcattatttaattccccatttttcaattaacttatccatttcgcctgaagttttcatatcatttactacttcattaataacttttgccaagtctttattgtctaatttacttgctataccatattcttgtggattatatctatcatctaagattactgaattatcatcaacataaccatttaaaatagatgcatcaactgcaaaacagtcaactctcttagaatcaagtgctgcttttatttcagggtagcttccaaattctgaaaattttagagatattccttgatttgctgcttcttcttcaagagcctttttagtagttgaactttgagctacaccaattgtctttccatttaagtctttaaggcttgtgtaacccgcatcttttttaactaataacccaacaccatcagttaaatatggatctgaaaaattgtagctcttctttctttcatctgtaattgtaaatgtggctgctaccatatctatttcaccattatcaagaagaggacctcttgttttagccgtaacaccttgaagttcaattttattttcatcccctaatattttctttgcaatctgctttgaaagatctacttcaaatccttctatttcacctgtatcaggattcttatatccaaactttggaacatcaacttttacaccaacttttaaaacaccattatcctttatcttctgaatatctgccccttcagcacttgctgatgcctttgatgatgtatctgtaccttgtgattgtgatgtagatgaagaacttccacatcctgtcataagcatacatgcccctagtcctaatgctattattaatctctttaatttcataatatattccccctttaaattgcttttttatatatttttcattatcttattattttgtttaaaaaacttcttgctctttctgttttaggagcttcaaaaaactcttttggatttccttcttcaattatatttccgttttccataaatataatcctgtcagcaacctgttttgcaaagcccatttcatgagttacaactaccattgtaatattctcttttgataatcctacaagtacatcaagtacctcttgaatcatttcaggatcaagagccgatgttggttcatcaaaaagcattatttttggatgcatattaagtgctcttgctattgccaccctctgttgctgaccaccagaaagttgagtaggataagcatctgctttttctttaaggcctaccttttcaagatacttaagcccactttcctctgcttcctttttactcacattctgaagctttattggtgcaagagttaggttgtccaaaacagtcatgtgaggatataaattaaactgttgaaaaaccattgctgtggattgtcttaccttattaagagttcttttatctctaagattgtatccatcaataactacacttcctgatgttggttcttcaagatagtttatacatcttattaacgttgatttacctgaaccacttggacctataacaacaactttttcaccttcctttacttcaagattaatatcttttaaaacatgaagatttccaaaatttttgtttattttattcattaatatcattagtatcttccctcctctattttggaattttaataaaaaaagagccatttcatgaaattcataaaacagctccattgctgatgcaactaattaatttatcaaaaacagttttcacagtgaaatgattaaaccacttttaattttacttataatcatcattgattataaaaaacaaaaagctattctttagttatactaaagaacagctccattgctactcattttataaatataatacttaaataacataaatttgtcaagtattttttcaaatttatatatttttgtaaaatactcacaatgtacttatttaatcttttatagaatatataatttatttcttactaaatttatttttagtaagctaaaatttcaactccgtcttctgtaattaatattgtgtgttcccactgtgcagatagttttccatcatcagtatatatagtccaaccattatctgcatcttcataaacttcataagttccttcattaaccattggttcaacagttaaaaccatacctggaacaaggagcattccagtaccagccttacctacgtgaggtacaaatggttcttcgtggaattcatttccaaccccatgaccacctaatagccttactaccgaatatccattcttatgagcatggtcaccacaagcagcaccaatatcacctaaatatccccatggctttatagcttcaatacctttaatcatacattctcttgcaacagtaacaagcttttctgcttctttactaacttcaccgatcatgaacattctagatgcatctgaataatatccatcaagaattgtagatacatcaacattaacaatgtctccatcttttaatattacattttcatcaggaataccatgacatacttcatcatttattgatgtacatacacttttaggaaatccgcagaaatctaaaggcgctggaatagctccctgtgacactgtataatcatacactatcttatcaatttcagcagtactcattccagcttttattttgcttgcaacaaggtctaaaacagcattatttacagccgcactcttttttattccttcaatatctgaagcagattttataatgcttctgtctggaactaaatcaccttttattttgtgtgactctattttttcatcgaattctaagtggcattttttatattttttcccacttccacaccagcattttgcatttctatcaaatgacattaactttgcacctctttgttatattttttaaaatttcatttttaaaatactattatctctataactaataatattttctcaataaaaatttgttaatttttttaattttaagtttaaatttctactaattcctatacattataacgtaaaagagaatgtataatcaaatttttcagaaattcattattttttcgccctatcacattttagttttttacctttaatagtaatattttttaatgcatcaagtactttttttccttttccatttaatatatcaacataagatatattatcttgaacatctattattccgatatcatctccagttaatccatctattctcgaaatagcacctacaatatctcctgctcttattttctttttcttgcctccatttagatatatttttgttatatcattattgatagccttggctttttctgtttttttcttaggcttagacttaagatatgatattccagattctaaattttcacttataaattcctttgtaaagtgttcttttacaggtattccaaatccaatatattcttctatatttttaaggtatctatcgccatgtttagaacatattgatatggcctttcctgattttcctgctcttccgcttcttcctattctatgtacataagcttctttttcaactggaagctcaaaatttattacatgtgttatattttctatgtcaattcctcttgcagcaacatctgtagctgaaagaattctaaattctccttttctaaaactatccattgcagataacctctctttttgaagcattccaccatgaattcttccacatgaataaccttttgattttaagaaattataaatctcatcaacattttcttttgttcttccaaatatcactgccgtttcaggtttttcacatataagaagttcatttaataatttaaatctttcattgtaatcaacataatataaaccatgttcaatattatcatttaccactttctgcttttctattgaaatgtccactggtctatccatgtatttttcacataaagttcttatttcatctgaaatagttgctgaaaaaagtgttgtaactttgtttttaggaagtcttcttataacaccttcaacctgccctataaaccccatattcaacatttcatcagcttcatcaattacaaaatattttatctttttcacatcaagacttcctctgtcaatatgatcaagcactcttcctggagtaccacatactacatgtgtcttttgttttaaagctcttgcctgctcacttataggctgctttccaaatactgcaacagatttaatccttttaaaccttccaatattcacaaaatcttcactaacctgtacagccagctctctagttggacttaaaacaagtacttgtggagcattttcattccaatctactttttcgcatataggaattgcaaatgctgctgtctttccacttcctgtctgtgattttacgataacgtctttatttaatataatttctggaataactttttcctgtacttctgatggttttttatatcccaatccatcaactgcttttaaaatttcttcacttatattgaacttactaaattcatttttcatatctattttatctcctaacgtgactgcataatatataacgcttagtacattatatattatttccattcaaaataaaaacacctgtatatattttattttttacaggtgcacactatatattatcttctataaatattagttttaatttctgtctaaatctttgcttatattaacatatttcttcaattgcaagaagtcttggttttttatttttctgtatttgaacatatattttcgccattttcatctgaattgtctcaatcattgtttttaccttacatataaagtaataatcttctatgccattggtaataaccgctaccggattgaatttccacccatatattccatctagtgctatacttaatatttccttatcataatctgttacttcattctttatttctaatggtgctattcccttatccatttttatcacccttccatatttttatcttatctatacttatgttctacattatttccattttatccgtttataatcctcattcttaattttctaatcaatatttaactttatatccttagtgtaatttacaattacattctcatattatctattaatctttttcctacctctgtattgtttatgtgtttattttacgatttaattctgtataatagcttaataactaattaagttaatattaaaaaattcttatctttaatttgacattttttaagttaattactataatattctacagagtgttgattaaggtcacacgaaggggtacaccaccacgggtgtaagtctttgtgtggccttttttgcatttcccattttttaggaggtgagtatgtgataactataaacggcaataaaattgtagacgctgataatcttaaattaagcgatttcttaaaaagagaaggatataacttttctatgatagctgttgaatgtaatggttcaatagttcctaaaacatcatatgaagaaaaactacttgaagatggagattcactagaggttgtgagttttgtagggggtggctgatttgaatatttttattaatggtaaacctgtttttacacaatgttctactctttatgaattacgtgataagcattataaaaatacaaaaaatttgataacaatttttaacggatttcaaacttatgatgattttattattaaggaaaatgacaatataagttttattataaagggtcaaatgcctagtcaagatgagtttgaagcattaatgtgtgcaagacatactcctcatgtatttgaaaaagttaaaaaagcccatgtagcaattgctggtcttggaggtcttggatctaacgtagctataagtcttgctagaactggtgttggccatcttcatctcgttgattttgatattgttgaacctagtaatctaaatcgtcaacaatacaaaattaaacatttaggcatgtttaaaactgaagctcttaaaaatgaaattagtgaaataaatccttttatagaagtaacagtagatactgtaaagataacttcagataatatagaaactttgtttaaaaatgaagatattgtctgtgaagcatttgataatcctcaagccaaagctatgattgttaatactttcatagaaaaatttccagataaaaaacttgttgcagcttctggaatggctggatttgaacgcaacaatactattttaacaaaaaaaatcacagataatttttacttatgcggagatgggacaactagtgcaaaaataggaagaggtcttatgtccccacgtgttagcatatgtgctggacatgaggcaaatacaatactaagacttattcttggaattgaagaagtgtaagtttttaaataattaaataccaataagtataatgcaataaaaagggagatataaaaatgataaataataatgacaaattaataattggtggacatgaatttaattctcgtttcatattaggaagtggcaaatactctctagatttaataaatgcagctgttgaaaatgctggtgcagaaataataactttggctgtcagacgtgcaaataccaacggtacagctaacattttagattatatacctgaaaatgtaactttgcttcctaatacatcaggagcacgtaatgcggaagaagccgttagaattgcccgtcttgctcgtgaaataggttgtgggaactttgtaaaaattgaaataatgcgagattcaaaataccttctaccagataactttgaaacaataaaagctactgaaattcttgcaaatgaaggatttgtagtaatgccttatatgtatcctgatcttaatgttgcaagagatcttgttaatgctggtgctgctgctgttatgcctcttgcttcaccaatcggtacaaataaaggattatctactaaagattttattaaaatactcattgatgaaattgaacttcctataattgtagatgcaggtattggaaaaccatcacaggcgtgtgaagcaatggaaatgggtgctgccgctattatggcaaatactgcaattgcaactagtagagatgttgcagcaatggcaggtgcttttaagaatgctatagaagctggaagatgtgcttatcttgcaggccttggaagagttcttgaaggaaaagcttctgcatcatcaccattaactggatttttacaggattaatttaggaggaattataaaatggaacaacgtattgatcatatgaaatacctccctaatatggaggttttagaagaatctaatatcatgaatgaagtaatcacaagaatgaattcttatgattatgaaaactatacttcagaagatgttatgactgcattaaataaggatgttcttaatcccgaagactttgccgcattactatctcctgctgcatttccatttctagaacagatggcacaaagagcaaaaatagaaacacgtaagcattttggaaattctattaatatgttcactcctctttatatcgcaaattattgtgaaaactattgtatttactgtggattcaactgccacaataaaattaaacgtgctagattaaatgcagaagaaatagagaaagaaatgcaggtaattgcagaaacaggacttcaagaaatattgcttctaactggtgaaagccgttccatgtctgatgtaaaatacattggtgaagcatgtaaaattgctagaaaatacttcaaggtaattggagtcgaagtttatcctatgaatagcgatgaatatgcatatttacacgaatgcggcgttgattatgttactgtattccaggaaacatataatagtgataaatatgaaacacttcaccttgcagggcacaagcgtattttcccttatagacttaatgcacaagaacgtgctcttaaaggtggtatgagaggtgttggttttgccgcactactaggtcttgatgatttccgtaaagacgcatttgcaactggtatgcatgcttatcttcttcaaaaaaaatatccacatgcagaaatcgctttttcttgtcctcgtctacgtcccataatcaataatgataagattaatcctaaggatgtacatgaacctcaactacttcaagtcatgtgtgcatacagaatatttatgccatatgcagctatgacaatttctactcgtgaacaggctcactttcgagataatgttataggacttgctgccacaaaaatttctgcaggagtgtctgttggaatcggcggacatgcttctgaagaagaaaaaggtgatgaacaatttgaaatttcagatcctagaaatgttgatgaagtatataatgctataataaatcatgatcttcaacctgtaatgagtgattatgtttatgtataatatacttgcaatcacaaatcgtcatttgtgtaaaggtgattttttagaacagataaaaaaaatctgtctttttaataataaaatccaacatattaactcttcaaaaaattataataaaaaatcagtcaataatataaggtcaatatcaatagttcttagagaaaaagatttaaatgaaagagactatgaacttcttgcttcaaaagttattagaatttgtgaagaatacaatactgagtgtattcttcatacttattataatgttgcaagaaagcttggatgttcaaaaattcatcttccacttcatatattaaaaagcaaaccatatattgctgaaatatttgatgtagttggagtttcaatacattctgtaggtgatgcactggatgctaaaaagatgaacgttacatatgtaacagcaggccatatctttaatacagattgcaaaaaagatattcctgctcgtggacttgcttttttaaataatatagtaaattcagtagatattcctgtatttgcaattggaggaatagcatcatctaatataggttctgttataaattatggggcttttggagtatgcataatgtctggatttatgaatattgaaaatccagaagatttttttctttaaaataattttttatgatctaaaagctattaatccctcaaagcaatatagttaattttgctttaagggattttttatcttaatgattattcctaagaaatatttacactcttattaaaccacaaattaagtcttatttattcataaacttaatttttcttatagataaatacgctgcaaatattcctaatattgcaaatgatattggtattataattattgaatttaatgaaaatccattatcataggaacaaaacataatcattaaaataatagatactataattgtcataaattttgattttcctaatatcccaaagtatataggtattatactaattaatgaagatgtaactccatatattactatggaaaatatatttgtttttataatatttaagttcaacacatagggtagtatattgaacattttgtttaaagcacaaaaactactttccaaaatgatatcagataatattatagaaaaaaaagtaattatacatataataataatttttgtttttatatttctttcatatttgtctctttgggtatttgaaccatattttaattcattgataataattttacaaccaatcatacttgagaaaatcataaatgtcgctcttactaaacagtctataacataaaaaatactagtgatattccatattttaaatgctcttgtagtatatgttgagacaagcaaaactccaaatattataatattagcaatcactatgttttttatatgattcgttatgtttattttcttaaattcacctttaattaaatcagtcatttcgttctccttatattttaatctattaaaccctattgtatattttaccattttttatttttaaaaacaaaactgtgtaaaatagaaaatttttaacaataaaatttaatttcaaaatactatttatcaaaaagcacccctttatctttaaatatatacatgatctaaactattaactggtaaagtgggcataataaagttataattaattgacaatcagtccagtctttttataattttatttatagactgttaattaatataaaatacaaaggagatattatgactacttttaatgatttaaacttagattcaaatataatagagggattaaaaaaacaaggaataactgatcctacttcaattcaagctactgctattactcctgcaatggaaaataaagatgttattggtgaagcttttactggaagtggtaaaacattggcttaccttcttcctatatttcataaaattgatacatcaaaacgagaaatgcaagctattgtcttagcacctactcatgaacttgctcttcaaattgaagcacagataaaacttcttgcagaaaattcttctgttcctgttacttctttttctgtaataggtgatgttaatataaacaatcaaattaaaaagctcaaggaaattaaaccacatataatagtaggttccacaggaagaatccttgatttaataagaaagaaaaaaattactgcacacactattaaaacaatagttattgatgaaggtgataatttattagatcctaaaagagctcaaattacaaaagatataataaaaactactatgagagatcgtcaacttctagttttctctgcttcaataaaaccagaaactctattaacatgtgaaagactaatgaaagaacctgtaataataaaatctgaagaaaaagctgaaatgaatccaaatattgagcacatgctttttgtctgtgatagaagagataaatttgaaactttaagaaaaattatagtcgctgcaaaacctgaaaaggcaatcatatttgtaaatagtaatgaagatattgaaatgactactgcaaagcttaacttccacagtaaagactgctttgcaatgaacggacacatttctaaagaagatagaaagcttgctatagagagtttcagaaatggaaagataaaaattcttgtttcttctgatgtaactgcaagaggtcttgatgttgaaggagtaacacatatattccacttagatcttcctttaaaggtcaacgaatatttacatagagctggaagaactgcaagaggtaacaatactggtgtttctattgcaattgccacagttaagcaacttaacataattaaaaaatatgaaaaagaatttaatataaaatttgaagaaaaagaagcctttggaggcaagatattagataaaaacattcctagtgaagcgtataatgaaagaactcctaaaaagaaaagtaattctcgcaacaataaattaggaaaatctaaattcttttaattaatttcaaagaagaaatcctatatttcattcattataaaatccagaaatatatctgcatgaatatttctggattttatatataattatttttcataaatcatattgtaatatctctctatatttctttctagagataaaagatctatatttcttccaattcttatactctctttttcatcaacatataaaataagcagtggcaatgaaaaaacattaaattcggcacatatatctggatgcttttcaccatctatttctccactttttactcttggaaagctttttaaaatttcttcaactttgaattttattgcttcacatgctccacaatctcttcctgtaaaataaattactgatatattgctagtatgaattatctcatttatttctttttcagtttttaataacttcatgaatacacaccttcaatcatcttatatattttaaataaatttattatctttctctatccactctacaatactttttataacatgattttcgttattatttgtgatgacatctgcatatttttttactgcgtctgaggcattttctggacaaaaagcaattccacattcttgaagcatttcagcatcattcatatcatctcccactgcgatgaccttacttttatcaagtccaaatatatttattacttctgaaagtgcatgaccttttgatgtttcatctggaagtatttctaagaatctatcaccactccgtactgcgtaaataccatagttagtttttaagtcatgttgaatagaatccattctttctacctctcctacaagaagtattttattccattttaaatcaaacaaattttctttataatcatatacaatatttaatagtttagttgcaggtctctctgctgttttattgtctttaaaaatgtatatatctgttccacaataaatttctataccaagattctcgtaatcagtatttattttatgaacaatattcatcttctctctttccaggcacttttcttttacaggctttcttttcacacaatcatatataaccccaccattatatacaatagcaggaatatcaatatttactccattaatatatttttctgttgcctcaaaagctcttcctgttgcgattgaaaactttcctccattttcaataaaataatttataaattctttattttcatcagatacttccttattattatttaataaagttccatctaaatcactataaataacatagccatcaaattttttcttcacttgcttgtcctcctttattatataagccttattttcctatacttaaaacttatcttatttaagctctattttaaattttatagttcatttatattatacacataatttaaatttatagcattaaggcataaatcactatatttcctttgcctttaataattattttttatatacttaaatatggatttaataacattaaaaggagatatatacaaatgaacaaagctaataatacaaaaatagtttttcttaatattattgcatttataactgttacaatatgggctactacatttatttcaagtaaaatattattaaatagtctatccccatttgaaagcatgttttataggttcttaattgcctattttatacttttaataatatatcctaaatttcacaaaatttcttcattaaaagaagaacttatttttcttatatgtggaataacaggtggatcattatattttttaggagaaaatactgcagtaaaaatatctttagcttcaaatgtaagcttaattctttctactgcacctgtactaactgccctattagctcactactttacaaaaaatgaaaagttaactaaagatcttgttattggatttataattgcaattacaggagtatttttagttatatttaatggaaattttatactaaagctaaatcctttaggtgatatattagcacttggttcttcactatgttgggctatatattcaatatgtataaaatattttgggaataagtacaatacaatataccttacaagaaaaatctttttttatgctttattaacaatgattccattattgtttacttcacagtttaattttaatttatcaactttaatgcaacgtgatgtaataattaatttattatttttaagtgtagttgcttcaagcatatgttatgtagcttggaattatactgtagataaacttggtgtaattaaaacaaataactatctttatttccttcctgtaattacccttatactttcttattttgttcttggagaaaaacttactccatattcttttatcggtgctgtattaattttattaggagtttatgtttcagagaaaggattttcttttcaaataatacaaaagcatactaatgataacttacctatttaatatataagttattgtaactaagcaaatattttttataaatgacaagctcaaaacccaatatgattaataatattaaatcaactagagctttgtcattttattctaaaccctatatataattcacacaatccacttattataaagtaacttcctattatatatggaactgaaataaaacttataatagggtttaatagtattaacaatccaagtaaaacaataatgcctccataaattaaactaaacttattattatccatatcatttctcaatgcatctacaacaatatatattcctcttacaacagaccatgcaccataaaagcttattattaaattaatactttcggttggcatagcaattaatcctgcacctagaattatatttattatactaattactatgtttcttctgtctcttattagatataatattcctaaacttacaagaatcaatcctgttacatttgttaatactaccaatgaatttataggattgaaaacaaaaagtatacctaacacagcaaataatataccttcaataacaaatatcttttctaataatttacccataatattcctccaaaatttctaaattacaagtaaaaattcattattaatttttataaattttcctatttaatattatctccaagcaatgttctttatatgcataaattgcttaaacatattattcctaataaatagaaatataaaaaatagtattaatgcttaatcaatgtttataacatttatctttatagcataaaactatatagaccattttctaaaagtttagaaaatggtcccaagtataacttatctatttcttaaaatcctgtacaatcagttagagatgctccagtaattacatttccaccattaattgatgtgcatccattcataattgcttttccaaaagtaacttcatatcccaaagctgatggtttacctttaagaggaaaattaaaattatattctccattattttcaccagtacaatttgtcattttaaccacaccattctgattatttctatcaaatccacttcctgtatttcctattgcaatacaatcagtaagttcatgatttagtggatcaagatgtgcagctactcctggagttttattatctactccccctaatttaaaaccattgccatcacccttaatgccatcacaatttccgttatttatagccttgcatcttataaatgtaacagctccatgtgctgcatataaatcatatccatcatcagaatttccttcagcagtacattcaattaacttatttccttctcctgaatgtagcttaattgcaaacccatctgcattttcaccagtttgatctgcattactatatgaataaacatttgtcaatgtattattagctgcaccattagatagttgaactccagcatctttatttttgtatacatttacatttgtaatattgttttttgatccttcaatatatattccattatcagctgcaccataaacatctaaatttttaattgaagctccatcactttttattacaaatccttttcccgaacttcctgaagttgaagaaaaatcaattttactcttccccttttcccctgttattgtaactccagctggcacatttacagttcctgattttacagttccagttatattaactatatctcctgactttgcttttgctaatgcatcttttaaagatgttccactattacttacttctatggttgttgctgcattaacaggtatttgataaaaactacttcctccaactgcaattaagcttaaagctgcaattaaacataaatttctcacttttttcatacaatttacctctcccttttctttattgttatcgttaacaattttatatataatattatgcataatttacataacttattttacacccacatttctattttgtaaatattttctttattttttataaaatgtattttaaattataaattaagcttacaactataaacaaattcaaattttcaacatttatatgataaatgcaaaaatttgaatttatttaataataaatttttaattaattagaatcttataacagtgctatttttccattttccacttttataccttataactgagactgtagaagcaaatatccaaccaaatggaacagcccaccatatagccccttgaccaataaatgatgccaatccatatgcaaatataattcttgtagataaattagttaatgtgcttgccaaaaacattttcatatctccacttcctctaagaactccattagtaataaccataagtcccataaagaaataaaagaccgatacaatttttaggtattgtgttccaatagtaattactccctggtttgaaactgaatctacaaacattcctattaattgatgaccagctaaaaatagtaatgatgctgcaaaaacacaaaaaacaccgatcattataagagcagatttatatcctttctttattctttcaatctttccagctcctatattttgtcctgtaaaagttgatacagcattactcatattagacattggtaatatggttattgaatcaattttagttgcagctgcatatcctgcaattacaactgcaccatatgaattaacaagagcttgtacaaataaatttcctattgaaactattgattgttgaagtattgatggaactgctatttttgatattttttttaaaattcttatatcaaattttttaacagtcgtatctgttttaatcatcttaatcttttttaatagaaaacttaaagataataaagctgaaataccttgagatatcaatgttgcaaaagcagtacctcttacccccatattaaacttaatcacaaacaataagtctaataagatatttaaaattgccgaacataaaagaaacataagtggagtttttgaatttccaagagcattaaaacaagatgttacaatgttatatataaataaaaatactactcccataaagtaaatcttcatatatgaactagaatcataaaatatattttctggcgtattcattacagataaaatccagtctgcaaaaataattccaagtaccattaaaatacaactaaatattgatataaatataattgaagtaaatattgatgttttaactttttctaacatccttcctccaaaatactgtgatattacaactccacatcctatacctgctccatttgcaactgttataagtacaaatgttattggatatgatgcgccaaccgcagcaagtgcatctgcccctacaaaatttcctacaatcatagaatcaactatgttataaagctgttgaagtatatttccaagtaccattggaattgcaaaataaaataatatctttgacggatttcctattgtcatatctttgctcatagcattcttcctttttacattgttttcatttttctataaattttcataaaataaaaacatatattatcattaataacctacatgataatatatgttttaaaataaagctcagatacaaactttttaataatttccaaagctattgtttttatattaataaaaaatcgatactaattttatatattttctattactttcaaaagatctttattgtagtctcttatatgttcacatatgttcttttcatttagctcaagatacttcttatgctttattgaaaacacctttaaaactttatattcttcattaatccaacttttataatcattaaataatactttcaccatatcttcaacttcttcaccaagaacaaaattttcattttcaatacttaatacatataattcgcatatttcatcatccaaaatattaccatgatttttattttctagttttgtaccagcataatttagttgagacttctccactcttaacccaatctcttcttgaagttccctaatcattgaacttgaagcttcttctccactatcaatatgtcctgcacatgcaatatcataaaatccaggataattatctttatcaaatgacctttgctgaaaatatatccattttgcattatctattttatttataatatagcattgaactaccttatgtttaaatccatatttatgtacatcaaaccttgatttaactccaatcttattgaaattttcatcataaatatcaatcatttcctccatataccaatctcccccaacattaaaaatacttttattactattttaacatgttttacaaaaaacatttgtttattattaaatttctccttttttaaaatcgctgaatattaatttatttccaatcaacgatattaaaatacctatggatacaaataaaatcctttcaatagctgttaataatgttccatttgtaagtgcaacggatgctacagttgaaactgtcacacataccattgtatcacggtaatcttcaaaataagagtttaaatatcctgctataagaattatcaatcctcttaatggtgttgatttaataaacataaaaagaattacaacaattaatgctcctataatagttccttgaattctcttctttgattttattctgcaattctctccaaacagttctgttaatgaaaatatactatacaccatccatttaccttcttgtatgccattaggcaataaaaatcttccatttataaaagctgttattgcaataagaagacccaatcttaaagcataataagctcttattttattaaccttaaattctattcctaaaatttttactttctcataagtatcatcacttttgctaaactcaagtatatcacttttttcaacttctatttttttatttcttccatatatcaaatattgaattaacataattaaaaatggtgcaaatgctaatgctccaaatcgttttattaagttttctccatatactggatcatataaaataaataaatattgaagaccaaaaggtaatattatagtttttgttaaatttacactaaaataatatccaataaaccaaagaactgaaaaatcaataataactccccaatatatattttgacttgcaataaatgctcccatgcctattatgatatttatcaatagcaatttcataaagttttttataggtgaaactgttaaattttcagacattaaaattaatacagctataacagttgtaattcctacgggagaatttgcatctccaaatatatgtttaaataagctaataaatagcaaaatacatataaatgttaatgtttttgatataatcttttttttcatacctctaatatatctgaatcaattcagatatatttacctccatccttatacaatatttttaaattcctttgacatcatagtactatttacataagcacatcaaatttaaaaatttattctaatatcatgttttcttaattattattatcatttccctatgttttataatatttttttaaaaacttattgacatttacctatatttatcaatataattaatataaattctatatatttacaagtatgataaggagaagtacataaattatttaagcaaagagagagaatggatggtgtaaattctcatgagatatttatggaactagcctttgacttttaaaagaaatctttatagagagtagacttaaacggatacccaccgttataagggtatatattagttcgattttattggtagtataaattattaactttctaataatcagaatatacaatttttcagaaaaatacttattataagttctctttattgaactttttgaaaaatatttttcaagttaattttttatagtaatacttaccttaatgaactaatattataaagtgtgtatattattatacaaatttaggtggtaccgcgatgaaccctcttcgtcctattgttttggatgaagagttttttaatatctaaaattaatacaatataaacttattcaaggagtgatttttttgaaatataatggggctgaaatagttattaaactattggaaaatcaaggcgttgaatatatatcgggaatacccgggggctttaatcttccaatttacgatgctttatataagagcaaaattaagcatatacttgcacgtcatgaacaaggtgctggatttatagcacaaggaatttcacgaactactaatacagctggagtatgttttgcaacctcagggcctggtgcaacaaatcttttaacagctattgctgatgcaaaacttgattctatacctcttgttgcaattacaggacaagttcctctttctgcaatcggtacagatgctttccaagaagttgatgcttatggactcactattcctattacaaaacataattttcttgtaagaaatatacatgatctttttaccattattccagaagcttttagaattgcacttgaaggcagacctggtcctgtccttgtagatattcccaaaaatattcaaacacaggttatagaattggagacatttcctcatagtgcatattctcagtctaatagacctgaaactgaaaactatgatgatacaataaataatgatcatataaataaatgtaataaaaaaatttttaaacgttcaactcttgaatgtatggctgaacttataaataattctcacagaccaataatatattctggaggaggagtcattcgtgctaatgcttctgaagaactctgtgaatttgctaaaaagaacagtattccagtaacattaagtcttatgggacttggtgcatttcctagtgatgatattcttaatctaggcatgctaggcatgcatggtgcaccttatacaaactatcttatgaatgaagctgatttaattcttgcttttggtataagatttgatgatagagctacagggaatattcaaaaattctgtcctaatgcttctattattcatgttgatattgacccttctgaaataaataaagttaaaaatagcaatctttctatggtagctgatataaaagagtttctaaaagaaatgattcctcttattaatagtaaaacaagattatcttggataaaaagagttggatgttttaaggaaaagtatcctcttccatcttatgaaaatcctttacatcctgcaaatattattccttatattgcatcaaaggtttcatcagatactattatatcaacagatgttggtgaacatcaaatgtggacagcacaaagatatccattcaaaaagccaaagactcttcttacttctggaggtcttggaacaatggggtttggtcttcctgttgcaataggtgcttcacttgtaaatactgataaaaccatcctttgttttagtggtgatggatctatattaatgaacattcaagaacttgcaacattggctgactttaaccttaatgtgaaagtaataattttgactaatcatcatttaggtcttgtacgtcaacagcaaaatcttttttataatgaacactatatagcttctcagtttatatctaatcctgattttgcgactattgcaaaaggctttggcataaattcatgtgatcttgccactgaaaatgatccactaaaaaaacttgatgaaatactatcaaaaagtggtccgtgggttataaacattcctatagaagaatgtgagaacgtgcttccaatggttgcacctggaaaatctaatcttgaaatgataggaagtggtgaattaaatgattaatacaaatttttatcttattgagcttcttgtaagaaatcatgcaggtgttatgagtcacattacaggattatttgcaagacgtgcatttaatctggaaggaattttatgtgcacaagttggagatggaactacaagtaaaatgtttcttcttgtaaaaaatgattttgttcttgatcaaataataaagcaacttgaaaaattatatgatgttcttgaagttgccatacatcaagattatgatgtatctgtatttaaaaatttagataaagttcttaaaataaactaaattaaactctagctattaaatatttaccaatagagatagctagagtttttaagattttatttcaataatctttagaaattattgaaatattctatgatataatatgactaatatattctttcaatattgtgaggtaaattaaatgagttgtttaggtaatattatatggttcatatttggaggtttttttaatgctctaggatggtttgcttgtggaattttctggtgtatcaccataattggtatacctataggtatacaatgttttaaaatgggcaagcttcaacttgcaccttttggaaaagaggttattgattcagaatcttctggattaacaagctttgttcttaatatactatggataattttcggagggtttgaattgtgtattgctaatcttttaagtgcattattgttatgcattacaattgtaggaattccatttgcagctcagtctttaaaaatggctaagctatcattaatgccttttggaaaagaaattatttaaatagaaaactatcttgaaaatccaaattttcaagatagttcttttttattaataaactatagtttgcttaatttttcatctataagttccttacagacttttggatttgcctttccttgactctttttcattacctgacccatcaagaatcctgctgactgtgtcttaccagccttatagtcttcaacagactgaggatttgcagcaattacttcatcaattaacttttcaagttcatcagtagaacttatctgcataagtcccttttcttctataattttcataggatctttattttcatcaaatatttcatcaagaacttctcttcctatattattacttatctttccttcattaacaactttaagaagctttgcaaaattttctgcatttaaaggcatttgatccgtatctaatttcttttcattaagaattcttaaaatatctccaagaatccagtttgctcccatttttggtgttataccttcttttactacagattcaaagaaccttgaaagaacaatatctgaaataagtatttcaacttctttttcactaagtttatattcatttaagaatctttctctcttttcatctggcatttcaggaagggattttctaatctcttcaatctgattatcataaattattattggtggtaaatctggttccacaacatatctataatcatgagcttgttctttagaacgcattgatattgttttaccttttgctgcatcccatcttcttgtttcttgaacaattttatgtccttcattaaagcttattaactctctttgtcttttttcttcttttttaagggctttttcaagttctctaaaagagttaatatttttaagttcaactttagttccatattcttgacttcctactggtcttaaagaaatattagcatcacatcttaatgacccttgttccatacggcagtctgaaacttctgaatattcaagtattgattttaatattcttaaaaattctactgcttctccaacacttctcatatctggttcagtaactatttcagctaaaggtacaccaactctgttataatctattaatgatattggctcaccttcaacatggactaacttacctgcatcctcttctatgtgaattctattcaatcttacttttacatgttttccttcataatcatattcaacagttcctccactgcatattggaatatcaaactgtgaagtctggtagttcttaggaaggtctggataaaaatagttttttctatccattttattgaacttatttattttacatccaagtgctgttcctgcttttattgctaaatttacaacttcttcatttaaaactggaagtgttccaggaacccctgtacatataggacatgtattttcattaggttttgctccaaattttgttgaacatgagcaaaatatttttgttttagattttaattcggcatgtatttcaagacctattactgtttctaagttcatatttttatcctcctataattctaccttcaaagactgctctaaactgtaagctgccttgaatattttttcttcacataacatatctcccattaattgaatacctattggaagaccttcttttgaaactcctcctggaattgatattgctggtatccctgctaaattcacatttattgtatatatatcagctaagtacattgctaatggatcagaattcttttcacctaatttaaatggtaaaacaggtgatactggtccaagtattaaatcatattttttaaatgtttttgataaatcatgttttagttttgttctaaatttatcagctttattataataagcatcatagtaacctgatgataaagcataagttcctatcattattcttctcttaacttcttggccaaagccttctgttctactcttttccataagttcatcaacactatcaaatttttcaggtctatatccatatcttacaccatcatatcttgaaagattagttgatgcttctgctgaagacattatataataagctgcaagcccatctttcattataggaagtgaaaacatttctacttctgcaccattttcctttaaaatttcaatggatttctttacagcttcttttatttcttcatctaatccttcaccaaaaaattcttcaggaacaccaattttcattcctttaactccatctttaagagattcagtatagtctatatgtttaagttctcttatgcttgttgaatcataaagatctgtacctgcaattatatttaacatatatgcactatcttcaacattttgtgaaaaaggtcctatttgatcaagtgatgatccaaatgccacaagtccaaatcttgaaacaagtccatatgttggcttaagacctacaaccccacaaaatgatgctggctgtcttattgatccacctgtatcagatcctaaagaaactggacacatatcagctgcaactaccgctgctgaaccacctgaagatccccctggtactctacttaaatctcttgggtttgctgttttcttgaatgctgaattttctgttgaagatcccattgcaaattcatccatattagttttaccaattataacagcatcttcttcaagtaatttctttacaactgttgcattataaggtggaacaaaatcttcaagcattcttgaagcacatgtagtttttacaccttctgtacaaatattatctttaattccaattggaatacctgcaagtgctccaagtttttcaccatttgctattctattatctatttcttttgctttagccaaagcttcatcagccataacagttaaaaatccattaacttttggttctttttctaaaagattttttaagtaataagatactaactcttcacttgttaattcacgactttttattttacttaccatttcttttaatgttaatttcattacattttcaccatcctactcaataatctttggtactctgatataagtatcctgcttatctttaacgttcctaaataaatcggtacattcaaatttctttacttcatcttttctaacgattggttttaattccttcttttcatcttcatttatttctaaatcaagttcattaagatatttaaaattttctaatattccttcaaattcacctgcaaatttttctgcttcttcatcactaaaatttaattttgcaagctttcctatatattttacttcatcaatagttactttcataaatacaccatttagttagttgacagttaacagttaacagttaacagttgatattaaaattttcgactcaaagctcatttatcaattgttactgttgaccgttctttaactgatatattactaaccatcctttctttttatattattttttaattgatttaacttatatccattcattgggtaagttcgactagggcattaatctcttcatgtctcttgggaataatgatgcttctcttatatttcctaggtctaacatttgcattgttattctttcaagtccaattgcaaatcctccatgtggtggcattccatatttaaatgtgtcaagatagaatgcaaaatcttcaagttttaatccccatctttccattttttcctttaacatttcataatcatgaattctttgaccacctgttgttatttctacgcctttataaattaagtcaaaactttttgtcatttcattgttatcttcacattccatagcatacattggtctctttgctgttggataatctgttaaaaatacaaaatcacaatcataagtttcttttacatacttatggaataaagcttcaccttcattatcaatattaccaactggtgattttttcccgaattctcttaataatatatcttgtgcttctgctaatggaattcttggaatttttaatttttctggaagttcaatattaaataacttaagctcttctccacatgtttctttaacatgcttgaacatatatcttaagaaatcttcttcaacattcattaaatctttttcatctttaataaatcccatctctacatcaagactcacatactcatttaaatgcctccatgtgttatgaagttctgctctgtatgcataacctacttcaaaaactctttcgaatcctgctccaaccatcatttgtttatagaattgaggactttgtgcaaggaatgctcttcttccaaaataatctacagtaaacatttctgatccaccctcagtacctgagtttattattttaggagtatgaatttcttcaaaattattgcttttaaaataagttctaaatgattcttcaatttcattttgaattttaaaaattgcctttttcttaggaattctaagacttattgttctataatctaactgagtttcaagtgatactttgtttttatatccttgaatttcaaatggaagcttgtcataataaacttttccagttacatcaatactacttacttctatttcaattccttttagagctttttcattttctctaacaattcctctaacttctactgaattttcaagtctcaagcctttaatttgttccttattacatacaagttgaattattcctgatttgtctcttagcattataaatgatacatgagctaaatctcttattttatgaacccatcctcttaataaaacttcttcctcacctttaattgctaaatctttaataaatgttctttccatatttatcgctcctttttttataatacaatctctcttatttacattttttagtgttttagtaatttttgtattttatttacatccgtttttgcaaaaagttctctattaatgcataaagattataaaacagaataaaaaaatctcgtccctatgcactttgcatagggacgagattatatatttatataacacgcggtaccacccaaatttaacttttaaaaagttcgcctcaacagacacagagcttaatttattaaacaatcttttattttataaattaaactctgcaaatattcaaaataccttaaaagttgaatttacgtaataaaatgttctaactttctctatatccttcacatataacggtgtgactccggttaagtctactaattaatttcaagtaaaattaatgttcggttaactgctccaaagtgttctttcaattcaagactcatacagatattccaccatcatctgctctctaaaaatcgtcaatagaatttacttttcttcatcaatgcatcatcgcatcttatttcatttttttgctttcatcatttcgttgatgttgtattcattatatttcaaatttatttacaaatcaatagtttttttgaaacttttttaatttattttcaatttaattgctttaatactacataattactttttactacattatttttattatactcaaaatttgatgtaatcagactttaaggttaattataatataatttcatacctcataaaaacttatattttaatgaatcaagtggatgcatttctattctattgatattactttcacaagaattctcatcatatttttcagatatttctttacaattataataatatactccagaaaataacagcaatgcccctatgcttatcattaaaattttccttttcattttaaccacccctttattattaatatatcatatttaagcttatttttatagaattttatttatttttataaccttttattattattttattaataacaagagtgatatgattaaagataatattattaatcatttcaaaaacttcgtaattaaaatctcaaaatattctccatatattttaaattttttattaaagccataatatttttaaaatactatggctttaattatatgatatcttgttggtactatattcctcttatttaatatgcaataaatcaactttagtaaaaatctttaaaacttaaaggatatagatttaaagttcattaaataatagaactttaaatctataaaactcttaaactaaaaaacttctctaataaaaagattatttaatttataagtcttcctcatagaatctacgatagtattttctttctacatatcgtgtgaagccataatctataattacaggtcgtccctttatgattccccagctgcttgctttttcgaaatcccctaatagtaatttgtatttatttttaagtctctgcatatggggtgattcataaaattcatgcttatttcctgcattaaagtaattccacacaaatcttatatcttttattttttttgcttttctcattataagaagaccataatcatttgatgcttctattacctttgcaaaaattcctgaagaatcattagctgatatataatattcagcacgattttgttctattccagctttatttttagcgactttaacaacatagccattttctaaatcatagacttcccttgaagatccagaaccaatataaacatatcttccgtttcttagtccaaacatgatatcattaaaatctataaacatatttttacctgctcatcgttgatttatttttattcatttgttaatactctacatagtgtatattattcatttggtataaaatcagttcacagtttagtaatatttataatataaattttctattattctttaaaataacaaaaaacatcctaaactagaataaattctagttagaatgtttttttaacttaatatttttctctatattaaattttacttagcagtgatataaccagcagctgttaaatattcagcagataaaactccaccgcctgctgctcctcttaatgtgttatgtgaaagacctacaaatttatagtcgaaaattttatcttctctaagtctacccatagagattcccattccattttcgtaatctctgtctaaatgtgtttgtggtctattatcttcttccatatatctaataaattgttttggtgcactcggaagatttaataccatatctgaagctttatagttattccatgcatctattatttgcttttcagttggtttattcttaaatttaacagaaatagttgctaaatgaccatctaaaactggcactctaatacattgagctgaaataactggagtttttgcatcaacaataatatcattttcaacagtaccccagatttttagtggttctatttcactcttctcttcttctcctccaatatatggaattacattatctaacatttcaggccattcattaaatgtcttcccagcacctgaaatagcttgataagttgatactacaacttcttcaagaccaaattcttttaatgcatttaatgctggaacataactttgaatagaacagtttggcttaactgctataaatcctcttgtagttccaagtctctttctttgactttcaataacttttgcatgttctccattgatttctggtataatcataggaacatcatcagtgtgtctattagctgagttatttgaaactactggtgtttcacacttagcatatctttcttctaatttctttgtttcttctttatttaatgaaactgcacagaatacaaaatcaactttactgcacacttcttcaacattatcagcatccattataaccattttcttatacttttctggcattgctgtaggcattttccatctatcaccaactgcttcttcataagtaagtccacttgatctcttactagcagcaagtgctacaatatcaaaccatggatgattttctaaaagacaagcgaatctttgtccaaccattccagtagccccaataataccaactcttaatttcttttccatttttaaaaccacctttaactaatatcttttctttgttttgtagtaataacataaactacttacatactgcaactctatatataatatattgaaatacttactatcatatttataatatttctaactaaatattaaataaaatcaaactaatatttaaagtatatatttttgacattatcttttaattaatgaaatataatttacatgaaactcctctttcaaatatataatcatttttataaatttgcaatattataatgataattgttaaccccaataagtaagtttttgttttcctgtcaaaattatgatatcataaatttatacattagtaaaattgataatttaaattaaatcaatcaaatttattgataggagtgatttatttggactttaaacagcttaatgcatttttaacaataagcaaactacagagttttactaaagcagccgatgctttaggttatgcacagtccacaattacaactcaaattaagctccttgaatgtgaactggatgtaaaattatttgagcgtataggaaaaactacaacacttacacacgaaggtaaaaaattattaccatatgctaaacaaatcctaaaactatctactgatataaaatcaactgtttctaatgaaaacaaacctacaggaacacttactattggagctgctgaatctttatgtgttcttagattacctgaaatacttaaagaatataagcacctttatcctgatgttgatgtatcattaaaatttggaagttgtgcagatttcagacattatctatctgaaaacttaatagatgttgcattttctttaggtgttaagatagactctgatgaatttatttctgatgttgaactaaaagaaccgatgctccttttagcatatcctggtcatgacttaataaagaaaagagaaatatttccaatagatattaaagatgaatcacttattctaacagaaactggatgcagttatagagctgcttttgaaagaatacttaaagataatggtataaaaccaaatattactctggaaacaggtagtgtgcaagcaataaaacaatttacaatgagtggtcttggaataacttttctcccagaaatagctgtaaaagatgaagttaaagctggaaaactaatccccttaaactgggcagggcctgatcttaatataatatctcaggtcatatatcacaaagataaatggatttcaccagctttaaaagaattcatttcactttcacatagatttttaaaacagaatttataacagcacttaaatctcccaaaactacttactaataaaattaccataaaatgctacagttgcattctatggtaattacattttcctatattaattaaaactaatatcccttttaattctcctttattttttgaaatacaagttttccattatcatctagtgcaataaagtcatcttttacatcaataaacttacctgtatatggatattcttttcctgtagttatattttttattttttcttccaaaatattatttaccataatttcactctttgaattaaaaaatatatcacttgaatttgctggtgaatcaagtttaatagaattccactttgatgtactctcatcaatttttccatacactataccagaaattttatctccactaacttctccaatgtaaataacatcatttctatctattcctataagcctcaatttattattagtattgaattttaattttgtattaggacttgttgcataaatactactatttacaacatcgtcataaattaatctatctttatgaggtattactttcatgttttccataccagctcccttaagcggaacatcaaacttgtcattatttatatctattctatagcatctgtcatatccttcattatttgatacataaacatagtacacacttgtaaatactgattcagtaacgttttttatcttcattccacttttaaaatcacatatttcagttactaatgttgtggctgaatttttaggattatatgttacaagctgtattttatcctttccctttttattaaccttttctaaaattacaatcatatctctctcatataaccattcataatacatgacttctcctttgttttccgtctcaatacttttatcctttccactttttgtttcgatcatgttaagtttatcacccttagaataagacatatacttaccgttataggatacttttatttcatctgcatcttttggtatttttatgttgatcttatcttcatatggtttatctaactctatttttttactttcaaatgctgatgactgtttaaatataactctatctaatataaatagtgcaccaacttgaataattaatgataatattgcccatgcaacaaaccttttaatatacttcatctaactgcctcttcctctacatttaaaatatacatttatttccatatattatacaacaaattcacataattttctctagtaaaattataaacatccatattaattcttaaaacttcaattttcctagcctttaaaacagttgtttttcctcataataaaagattacatattttttattatttaggctcttgatttaataatacacatttttaatatttcaaagttatatacatatttgactgcattacaatttcataataaataaaaaagaattgaaaaatgagaaaatatcatcatttgtcaattctaaaaaagattactttaactagcttttgccataatagttaatccattaacaacaagatttttatataattttaaaatataaaatggattaattgtcctgtttataaagcatccttttatcgtaactataatggtcaatactgcaagatataaagcataaaattttcctacaagtaatattgaattttttatataaacattaatagaaggcacagcccatcctaatgcatatgtaacaactactataattataattcctattatcattactggcagcataccttttatgtctgaattactaggtgcaatacagcttattaatattaaaaacattacaaaattaaaatatatattatcacttttagagcatataactgtaaaaattataatattaaacactgctggggctattgaaacaacaaaacctccaataattcctcttaaatttgatggggccataaacttaacatgtttaaaaatattaatgttagtaattctaaaaccaaatattagtgctgctactgcatgagccgcttcatgtgctggtgctccaatcattgagaatatcttataaacactcctacttatcatcttaagagctccccatgaataacattgtatgtatcttaatacataaatataaattaaaaaataacttattataacaactacatttttaagtgcaagattttccataatctatccctccttatatttataacaaaaatactctttcaatatatctaaagttgtaaatccaatatcaagtaatatattaataattggcatctactttttatttttttaattatatatattaattacagaatgcttgtcatactttttctaaagactacaataacacaaatttataataactgctaacttattatactaggtatacattctattttacaaaaatgcccactgtcacaaatgacaatgggcattgattttattatcctatatttcaataaagttaaaattcaacaacgtctggaattactcctgcatttcttaattcctttactgcttcttcataattcttttcttcaggagctacttttactgcttcttcataacagtataaagcttttctttcatcatcaaaatgataatagcatgctgcaagtttattaagaagtacatgattcactctatttaatcttaatgaattcttataatatttaacagccagtttatagtttatcttaagtttatctgtagagtcaaattctaaaacatcttctcttgataaatatatatttcccatgcattcataaactaaagccattaattgtgaattattactttcctcttcttctgttatgttttctataatcttattgaaaatatcaagtgctttttcactatctttaagttcagcaaagcaaaaaccaatattagctaagcttgctaagtcatgttttctactattgcaatatttaaaagcttttatagcatcttcatattgacctgtaaacctaaagcctaatccctgtaaaaacactgaatataaatttttcttgtcaaatttaaaagaattaactgcaaaatagagtcctttttcataatttcctttatctatttcactttttgcaattctactcaatagtaatgacatatctttttctgtatttatctgtccaccttgaatttttatcttatgctcatttaaaaataaatcaatcttcttttgaatttcattattttccattaatcacacctacttctttatagtttaaattacttaattataccatattaaattattatgtactatttaaaccactattattttaacatgatcatataaaatatatttttatgatatttccttaatataaaaaacaaccatcacatagaaatgcaatggttattaataaagtcaaatagtcaaaattaaatttttaataaatttcatagacttttatataaagttatatctaaatcactcaataaatatattagaactattttcttttgattttaattccttaggtaaaatcactttaagttccccattttcaaattttgctcgaatcttatcttgctttacattatcaaaataaaatgatcttgaaaactgcccataacttctttcttttcttatataactatctttactatcatcatgtacctcttctctcttagcagttattattaagttattgttcttaaagtcaagatttatgtcatttttattaactcctggaagctctgcacacacaagatattcattttcagtttctctaacatctgcattgaatttgctcatatcaatgcctattcccattggtgataaaaagtcatcattaaagaaatcgttaaagaaatcacttaaagctcctcctttatcagttgcattatttgttctaattggtattaatccaaacatataaacgacctcctttaattattattttttattatattttgaattaatttaaattagcatactgattctaaatttcaagttatcatatagcgtatattccaattacacactatagtgctattcaatttaaaatctactcttttcttttgcacaactatattatattttaaaggtcaaagaaagtcaaagttaaaatactatttactatatcattttaactgtataatttattaaatattgaaacttgccttaaagttacaagctttttctctgtttttcttctatttactcctgtttttatattatacatattaagatctaacattttttaacttaaaatatattgacaataaaggtaaaaagtttcagaatataattatcaatattttataaaaagggggatgaactatggaaattaattttagcaaagttcatgaagaaaaagaaatgtatgctgtattaaaagcaagtgttattaacggaaaagaaatcgaatctcaattgcttggaatttatgaaagtgaatatgatgtaaaaaaagcaaagaaaaaattaagtgttgatggacacaaaactgtagttaaagttaaagtacacattgatccaattgagtatttaggggatatagacaatataaaataatttttaccgttaattgttcacgtgtgcataattaatacttctatactatataaaatttatccaaacatctaaatttttatattaaccaaaagggtaattttatagtaacaaagaaacatgctcttattaaaactattttttaataagagcattaaatttattctatatattgtatattgttttttttacaccattcaatagcaatttctctttctgaatattctctataatcataccattcattaattaatcctttatttctaataatatttttcacttcatgcaacatctttccttcatcattaaattcttctaatttaggtaactcaatatcgctaaatgaactacaaaaatttatcattatttttagttcatttaattgttctttatctgggagtttaatatagttctctggattcttctttaaatcatatagtccctctatgagttccttttcccattcttccatagaatcaactctatctatatcctctgcaaaatatgaagctgtctccatatcttctttatatatgattacacctgtatctttattataataatgactaagcatatcattttcaaattccattgcttctattaaatcacttaagttaacttgcatatttttaccttacctatctcatatatttttatatattatatcataaatttatgagtattaaattctaattagtttctaatattattccaataaaaaatattattccaataaaaaaattatatacaattcacatataaaggcaactgtcaataattatactgacagttgcttaaattttaacatttaactaattaaacaattctccctgtgaatttattttatatccatctataatgctatcaataatcatttttccactctcatcaagataataccagttatcattgctgttaatccatccagtcttcatacttccatcatcatttaaatagtaccataagctaccatcctttacccaacctgttctcatatcccctgcttcacctaagtaataccacttatcatttttattcaaccaacccgtcttcatttctcctgattcatttaaataataccacttttcatcttctttgaaccagccagtattcatattaccagtcttatttaaataataccatttattattatcattaagccagcctgttctcatatctccttcgttatttaagtagtaccacgaatcattatcctttatccatcctttaattacttcaccagcttctccagttctataccattttccatcaatttcaacccaagcattaactttcttttctccattgatccatatttctttgtttccattttcatttattactatttttccttctgattctgttatattatttgatagtgtattagagctatctacactattatcttgaatagtgctactatcactatttcctgatgagcttccaccagatgaagaactgctctttttctttaacgatagttctatactagaaatttcaccagatttaattttaaatttatcatttgcagatatataaccagttctagttacaactatagttccatcatcagtttcttttagattgtttataaagaatcttccatatttatcactcgttcttttataaatatcgccatttatactaacagttacttctgcattatcaattatatttccttttgaatctgttataattccagaaatcataccataatttgtaccttcagtgttatctttatatgagttaagtgattttaaggctttaccattaaaatcaaacaaagtagtgttactaactacgttttcatcaacaatatcttcgctaccatcatctgcagcaccttttgctattgcccatccaatcccttcatgatttatcattataggatcccaatataagtctccaacaatacaattgtcatcagcatttctcattccattaaaaagctcatccataaattctttctgtccctgtggtgttgaagcatggctttcatttccattatcaacaagctgacctggcttactgccatctggaactgtaggattccagttatatcctgtttccataaatattattttctttccatatttagcatataaatcattacaccatggtattatctgttctactgaatttcttgtccaatatggataatatgatggtccaataatatcataatctacattatatttttcacatccatctaacagtttataatatctgttattatcacctgcttcatccaaatgaagaattatttttgtagtatcgcttacatctcttactgcttttgctcctgcattaagaaatttcgctaacgtttccatattatctactttaccaaaaggatataaaagacctccttgcatttcatttccaagtgaaatatactctggaagtgttccttgatcttttaaagacttcatcacatcatatgtgaaatcatatacaaatccttcaagttttgaaacagcctcttcctcatctaatccttttattgcttcctcccattctactggtatatcatgcacaagaccatttgtccaccagtcactataatgaagagtcagttctatctgcatattcacatcttttgctcttttagctaactttaacatatcctctttattctgatatccatctggaaggtagaattcacttccatcttcatatttatgactgctatctcttcctgttttattgtatattcttaatctagcaaaattaaatccgttctcagcaagtatatgaaatggatctctaggatttccgtcttgatcataaaatacagctccagtactttcaacataatttaattctgtaagatctccacctttaagcattgtatatccttcattaaccttatataacttcacattatctattattgaccagctataatttgaagactttgagtaaaatcctatagtagcttgtccgtctaacacttcaaaatctactacaacttttctgtaattgttatctactggcacacttgtccttgcttcactctttcctgtatctttaacatatccatatatattctgctgaccaccgttgctctttgcataaaactccaatttatagtgaccattttcaagcccagtaatagtctgttcaacttttccttcataggatttactatcttcaaattttaaatatgaactatcattataaccacttcctttaagtgcttgaacggaatccttattgccaataacattccatccttttagtccatcttcaaaagtaaagttttcaataacgtctaaactttttcttttgtcttcgctttttttacttattgtaatttcatcaaaattagcccattcttcctttccccctttagcatgaaaacctatagtcatctgtccatttgttacttctacctctaaaagcgtaattctaaaattatgagcatccgtgatgttttctctcactattttttccttattatctttatcaaacccttttgcatagaaatacagttctttctgttctccactagactgtgcatatgccttaacagtataggttccattttccaatcctgttatagtctgatgtgtatctgtttcatactctccatctccatcataccacccataattaagacacccttttgtatttgaattaccccaatcaccattccattttacaatgcttgatgtccctgtagtctcccacccatcaaggttatattcaaaatcaggatttataattttcccagtattatcaattacttctgctttatttatttcaacattatcaaaattagcccatgataagccagatgctccttttccatagaatcctattgttagattatttgattttgcttgaaattgaagtgttacttttgtcatatttcctgatgggcttatttctttctttgttactaattccccatctttcacatatacatatagttcattaaactctccactattcacataaaaacttaattcgtatgaacctttttcaagtcccactaatgtttgatatgtatctatattaaacattgttggtttttgatcattgtccagtttttgatccatccagtaatttaatccatattcatactcatcatcaatccacttaacattggcagaacttgtttctccatttatagtccaattattaattccattagtaaaatcgccatttaaaacataattatccgtactatcttcattagctataacttgactttcagtcgtgaccttagtttgcatataatttgaaatatcttctttgttttttgagtttagtaatacattattttcatcactgttataaaaagtaccctttttattctcagaaggctcgtcttcattattatcgataaaataattttcatttatgactttttcagtttgctcttgtgaattatttatagaatcatcatccactattgcttgaactccattcgatgcaataagatacattaataacgtcaatatagacgtattttttgtaatattttttttcattttttacaccagacctttcatttaataatgtgatatcacgccgatgtaagcgtttaaattattttatcaccatttttctgaaagttcttagtatttattttgtgtattttataactcttttaaggttatatggtaaaaatctgtaatatttaaatattttataaaaagtcacaaatatttattttataaatatttttaaaaaactgcttaagaattgtgatatctcacataagttcttaagcagttgttttttataattcttctactatatatgaaattttttgtgctgaataaatagatttattcccattgaaaatatatgcaagagaacatgctacaaaaaataacggtacatattcaaaaccaaagacctctgcacctataaatattggagcaataaaagtatttgttgcacctccaaacacacatgcatatcctaaagctgctacaagttctattggtagtcccataagattacctaaaaatactccaagacttgctcctattgaaaataacggagtaacttcaccaccttgaaatcctgcagcaagagttactattgtgaatataaattttaatatccaatcataattatatataaaacttccattaaagctacttgagataagattagttccaagccctgaatatcttcctgtatgcattactattaatagaatacttaaaattatacctataacaaatatcttcaagattggattctttattaaatctccaagaatttttttcatctttccaagaatatgggcaaataatcctccaaccacaccaaaaataatcccaattaaagctaatttaataatgaaatttagatctattgtaatattagtttttaaagcaaatgtaaatttttctaatcctagtaaatgagatgttgtacttgctgaaaatgcaccgattagtgctgtaaataatgcactatattcaagtgttcctgccaccaaaacttctaatgcaaaaaatacagctgcaataggtgtttgaaataatccagcaaaacctgccgccattccagttattaaaaatatccttccactattttcaatatctatcttccttccaatattatgtgctactgttgcaccaatttgaactgccacaccttctcttcctgcactaccaccaaataaatgtgttatccatgtacttaatattgtcaatggaataagtctttttggtatcaccgcatcttctttatcagcactttcgaatacaagagtcatgccttttatactattctttccgattttattataaatataaacaattgctactcctgctattgataaaaatggaattaattttaatggattttcatttctaaaatctgttataaaaatcaatactttaccaaaacacgtatctattatacctacaattattcctataaaaactgatattattcccataaagatgatatccttatactgattataaatttttttaaacatacgtattatccttcttctctatttgtatttctaaagttattttatatattttgagtcattattatttagtatttacaaatgtacacaaaaaaagctgataaattctgcggaaaataaaccacagaagtcatcagcgttaatagcactttagattatatcatgggagacttcattccctgaataaaagcttatcttattttttaatatctgtcaacaattatactactattttttcttaattattataaaattcaataagctgtttaatataaggcttttgaatatcatcattttctagatatatttcatgctttgcattatccatttttacaagttcacaattctgtgcatattctgcaaatttattctgaccaccaggtcttacatatgcatcatctccagcttgaaataataaaattggaattgtaactttagacgcattttctttctttgttatttccttagtaaccttaaatgcctcatcagtccacttatatgatgcttcacctctttgaatttcctcattttcatttatcaattcattaatatatgtccatctattttctgaacttgtcccaactgaatcaaaggaataacaaggcgaaaaaggttttttccctataacgtattttccatcttgtccaaaagctacagctgctttaactacaacttttgcaataaaatcaggtatatttccagtgtcaacttccatcataggagcattcaggactgccttactgaaatactgtggataaacttctaaaaatctgcttccaatagcaccacccattgaatgtgcataaagatataattccattccattgctatttggaacaacaacttcatccataaaagttttaaaatcttctatataatctgaaaatgaatttacatatatctgagatttatctgcaacaccaaggcttccagatcttccatgacctctatgttctattccgaatacattatatccagacttcaaaaaataatatatcatttcatgatatttttctaaagattccgtatatccatgagagataacaatatttccttttgcatcatctgcattatataattcgtaatatagcttagcattgtcaattccatcaatatatccacttttcattctattttctatatatggcataacaatattattcatattttctttataattatcttctgaaatatagaaactatctaaatttattccactctcaggatctcttttaatttctgtatctgaaatttcatttgaactttctttaattccattatcagaattatcttcactacgtttagtatcagtaccatatactgtcttatggaatccaatactactacagaaaattgttcctgcagccaaaatacatataccaaatttcaaaaaattatttttcatacaatgatctccttaactgctacttaatgaacttttcattattttaatccttatcaatatataaagttcaccaaatccttatcttttgacaaatatgaaaacccatatttataatctattcttccaataaagaaattacccattttccacatgcagtacatttgtgtattgttataacaaataagtcaaagttcattccatcaactaaaattcccatagcatcacgttcttcctttgtaataaactcatcattttcatcaatataacctataatttcaactaataagttcttctttgttttatcacagcatccattatctccagctacttctatcatttcatatgatagtgatggacttaattcctgtattatttcaattatatcttcaaaatcctttatatcttctaaaaaatcttcttcataaaatattaaatctttaacttgaaatacttttttcatatgcttctccaatcgtatactttttaaatttatagtctattgtatagtatactataagtctaattttaattaaagcaataaaaacttatctttaaaatatatgttataaagatatataatctttataacaaaaaacaagattgccttataagacaaccttgtttttatatttttagtaagtaatttaagttaaataatctactttaatgttattgttttttcataaaaataactactgatttaaataaatctccatcaatttctactttaaaaattcctccctgtgcttcaacaaaactctttactattgcaagcccaagaccagaaccttcagtattccttgatttatctcccctttgaaatctctctattatttcatcagacttataatcaatctctacagcagacatgttttttatatttattgttacatcctgttcattttcagttatatcaacataaaccctagacccttccattgaatacttagctacattatttaataagttttcaaatattctaaaagttttttgactatcaagatttaaaaatattttattatctggaaaattgttcttaaccactacttttgcattatcaagcttatcagaaagttcaatttctatttgtcttataagctctataatatctacattcacaggattcaacttaatgtttccgcttgttgctttgcttacttcaaataaatcttcaattaaaaattttaacctttgagacttgttatctatggtatcaatgtatgattttctttcctcatcagtaatattatcatttttcaaaagatctatataagttattatagatgttaagggtgttttcaaatcatgtgatacattagaaataagttctgttttcatcttttggcttttaacttcttcatccacagcttttttaaatccaatttgaatttttttaagttcatctttaaaaggattgaacaatcctaaatcttcacttatttcagtttctagattgccctctgctattttattagtagcatttaataaattactgtaatcatttcttatcttatcataatattttcttattaatacaaatagtattatgttataaacaattgcagcgaatattccaaagaaccatattatacttatagctgaaagtatagcaaaattaattagaagaactttaattattactttattagatttgtcacttaaatctatatgattaagataatctaatccatcttcagcttttcttataatatatctaattcctcttattactattactttttccttgaaatactttttaaagccatattggaatatgtttttaagatatgttactccacttatgataaagtatattataacagaccataacaccacattagatagatatattaatatatcgttaaattcaccattaatacctaagaatctaagtatttcgttactttcaccagttaaagtaactgttatcattccaatggcagacataattaaaatacttgagaatattccataaaatatgcacgctacttcaaaaggcatttttaacatactcttaaaacctacaatttttctttcaaatttataaggtattataagacctaaaaataaagttatacatccaacaataagaccaaaaatcataatagcattatggcttatatatctatcattcatattttctactatatctgatattttatcatcatatttcaattctttaggtataccataaactattgtagtatctttcatagtattataggttactttaactccatcataagaatgtgaatattgagaatttatattattactaaatatatttctaatatagctgaaatctgttccatagtaatctttaatttgagcatatccattactgtcatagtttattaccacataaaatccatataaatcttttaagctttcataacttcctgaattctgagataaaacttctccaatgttttctaatcccttattgattattacatttccatctttatccatagctgcatactctaaatttttcaaatcatagtctaactttgtttgtaaattatatagctgagattgaagaggatttaatactgcttcctcataaattgttcttttatcataaccagaatttgagtcaacttcatagttttcatgtgtagcataattgtcactatatgatttaatatatatttcttctaaactcttttctgattcactttgcttttcaactatgtctttataaagaagaaaactacagctatctatatccgataataaattatagtcttcatatggtgttctcttttcattatttgaaattatctttattttaggatagaaaaatattattccaaaagacattattaatattgaaataaatgcaatcacattaatgataaatttgttatctttttttattcttttattattatttgctaagttctcattatctctttctatattttcagttatctcttcagttaattcattattatctttatttaatttattaaatcttttcaattttatatccaactccccacactacttttaaatatttaggattcttactatcaatttctattttttctcttatatttcttacatgaaccattatagtttcagtacttatagcatcctctttccatactctctcatatatttcttctgctgaaaaaactcttcctggatttttcatgagtaaatgaagtatgttaaattccttaggggtcatttttactatatcaccatctacagttacttcctttgtatctgtatttagttcaatacctccaactacaaatagatttgttttcttttcattattcttaagtacttttaaatactttgcatatcttctaagctgtgaattaactctagcaataagttccataggattaaaaggtttcgtaacataatcatctgcacctatattaagtcccataattttatccatttcttctgactttgcagaaagcattataacgggaaaatcatgttgttccctaagcttcataaccattgtaattccatccattttaggcatcataatgtctactattgcaagatgtattttttccttttctataatctctaatccttcaataccattgtaagccttaaaaactgtatatccttgattttttaagtatatttctattccgtcacatatttctttttcatcttcaactattaaaatactatataagttcatattccactcctaaactttaatcgaatttataaattttattatctcaatactctacagtattagtatttaacaaattaaaatactaataaattattaaatatatatttgctttataaatccaactaaattaattctttgatttttatattttcacactaattatatagtactaaaaaattttttacaaaatttctacaattaatcacttctctttccccataaagtatttgctcatcatatattcacatcttaaatcctccctattcactgactataaacacagtttaactttattttttaaaaataaactttggtaaattctaaagaaattctaaagaaattagtaagattctacgctaagtccacatctttaagtaattttattgtgatttttatacaatttattaagttaatgttaaggttagcttcttataatctaatcaattaataattataaaaggttgtgagatcatgataaaaagaagaaataagataataatttttacggctctaatagtaattttaatctcttccttgctctactcacttgcatatcgctatttaattgaaagagatgaaaaagcagttacaaattcaatttcatcctcatctactgcaaaaaatgacgtaacttatgatgattggaattattcttgtaataatttttctataaatattgaaaaaaaagaaactggagatggcgataataagataacctactatgttgctcacttaaatgttaaagatatttcaagtataaaatctgcttttgctcaaaatagatttggtagaaatattactgaaaccacctcaaacattgcatcttctaataatgccatttttgctattaatggtgactattatggttttcgtgaagatggaatcattatacgaaatggaactctctatagagatgcccctgcaagaaatggacttgctttctttaatgatggaacaataaacatatatgatgaaacagcaacaaatggtaatgatctattagctcaaggtgttactaatacattttcatttggaccatctctattagataatggcaaagctataactaattttgataatgtaaaaattgatagtaattttggcaatagaaatattgataattctaatcctagaacaggaataggaatgatatctcctaataattttgttttcgttgtagttgatggaagagataatggctatagcagaggaatgacacttaatgaattttcacagctttttgaagatcttggctgtacatatgcatacaaccttgatggtggtggttcatcaacaatgtatttcaatggaagagttgttaataatcccggtggtaaagattctgaacgtaaagtaagtgatattatctatattaattaaaaggagaatgaattatgattgttattattcctgcatatgaacctgatgaaaaattaattaaattagtttcagatttaaaatcaaaatgtaattttaaacttctaattatagatgatggcagtggtgaaaaatacgagagtatatttgataaagcatcaaatctcggtgcttccgtatatcaccataatgaaaataagggaaaaggagctgctttaaaaactgctttctcaataataaaaaattttgacgatgctgaagaaattatcactgctgattgtgatggacagcatactccaatggatattataaaaatagctcaatgtattaaaaataataaaaataaattaattttaggagttaggtattttactggcaaagttccctttagaagtattcttggcaataaactcacaagcagaatatttgaacttataaatggtgaaaagatttccgatacccagactggattaaggggattctcaaaaagcatgattccatggctctgcagtattaaaggaaatggttatgaatatgaaatgaatatgcttctggaatctgaaaaatatggatatggcataaaagaagtacctatagaaactgtttatatagaaaataatacatcttctcattttaatcctttgattgattctttaagaatatattttcaaattttaaaatacagtatgtcttcaattttaagtggtatcctagatttcatatttttattaataatcaaagcacttacttctaatctcttactttctgttgttattgctcgttttttaagttcatcttttaattatgttatgaataaaaactacgtattctctcgaaataaagaagaatttaatacaacattatctttgccacgatatatttttttagttataacagttctcatttttaactatataatattagattatctatgtagtttaggggtaagcctagtcatagctaaacttttaactgaatgcaccttatttatttttagttttgttgttcaaaaaagattcgttttcagataaaattattcttattatacatagtaagctgtccaaacaaacttgaggcagcttactattgtaaaattcattaatctatcttataaccttagcctgtaaagattctgctacatccatagctttctcatgtaaattctcatcaaaacttgcacacagattagaatccacaataatctgtgcattaacatattgagattgaaatgtaattatattacttatgacacaaatatcactcaccacgcctacaaattctatttgatcaatattatttcctatatcttcactgagcttaatcatattctttggtgacataccaaatgattctttgttataatgaaatgcattttttacttgcttaaattctttaagtcgtccataaagttcatgtccctcagttcctatgtaacaatgtggaactggtaaattttttccttcccttgtttcaaggtaattttcataatgagtatcataagtaaatactactttatctccattctctaaatattccttaatctttttataaataccctcttcaagtgtttcggcttttttaaatcctaacgctccatcaacaaaatccttttgataatctacgacaactaataatttattcatactccattttccctttcgctttatatcatttaaaaattttaattataattatactacatctcagtctaagttttgtaaatatatttcttagctccatcaatctttacacatatatatttttttatatctataaatttaagactaaataataacaatgttactcatatagattctaaatatgtatatatttcctctttataatatatttttactcacatttcatttattttctcatagtatatttactaagtgaacaacttattgaagggatgaaaattttatgtacaaacacgaagatagtggatgtaaaatgacacagtatgcaagatcatatatattacttcaaaaatatgaaaatcttttttcttgtaaggaaggctttagcaaaggaacaatctttaaagatttagctattccttatgatgataaacagaaaagtaaatgttaaaggagtgatatgagatgactaaaaaagatatattaaatagcatacgaatataccacttttgtgctatagacctaaatctttaccttgataattttcctgaggataaaaatgcaacagaagattattgtaaagtatctgctaaattacaaagcttaattgctgactatgaaaaaagttatggccctttaacaaactttggtcattctttttttgaaaatccaaaagcatgggtagaacaaagctggccatgggaaaatgaacgcaaggaggattaatatatgtgggtttatatgaaaactttacaacatgaaattaacttaaaaagcaaagatcttaaaatggctaaatatcttattacacaatatggaggacctgatggtgaacttggtgctgctttaaggtaccttgatcaaagatatacaatgcctacaggcaaaacaaaaggattgcttacagatattggtacagaggaattagctcatgttgaaatgattgctactatgttccaccaacttatagaaaatgcaagtatagaagaaatagaaaaagctggattaggtggacattatgcggaccattccaaggcagtattttacactgatgcaacaggaaagccatcacactacaaaatacatattttagcattaaaatttgctcttacaattaataaattataatttatatactataaaaaattatttcttactgacaactacctaaaaatactacataatgtatttaaacataataatttgacaagaaatttaaaaataattagaatatattatctggaggaaaatttaaagtatggatgatttggattggatttatatgatggaaaaaatgcagaatattaaattgttcagtaggaatatgattgtacgtggttctaaagaatatgaaattccagcacagcatttagagttactatcatgtcttgcactgcatgataaaaacatgactccactaaatattagtaaaatgatgggcgtaagtaaaacgataataagcagaattttagataaattaatagaggacggttatgtaaataaaactaaagatgaaaatgataaaagaagttataaaataaatctcactgagcttgggcgagataagttaaataaaatatacaaatattatttagctcctatctatattcttcgtaaagaattaggaagcaaagaatttactacattaatgtcaaacatcgagaaagcaaatgaactactaaaaaattatgatgattcagcaaaacacaactcttaaactcaatataaatagacatattataaaaaaacagaaactaatagaaaattccactcataaatatctagcttacatatttatgagaacagtttaatccatatgtttctgttttattatttattaacgattttaaaatttaattttccattttattaatttaaatgtttcttactttttacatatataatatatgtaattccaataacaactcctaaaatgctcataaattgagctattcttatatttcctatcattaagctatcagttctaagactctctataaataatcttcctattgaatataaaactgcatagctggctatgacaactccattttcatttgattttttcttatgtaaaataatcattaatgttaaaaaaataagtaaattccacattgattcatataaaaatgttgggttgtaataatgtccatctaaatacattcctttttgtatgaattcaggaaatttacttataaattcatatgacactacatcaccatgcgcctcaccattcatgaaatttccccatctcccaattgcctgtgcaagtataagtgatggagccactacatcaaggtatttcatcatttcaatcttttttaacttacagtagattattgttcctataagagctcctattaaccctccatgtatagctaatccacctgttcttaaattaaatatggaccatatgttatttttaaaattatcaaactcaaaaaacacataatatgcacgtgcccctactattgcacatggaaaagctactaaaaaaccatctattatcttttcaaaatctaaatttaactttttagaattataatatgctatgaacataccaacaaaaatacctaaaactattaatattccataccatcttatttcgaagtttccaatattaaatgcaactggattcataatattaactacctctttttcattttatttcacttaaaattttaaggattttcaattaaatttttcatcgtttcttttgacattccacctggaacatacttagtaatgtatccttctttgtttataataaatgttgatggtaaagaacttattccatatccaaaagcctgtgctgcattttcatcaaagactactgggaatgtgaatccttctttatttaaaaagtctttaatatcatctatagaaccctctcttccaagattaggtgttgctattccaagtataactacatcatctgaatttttattatactcattatacaattcttcaatatgaggcatttctgctctacatggaggacaccatgttgcccagaagtttaagaatacagttttacctttatactcactaagtgtatgcttatttccatattgatcatataaagtaaaatctataggttctaatttcttttgcgattcttctttctttgcttgatctatattctcttcctgcttttcattagcactttctttgctattagcagtatttgttttgttttgagatgaattcatattattatttgatgatattttatttatattaactgctccagatacaatcataattataccagaaataattatgataatgccactgattttctttatcacttccatataattttttaatttatcaaatttcttataaagcttactatagaataatgctgctattataaatggaagtataaaacctattgtatatactaaaattaataaatttgcacctaaaacactgtctgaacttgaagccataacaaggacagatgcaagtattggtcctatacaaggagtccaaccaaaactaaatgtaaaccctaaaacaaatgctgatactggtgacatattcttagattttacattgaatctcttttctctacttaataactgtgatttgatgattccaagataaaataatcccattattattatcaatagtccaccaattatcattattatatttctattagcatttaaaaatgtacttaaggcttttattgatgagcccaatataaagaatgttgaagaaatccccaacgtaaagaatatggtatttttcaaaagaacactgtttctaaaatttgattctctcatatcctgaacactgctattagacagcatactcaggtatattggtaatattggtaatatacaaggtgaaaaaatcgataatattccttctataaaaacaataaagaaatttacattttccatgtataaatcctcctaaattataattttaattagtatttattaactatatttttgttaaaaaaatgactacttcaaaagagtagccatttttaaggttattgttcttttccacacgaaagattgttattactccattttatcatcttttccattataggaagtaatgctaatcctgaattacttagataatatgtagattcaactatattgttaacagtttttttatcattaattattatattattatcaattaacaattctaattgttgtgttaggaccttcttgctacacccttcaacacgtctctgtaattctccaaatcttattttctgctcttttatctgccagattatttcggcaacccatttcttgcccaatatactagataaggcttctacaggacaaccatatataatttcatctacactatacatactctacctccaaatatacatattaagctttacagaccacaacctaaacttatcaatatatctctaaaaagtttatcttcatcaatatcatttaaatcattcacaactcttattgatccaacaagcttatagtcaactattataccataatttatatcattattaaatttcatatttacagtataaacttcattttctttgctcatatttgtcatttccccagtaactgggtcaattataaatacattatctgtatctactccctttaaattcacagtaaattcatcctgaatttgagctactgtaacaaaactatctaaatagtctccatcaaactctttattgataatattcttatttgtcttttcaaaagaatagcctgatactatttttttgtcatttaaattttcttgtactgtgtctgtagagcttactgtattctgagtttttgatgtaattaaaaagcctataacgcctccaattactaatgttagtaaagtataaaatattactatttttttattcaaactttatttatcctacttatattaatgaaaacaaatcatttaatgcttcgctcattgttggatgtgtgaaaatattatctcttaagaatgtatagtcttctcctgctttcattgcagttgccacaatattaattatttcgctaccttctgcacataatagtgtacatcctagtatcttaccacttttagcatctactacagctttcatcattccatctatttcttcaataactcttgctctaggaattgctgcgcactgtaatttagcaactttaacatcatagccttgttctattgcttccttttcacttagccctactcttgcaagagttggatcaataaatactgagtatgggacaatatctctatcattaattgttctctttccatcaccaaataggttatcttttataattctaaaatcatctaaagatatatatgtaaactgtaatccaccagtaacatcacccatagcccatatattagatgcacttgtttttaatctgctatcaacctcaacagcgcctctttcagtaactttaacacctgcattttcaagattcaatccatctatattaggttttcttcctgttgcaagaagtacagcatctccttttatagttttttctgaattatcattaagctctagataactaacttcaacttcttcatttatatctttaaaagattttacacttgaatttaatataaatgagatacctttcttttctaagatttcctttacatttgttgaaatgtcatcatcttctcttcctgcaatctttcctgatgtttcaataactgttacttttgatccaaatgtagcatacatagatgcaaattcaagtcctatatatcctccaccaactataactaaatgctttggtaattctttaagttccatcattgatgtacttgtatatattctcttactgtcatttattccaggaatattaggtataatagactgagctcctgtatttataaatatcttttcaccttctattattttttttccatctttcatttgaatttctactttttcatttgatataaaggaagcctttccattatatatatcaatattttcattatcatttaacatattaaaattttttgttcttaacattgttattaaatttgttttcttttctactgcctttttatactcatctgctttttcttcaaatgtattgagttccttatacgaagaaacttttgatgaatgtaccaaagatttagttggtatgcatcctatgttaatgcatgtacctccatacattttatctgatttttctattaaagctacttttttaccgctctttcctaaaaaacctgctaatgttttaccaccttttccaaatccaattataattgcatcatatctactcatataaaattctcctatatcttattctaatttttataatttatcttatgtatattattttaaaattctcttaaagtgtcttttttatcatatcttttaatgattcttttggcataaatcctacatttgtagtcaattcttttccatctttaaatatctttattgttggtatattcttaacaccatactctgctgctgcatctggattttgatctatatcaattttaacaatttttacgctcttcatttcatcttgtacttcttctaatactggagctaacattttacatggtccacaccaagttgcaaaaaagtcaaccactactactccatttccttttaatacttcattttcaaattccttttcatttatatgttttaccatttttactacctccgaatacttttgttttttgcttgtttttattatatgtttttaaatttatttcaacaattaggcacttttaagttactactgccttaattgatattttttatagaattactttcaacttatttattgctatctaaataagaaactgcgcttaatgctgcaatattcccttctccagcagacttaatatattgatatggcttaccaacacaatctcctgctgcaaaacatccttttatatttgttctcattgatctatcacacttaatatgtccctcttcatcttctatacctggaactaactgtgctggtggaattgcatcttttaataaaaatactccatcagtttcaatttcacgttctttaaataccactttttttacgctattttctcctaaaatctttaaaggtttatcattaacaatttcaattttttcgtttaaattatactcacctttgtataatggtacataatacacctttgatgcaagttcacttacaaaatctgcttcatgttcaccttctttgcttgatgctactataactactgtttttcctttgtataaaggtgcatcacatgttgcacagtatccaactcctttacctaaaaattcaacttctccctctaatggccttgaaaattcaacacctgttgctactattacagtttttgattcatacatcttatcatttaccataatattaaaataatctcccatggaataaactgagttaactctttcctctgttatttctattcccattgcatcaatgtgttctttaaatgcttcaccaagcttcataccatttgaatttggaaatcctagataattatttatctttggtgctttttcaacttttggactcaaagtcttgctcccaaaaattatgaatgatttatttcttatttttgcattaagggcagctgaaagtcctgctggaccacttcctattatccctatatcatatctttcactcatatttttatcctccctaatgtgattttaaaattaatattttttatcaccttttaattttttatgctgtaatcatcttagattaatatatttgtattgcaatcttgaatattaatataatttttaaatctccatacaaaattttgaaaaggttacttcttcaacttcaaattacaatatatattgtctctaaaaatcatctaattatttgtgacttgaatttattttatcagtagtgattccattgaacaattaggcactttttagttactaatcagttactttttagttactttgtataataatcaatttataaagaatacaaatctatttaaaatgtacattagataagaattcttttgttctactttcctttggatttaataaaacttcatctgtacgtcccttttctataatgattccttcatccataaagacaattacatcagctacatctttagcaaatgaaatctcatgagttactataatcatagttctattttcctttgctaaatctttaattagatttagcacatcaagtaccatttcaggatctagagctgatgttggttcatcaaacaatataaactcaggattcattgctatagctcttgctattgaaaccctttgtttttgtcctcctgaaagatttttaggataactatcctttttcatatgcatattaactttttttaaaagcgataaagctgtttcttcactttctcgtttactcattttcttaacagtaatgagcccttccataacattttcaagtactgttctattattaaataaattaaaattttgaaataccattgcagattttgatcttaattctttcacgttattttttgtataatttttcgcatggattttaaaatcatcaactttaatagttccctcatctggagtttctaaataatttaagcatcttaagaatgtagattttcccgaaccagatggtcctattattactataacttcaccatctttaacctctaaatctatgccttttaaaatttcggcatcaccataacttttttttattccattaatattaatcattgattttttcctcctaataaatcgataaccttttctctaatactttttgaagataagttaatatttctattattatccaatatataactgcaattagtatgtaactttcaaaaaatttataattagccgatgcaatcatctgagcttttgcaagtatttctgcaactccaattgtaaatgctaaagatgatcccttaattatatctatataaatatttcctattgatggtatagatatctttaaaacctgtggcaaaactattctctttattgcttgtatatgattcattcctattgctaaacaagcttccatctgccctttatcaattgcattaaatgatcctcttaatacttctgaaatatatgcagatgcattaaaccctaatgctatgtaagctgctgtaaatccccccatgcccttcaaaatcggaaatatttcaggaagaccaaaatatagtaaaaataattgaactaaaactggtgtacctctaaagaatgatacatacagagaaaaaatctgacttaaaacaggaacttttagatttcttataactgaaataatagttcctaacattaatcctattatcattgatataattgatagtaatattgttactttagccccattaaaaactgactttaaaagtttagctaaaaaactatcattattttttgcaataacatttgtgtttaaccatttatttgatatgtcttctagagttccatcatctttcatgtctgatagagcaatattaacttctttaattaagttcaaattattatcatttttagtaaatacaaatgaatttactaccttttcaaaaggttctcctgccagctctaagggtagctttttttcattaatattaattaatgcagaaatcttatctattacaacagcatcaagtcttccaatcataagatcattaaacgctgcatcagtactctgataagtaataatattagcaccactatctttatcttttaatatctgctcataattgcttcctaaatcaacacctactttttttccttttaaatcacctacagaagatatagagcttttgtttccttgttcaactacaatctgcgctccactttctacatatggatctgaaaagtagtatttttcttttctttcatctgttattgttatttggtttgctagaacatcaaccttgcttgaatcaagcattccgaaaagaccactaaaagaagctgtttcatattccacattatatccaagtcttttcccaatctcattccaaatatctatttcaaaacccttgacatgattttcatctaaaaatgtaaatggataataggttcctgatgttcctacttttatacttctgttttcattatttttattatccacagcatataccttaacatttgttattgaaaaaaataacattaataaagttaatattgtagttattctctttttcatcttttcttctctcctacaattaaatattagcgcttatttaatgataattagaaatgaatttttcatcaattaggcacttttatgtaatcaccttcttaaagtatttcttttcatattgtttagtcatctacttgtttcttagtcattaaatttttttgctcatctttacacaattcaatgtaaaattcttttaaattttcatttccaaattgatcttttaaagcattccataactgtttataatacttttcaagtaattcttcacttatttcctcagtaatagttaccgtaatatcctttttcataaaaaatatctccaaaatgaatagtagttctcatttatatactattcactcttttaaattgtgttcttcatctacaattaaagtaaattaatttagttcagttaatcattatttcttacatatatataaagtagagattaatatggatagttcttcaattaacgcatcttattatgcttaatcaagaatgtaaattgttaataaggagctgacacaatgataaaaatagctatatattcacgtaaatctgtttttacaggcaaaggagaatctattgaaaaccagatagaactatgtaagaattactgcaacacgtatgttaatagtggcagtaatttggaatatataatatatgaagatgagggtttcagtggaaaaaatacaaaccgaccagaatttcaacatatgattgatgatataaagaaaaataaaattgatactcttatatgctatagacttgaccgtatctcaagaaatgttgctgacttctcatctacccttgaacttcttcaaaaatataatgtaaacttcataagtataaaagaaagatttgatacaagtactcctcttggaagagctatgatttatattgcatctgtttttgcacaacttgaaagagagacaattgcagaaagagttcgagacaacatgattcaacttgcaaaatccggaagatggcttggaggaaatattccttatggatttaatatagccagaaaaacttatattagcgattttaaagaaaaggaattttctattctttctcctaataaaaaagagcttgaaactgttaactttgtttattcttattatattaagactcactctatacgccaagtcacacgacttcttaatgtaaattcaataattgggaaaaatggtggaagttttgatcttacacaaattagaagaatgcttcgtaatcctctttatgtaatatcagatgataaatctcaccaatatcttataaaaaaaggattgaatgtatttggatctcctaatggaaatggatatattacttataataaaagtaatcaaaaaaatatatctgcagattctaatcaatggattgtagcagtttccaatcataaaggaataataacttctgataactggctcaaagtccaataccagcttgataataacaaatcaaaaatgccgagaataggaacaggaaaaaatcattcactattttctggaatattaaaatgtaaaaaatgcggttcaaatatgattgtaaaattttctggaaaaaataaaaataatataccttatgaatattatgtatgttcaggaaaacaaaataaatatttgaataaatgtactacaaaaaatattagggttgataaacttgataaactattaactagaaaactaaaaatccatgataagacagctcttatgaaaactttgagagattcaatagataatatctgctgtgattttaaaaacaaccaaatttctagcatagaatatgagatacatgaaaataaagtttcgatggataatcttattaaacagcttactaaatctgcttcatcaacagtatctgacagacttatgaatgaaataaaccttcttgataaaaatattgtccgtctgaaaaaacatcttgaaactatagaactggaacagtcacatgataaaaaaactaatattgatataaaaaatattattaatgtactaaatagcttctctgatacaattgaatatatagatgatactgctcaaaaaagatttctaattcaaacacttattaaaagtgcggtatgggacagtgataacaataatgtggaaataatattcaatacacattaaattaagtattttgataactttagcaaatccatggacagcaacttatattcaagcaaaaggtgatccagtagcagatttgcatgaagatatggctgctgaacaaaaagcgagagctacttatgagaatttaataaaattaactgatgatcaagatataaaagatgtattaaaattcttaagagaaagagaaatagtccatttccaaagatttggagaggctttaatggatgttcaagatcgtttatgttctaaataataatttggaaataacataaggctgtgaaaaatcacagccttagggacagtagatagatttgtgtaaaaacaaaatctatctactgtttttttgtatgaacagttggtagttttggaataataaaacatataagtttaggaggaattattatgacaaaaaaaattgatactaactttgactacaatgaagaaataaaaaaatgtaaaaccatcgatgatgttatgggtaagaatgggctaatacaaaaacttgtaaaagatgtccttgaaaatatattagaaggcgaaatggaagagcatcttggaagaaataaatatgagcgtacagaatcaaataatcaaagcaatagaaactatagaaacgggtatagcagtaaaaatctacgaagctccttcggtgacgtcgacttagacgtaccccgtgatagaaatgcagaattcgaacctcaaattataaagaaatatgaaactgtctgtactgagttagataaaaaaattatatctttatatgctaaaggtatgagtacaagtgatatccaatcagagattgaagatctatatggaataaaaatatctccatcgatggtatctaaaataacagataaagtactcgctagcgctaccgaatggcaaaatagagctttggataaaatatatcctatcgtttatttagatgctatgtactttaaagttagaagtaatggaaagataattaataaagctgtttacatttgtttaggatatacaatggatggctataaagatattttaggtatatgggttgatgaagcagaaggtgctaaattctggttaggaatttgtaatgacttaaaaaatagaggagttaaagaaatattaattgcatgtatggatggtttaaaaggattaccacaagctattaaaacagtatttccatcagtaaatattcaaacatgtattgttcaccaaattagaaattcaatcaaatatatagcttcaaaggataaaaaggcatttatgaaggatttaaaagaagtttacaaagcatcaactgaagaacttgcgttggcgcagctagacaatttaaaatctttctggggtaataaatacgctatagttattgattcttggtataataattggagtaatctatcaacattttttgatttctctccaagcataagaaagatgatatatactaccaatgcacttgaagggtttaatcgtcaaatacgtaaatttactaaggttagagtgatctttcctacagatgaatcgttaaataagtgtgtttacttagctacgatggaaataatagaaaaatggagtcaacctactccaaattggggtgctacgctagcggagctatcaataatatttgaagatcaactaaaagatgaattagcttagaagcttgtacttttattgattaatatgcatacttttagattttattgaaatactaaaaaaggtaataaaaaacattattagtatttcttaaatataaaaaaatattactggaaatcaaaatttccagtaataataaattgataaaaatactaattacacaaaactatctaaactctccagccttatgttatttcctatataacgaaactcgtccaatttatgtaatacaattttaaaaattttactaaaacataaatttactaagttctttaacatatatatctattgtaaccatacaagtcacaaattatagccccaaatttatattttttatgaactgatacttgttaattaaaatatatactctatattatacttgatatatttttgtatatttcttttaatacataagtctctctttcaatccagttagctttattttcatcatttgaatttattattttagtgttattttctattgcttcttttatgtcaacccatacaggtttgaactctaattttgcttcatatgcgtcaagcttctgttctctaattatatccgtaacttcagctatataataatatgaaatcattttaaatattctgttatgaacatatttgtctttgcttctttcagtgaccatgccaatttgtttaccaattcttttggcaacatagcctgtttcttcttcaatctccctttttaaagcttcaatctttccctcacctttttttattcctccgccgggaaacttataatctttatttttggagtgaaccattaatatttttttatcttttattattattgctcttacagcttctctataatttacattgccaactgattcactaactttatcgatttgaaacagtttattgaataccatccctatatcgttcacatcctttcctgtatataatccttttatattattatttcataatttaactattctataacataaattatacttcaattattgcataatgtaaaaaaaagttaatacaagtcaattttgtgattaaatttaaaatgacctgaaagaataaaaatcctttcaggtcttatgataattttatgatatgtatctactaaatcaacatgatatttatataatagtgtgcctaaaatgtattatttttctatttgaaagaagttaattcagtgtgtaggactgaattaatattttatatgcgtctaatatatcgatttattcttgttgtgtggaggtcaagaacaaatcttatcatctatttaatacgttattactttaccgatttattttttacctgcataaggtgtgtggagtctatatgcagatataattattgtaaaaggagtcttttatgcttgatactaaaatccgcgatgagtttccttcaagcatattttttattgtataatgttttacctcatcatattgattgaatatcatttttgcttcatcagaattattatatactttccaatatccacaaagaagacatttcttagtagtacattccataaaatctttaacatcttcaaaaggtattcctaaaaataaccctagttcatgtggacaatgatatttttcatatctatcttttaatgtttttacatattgattaatttcaatttgctctggatatccaagattaataagaaaatctatttgttcttctttgtttaattctcttgtaagtacttcttcatcataaatcattaaaattatagaatcatcattttctctaagttctatatatttcaagtttatgtctgctaaaaaatctttaccatatagattccagttttcatatattttttcatctttctttttaaaaccaatcgtaactgctggcttaactcctgcaattacccatgaggttttatatactagaaaattttctatatattctttattttccattgaatttaatcgtttataaaaatccagatacttcataataaaatcatccaccttgtcatattataataaagctattttcttaccaaattctatgcactcattttcatcagcttcattctgatttattaaacaatctaaagtaattgtgcatccataattaatcattcgttcttcaaattctctcatccactgaccatcgccccatccatatgatccaaataaagctgctttctttcctgaaatccttccgcttatttcttctataaatggttcaaattcaccttcttcaagaacttcatcacccattgcaggacatcctaatataagtacatcttcttttaataattcttctatattaacattacttacattaactaattctgcctcttttccactttcttttatacccttggcaattccttcagccattgcttctgtattacctgttcctgaccaatatactattttcatttttttgtcccccttctatttgaaaactattctcaattagtatattataataccctagtccttttgtcaagatttttttgaaaataatttttatttgagatacattttcatttatcctcatattattgtgcaaaatataataagcccattttatattcacagtgtttgtgtaatataaaacaggcttattgttttatctttaaaattatttattattctgttctttatcaagcttcttattattgataaacatatatagtgatgaaccaaatattataagatatcctattacacttaaataatctggtaacacgccaaataaacataaacttataatagctgaaaaaattatatttgtataatcaaaaattgatatttctttgcctggcgcaaatttgtatgcaaaagttattccaaactgaccaagactggcaaaaatacctgcaagaattaaatatgtaaactgaattattgacattggcttatatgaaataagcattaatggtagggtaacaatactagaaaaaagtgaaaaataaaatactatagtatctggcttttcctttcctcctaaagaccttacacaggtatatgcagctgcagcgcttattccacctaatgtccctgcaagtgctggaatcatttcaaagctaaatgaaggctttattataaacaatgctcctaaaaatgctactgctaatgcaaaaaactgattaggttttattttttcctttaaaaaaattgctgaaaatattataacaaaaaatgggcttagcttattaagcatgtttgcatctgataaaacaagcctatctattgcataataatttaaaagtattcctattgttccaaaggttgatcttaatataagtaatttttgattatctttttttccaaaaaagcttcccttattctttactattaatgtaagagcaactattacagagatactatttctaaaaaatgttttttgaaatgatggcaggtctccagaaagttttataaatgctgacatcatagcaaatccaaaagctgacattataataaaaattattccttttgttctgttactcaatttgttaaaatccatcttttcctccttttgtaatgagttattttttatattttaaggactgcctgaattttaaatttatttaaagcagtcctaatatttttaaatattattatttaattttcactattaattaaattttgtatctgcgtttcaagggtctcttcattcaattcaaattttgcatctttttgaatcaacccatttttatcaataaaaattgttcttggaagagttgcgattttataatttattctaacatcataatgatcatcaaatgtagtattgatgttaatattattatcttttaaatatttaagagcacttcctattgtttcactctctccatctacaatattaatcataaaaaatgttacttgtccttcatatttttttattgcttcttcaaaatatggaagttgttttgtacatgaggcacagctactgttccagaaatttaaaatcacatactgtcctttataatctgaaagtcttatctcatttccatctttatcatgaacctcaaaatccttggcttcagctttaaacttttgttctacatctggagctacattatctataattgatggaggtatatcctctatattttctggactaggctctttatctgatgaattttgcactgcacttttaatcttatttttctcagaatatataaatgctgctgaacaaattacaactgctactgatgctaaaataattgctacttttctctttttattcatattacccctttcttttgtcacttatattttttctatagaaatttgttcaaaatcaaatccaccttttatattattccatttttcacttttcatcaatacataaatcatatcattaaatttctcattcctatgttcgttctctttaaaacgtccttttatatcacatcccattgcaagatgggtgttaagatttttttcatcattttctgaaacaacagtaattgcatatttcatttttagctcatcgaatagataattatacatattccataaaattgatgaagttatatttcttcctctaaaatgaatatctccaatataatattctaaaacacatccatcatcatctatatgatttatatctacaacaccaattttaattccaccattatttatgatccaatattgacaattgctgcatcccattattttttctcgccagtattttttgtcatatttaataacccctttaatgttatgctcattttcataattacctttccatatgtccattaattcactatcttgttcttttaatttttcaatacttatcatatcctcatctccattcatacacatattgtggtgtttattaatccttattaatatgtttttcatcttttttcacgataaccattatatgcatattttttcaaattgatacaataaacgaccatatataaacaagataattattaaacatttattaatttttcctattaaaattaatcattttatttgccatagcggctattttttgataaaattttataagcataaaaaaagggggaaaaattatgaatcaaaaattaattataggcataaccttcacattatatttatttgttatgcttctaataggatggtacttctatgtacgtactaagaatttatcagattatacattagggggaagaaagcttggatattgggggacatctataagcgctcaggcttctgacatgagtggctggcttcttcttggacttcctggtgcagcctttttgaccggattatctggttctgtatggatggctggtggattagctattggtacatatctaaattggaaaataatcgcaaagaaattaagaattgatactcagaaattttctgattctattactataccttcatatcttgaaaacagatttggagataaatcaagaatattaaaaattgcatcgtcaattttcattattttattctttcttccatatactgcatcaggttttgtatctggaggaaaactttttacaactgtttttggtacaccatatattgtttctgtaataatctgtgctattgttgttgtaagctatacctatctaggtggatttatggcagtgtgttatacagatataattcaaggattattaatgttctttactcttataattcttcctgtaatggttgttgttgaggcaggtggtttaagcagtatttcaacatctattgatgcatcactcttaaatccttttaacattgaacaccttactggttctacttctggaacttttggtatggcttttatcggaattatatcatcacttgcatgggggcttggatattttggacaacctcatatacttacaaagttcatggcaatagaaaatcctgaggaaattaaaatttcaagaagaattgcaactgtatgggttatccttactcttacagcttctactgcaataggacttgttggacattattatttcccagatttaagtggtgctgatgctgaaacaatttttattttacttgtacataaatgtgtaccattactgcttacaggaatactgttatctgcaattcttgcagcaattatgagcactgctgattcacagcttcttgtaacatcatcaacagtatctgaagacttctacagatcaattttaaaaccacatgcttctgataaagaacttgtaagagtaagtcgtctgactgtacttgtagtttcagttattgcatttatcatagcccttaaccctgatagttcagtgttaaaacttgtgtcatatgcatgggctggatttggatgtgcctttggaccagttataattctttcacttttctggaacaagatgacaagaaatggtgcagttgcaggtatgattgccggaggaataacatcaggattctggcctattttaaaagtacatttcagtagttcaatttttcaactttatgaaattattcctggatttttaatggcattactagctatttatatagtaagtaaaattgatgaaaaaagaggcattatatgcactcctaattattcagaagacaatgtcgtaaaacaggctaattaagtgttttataaattttaaataaaataacaggatacatatttatcttagtatatgtatcctgttatttttattccatcaattctaatacaggtctatatcctactgtttcataagttatatctttgtcacagtaattattataagttgttgagtacaatcctcttattatgcagaacttattatttttcccgtattcactttgtgtaaaactacaacagctgctccaatgccataattgattgttttcgcctttttctttgtctccatcttcctcttctattgtattatttttatcttcatctgtagaaactggcaatccatcaatttcatttaaatttaatatatacttatcccattcactagggttttcttccatttcatttggtgatcctgttaaaagtctcaacaagtactttttgccaccaagtctaataatttttccataagcaagattctggttatcaagctcactccatgatattcctattattaaatttctatcacatataagaagctttttaccatcttcatttatttctacccatgaaattttattgttatcatttttatcagcatctcttatctcaattgcaccaccgtcataagaaattacatcttcacaatttaactgctgagaaagaatatcctgctttatgttatttaaatataaagaacctagttttcgtactctccctgttacatatatactactctcaatttcattttgtttctttattttcttccatttattcttcagtataaaagtccccccaactgctgcaagcgctgccaatgaaactcctaatactttatttttattagtttttttcataaactttcctcccattctcaatcctattactttttctaccacctttattatatatatcctttcaatactattatacttcaaataatggaatatttgtaattatttttagttcattcaaataattctataaagctaataaatttctaaaatattatgaatcatagtttatttgtctaagtgtataataaaaagcaagttgaagtatttttatagttcaacttgctttatatattataatttatatctcatatacaataaacaccataagatacctaaactttaacaaagatttataaaatatgtttaatagctgttataactcatttattatatctttatttatatttagagcattttttaattcatctaatgtattgtttacaaaatttaattgttcacttgtcatgcctgatactgcatttgaaagattctgacagcttgtacttaattctgcaattatatttgcatttccatctatttctccaacttcagtaactattgactggaatgtttcttctgttgttgcaacattagttatactttccttaattaattctccactttcattggcattgcttgttatcatctcaattgcggctgtaatatcattaattattgcatcaacactgtttacagcatttttaacatcatcagcaagctttcttatttctgatgctaccaccgaaaatcctttaccagcttctccagctctagccgcttcaattgccgcattaagagcaagaagatttgtctgtgttgcaatacttccaattagatgaataatatcaattgcttccttagtagagttatttgcagccttgattgattcgtcaagctgtgtatttgcttcaccaattttctttattgatgtatccatattagtcatattttcacttccaacacttacaagatacatagtcttgcatatggcttctgctaatttcatgctatcatcagatgctttagtacatacattatctaattctttagcttcactttcaattttagtgacattatcattcacctttaataaactttcattaatgctgtgcattgatttctcttgtgactctgctaaagttttaatttcatcagaatttatgatattgttttcattgaaatgtataatatcttcatcctcatgcttaatttcattagtaggatcatcatttacctcttccttaatctgaactgtcttgtcctctttttcctttgatgatgttgaaattaagtaaattcctgatataacacaagcacatactgcaactgctgcagctccgcctacagaccagtttaaaaaactcggaataagtgtactaacaaataacattatggacattatagctatatctaaagtcctcttgttcataatatttatttcccccttcataaaacataatatttcttctgttttctttatacaaaatttattcctttgtacaaaaatacataatagtaattggcataacttataattaccccaattactattatactcttttttctatgtattttctattaaaatgtatattgttacctatttctttttctaaattttctaactaatacaaatattataattattataactaaaaatgtaattatatcagcaatacatgatctaaatccattataagctggtgcataacttgtatttccatagctatctacataaactctattattaggagttaacattctaaaaagcatatagttgctcaataaattactccatctgctcccactattataataataattattacttacagaacgagatgcataactatcaggaattgaaccattaaaatttttacttgatgagctagttgttcctgagcttgatttaggtgaactgctgcttgatgaactagatgttttactactactacttgagcttgatgacttactactattgcttgaactactagaactacttgatttagttgaacttggtgatgtgttgctactattttttgtacttgtactgccactggatggtttgctagaacttgaacttccagatgatttactgctacttggtgaagaactgctttttgagccactagaacggctacttgagtgactgctgctacgactagatgatgactttgcataagctgtaattccactaaatcctacaagagtcataaaaaatatacttgctactagtatacatatttttttcttcattactaaacctctcctaaatatactaaattcgttattattacatttctccaataattttctctttcgtacatttcttctatttctctaatatcatccacagatagaactggtttatctccttcccaattcataacatcatttgatatgtgtctatctcctatactatcctcataatccattacgactaaatatcttcttaccattttttatttcccccttataactattatattcagtatttttataaaataataaaaagtaatactaatattataacaggtattctcaaacttatcctacttatatttgaaaatataataacataaaaattgccaccaaatttcttttggtggcaactgaccggaacctgcaagctatttgtttttttcttgattttgctaagctcttggatgtgtatgcatataaatgtaattgattttatcgttatttattatctcgtagtaagtgtccatatatgttaatacctgattaccaagaagtttttgaactgctcttacattagctccattttgaagaagatgaactgcaaaagaatgtctgaaggtattaaggtttacatccttatcaattcctgcttttcttgaatattccttaactattctccatatgccctgtcttgttaacttatttccgtttaaattaacaaaaagattggatactccacattgagcaattttatatcttatgctcaaatattctgataaggctttgcaagcacttcttccaattggaattattctttcataatgtttattatccgtacatctaacaaaattcaattccaaattgacatcttcaacatttaaattaataagctcggacactttcattcctgtagcatacattaattccaacaatgcattatctcttatccccttcggacaatctttttctacaattcttatgattttgtctacttcttcaatggttaatatttgtggcagttttctattgtttttagaacttttatattctattttaggtacctcttgtataagtgattgacttttaagatatgaatagaaattacgtaagcttattactattctatttatagatctttcagatttcccctgatttaaaagattttgaatgtaagaagccactgtaagattatcactcttatatatatcaaccttttttctatttaaaaattttaaatagagagttacatctgttacatatgcatatatagtattttcacttttaccactctctaacaaataatccttgtaattatttatactatttatcattgttctctcctataccattgattctgattagcattcgacaaactaactaaaacactctctgcttatattcttcatatgttctaatatgaatttacaaatagaattttgtaaccacaaattttattaacattggtgatatataagtttctaccaatattccagctataaacaatactgcaattacagccagcttttttactatcccttcagaaaatagactatcacctttgtttttcttaaagaaccttcttttgaaactttcagtagacattgaaagaccaattatgcttaatccaataatgcatggaatgtaaattagattttgaggaataatacttatcatagctagtccaaatcctttgccttgaaatacagtagccatgaatgaaaaagtataccctagtatgaagccttttaataaatcaataattaatattacaggcccaccaaaaaaagttaacccaactaaaaatataggtaaaataatgattacattttttttcacaacctcaactagtaaacttccataatttatttgatcatttcctaaagaattagcaaaactggtaaaataatttatcaaatcgtttttatctgctggtcccatatattttactgtataaagtccaaaagacagtcccaagcaaaacattataagtacaataaaaaagtaaccctttctgctgttaaaacctatattcactttcttacctgaaatattcatctcttattcctccttctgttactctaattaatactatgtttaatatccataatttattcatcttattaatataactatgtaatattatctactattttttttacataaaataaaatgctgttcaatcatccgtcttttctgacattgattgaacagcatcttataaatttcaatgaattttatataataaatcctactgtttatagagaactttacataataatttactttcaaaaataatgttctaattataaggtttccattcttaatttaatatactcttttatatattttacacttttttcaattcctaactctccagtatttatacacaaatcataattagacattttttcccactctttaccagtatgatacatataatattcacttctataattatcccatttctttatatattttattgcaccttttctatctgtacacaaatgactcatttcatgttcaatgcaaaattcctctgatgcatataaaaatattttaaatacatttggcttgtcttttaatatatagtcagcccctcttccaatgacaataaaagactctctttctgaaagttctcgtaaaacttttgcttgataattaaataaattttcatcagatacaaaattatcactttcaggaggtattaactctcctttatatactttttttgatacacgatataatatgctatttttcactctttcatctgcattttgaaagatagcttcattaataccactatcttctgatgctattcttagaagttttttgtcatataaatttatactaaactcatcagcaagcatttcaccaattgttgttcctccacttcctgcacgtcttgtaattgctattacaaatcgttccatattattctccccccttaaatttatattaatcaccaagatatgcttttcttactgcatcatcatgaagcagatcaatagcacgtccttctaatactatatttcctgtttccactacatatccacgatctgcaatctgaagagctgcatttgcattttgttccacaagaagaattgtagtattttcttttcttatactctttataatctcaaatatttcttcaacaactataggcgcaagccccattgaaggttcatcaagaagtaacaatttaggtgatgccattaatgaacgtccaattgcaagcatctgttgttcaccacctgaaagtgtccctgctaattgatttcttctttctttaatacgtggaaaccatgtaaaaactttttccatggtttcattaatctgctttttatccttttttaaataagcacctaaaagcagattttcctcacatgtctgatctccaaaaacacgtctgccttctggtacctgacttattcctgatgatacaatcttatgaggtggaatattacttattacttttccatcatagcttataactccgctttttactggattcaaaccacttatagctcttaaagtagaagtttttcctgctccatttgctccaataagtgtaacaatttcaccatcatttacttcaatattcaactcatgaattgcatgtattgcaccataatatacatttatattttctattttaagcatattatactgccccctttccaagatacgcttctattaccttaggattcttctgtatttcttctggaactccatttgcaataatttgtccaaaggataatacataaatatattcacatacattcataaccaatttcatatcatgctctataagcagtacagaaatcttaaattcatcctttatccatcttatcatttctgtaagttctttagtctcctgtggattcattccagctgctggttcatcaagcaataaaagtttaggttttattgcaagagctcttgctatttccaatcttctttgttcaccatatgataaattttttgcaaattcattaaatttatgatctaatttcataatctttagataatttattgcttcttctctcattttttcttcttcaattatctggtgtggtgtgtgtaaaatagatccaagtaaagttgtctttgtctgaaaatcaaaacttgtcattacgttatctaaaacagtaaaatctttgaacaaacgaatattttgaaatgttcttgaaattcttttagatgctatatcatagggtttaattccatctattctttcattgtcaaattctattttgccgtatgtaggtttatatactcctgtaagcatgttaaacaaagttgtctttcctgctccattaggtcctatcagtcctacaagtttttgttctccaatttccatattaacttcagatactgctgtaagtcctccaaattttattgttagattctccacatttaataaagccatacctacacacctacctttgtttctgatttatctgatttattagaagaattcttcttcgatagtaatttctttattgatgtttttattccttttacagttatctctctagatcctaaaattccatctggtctgaatatcatcattacaacaagtaaaaatgcatatataagcatacgattttcctttaatacatcacttaatccgcgtaatgattcaggaaggaatattaatattgatgtacccaatactgttcctgatatacttcccattccaccaagtacaacatacgtaatcaattcaaaagattttgagaaattaaatgttacagggtcaatgaatgtattaaaatgagcatataatcctccagcaagtccagccataccacttcctataataaaagccatcattttatactttgtagtatttattcccattgcttctgcagcaatttcatcttcacgaactgacattatagcccttccttttgatgagtggagcagatttttaagaagtgcataacatcctgctacacataagaaaataatcaataaacttgactttgtaggtatgcttgtcatccctcttgcaccacctacataatctatattctgaataataaccttaacaatttcaccaaatccaagagtacatattgcaagatagtcaccttttaatcttaaaattggataaccaattaatgctgccatgatacatgataaaactgttcccataactaaagaaactgcaaaaggcatattgaaattctgagtcattactgctgaaccatatgcaccaatagacataaatgcagcgtgtcccattgtaagctgtccagtaaatcctaatattaaatttaatccaagtgctgctatcataaatatacctatctgttttacaattctcaatgtatagttatccattattcctttttgaataagtaataatgccatccagtatattattaataaaactcctgtagtaatcgcatatctaatgtaggtcttttttatatttctatttaactctgctttattaacattaatatccatatatattctcacctacactttctctcttgaatttttaccaaataatccagttggttttactaaaagaattattattaatattgaaaatgcaatggcatctgataaaccagaactgatataaactttagataaagtttcaataagtcccataataattccacctaccatagcacctggtattattcctataccaccaagaacggccgctacgaatgattttaatcctggcataactcccattgctggtgttaattttggatataaaagtcctacaagtactccagcagttcctgctaataatgaacctaatgcaaaagtaagtgaaataaccttatttgtattaatacccattaaagatgctgcatccatatcatatgatgtagctctcatagctcttcctacgcttgttttctttattataaattgtagtaatatacaaaagataacagttgtaagaattgctataatctgatagttacttataataacacttccaatgttgtatgatttcaaaggtattatttctggaaatgattttgtgttaggtcctgcaagcatgtctgtctttataagattttgtaataataattcaacacccatagttgttatgaataatgtaacctttggtgaattacgcaatggcttataggctactctttctataagcattcctaatgcagcacatgctaccattgcaaatacaagtgtttctgtaaaaccaaatcttaatactgaaactgcaaaatatcctgcataagcaccaaacatataaatatcgcagtgtgcaaaattgattaattttataattccataaaccattgtatatcctattgctataagtgcataaacacttccctgacagactccatttactatctgctgaagtaaagtattcatattttccgcctccctctataatgaaaaatcaaaggcctgcattataccttcatcctaaatgcaggctttacaacatattttatataattactatttgggttgaatttcctttacgaactcaaattgtccattagaaactttgttgattacaacactctttatcggatctctattttcatcgaatttatagtgagtagttccacagttttcatctaacttctttaacgcatcttttatttcatctgagtcagtgcttccagcattcttaattgctgttgccataatataaactgaatcatatgcaagtactgagaatgcacctgggtcttgtccatatttattcttatagttagatacaaatgtttttaaattttctgacttaatagatacgtgatctgtaaaataagcaccttcaactgcatctccaccaactgccataagccctggatctgaccatgaatcactacctaaaagttgaatatttaaaccaagttctttaatttgttttgcaattaatccgacaacatcataatcatcaggtatgaaaagtacttttacacctttgtttcctatttctgttaggtaagatttgaaatcactttcaccagtgttatactttccttcataagctacttctccacctaacttttggaatgtatctttaaatgtacttgaaataccaacacagtagtcttttccaacatcatataaaagtgcaacttgttttgcttgtaaatcgtcatatgcaaattctgctgcaatttttccttggaatggatctatgaaacatgcacggaatacatagtcgccgccttctgttgtaacctttgcgtttgtagatccaatagaaagcattacttttttatttgcagttgcaattggagccattgctattgaacagctgcttgcatatgttcctaaaactgcatctactttatcctgatctattaatttagtaattgcatttggtgctgttgctggtttattttcatcatcttcaataactgccttaatttttttaccattgattccaccctgatcattaatttcttcaatggctagttctgcaccattcttcatagcacttcctaaattaggaacacttcctgttatgggaagtacgaaccctaagttgatagtatctgactgacttcctgtagaacttcctccactgctcgtctcagctgtttcactacatcctgtaaatgacatcatgcatattgatgctacagttaatgcagctgctaattttgttaatacctttttcataagaatccccttctttctttatgacttcgtttcatttactgcaaataaatgtacttatatataaaaacaagcaatgatattacatataaatatacttatacacaacaccattgcttgtaattatttcaaatattttgctttaaatgtgtaaaaaaataagcgaagcttatgataatcataagcttcgctgctttctacttattcctattatatattcacatatataaaatttcaatatgacacttgaataatatttgttgtgcaattgcacaatctgatatgttaattttctatagtatttatctaaattctaatatcatttacatatgaaaaaatatattatacattctttattatagtttttattacgtttcttaaattcatatccataaaagtatatgtgctatcaacatgtcctattatttctggcgacaaattagaatgtatgtataatgaagataatcctacacttttagctccatctatatcacatatagaatcgtttccaatcattatactttcattaacattaatattatgcttagttaacaaagcatcgaaaaatattttttctggtttgcaaatattataatcagatgagaaaaaaatatcatcaaagtacttttcaatatctaaaactctcatttcatatgatgtaaatatcctttgagcattagataataagtatatctttttaccactttcttttaaacatctcaataattctatagctccatcataaagctttagatattttattgataaagttctaaaaacatgtgccgtatcttcaataagttcatcagatggaacaacagctttatcttcatacaattccttaaaaattttttctaaaggaaaatctggatatctagtattagtaaaactttcttgtagtttttttactttactatcataagtaatttttaaatcctcaggtgtatattttgctcctttgaaagaataaaatagagataacttgtaccaaaattcaaaactttcttcatcagtattaatatcaactaatgttccgtaaagatcaaaaatataattcttatacatattagtcctcctgtttgataactcttttgaccaattaattattatatttttattataacatctatggcgttatacatgcctgtaatatggtaaataattcatttgtgtatatatatttttttattttaaataaaacacctgctgcattagtaaatacactaatctgcaacaggtgtttattaaataattcaatattatatttatagatataaatcgttaaaatctacataacatttgtcgtcctagctatcttttcatttcaaaccttgacactatcactgcgattaagacactttatttttaagtcttaatttatctgcaataattgcaataaattcactattagtaggcttgcccttatcgttatgaacagtgtatccaaatagcttattaatagcttctatttgtcctctgccccaagctacttcaattgcatgtctgattgctctttctactcttgaagctgttgtgttgtacttcttagctattgatggatataattcctttgttacaactgaaagaagttccatgtcgtttactaccataaaagcaatacttttaagacttaattttcattattttatacctgaaatatttcaataaatttcaaaattatcagttggtttttagtatatcagtttgttggatatacttttttaatagtatactatatttttaatatcttaacaagtatcatctttcattactaattttataacttaaacacattctataaatatttctaacagttttattaattatttttatattaattgaatatgcaactacataaatttttttctagtgactatttcccaaatatcttttaattctattatctcaatattaatatttttttcttcattaattagttgaaacttataccctggctcttttaattcattcttttttaatattaaatttatcttttctccactcatgcataacccaacaaaattgttataaatatctttatgacttatctcccaacaaataatagtatgtaaattttctatgcaattgttaatctcattaggtaatacctttttaaaatcacaccaaaataagttttcttcatcattatcataataagctaacgaatcgtatgttgtattttgactatatgacggaatatttatatttatgtatttaggataaatatattttaacaacataaaatttccatataaatcaatctccgtatgaggaacataaatatcttttccttcaatatttatagactttttaatatctatatcttttttttgttttataaattcatttctaattttagtaatatttttattttgattcttgataaaatcatctgaactcacattttttttattctttttattatcatttttttcattactatcttcaataattattttcgttggagtagtactttctaaagggatatttatattagtatctttaagatatttctttttaaattcattacgaaacttttttgaatttttattttgacttttataatcttgtaccaaattataatattcttcatatctatctctaagtatcttttgacttttttcagttaaattagaatcaaactcatacatatcatttaatcccatgtaagaatttccttctccagtttctacagcttcgagatatgaccaatctttttcatcaattttatacccaaagctttggaactttctcactatgctacaacgtactaaagctttttttatatccttagaatttccgctaaatctctctgctaaatctttaattatttttgatactttctctgaattatttagtttcctacgttcaataaatgttctatagacgtgctcacacttaggtttttcattccaatcttttacctttaaaatatttgcttgcccttggatatacataatttcaagattatattctttccttttaaaactatcattcttttcattatcacttaatcgaaaaatacttacaggaatattattactctctttttctaatgtatggtcatatagacatgcaagtcttgtatttccttcaattacaatatacttatatttgctgatatctgaaatatttattttttctttagtctccaaatctaaatcgtcaataggtcttataactattaaatttatccaacgaataccttttttcatagattcaagcaactctttatagtcatttcccttttttatatgttcaattatttgcctttgtgtcattttttttaattttccatcaaaccttgggttaaatgggtctaaaagtatttctctatagtctattttcttatctacatcataatacaatttacacacctcttttaaattcttttatctttctcatatccacacataactttcattccgcaaacatcatgaaaaataatattagtttcaaatactgaccaatccttgtgtgatattctttgagccactttcagcgcttctatttctgtatcataggcatatacctctgtctgtttccttatattctacaattgcccacattcttcttacttcctttggaaaatcctcaatagtcattaattttttatcattatctctaccttcaaaaagatttattactttactttcttgcattcccaaatccccatataactgatattataaagattaaccccttaggctccaactaagttcactttcctttactataaggcttttttcatcttttctatacccctttattcaaaataattgcaactcaaataaaatattaactttattatataattcttccttattagtaagcttccgaatttactcttttattaataatctatattcaaatggttcagcataatatttatcaaataatacaatattttttccatgtctattattgcatactgtacttttatacataattccatcataacctaattgtttaaaatatttagctatacaatgaaacggaacatattgattactcttatcatcactttttactggtttaaataattcttgtgacataaaataaaaataaatctttaatacaaatatctctgttgccttgtattgttgctttttctgttcttcagttgcatagattgtaagataatttctaatttttttatattcttttataaattcttcttgaatttcatcaatactcttattatctgatattgttaaattaataatatttttatcagaaccattcaatttttcaggtatacgaaatttacataccccataaacttctccctttttagctcttacttcttttaaagcaacttcttctatgtatttataatttctttcttctattattttttcattacaagctaaatataaatactctacatttttagggctaaatctattgtcatcatttatatactgtttattcggcaaaaatcttttaaatggtaaaggttctatgtctctatctttatctatcttagttgctctgcaaaatgtataatctctatataacttactgaatggtacctttataagttcattatccttttcatatttcaacatattatcaattactgataaaaaagtttcttttttaagcctctctaaatcaatatcctttagttccttgtttactagtacttgtctaaattcttcccatttttctttataagttttaattagttgtggtatattttcagtatcgaacattcccttcctccatttaacatatttatttaattataccacgcaatataattcaatccataaacttcttacataatttaactctcacacaaaagtgcaattgggactttatgaatgtacaaatatgtcgtagtcatctagaaaataaccatcgtttttctctcaaaaacaggaggggatacaatagcgcagtgagtacctgaagcgcacgaagtaagcaaaggttatatgtaatcactttattaattcttatattatctttatctatttatcctgatataaaaactagtgggacaaatctgtgcaatgaattaggtcaatacacgaatatgtcccattatattattctagtctcttacttttaacttatctgtaatttctgaaactctttcccttttcatattaatataaattcttccatcttttactgcataattattaaataataataccttagtgaagtttccccatcccaatagccttttgttactatctcttaaatctaataatttaattaattccttcttttcaggagtagtaagttttctgtctaagtactctgttggaactgctattacaggatagtcgctttgtactgctctaggtactctatacatcaataattcaatatcttttctaactcttgaacgagcctgaataatagtatcagatgtactgttatttactattactatttcaacatcttcatcaagaacattaataccagtttcatatgctccgtttatgattaatacattatattcttcgggaataattccagtagttaatatggattctctcactctaaattgttctttattcattggattatctttattgttggtactccataaggctattgtattaatatttctaaatgtttcgtttaaatatgcttctgtttctttggcagttgttactctgtctgtatatatcaagcatttcttaccatatttgaataggttagttctagcaaaccagtaattgatttgtgttatatcattaaaagcacttacaaagttttctctaagacactttatatctgttctatttgataaattgataacattccagctaccattaaaaacatttgtaacttttgaatcatcattaggtaataagccattcatttctcttttaattctttcatgtgtagcagtgaaacctacgacttgaacaccttgctttgctcttgacataatattctcaataacttctgtgtaatgagttgattcttcattgtcaaatttatctttatatttatatagattatgaatttcatcacatacaatagtttttatatctgcatattcaggcttatctttctcataaaagaattttgcatatgtcatgattacgcaatttggtaacacaaatacatctctccatttaatttcatgaacatttacattagtgcttctaacttcttgttttatttcttcatcttttagaatcatatctgttaaatttgaagtatcacataagtaaattgccttttcaccttgcaacaaagtattgaagatataataagtcttacctgaaccagctggagcaactattaaatttatcttattcttatgtagcataaccccctcatttttaataatctcgttaaccgttaattttttcatttgttaacaacctcctaaaaatttttaactatgttattttcatagtatgtatttaattcatagtatttttagaagcaaagattgctggagctttacgctccaacctcttaataataataacggttttcacgttgaattcttcgatactctctttcttcttcttccattagtaatattttatagttttttactcgtcttccaaaagctaattcaggctcctttcttgttgtatcgattggtgttaaagtaaaattaaaatcttcatgtttttttgaatctttcatatttgatattctccttttaattaaaattatcattttatttcttttaattctgcaaccataattgattcgcttttcataattgccttatgtttatattgtataaatctttctcacagagtaaactccaaccaaaaaagatttgaacaaattttttatttcttgtccaaatcttcctaaattttatttttttcttttattgttttcccttatgagagtgcttttcgatatgcctgttatttcaacaacttcattatagcttttatctccaccgtttactgatagcaagctcaaggcatgttgcaattgcttatctgtatatgacttaggtctgccttctttaaagccttccttcgttcttgctattgcttttccctcttgtgttctttcaactatcatatctcgttcaaattctgcaaaactaaagaatatgtttcttattaactttgaagctggagtgttatccataacccctatatttaatatatttacctttattcccttttcaattaactcattaacaagttcgcttccttgagtcatgcttctagcaaatctgtccagcttacatactactaatgtatctccagcttttagctcattcaataactttgtaaactctggtctatctgttttagttcctgtaaaagaatcttgatataccttatctgctccattatcttttaacttctctatctgactttctaaactgtttccatcattagcctgtccttttgtcgaaactcttgcataaccataaatcataatcaaaaaacctcatttcttagcccaaacttttgacaccaagtttagacaccattctatatactgattttacgttatgattttatcagtgtcaatacttttaagttgtgacacttaacacgtatataatatttactctataagtataaaattaaatctgtcaggcgatttctgatttaatatttctgccttaacttcatacctatgactctcattatatttatcttcaaagtcaatcataaatctcaccactaaataatctccatgcaacgcagtattttcaaattcaattttagcttcttctccgcttagcaatgcattatttgatattttacacttttctttactatatattaattgtctctctttatcatgtacagaaaaagatgatactatcaatccatttgcaatattttccgaaacattttttaaatgaatataccaatttgcaaaagtaccatttgatcccatagatgaagttatattaaatctaggtatattcatttgcttttgttgattatttatcagctcattaaatttttgatttttaattgctaattgttgattttgccacaatgctaatccacccaataatacagttcctccaaatgataacaacgagccgtaaaattgaagtaattcaccagctgaccattttgccataaaaaatttacaaggcatttcaatactatataatatgtgaatcaaaaatactggcaaaaatattattacaaaacttaatataattgaagctattatgtgctttttaacccattcctttaaattccccatttttatctcctcctaaaaaatcctactataagtcttcttttacttcattataaattgaattacatatcaataccccatattcagccatgaattgcttttgattatctgtaaacagttctctttccttaaggctttcttgtgttgagtgcctaaagcattgaactttttttcttaaactctttatatcattttcattaataaagcccaaaaaaatatcatcataatctaacgtaatgaatttgttatttctttttaataaatattcaattaaatttcctatttctttcagtttttcatcaatagccatctcattaaattgtgcatttcttgttgatattttttgaattaatgcatctacttcttcttcaatagttatttcattatctccactttcttttaatttttccatatcattgagcacttctttaattttctttttatcgtaatctgttaattcattatttttcattctaaaatcttcataatgcttcatcaaagcaataactagttttgcaacttttatgttactttcattttctataacttgtcgcaatttattcgcttttgaacaatattcttcatacccatcatcctcatacacatcaagattaataataccctttacaaatctttggaatgaactattagaaaaatctattacatatcctgtttccattccaaataattcttctattgtttctcttgtagtaaacttcaattctgacatataccctccatttgctttatttttttcaagtaattacacaattattataaccttttttttacattatgttaattatttgtttaggaacttatgagttactgaaatgtataattatcttacctatatctacaattcaatagttgtagacataagtaagaataatatttattgtttagtttactcattgagaacctcattaaacacttctattattattgcagttactgctcatcagctttaccatttataacttgtcctaaatgttttatcctttgctaatgcttacccattcattagaatgccaagctacctccacaactgttatttctaggctatcggtcgttgtccaccttgcatatgctcaataccttgcataagttccaatagaagtaactcccttatgatcaagcacatagttgattttctgcattggctcaacttacctactatttattttatagttgcaatagtgcatgacaactgacctataccttaaaattgggtataggaaataaagccttgcattctccaattttttcaattacaattaagttgctaaactgtttgtaacctcctttgttggagttgcaaagatttataaaactatatttagttttagtagttaccattactgtggtagctatttttttattttctcatattctcaagaggtgaaaaccgttgatagctctttcttatatcctctgatgtaacatccaaataagcctgttctgttacaattacgcttgaatgcccaagtatcttagacaatataaatatgtcccctcctgacagcaagaaacgccttgcaaagttattccttatctgatggcaagttatactttcagcaatccttgctctaatgcaatattttttaagatttttttcaaaattcataacattaaaatttgatcctcttgtacttataaatacatattcagtatcaaagtacctttctttgtaatcaatccattttcttaaaataccttgcattattgtgctgaaaaagacatatctgttctttctcccttttgctatttctgctggaatgaatattgcttttttatcaataagtacatcatccatctttaagttaagcgtttcgcctattctcattccagtgtccataagaagctgcaatatcacataatctctatattcagcaaatgaggtcaaatctagggacttaataagcttattaaagtcaacatcctttatttggctcttaggctttcttctgtgcttatatggtctaatctgcacagttggattctttttaatgacttcgctatcatataaccatgtaaaatacactttgatgttccttaagtagttatttacagtgtacattgacacctgctttccaaaatctcctctagcagttgggttgttagactttcatgaattgacatctgcaacatatgaatattttccttttgtttttgtaaactcaagataatccttgatgttttttgttgttacatcaagaggagtaaaaacattaacttcatccgctaaatatttagcaaacaactttaatgtcccctcataggacttcatggtctttttagtcaaatccttattggtgcagtaaatcataaagtcgttaatgctttcgtcaaaatcataaattcttttcttaagtctaggcataaaaaaataagacacctcctaatcagttatctcaactgattattcgatatcttattgaatattcatatatttgttggctatactttctaaaggttacatgacctcagcccaataaaatagctctagcttactttatttttaagtcttaatttatctgctataattgcaataaattcactattagtaggcttgcccttatcgttatgaacagtatatccaaatagtttattaattgcttctatttgtcctctgccccaagctacttctatagcatgtctgattgctctttctactcttgaagctgttgtattatatttcttagctattgaaggatataattcctttgttacagctgaaagaagttccatgtcgtttactaccattgtgatagcttctcttaaatacatgtatcctttaatatgagcaggtacaccgatttcatgaattatgtttgtaatttctgtttcaagatcaacaggcgtttttgattttggttctgaagtaagaatatatgaagaagttgttggataagaaaccctgttagattgtgctgaactttcttgtattgttggagcactattaaacatttctcttattctttttgtaaatacttccatgtcaaaaggcttcactgtataataatcagcacctaatgtaatcgcttgttgagttattttatcttgcccaacagccgataagataattattcttggtgtcttttccaaatccatagtatttagcttttccaacacccctaaaccatcaagatgtggcattatgatatcaagaataactaagtctggttttctttcaacaattagctctaaagcttctctaccatcttttgcaatccccgtaaccacaatatctttttgatttaataagtagtcatttagtatactgcagaattccttgttgtcgtcagctattaatactgaaatttttgaatcttccatatttttctctcctttaactattaatgcactttttatatgttttcccctatcaacacacacatattgtaactttccatttgcttacatcaagataataattccataaattttatcaaattcctcttttattgtagggtatatatttctctcaccatatttatctactatatgtggtttataagatttatttcttaattttatggttttaatgtatttatcttccactatttgtaaattatacacttttttttgctacaagtaaataccttgaaaaaaaatacttatattattttgttgagaaagttacttagcactctacttaacaaatatttctctattatattatataattttcttgtcctttcttcaaataaataatcatttttttgttaataataagagttgattcaaatatttgttatccttacaacaactttttaaatcaactcttattaaaattatttaattattcctgcatcttgcagcatccattctatgtatataccatatccagtgtcaggtttatttataagaacatgagttacagctcccacaattttattattttgaataataggacttccactcattccttgaactataccacctgttttctctaataatcttggatcagttacttttataaccatacttttcgaacttgcaacattttgatttaataacttttcaatttctatttcatattcttgtggaccattttcatcgattgttgttattatcttagcttttcctggaacaatttcatctctaaatcctacttttaagcgtttaatatcagatttctgaagtatattactgtttaattgaccgaatataccactttgtgtatttttatcaatttcacctgttggattactttcatttatgaaaattccttttaattctccaggagaacctttttctccttttcttatgcttatgatacttgattcaattacatcaccatcttttattaaaaatggttcatttgtatcagaatctgttattggatgtcctaatgctccaaatttttttgatgtatcatcataaaaggtcattgttcctacacctgctgtcgagtctcgtatccataatccaattttatagtctttattattttcttttttcaaagttactatttttgttatattttctccatgtcttaaaatatcaacttttatactatctttttcactttgttttattgctttaactaaatctcttgaattatgcatttctattccatttatttttagaattacatctccaatttctaagcctccgactttacctgggctttcttctttttcattattgatttctatatcggaatatcctacgacaagaacaccttcgctacttactctaacaccaataggtacacctccaggatataactcgagatcttttattttttctacttctacactttttaatggaatcattcccaaaaattttatttcgtatttattggaatcatcatcaacttttgttattgtgtttccaataggagcaattgatgggactgtttcatcatttttagtgtaaattttatctggcagcttaatgagacatactgcggtaattaaaattagaaataggattggagtcataagcagactaactaaacataaaaattttttcttcatatttctctcctcctttacttcttgattttaatttccccacaagacaagcatattatcctataagaacaatgttataaaagacaaaaaatttacctcatactaaatttttaataaaaaataaatttatttcttgctctcccttccaactatcatggtcgaaagctttgagattattggggtttcatattattccaattatttttccataaaattcatattaattagaatgaatttactatgtaaaaattacaaaaaaaataaaaccacggaaatccatgattttatttttaccagtttttataagtatatgtatttaatttttaatttcttttttcttttcttcacttattcttatcatttcttttacattatttaaagttgcttctgtaacatcatttccagacagcattttacttatttcgagctctttttcttcaattttaagaacttttatacttgtaaaagtcttgttatcaactacatttttagttacaaagtaatgataatctgataatatagctatttgtggaagatgtgtaatacataaaacttgatgagtgcatgaaagctgatacattttttctccaactctctgtgcaactgctccacttataccagtgtcaatttcgtcaaatataagcgttggaatttcatctttttctgcaaaaacacattttaatgcaagcataattcttgaaagttcaccaccagataaaactttttcaagaggcattaatggttctcctggatttgtagaaataagaaaacatacatcatcaaaacctctttcattgaagttttcttctctttcaacccttatctgcattcttgatttttcaagtcctacaaacgcaagttcttttaaaattttctcttctaaagcaccacttttttctactcttaattcatgcagaataatcgctgcttcttccatagactttaatatattattttctttttctctaagttcattgattatcttttctgaatttattatttcatcgtattcttttttaattttttcaagataatcaagtatgtctttaactgtcggaccatatttctttttatactgattaatttcataaattcttgaatttatgctttctaacgcatcattatcaaaaactatttcttcagccatatctcttatttcacgagttgcttcttctattgtataaaaagcttcttctataacatctttattcttttttattttttcaaaatgcttttctacacctgataattctgaaattactttagatagtgaatccataacactaaattcttcttgtccgcttaataatttataagaatcaactaatgcatgattaattttttctgcattggctaaaatgttatattcttctctcaaagtgtcttcttcattttctttaagcttagccttttcaatatcttcaatctggaattttaaataatcaagaagcttttctctatcttgattacctgtaattcttttaagatcttctctaacttgtagtaaactttccctaaggacagtatatttatttaaaggttcttcaatacttttatctataaatccatctaaataaagtatgtgactgcttctaagcagtagttcttgattctgatgctgaccatgaatatctaaaagctttgctctgactctttttaattgagatgtaattaaactttttccgttaattttaattaaattcttcccgctttgatgtgattctctgcttattataagcacatcatcatattcaatatcaagttcatccaatacttcacagactttagaaccatcaagagtaaacaatgcttcaacatatgttctgtcttctccagttcttattaggctttttgaaaactttccgcccagtacaaaatctattgcatcaatcataatagactttcctgcgccggtttctcctgacagtatattaaatccttctttaaagtttattgtcatttcttctattaacgcaaaatttttaatatttaattgaattaacatttcatcccatccttaaccttatgacgacattctctttcttattttagacactaaaagttcagcactttcaatagttcttactaaaataaatattgtattatctcctgctactgtacctgctatatctgcactttctaaattatctacagcttctgctgtaataggtgcagatcctgttattgtttttataacaaccattttatctacattttctacagataatacagtatttgcaagaatattgcttagtctgtctattatatttttctgctcgcctgtagatacagcatattttgactttccacttgaagactgcatctttattaatttaagattttttatatctcttgaaacagttgcttgagttacctcaaagccttccatttttagtgcttctgcaagttcttcctgagtttctatttctcttgagctaattatttctaatatttttgtatgtctttttgatttcaaaattcctcaccatcacattctttagaattatttaaaatcttattcctcaaaactttgaaataatcataatcatcaaacaaaagaagtttaacatttttttgttttttataaattttaacgcatgatttttgattaacttccatcgctttttgtccatcaactgttaaatatattttttcttcttcattttctgcatatatttctataatactatcacctttaaggactatagtctgcatgctttttgtatgtggacatatcggtgttatggttataagttctaaatcaggatagataaaaggtccccctgctgaaaaagaatatgccgttgatccagttggtgttgcaacaataagtccatcacctttaaaagatgaatagagctttccgtcaacatatattttaaatttcaccattcttgatagtgtacctcttgcaagaactacatcattaaaagcatttaatttttcttttttaaaatcatctatatcagcacagcctttaatattttttaattcttttttgcatatgagtccacattctactatattcttaaactctccagcacactcaagcatcattctttcctgaatttcatattcattgtttttaagttttgtcaatgcagtgtcgatatcagatatctctatgcttgataaaaagcctaaattccctatgtttattccaaacaaaattccgttaaactcttctttaactgaccttgctgcacttagaagtgttccgtctcctccaagtacaacaagcaattcaatacttttgagattttgtctttctaaatcataagaattaaaaatatgaacttcttttatcttgaatacatcttttattttatttataaccatatttaagattttattatcattatcctttgacggattaattgcaataccaatatttttcatagcccctccaaaagaagttagatttctacatgagatgcttctaccactgcatcaatatcttccttcacaaaactgctttccttatctttatttttactaaagtaaacaagatactctctgttaccttcaggtccttttattggtgaatatccaacaccaagtacgttaagatcctgttctaataaaaagtctattattccatgaactacttctttatgagtgcttatttctcttacaacaccttttttaccaactttttctcttcctgcttcaaactgaggttttattaaagctactacttcaccatcatcttttaaaagacctaaagttgctggcattatcttttttaatgatataaaggacacatcaattgatgcaaaatctaataaatcattatttatatcttcaggagtaacatatcttatgtttgttctctccatgcatacaactctttcatcagttctaagtttccacgcaaactgtccatatccaacatcaactgcaaaaaccttagctgcaccattttgaagcatacagtctgtaaagcctcctgttgaagctccaatgtccatacataccttatcatctaatgttaagtcccatgtagccattgctttttcaagttttaatcctccacggcttacatattttaaggtatctcctctgtactctatatcactgtcaactcctactttttcaccagccttatcaactttttggccattgacataaactctaccttccattatgcatgctttagctttttctcttgaagtgattattcctttttctactaaaagtatatcaagtctttcttttttttctgccattatgttctccttttaatcataaagttctaatattgattctctaatgctttcgcagtcaagtttatatgctttgtaaagtatatctacttttccctgtggaataaacttatcatcatatcctaatgattttatttttcctttgtatcctatttccataagataatctcttactgcactgccaaggccgcctttaagtatgttatcttctattgttaatatattatatcctttatcagatatttctttaattaaatttttatcaataggcttaataaaaacagcatttattatagtgggatttatgccttgttcgtataacatttcctttgcataaactgcatgctggaccatcttacctgttgctattatacatgtcttggatcctttatttacaatctcccacttgccttcttttacttcttttataggaggaatgttgtctattatgtctcctcctcttggatatcttattgcaactggagaatttttattaacagcccatctaagaagaacttcaacctcagcaagacacttaggtgctgcaatagttatattaggaataagagataaatatgaaagatccattactccttgatgtgtttcaccgtcttcaccaacgattcctgctctgtccactgcaaagattacaggaagattttgaatacatacatcatgtattacctgatcaaatcctctttgtaaaaatgttgaatatactgcaaagaccggctttaatccattacttgccattcctgctgcaagtgttactgcgtgctgctctgctattccaacatcaaaaaatctttctttaaattcttcactaaagcattttagtccagttccttctggcattgctgctgttattgctacaattctcttatcttctctagcaatttttgcaagggactctccaaatgcttttgaataactatttttatgactaacctttggctctccactttctaaatcaaaaggacttactccgtgatatttacttggactcttttctgctaatgcatatccttttcctttttgagttatagtatgtattattactggtccatcaaaatccttagcaattttaaaaacttcagtcatagcttctatgttatgaccatctataggtcctatatattttaatcccatattttcaaaaagcattgatggaactacaagttgttttatgctatctttaactttcgaaagcttaacagcaatatttttgcctatatatgattgatttaaagagtcatgaatttcattttttagcttattatatgttggtgccattctaagtttattaagatatctagatagacctccaacatttgttgatattgacatctgattatcatttaaaacaacaattaattttgtttttctaaatccaacatcattaagggcttcaagagccatacctccagttaatgcaccatcacctattactgcaataacatgataattctctcttttcaaatctcttgctcttgctatacccagtgctgctgaaattgaagtgctgctatgtcctgtgtcaaaacaatcataattactttcatttctctttggaaatccactcattccattaaactgtcttaaatttttaaaaccatcttttcttcctgttaaaactttatatacataactttgatgacctacatcccagactattttatccttttcaaagtcaaaagccttaaacaaacttaaggtaagatcaactacacctaaattagatgataaatgacctcctgttttagaaacgctttctattaaaaattcacgcaattcatcactaagtatctctgtatcttttggggttaatttcttaatatctctagggaagtctagagtatctattaatttcataatatcatttcctctgctaactttctctatttaaaagatcatatgttaaatccactaaacattgtgaatcaacagttaatgttttaagcaactccacacattcctcgcttattgttttacataactctctacatttatctaatccataaacacttataaaattagttttgtcatgttcttcatctgcatgtgtatttttgcctagaacatcagcatctcctacaacatctagtatatcatctttaatctgaaatactaaacctaatttttctccatatgttcttaaaatttttacatcagattcacatgcaccggcaagtactgcaccacctacaattgaagctcttataagtgctcctgtcttttttgcgtgcatatactcaagttcatctttagaaattttctttccttcagatattacatcaacaacctgaccacctatcattccttctgcaccagctgaagatgctatttcataagctgcttttaaagagtttcctccattctttagagaataatccatcattaaaatcattgcttcattaaggagattatctcctgcaagtacagcaatattttctccaaagactttatgatttgttggctttcctcttcttaagtcatcatcatccatacatggaagatcatcatgaataagcgaatatgtatgaatcatctctattgaacatgccattggtaaaatatttttatactcatttttgtaaatataataagataaagcaaataatattggacgtattctctttcctcctatatttatgctatagccgcttgcatcatatattactttgttatatatacctttgtttttgaaataattatctaaataatcatttatgtctttccttaaattatttatcattatcaacttcattaaactccacttctttttcgtctttaaccatagaaatctttccttcatacacgctaagtgtcttatagatcttattaacaagctttactccattttcataagatttcatagaatcttcaaggttaagctcatcattttcaagaccgcttagtatttcctgaagtttagataacatttcttcataactttcttttttggccatttttaaactccttattttaaggggataaaattccctttaacttttccatctttaagaattatatttaattttttttcttcattcaactgattttttgaaattattatattgttttcatcatcctctattatagcatatcccttttcaataaccttagtcggattatatgcaattagaagattgtttaaatgttcaatatttttcttttctttatttagttttgtttttatagcaaaattcaatcgttctttaagtttatcaacttctaaatatgaatttgcaataaggctcaatggtgagtgtatttttaatattctttcagcattattaatttcattaatacagcttttaattttatattcaatattatcatcaagattttttcttaaattgtctatattgtttaatatttcacttttcaatggtactgctatttcagcaccttgagacggagttgctgcacgaaaatcacttacaaagtcacaaatagtataatctatttcgtggcctactgctgaaattataggaatatgagaatcatagacagtcatagcaagttcctcttcattaaaattccagagttcctctattgaaccgcctcctcgtcctacaattattacatcaacattgtttttcatattgaagtattttataccttccattacttctttataggcacctacaccttgaacttttgctggatataaaacaatatctatagagtcatttcttcttcttgatacattaattatatcacgtatagctgctcctgtaggagatgttacaacacctactctcttaggatatgcaggaattggcattttgttctcaacatcaaagtatccttcttttgatagcttatcttttaatttttcaaatttaataaataattctccctgaccttctttttgaatttcatcacaataaatctgaaaagatcctgtcgctggataaatcgatgctcttccacatattattacttccatgccttcttcaagcttaaactttaaaaagctggcattacctttaaacataacacagtttacttttcctttatcatctttaagagaaaagtaaatatgtccactgctatgatactttaaattagaaatctccccttttacagagagattatttaaaataaagtcattgtccaaaactcgtttaatataattagttacttctgatacggttaaagttttaattttcatcttcctttaaagcctcacatgcattttttattagtagcgtagttgttaatgctcctactccacctggaactggtgttaaagcgctgcatttatctataactttgtcaaaatcaacatcacctgttatctttccttcaaaacgtgatgtaccaacatctataacaacagcattttcatttacataactttcatcaataaattttggtctaccaatagcaacaaccagtatatcagctcttttacatacttctttcaaatccttagttcttgaatgacatattgtaacagttgcattttcatttaataacagttgtgctactggtttacctacaatattgcttcttcctagtacaactacattcttcccatttaaatcaatatttaaactctttattaaagttactactgaatttggtgtacatggtaaaaatcctggttcacccatatatagtttaccctgactttcaaatgtaagacagtcgatatcttttttaactgaaatttctcttattattttcttttcatttaaatgttttggtaatggaagttgaagtattattccttgaatactatcgtcttcatttaattttttaattgtatttattacttcatcatctgtagattcttcttttaattcaactcttaaaaatcctacaccaagagttactgctgctttttcctgactattcatataatatattgaaccgccatcttctccaactaaaattgatgctattttaggaagcttaagacctttttcttttctattatctacaaaatttttgatttcttcctttacctttgctgctacttcttttccgtttattaattgccccattttattaattccccactttctcatttgcgtttaaaattataatattcttatttgaatatactttactctatgtgtctattttaactttacttttatattttttcaataattgtttatatatatacatttctcattttacttctaacaattattatataactttattcaaaatataataattataaaaacgataatttatacagttgatagtttattccaaaaatttctctatattaattatttgccctatatattgtccactatttaaatttaccaaatttcaattctgaagttataaaaaaactcaggtttgataaattataaaattaccaactctgagtttttaatatatattgtaactacacatctataaatacaattaaaacaatccatgaagaattttttcaattaattattcctcttcatcacacatatatttcaatattattttattttatcaagtactccattaacaaatgaaacactcttttcatctgagtattttcttgttatttctaatgcttcatttattgcaacgcttcgtggaacatcttcatcaaataaaatttcataagctgcaagtcttaaaatagttaagttcactttagaaattctctcaatcttccagttttgaagatttgaagatattgcttcgtctatagcttctttattattttcaattcctattaatgcctttttaatatatgtaagatctaattcctttatgtcaccttcataattgtcaatgaaagtttctaccgcttcttctactgtgtctttactgcaagtcatcccaaaaaataactccatagctttttccctagataattttctattcatcgaatcctcctaaaataaatgtcatattaattatgtacatctaacattatacacactttttatatcttttaaaccccattcaaattaaacaccctctgaaatttcagagggtgagaactaaactatttagattcatttccttcttcttttggtaagtaaatgttttgaacacagatattaactgaatctacttctaatccagtcatagcttcaacagtctttttaacattttcttgtactgcagatgctaaatcattaatctttcttccatactcaacagccacattcatatctataatggctttatcatcttctagagttactttagtgccttttactgcactctttttacccttaaatatatttgttaagttgcctgccacaccattttgacagtctaatattccatcaacttcttgtgctgcaattccagctataacactaactacttcatcagaaattttaacaattccgatattttcatctctatttatatcttccatgctatctgaacctcctcggttttgtaataacaaaacatcctaatcttatgttcattataacaaataaaatttaactttacaattatattatttttgatatattatttttgaacttcaattattacatctttaatatttgaaacatcttgaacaatctcttgaattgcaacgctatcagattcttctattccagtagatgattttactattacagttgctttattatcttcaagcatacataatgcatcttcaaaccctttattttttatgtttaattctattcttccttcattatctcttgccatagtctttttagttaattgtttagttgcatcatctttttgttctttagaagtattttgatcagaaataatcgcatttaaagattgtattgtagatgaatcctgctgttctctttgacttctagcttcataaaaataattctgtgtatttaaagtctgtgtatcactttcagcttccgctgtttcactattgtccttagttactgtttctgatgataaaacttggctcaaatctgttggatcatttaatcctccattatttagttttgctgcaagtacacctgtacacaatattagtgcaagtagtgtaaaaataatcccacattgtttctttgtcataataaaactccctcccatttcctatctatctaattatatgctaattcttcatactatatacattaaccttatctaaacttaagttatataattttgaaactgcttgttcaatttcatattttgttttactattttcagcgccttctgcaacaattactatacctattatcttaggcttgtatgttgttaaaataaaaggttcatttttgccatcattttgtgtcattacaacttttgaattatcgttattctgattattaaccctttttcctccctgtgtatctgtttcttctgtagttgccttttgttctgtcttatcataagccggaactttctgttcaccattttcaaatgttatcattacatcaacatcacctacaccgttcatctttttaagtatattaattaaatctgtcttctgtttttcttcgtaatcttctgctgtaataactttacttgtatctaaatttacattttcttggcttttagaagagcttccgctggatattgatgttattttactactcagcttaccgcttccgcccaccacattcattgcaatgagaataaatacaagaattaagcatattacaataagattttttatcttactgttcttttccagaaaatctttaacatcatctgtgacctttttcatactcataaattcattcctcctattcctccagcatatacacttctattttatcttccgaaatatcaaactcacttgctgcatagcttattacgtctttgtactcatctctgagtgtatctttcttttcctttccaatctcaactttctctattcttcgtacgtttttatcttttatacctatcttcaagttcttaacatttatctttacattgttaaaatcaacatcacaatcaacttcacttttgaaagtcatattatcgaacttatttttaagcatgctgtcacagtttttattgaaattgcttataaatgcctttttacgtgcatcctcactatctcttgtactttcaaatgaagtagctccatctgtatttattttgttctcattctttgaaaaaactgtttcataattttcaattccttgaagaatactattttctccatttgtaataaactcgacaattggatttaaaattgtacttattaaaatcaaacctaaaacaaatgaaatgtactttttcatctttttgtctggagcaagaatttctactgcacttataaatattaaaaccgttgttagagtagctactagagcttttaacttttccaaaattatcagccccctactacatagctgccagcctgagccataattgcaattaaaataaagaacataaggcttactgtaagcacacatgatattatgagaaccatagagtccccagcacattctaaggattttgttattcttgaatcacttactggctctactaatgctgatgatattttataaataaatgtcattaagattagctttattattggataaagtaaaatcaacaatactacaacaagaccaattgaacttactgcattctttattattaatgagtaaccggcaacagacgttattgcatctgaaaatgtctttccaactataggtataaaattatcaactgcaaacttagctgttttaagagttactgcatccatagtactagaggttatccctcttattgtgagcagggcaataaatgcagttaatattatcccctggaaccatagtatgcattgttttgtaagcttgcatagattagttatcttatgttcttctgagatattattggcaaattctaaaacaaatcccataagtatcattggtattattatatttgtgtatatctttggtataaatattacagccccaagaataaatggatctaaagtagcagcctgtgttattcctcctgccagtgcaatcattgtaaccaatataggcaagagtgcattcataaaatttgaaatatcatttataacaccctgtgctacagatattgaaataataaagctctttgaaagaatcattatgacaagagcataacaggcataaaatgcaacttgtgatatgctttcatctgcaaatgagtcctgaagattctttagaagtgcacataatattgcaattgtaactatagatatcacaagagcaagtacgcttctaacttctttgaaaaacaggctcaaaacagccttcattatcgtgtcaaatgataaattcccttttccattagaaataaaagccttaatataatctaccggatctaacccctgaagaagctccacatccgttttcatcttattaatataatcatatagtgtttctatctgcccctttgcactgccaccaatatcatcaatacttacatttgttttttcattggtattatcatttgtctttatattactttcttctgtagtccccatattattctgagtatatgaatttttttcatcataagctgctaaaaccgtgtattcttttgtattcttttccgcacaagcatatctattattgcctgagagaaaaactggttcatatagtgtaaaaattaccaaaaagcttataaaaaaaactgttaacctttttatcctcgtcatattgaatacacaaccttttaaatttacttacacgaaatttactgctcttcatattcttcgcttttcaaaacattagatgttcattggttttaatcacattatctgcaatatagaatttaatactgccattaaaataggaatagctaatactagaatcattatctttcctgcaaaatcaatttgtgttgccagactgtcaacatttgcatctttacataaagtgctggcaaaggttgcaatataggctataccaataattttcaggacaattcctatatatactgtatcaatattagctttatctgacatggtctgcaaaaatgtcattatttccttaagcggatcaaatataacaagaatcattaatgctcctgcagccaaagctaatagcacacctaacgcacttccagactgttttagcataagaattaaaaatagtgctaaaaaagccatccctacaatttttaaaatcaacataataccacctgctacataataaacatggtctttactgtactgaacagatctcctattattgaaactatcatcaaaagtattattacaactcctgcaatatttgtgattgctgcaatatcggattttccactgcttgtcagaactttatcaagaataacaagaattattccagctccgccaatctttaaaagaatacttatatcattcattttttctccccctatgcatggtttttatgctttctgactaaaacatatctgataaattaatttttaaaagtattgactatacagcttcattataaattttcagaaaaatttatctgttacaatcctaattactgctgttaattattaatattaaaaatatattatgtttatgaatcataatacaaaaattgtaagcattcctcctacacagactcctaaatatctatacagcttaacattctttttagctgtatcctcagcatcctttaaattcatccttataccttcaatagcgagagaaaaaattctttcctgaccaaaaactccagaatcgccaagagacttaaaaaaatcccctaaaatctttatatcattgtcatttaaactgaattttcctttaagctccctatactcctctgccacaccatcataaacactttcaacacttccagatacaagtttttcccttattccatttataaaagaatgaatcggctcttcaactttatatgaaaagttttcaaatgcttctggtagtggtgttgaaccatataaaatatcattttgaagtattataagactttttagtatctctctaagctgcatcattcttctgttgaagccttctccatattcaaatcctacatatgaacaaatactgaaaagcgcacaagcaataactaatttaagcatgtcttctcaccttctctcaattcatatatattttcaattgttccaacacctttccttgaactcaatacaatggctctttcaattattccattatctaaaagttcatgaaaaacctttctcttatataaatcttcaattgtaaaaccatgaattgatgttattatgtttactcctgaattaaaagccattaaaagagcttcaacatcaccctttgtaccaatttcatcacatattaatatttcaggcgaaagacttcgtattgccataatcatgccttcttttttaagacagttgtctaatatgtctgtacgcattccaaggtcattttgaggaattccaaaatgacatgctccaatttcacttctttcatcaataacagctaccttgcgtccgtaaaggcctattgaattcattccatttgaaatatttctagctatatcccttaatattgttgtcttaccacactttggaggagaaattattatagtattaaatattctattctctttttgagagtatatatattttattaatttgtcagaacatcctataacttcactgcatactctaatgtttattgatgaaatatttcttatggtcttaacttcacccttttccataacacattctcctgcaatacctatcctatgcccaccttttattgtaataaacccctgtcttatatcttcttcataagcatataatgaataattagaaattttctgtatcaagcttttcatatcttcttttgttggtacataatttactatgttctcaccatattttgaatatacaagaataggttttccaatcttaattcttatttcatatatctgttcttttaacagacgttccttaagtaaagttcctatctttagtggcaaaatacctattatatcttcttctgctctcacaatgttagtagtacctcctttcctgtctccttacttaattaatattttattaaacagaaaaatattactgattacaataaaaaaatatgtaaacaaataaaagcctcgtaaaataaactttaatttgtttattttacgaggctttttattactaattataatctactattattaataaattactttatgttttcatgacagtaaggacatggaatttgttctttactggttaaaactgatttttccataaaaattggtttattacaatgagcgcaattaatttcaacatactcatcttccatatcacacaattcatcaatggatacttcttcaaataattcatcttgaatgtttgataaatcatcatctaagaactgcatattttcttctattgcttcttgatttacaacaacttcttcaatcttatttgccattgtgcttaaaatagattgtatgctgtcaaagtattttttatacttgtcatcgtctacattagataaactgttctttaactcttcaatttcgtttctaagctcttccataccttttcacttcctgttcatattatatattaaacattctaataatctaattacattccttagttctaaactctattaaataaaaatttaaaattcaatttttatttaaagtacacatatgcaaataaagttgctaagtatattacttagcaacctacataaatacataaagattaaactctttccatgtagtccccagttcttgtatctattctgataacatcaccttcgttaacgaacataggaacattaacaatagcaccagtttcaactgtagctggctttaatgcattagttgttgtgtttccttttactcctggttctgagtgagtaatttgtaattcaacaaagtttggcgcttcaactgagaaagcttcacctttgaagaatttaatagttgcaaacatgttttcctttaagaacttaatagcttcttctactttttcttgatttaaaggaatttgttcaaatgtttcttgatccatgaagtagtacaattcaccatcattgtaaagatattgcatttcttttctttcaattacagcttcttgtaatttttcagttgggttgaaagttctatctacaactcctccagagataacatttcttaatttagttcttacgaatgctgcacctttacctggtttaacatgtaagaaatctgttactgtaaacacttgtccatcaaactcaaaagtagtcccttttcttaagtctcctgctgatatcataaaatatccctccaaatttataaaataattacaatgcaaatttaatacttaaatactagtatatacacttactcgttgacataacaatgatattttatcaaaagacagtcataaatgcaattatttatgattactttctcctaaaaaattatctattttatcatatttgttcttattcattgccacatatatcgattataacacaattttctgtattatttttgcttataatataattgttaatttcatatttttctaattttttaatttcctctaaaataatctgtttatctccagatattttcaactgagcataccatatattattctttttatctgcacttaatattgatgtattatttaattcacttatctccctatttaactgtgttaagtccttatatttttttattacctgagcacttactggttttatatttattcttttaattaatatgttatttaggcagatttgagcaaaagcacttaacataaggagaactattgcaatatacttaagtttactcttcatttatagaaactcctatcttatatttttcatcttctataagtgacgcttcgttcatttccactaatttgcttttgtttatattttctgcaatttttaaattattaataataatttctccagcatgattatttatatatacatcttcaaaatcatctaaaaaaagttcatcaatgacacatattattgtattcaagttaaaacttcctttatcactatatgattcatgctcatcaattttcacatttttttcagctaaaatacttagatttttaaagttaataggtataaatataaggttaaaaatcacaaataaattaattaatatattttgttttttatttttttgttcactaatttttatataaaaactatctggtataaaatttttatattttttatacattctcatttatagcccccacaatatccttttttattatttccagtttttctaaagaatattcatctagaaaacatttattatcaataatgattgtttctttttcatatttggaatctatatactgacatactttttcaagatcctttgacacataattatcaataaagacatcattgctacattttataaaataatatttattatcaaattttatgagactcatataatctttacatttatttttaaaaatattctttaacgtctttctaataataaactgtaatggtgtaacttcaagaaaaaccgtgtgactgcataacttctccactttttcctttcccctaatagaatatatatacacagagtttgtattctcacttttttcataatcatagagtatttcaccattctgagaaaatatattttttatttcattagctatatacttttctagttcaaaatatttagatttaatcaaaatactttttatatacaactcttccccaagcacaactgcttttaaatttttaaatttcatatttttatctaaaagttcataaaaaccatattcattatctctataaacaaaggaattgtcttttataaatacaatatcttttttcatcaagcacttcctttctttttcacttttcatattacatattaatgacttatttaattttcattacaatttatcaaattcagtattagtatcaataaaattagatgtaggcaataaaattatcctgtcattttttataacatattttagttctcttactcttaataaattatatttaccataaatctttaatgtaattttatctgccgacttctcatattttaatttattccctttgttttcttcttcaaaatcctcataaaatatatctgtaatatttaaactttcctcaaaatcaatatattttactttatttgaaacattgctcaaattctcatattcatcatcacttgtcacgcttaaatctttattttcatgttcattattctttaagttttcatttttattatttaatatcctcataaattcatatattactttttcttcattatcatcaacagaaaatatatcatcatctatgcaatacatagatgaaatatctatgttatttttcataagactgaacataaaacttgaaattgacatcaacaatgaaataataataattgtatttattagtgcaaaacctttttttcttacacgctgcatatatacttatcaccattttcatcatatatcttcatataaattagattttcttttttatttatttctattttttcaatattaaagagcatattattgtaagtcaaaatttcatctcctcttgaatatacaactactatttttttatcatgtacacgtatggtcttttttaaattatctccaaactcacttttgcataaagtcatatagtcattaccgataactatattatcaatagctccttcacttataatattatttaaattaatataaaaattttcatattcattagaacgtatactcttgtttttaatctcaagatatgttttatacataggaataaatagatttaatccttctgcaataatcattgttgataaaaaaatatatataattgattctaatattgtaaatccactctttttatatttcatccatccaccaacttttataaaattcctcttccctttcataataaatattttcgttatcaatacttactttaatcttataattagtacccatattatcttcacttattttttgaatttcaatatcatctccactttcaagacaaaaaatatcactatcaaataatttattatctatattctcatcatacttaaaataaattacatcattgtcacaaaaaaattcctctaactcttctttagatttattgtacttacattccttaatcaacatattaacaaccctattaagtttttcttcagtactcctattctcataatatcttaaacattttaaacttgttgacaatacaaatatacctgctatagatagcattaatatggatgccattacttcaattaatatactaccttctgactttttcataagaactaccttctccttaaattatgaatcctttattcatcaattcttattgtgtccacacctactccaactgtaattttagtaatatcatcatcattttttattgatattgttgttccagactttatctttccatcatcgtctaaatatatgtttgtgtttttaccaagacaatcagaattctttgataagttcatttttctaaacaaacttgaaattcctccatcataataaaaatacatttcctcatcttttgaatttataagtatgtgaccattaacattttcttttctgcaggcagctttactcaaagtcaaaaaattttgtacttcataaatatcagaatcatatgctaattgattttctaaattagaattcatagcacttattgatgtagttattgtaattaccaatgttaatataaaaatacttattactgtttcaattaaagtaaatcctttaacctttcccatattaacgtataccactttgcaattctttgaataaaggaagtacaaaaactgaaataaaaataagtactattgtccccattacaataatcaatagtggatttaatgccttcaaataatttctaatctttttatgaatctcactttcaagccttattgataggatttcaaagccttccgcaatacttcctgtttcttcacgaactttgataacagcaagagtataatttgacagtagcatactttcttctaaagattcgcttaaggtttttcctttcattatagaatttcttatttctaatattttgctgtttaaaaactctggttttatattgttactacataattcaagaccatgtaaaatattgatacctgagttagttattatggaaaaaataagtattgttatatattctaaaacatcttttattaatccaacttttaagaaaaaatcaaatttcccattggaaatcataaatttaatagtcataaaccatataactgtccagcataaaatataagtcatgtttacaaaatagctttctgtaaaattgttttgaaaattatatacacatctataaaagtaagatggtgtaattcccatagaattatatattccataaaaactaggtataattttgcatatgaaaatacctatgaaacttattattgaaataattatgaataaaggatatatgcaagccattttaacttcatttttaatttcacatattttttcatagaaattaccaagtctttttaatatttcatataactttcctgtattttctccaataaatataagacctataaataattctgggtacagaggtgtacattctttaaatgcttcacttaatcccttaccattgtgtatggcactatggatagttttcaaactattcttatattctttatgtgatacactttctctaactaaagtaagtgctttattaattgtaatcccatccttatacatttccccgagacttctagcaataaatgatacttgcttttcatctgcacatcttcttattacaaggtttcttttttcacaaaatagactgcgcactttatttacaattttcccttccaaaacctcatacatatcagtttttctcaatttttctttattcattaagtctctctccttctataaattcaagataatcgttgtaggatataactccacttataagaaggctttctgcatcttctttcatacttctatttgataaaaattctgaattgttttttaatgcatcattagacttgttaaaagcatgtgtaaagctacatacagaacttaccacctgtcgcccctcatatcctgtaaatttgcacaattcacatccactttttttaaatattttatgatttttataagttttttcatcatcaacaaatttacaatttgaacataatcttttaataagcctttgagaaatgacacctacaagactttcctttattaggtatggcttcacccccatattttcaaaacgcataaatacttctttgggtgacttacaatgaattgtactatatactttatgacctgttattgatgcccttattgacatttcagccgtttcttcatctcttatttctccaatcattatcacatctggatcttgcctcagtatacttcttaatccacttgcaaatgttatgtcaagtttcttattaaggcttacttgattaacttcaggcatctgaacttcaactggatcttcaagagttgttatatttaaaattcctgcatttagttcttttaaaattgtatataaagtacttgattttcccgaacctgttggcccacaaattattaccatgccattttttacagagatcatttttcgtattatttgtatcttttcttctgtaaacccaagatcttctaaattatagttaaaattatcacaatataaaattcttattactaatttttcaccattaattacaggaatagttgaaactcttaaatcatatttttttccattatattcaacaactgattttccatcttgaggttttcttttttctgcaatatccattccactcataagttttattttagaaattacttttacatactcttcatttggaattttatgcatacgaattagagtcccatttattctgtgacgtatgtttacccattcaccttgaggctcaaaatgtatatcacttgcattatcttctatacccttaaatataatattatcttcggtatttccttctctaaatgtaaaaatcatattttttacttctttaaaattttcttctgatacttcccttagaataaccttttttctataaataaattttaggtaatcaagttcatcttcttttatgttgtatcctaataaagtaatatttttttcatcttctttaacgggaataacattatatttatcacttatttctttattcaaaccatgtataacatttaaatccacatcatttattgaataatctttaataaatcatcacccctatatctattttttactgactatatttagcttaattatgtccacctttttccattaatattcatttactctttaatcttctacaataaaaaaacagcagcttagattaactaaactactgtttaatagtatttattaaattacattcacatacttataaattgcatcttgtatcattactctacgtattctacaaaagcataatcagatgatccatctgaaatactacttatgcttccatcctttgaatatttaaatacctgctcttgaccagaactcggattattttttcctatgaataaaatattattttcagaatcagcttcaattcctttttctgtatcaataacggctggaaagtcataagccactctctttgtatttccattttcgattttatatagtgaattaacattatcttttactcttccaacaaaaaacacatcattatttaaataaacaacatctttaatctcttcaatattattgtttaatatttctatgtccttcgtatttttgtttaaagctataaactgtctctcattatcaaaatttaattgaagaaataatatattgtctatggttcccttcaaataagctaaatacccctcttttaacttatatagaagttcttctttatcatcctctatattatatataaataatccatttacaccatcttggctaacaccataatatacaagtgatttatcatcataccagtcatataatgttcctgatatagacacattggattttatctcagcgaatttattttctttaagattaattatctttaatttcatcccgttgtcatcaacaaaatatgaaacataacttccaccaggagataattttaattttatatattcagaatcttcaattttaatttccttttcattgtaaactgcaaaagtttctccattttttctataaacataattgctactgcttttatcataagtcaaaactagcttatcagtttcctgttttgtatacttttcactataatcatataaattataatccccattctcgctttttaaaacagctcctgaatttaaattaatattctctgccatattagacggtacttcttttttatttgaattgcaccctaaaatgaacagagaacacacactgaaagctaacacacataaaaactttcctttgaactttgccatatcaatccctcttaatcattatttaaatattaactctttacataaaagcagtcagattccttaaattaaagtatttccttcaaaaaccacttcagctggtcctttcatatatacatcatccccattaacttcaattataagttcaccgccaggtgcttttacataaatctctttttctttattaactaatcctaatttttttgcgactactactgatgctgaacagccagttccacatgcaagtgttgctcctgcacctctttcccaagtattaactcttatatgtgtatcatctattatctttacaaaattaatattgcttccttcagtaaaaagactgtgtttttctaaagaaggtccatcttcattaacaacatattcatctgtattttcaaaaataattgtatgaggaacaccaactaaaactgtagttgctttatatgttttcccattacatgtgatttcactatctataaaatcttctccatgacttaatggaatatcttctgctctatatgaaggcttacccatataaacttttacatatttaattttttcatcttcaagtaatacttctataattttaacaccatcaccagtctccactgaaaattctgttttatttactatattatgttcaaacacatattttccaaaacatcttattgcattaccacacatatttgcccttgatccatctgcattaattattatcatttttgcttctgcaacttgagactttctcacaatgacaagaccatctgcaccaattccataatgtctatcacaaagcttaacagctagactacattcatcatttatttgattattaaaatcttctacaaatacaaaatcatttcctgctccctgcattttataaaatttcattattcttcccccaattcaaatttgctattaattaaacactacttattaaataataaaagtattagacctaaattacaataaatatcataaatttttcataaatttatgttattttttatattttcttcttttatttaatgaatatttttaagattaacctaataattgataatagtctccatataatgttatactattcttaatcccataaagaaaggtgaaaaataatggcattagatggaatatacttaaacagtttaatgagatcattagaagatacacttctaggttctaaaatagataaaataaatcaacctgaaaaagatgaaataatattaacattaagaaaagatcgtaaaaatataaaattattaatatcatcctctccacgctttgcaaggattcacttgacagaaacagttaaagaaaatccaataaaagccccaatgtacttaatggttcttagaaaatatatactaggcggaaggattataaaagtaactcaaaaagacagtgatagaattctaatcatggaaattgaaaatagagacgaattaggttttgatagtgtctactctcttattatcgaaataatgggtcgtcattcaaatataactcttgtaagagatagagataataaagtcatggaatcaataaaacatataactcccgatataaacagttatagagttctctatcctggtgtaaactatgtatttcctccaaaatccgaaaaactcaatcctttcacttgcagctatgatgaatttaacaattatataagcagtaacagtcttatttttgatgataaattttattctgcatgctttactggagtaagcaagctattatctcaggatttgtattttacactaactgaaaaaatacaatcacctacaagaactgaaatttacaataactttaaagatttaatggataatcttgataaaaatctatcttttaaaatatatacaaccaaaactggattaattaaggacttttattctttaaatttatctttttttgaaaaagattataattcaatatcttatgatgatccaaatgaacttatggatgatttttatagtaaaaaagataagcaagatagacttcaaaataaatcaacagatcttcagaagcttattcatactaatattgaacgttgtaataaaaaagcaaaaatacttcatgaaactttaaaagaatgtgaagaaaaagaagaacttagaatcaaaggggatttattaacttcctttatttatacaataaaaaaaggtgataaagaatgttctcttttaaatttctataatgaaaacgaagaagaatatatcacaatttcactggacagtaataaaactccatctgagaatatacaaagatattataaaaaatacaataagcttaaggtttcagaagaatatgcaaaaatgcaactttctaaaaatgaagaagaaattgaatacctgaattcggtacttacaaatataattaatgttgagagctatgatgaaattgatgagataaaaaaagaacttattgaaacaggttatataagattcaataaaaatttaaaaaatggcaagaaaaataaaacttcaaagccacatcactttgtttcaagtgataatatagatatatatgttggtaaaaataatcttcaaaatgattatttaagtcttaaatttgctaataaaaattatttatggcttcatgctaaagatattcctgggtctcacgttatagtttgtgactttaatgttcctgatacaacattagaagaagctgctataatagccggttactatagcaaagggaaaaactctccaaagctttctatagactatactaaagttaaagaattaaaaaaacctaatggtgcaaaacctggaatggttatctaccatacaaataaaacagttattattaatcctaatgaatttacaaaaaaatttgaaaaaaataattcaaataaacaataataaaataagaattagattaatgttattcttagaatatcttaatctaattcttatttcttacttttttaaaaaagcttatataaacaagtcaaactttttcatagcctcttctagaagctgtacattacttgcaaaacaatcttctttttcacattctatagagacaattagtgcatttataagactgagtggtgccacaaatgattctatagattttgaacccttacttattgctgcaagtgtaacatctgcatatggtacaagaggagacaacatattatcagttattgcaattgtagttgcaccttttctcttcaagtggctgaatatttccactgtacttcttgaatatttatcaaaacttataccaattattacatcttcaccacaatctttattaatctgttttggcatctgttcaatattttcgactataattacattgttgaacatgaggtctaaataatattttaaaaatacagcaagagctgctgaactcctttttgcaactatatatattctctttgcattaaggagaagattaacacattttctaatctcaaaaacatttaaattctcaactgtagtctttatattatttacatcttcttcaaaaatttcatatattgatttatctttgctaaaattcttttcgacccctagctttatccgttcactattatttacctgctgttgcattgattgctgtgtatcctttaaaaattctggatatccgctataacctaaaaatattacaaaccttgtcactgttgcaatacttacaccagacagcttggctaatttctctactgtcaaaaatggtgtgctattaggatgagataatatatattttgctattttttcctgagccttactcatatttggtaatttttctgctactctttgatatacttctgccattttaattctcctccccttttaaatgttatttttgatatgttatcattctcactttaatcttaaatcttattaaaaataaacgaaaaaaagatgctaaaaaaacaaacagttttttagcatcttcgcttcaaaatattttattaaatatattttaccatataatttaatctctgtaaatatattttctatctttttataaacccttaccctataattgcttttataagagtatctccatcacttttaattttatcattattaaagtattgataataataacattttattttaccattataaagctttctatttttagtagatttaactcctagagttttttcgaatggttcaaaggatgtaagaatattaaaatcccaagaatccagtcttctcttcgtagcccccatatgtttatataattcatcaagagctttcttttcacctattctttcaccataaggtggattagatacaatgaatccatattttcttgatgtagagaactccataaaatctctcttctggaattgaatatacttatcaactcctgctttctttgcattttccatagctactttaagagttttatagtctatatcatatcctataattttaagatctttatgtttttctgaatttcttgcaccatctcttactgattcaaacatatctttatccattgaaggccaagtttcacaaacaaaatttctatttacaccaggtgcaatattaagagctatcattgcagcttctactagaattgttcctgaaccacagaatggatctataagttcaaattcatcattccatcttgaaattagaagcatagatgcagctagtgtttcttttaatggcgcaattccagcaagttctctatatcctcttttatgtagtcctggccctgtagtatctattgtaagtgttacaacatcttttaatatagacacttctattttatatacaggcccactttcactaaattgttctattccataactttcagtcatgctttttactattgctttttttacaatcgactgacagtctggtacactatgaagtgttgattttatagatttacccgtaacatgcataactccatctataggaattaatttgctccattccacactcttagttccttgaaataattcttcaaaagatcgtgcttcaaattctgccattttaataagaactctatcagcagttcttaaatggatatttgctattgctatatccatttcatcaccttcaaaagtaactcttccattttctatttttaaatcttcatatccaagagctcttaattctttagctgttatgctttcaataccgaaagtacttgtagctatcaattcatgcatcatatttttttctccttctattcgtctgcttcagaatcatatatcttaactgaatcattcccatcaatttcatttagactaactgctataatttcatttttagatgtaggaatatttttaccaacgtaatcagctctaattggaagttctttatgacctctatcaatcaaaacagcaagctgaatcactgtaggtcttgcaacatcaataattgcatcaattgctgctcttatggttctacatgtatataaaacatcatcaacaatgataacctttttatccttaacatcaacacctaaatctaaactctttactctaggtgtttcatcaaggattgataaatcatctctgtataatgttatgtcaacataacctacaggaacttcacgtccttctatactctttatatattcagcaattctctttgctaaaggatatccccttgtttttactccaattaatactatatcttctacgcctttatttctttctattatttcatgagaaattcttattaaagttctatttacagctttttcatctaataatgttgcttttaatttcataaatttgcctccttaacttttaacttctacatttcgtttttcagtttatttattaaatcgcaaaagtattgtggaagttcacttgtaaattccatatactcaccagttctaggatgtataaatcctaatgttcttgcatgaagtacctgtccctcaagtttaaatttttgtctcttaaatccatacaatggatctccaacaagaggaaaacctatagatgccatatgaactcttatttgatgggttcttcctgtttctaagacacatttcacaagtgtatatccattatatctttcaaccacttcataatgagtcacagctctcttaccatcttctattattcctatttttaatctatctttcttacatcttcctaagggtttatcaatagttccatcattattttttagtcttccttcaattagagcataatactctcttttcattgaatgatcttttaattgttcacttaatttattatgcgcatcatcattttttgcaataacaagaattcctgatgtatccttatcaattctatgtacaatacctggccttatcactccatttatacttgacaagtctttacaatgataaagtaatgcatttactaatgtaccattatagtttcctggtgcaggatgaacaaccattccttgtgctttattaactactataacatcttcatcctcataaacaatatcaataggtatattttcagcttcaacacttagtatttcaggttctggtatcattatttcaatttcgtcagccttttttaatttataattactttttagtgatttgctattaactttaacattttccttttctattaatccttgaataaaagatcgtgatttatctttaaatatatttgataaatatttatctattctaagaccttcgtcttgttcatcaactttaattaatgtcttttccataacgcagaccctttcttctacatattctctaaaacattatattataatccattttaatttacaatgtaaagttaatattacaccactcttatgagacttatgcatgaaatattccttatgtagttcatatatatattaaaaaaacttattctttttataaaaataagcttacctaaaaataatataggtaagctcattttttattattcgttaacaaagaagctttttatttcatttaaatcttcattaaaagtttcttttgaagcatcatctctatctttttcattttcatccatagatacacttgcttctttctcgcataattcatcttcttcaataggttctgaaacattataatttttaataaaatctttttctaaatcatcaaaagtttctaactgtgtattcataaaatttctatattttgctctgaattttataaattcctgtttaactctttcatattcatcatttatagaaataacatcattatgagctttatccataactttttgtgctgtttcatttgcatttttaaccatcatttcagcttcttttttagcagagtttttagcttgttctgctgcattctgagctaataacaatgtattttgtattgtagcctcaattttagaatagtgttcaactttttcatttaaatttgtaatcttttccttcatattggcattttctttatataattcttcataattttcaacaatttgatctaagaattcatccacttcatcagcacaatatcctcttaatgctctcttaaattccttgttatttatgtccattggagttaacttcataatttcacctctaaatttatgtatatttttttatactaactttaagtcttccgcttttacttgacccaactatagttcctaatataaactttccaacacctcggattgttattctctcatcttcttttggctcgtaacttttatctcttatcttaacatagtctaccagcacttttccctgatcaatcatcatttgtgcttttccccttgaaacattagctaatttagacactataccatcaattctcaaagaagaaactaaaataacttcttctttgaaattaaattgaggtaaagaatcatatttttctaaaatttcaattttacaagaagactttcctatcttatctatattaaaaataagaaagctttcaatatcttcatgaattggtacataacaaacattatctttgaccaataaatcacctattttattacgttctattccaagagctaatattcctcccaaaaaatctttatgggtaagttcattaaatttcgacgtattttctattttcaacaatttcataggaaaagatgtgttatacacattattaaatgaaatcatccttctttctgaatcttcaaataccccgttactttctactttgcaagaactgttaataaaatttttttcaaaccatcgccatatgttaggagtataaaaactgttcccgaacataggtatttctttatctcttgccagtttatatttttcatataaattaagcacttcatttttatcttcatcaccaaattgtttattaattaattctttcataatactaataaagtaagcttataagcactcctcttattatatctaaaagaaataatgcaagtattggagaaaagtcaattggtgaatcactgacaaatttatcctgcaatcttcgacatggttctaagataggataagtaatgcttcgaactatatccataaactgattgtatctcatttgtggaatccatgatgaaatacattcaacaagtattgctaattcgattattctaaatataccacttatagcttgtattaacattttccctcctatttagaccaattaaataaagctttagaacttaattcatttttcaattcattagttacttcaacattagatggagataataagtaaactcctttttctatttgttgtaattctcctcctaaggcataacatgatccacttataaaatctaataatctttgtgcaatttttaattcaagtactgtagtattaactagtactattcttctgttctttaaagcttcacaaatttctgtagcttcttcataatcaacaggtttagttattgtaactttcacagacgttgatgtatgaatgtttacaactttattattcttcttatttgttataactggttcgattgattcctcttcttctcttacttcactttcatattcttcatcttcgtaatcttcgtaatcttcataatcctcaaaccctaataaagatttaacttttgataaaacattgttactcataaataaccctcctattttgttatataatttctttcaccaaagattccagttcctattcttactaatgtagaaccttcctctattgctgtctcatagtcatgtgtcatccccattgataatatctgcatattaatattattaaactttctcttctttaaatcttcaaagatctgtttagtttttctaaagtaatttctattgctttcttcatctccctgaggaattattaccattataccttttacagatacatttttacatttttcaatttcttgaagaaactcttcaagatcttcttctaaaattcctgttttgctatcttctcttccaatattaatttgaattagagtctctgcagttaaatctgctttttcaaaaactctctctattacatttaacaaattcacactatctagcgagtgaattagaaaaactttacctactaaatatttaactttatttgtctgaagatgtccaataagatgccatctaacatccttgtgaaaattttcatatttatcaacaagttcctggaccttattttctccaaagtcacgcattccacaattatatgcttcttccaagtattctaacggctttgtttttgatacagccagaagcattacatcatctggaatactttttttaaggtattctatattttcttttattcccattgtactgcacctataactaaatcctttctttacctcattttgtttatattctataaaaaactttaatttcctttaaaaaaataatatttttttattttcctgattcatctctttccatatatgtgacattacccatggctgtggatgcaggcattgttattttttcactttcttctatttgaacaaataatttctttatcataagctgctttacgtggcttccatcttcaagaagagctgctttaagcttttcaggatcgcctattgcataaattttaaatggtgctgattccatactataatcatcaaattgtataaatgcccacgcgcacacaacaccagaccatggaacaatacgatgattattcacgcttatagcttctgctcctgcctgtcgtaattcattcaatactagagccatatcactatcatgaagaagcttactcataacagcttcaaagccttcttcttttacatctgttacaccatcattaagagtaagtattatcccaggaccttctaccgcagtaaggccagtaaacattccataatctacaatctgttctttcatatcttgaagtatttcatcatttttcatatcatcatgcttatattgatttatctttctattagcatcaatatttccttcttttaaagctccaatttctttatacaatctagatctctcttcaattgcttcttgatattccattgtatttaatgatgtatatgattgttttctatcaaaattaaaatttatagctattagaaatccaagcattactgcggctatgaaaataaagaagtattgaggttttttcttcactttacacaccccttaaaaatcatctagattttgttttgcccttagcttctttctcatcttatgtattctcttttgcttaaactgttcaagtaaaagccttcttataattgcgaagttatcaaatattcttccgccaaatacaattacagctgctatataaataggtattccaagtttatctcctaaataagctaacaatgcggctaaaagtgcatttccaaaaaaacccgaaataaaaatatctggctgaaaatttttagataaattagctctaactgctccaaaaaccgaatccaaacatgctaatatggcaactgacatatatggcgataatttatctgatatatttacatctaatacaaaacccaatattattccaattaataatccaaccgttgcaatcaatttactatctcctattctttaactgattttataaattcattttttaatgactgagtagttttagcaataaaaatttcatcttctgtttttatttcattattataattaggaagagctaaatactccaaagatcctggaaatgataatcctacattaagtcttcctttatcccctatagcttttattataattttttctttaggatatattcttcctgctgatccaatagaaataccatttccagcagttttaattcctgtttgtggagttattcttatatcattaatcgaaatggcttcagcaccagaataccataaaagatttacaacatgaacaatctcatcttccccaaggtctctacttgtatcatttgaattagcattaaaaatagacgtttttggtgttattgtaagtactatccctggtcccttaacatctacaactcctagatgcattcttgcagcatcaagctgattttttatttcttttccaacgtcgccatcctttgaagctacttcttcaagttgttttaattcatctgacaattttgaatttgttgaaactaattcttctttttctttcctcaaagtttctatttcagaaataatatcactttgatcgtatgtgcttaaattagcagagttctgctttgataaaactttaaactgatatgataataaaaaacctagcaaaccgcaaacaattgctataaatatttgtgatttagacaccttcatttttaatattcccttcttcgtttttcacttcttctttataataaattggagatccatcaaatccaacatcgacatatcctttttcaatccctatttcagtattttcaacgatatgcattaatttattcattttatcaggtatattctcatcattacctagtcttccttcaacgcctccgatatatacttttatattcataaaatcacttaaatcgatagaatctattttataattagttggattgacttcttctatttgagaaaaaacttccaaaacatttataattctttggtttgtacctagaggatccccaagctctaaacttcctacatgttcatcaagtcctagtatctgtattagatttctgttatctatattatcagccttttcaagcaatactcctttatcactaaaaatatagtattgtccatctttttcgctgcaaaaaattccttgtttctcagttatttttatatttacctgtctaggatattctttacttatctcaactgtttttacatatggattttgttctgttgcttttattatgtcactagttttcataaaaaatatattttctccaatcaaatattgtgtcttttctttaacatcttctccactcataattggatttcctagaattgaaactttttttataataaatacctttgattttgttataaataaaatgattcctataaataatattacacacataagtataatcttttttactaattttctcttacgtgctcttatgacaaactcattggtaggctttttaactgattttattgtactcacctcaatctaaattataattcataaatttcatatataataataccactttacatgtatattttcattacatttttaattaattaagaaaagtactgttcatataacctttttattctaaattaattcatttaaaaagcagaatagtaataaatattatttaccattctgcttatttctttacccattaacaaatgaattataactaccctttaaattcatctttaccttccgtctgcctcgaaatgtttagaagtatacccatggccgtcatatttatcacaagtgaggtacctccataacttatgaaaggtaatggaacacccgtaacaggcatagatcctgttacaactgcaatatttattaaacattgtactgctataacagatgttattcctacagctaaaagtgtaccataagtgtctttagcttttaatgcaatatttattcctctccaaataaagactaaaaataatgcaattatacatatacaccctattaatccaagctcctcaccaattattgaaaatataaagtcattatgtggttcaggcatatataaagtcttctgccttgactgaccaagacctaatcctgttattcctccagcacctaaagcataaaaagattgtataagctgatatccgtttccagctgcatctttccatggatcaataaaattaagaagtcttgcttttctataatcactagatattgtaaaaaatgtagctgccgcaatcatagctggagctaccactccaaataaatgtttatccttagcacctgctacaaataacattatgaatgttactatcattattacagatgctatacttaaatttttctcagccaatattaatgctgcgaaaatacctgaaacgcctaagtaaggtactattcctgtccaaaactttttaagtccttcaccttttgcttctaatcccatggctaaaaatattactactgcatatttagtaaggtctgatggttgaaagcttaatggtccaagttttatccatctctgtgctccatttacatctgggaaaaagaacaccgcaaataataacggtatacatactaataatacccatactgaataggtctttattttgtgataatcaaatcccatcataaacatcattgcaaagaaccctagtggtacaagcattaactgtttctttaaaaagaacatactgtcgccataagtaaacattgcataatatgaacttgcagaataaatcataacagttcctactgccactaatagtaataccgtataaaatacaccataatctatttcacccataattcttctttttctctttttgggcttactgactttcatacataaatcctccaaatcaaattgctaaatggctataaaacctattatgcacaaaactgctgtcactaaagaaaatattgttactattttaacttcactccatccacattgttcaaaatgatgatgaatcggagccattttgaaaactctttttcctgtcattttgaatgatgttacctgaataataactgataatgtttcaactacatacattaaccctacgataactacccatagttccatcttaagcattaatgcaatagttccaactgctcctcctaatgccaaggatcctgtatctcccataaaaattttagctgggaatgcattatattttaagaatcctaataaagcaccacataaagctattgaaaaaatagcaacgtccttttgaccagttttaaatgcaactattgtaaagaaagttaaaactattattgtcacacttgttgcaagaccatcaataccatcagttaaatttactgcatttgttactgctgcataatatataataacaaatggtatatacaataatccaagatttaatttaaatccactacctaaaggtattagtatatctgttccaatattcttatatccataaactgctaatgctacagaaaaaataagaagtaaaatcattttttgacctgctttaagtccaagattatctttatgaattatttttaacatatcatctaaaaatcctataaatccaaatgctaaaaatgaataaagaattatcattttgggatctgtaaaacttggtcccataattaaaattgttgctgccacagaaataaagaagattataccacccattgtaggtgttcctgcttttttctgatgactcttaggaccttcttttctaatattctgaccaaatttcaacttgtgtaatattggtatgaatataggtccaagtattaatgaaaatataaatgatataactaatggtgctaaaattgtcgtgctgaacaaactatttattgtgtcccccattttaatctgcctaactttaggcagttcacctccttcgtattatttattctgtatttcttttattatttcttcaaattttgcacttcttgatgctttaactaaaatagtatcttcgtctttaatcatgctatttagtgactttattaaatcatccttagtatcaaaaactaatgtatttgttccaaatccttctttatagctatccttgtattcacctgttgtaagtaaaatatctgcttttcctttagcaaactctccaacttctttatgagctatatttgcataatctccaagctcacccattgttccaagaactgctatctttctatcaccagtataacttttaagtacattaatagcagccttcatagagtctggatttgcgttatatgaatcatttattattgtaaatttattatgttttataaattccagtctcattgaagttgccttaaaattatcaagacctttttccatttcttcaaatgtaagacctaaatcttttgaaatttgaattccaagtaatgcatttaatacgttatgttctcctaccatatttaagttaaatctatggcattcatctttgtaaacagcatcaaatgaagtagtctcacttgtaagttctatattttctgcgtataggttataacttttatcatatcctgttctttgaatatttatattcttatgatcttcatctttcacagtctttaacatatcattttcacagttaataacaagacagctatcatctttaaagaaatctgaaatactcatcttctctttaagtatattttcccttgtctttaaatattctatatgtgcaactccaacatttgtaattgcagctatatctggaagtgctattcctgcaagtgtattaatttcaccaaaattacttgttcccatttcaagcacagctacatcatagtccttattaagttcaaatatcattaaaggaagacctatttcattattgaaatttccttgtgttttgaatactttatacttaccacttaaaaatgctgcaataaggtctttagttgaagttttaccagttgatcctgtaataccaacaactttaataccaagtttctttctataatatctagctaaatctcctaaagcaactttagtatccttgacttttattacagttcctttgcattttaaatcttctttttcaaattttatctcatctactattacaacagatgcacctttttcaattgcactaacagcataagtgtttccattaaaatttgcaccttttaatgcaacaaataaattatcattttctatctttcttgtatctgtagaaattttattgaagtgtccatcattattttttactatgatttcaccgttaacagcttcaataacttcctgtatattcaaatccaaaaccatccgccccttcttttagtaaaagtccatatcgattaaaaaatatatctttaaactatctttttatattatctaatatttctttgactacttctctttcatcaaagtgtatagttttatcttttaagatctgatatgtctcatgtccttttcctgctattactataacatcatctttctcagctaattcaattgccttctttattgcatcatgtctattttcaataattatataattatctttatcaagaccagctttaatatcctctattattgccattggatcctcacttctaggattatcggatgtaattacagctaaatccgcaatatctataccaattttacccatttgaggcctttttactttatctctatcaccaccacatccaaaaatagcgataagcttacctttagtgaatgcttttgcagtttttaaaatattttcaagaccgtcaggtgtatgtgcatagtctattattatttcataaggaagattatattctttacctactctttcacatctaccaggtaccaaggcattttctataccttcttttatagcttcaatagctattcccatcttgtgacagactccaattgcacctaaagcattataaatattatattcaccaggaattccaagaataaattcttcttcctcatcaaggacaactttaaatttaatatctctacttcccataagttcatcatatgctttataatcagaatcactttttactgaaaaagagtaaatattttcagcatttaatttttggcaatcttttagcacctgtattccataattatcgtcaacatttattacttttatacagcttctttcaaacaatttaaattttgcatcgtagtaattttcaaaagtcttgtgaaaatcaagatgatctcttgtaagatttataaagataccacactcaaattttacaccataaaccctatctaatgctaatgaatgtgacgacacctccataacacagtattcaactcctttttcaaccatttctccaaataactcttgaagttccaatgattctggggttgttctttctgtatgaattttttctccacatatataatttgcaattgttccaataagaccaacttttttgcctgcacattctaatatatcttttatcataaatgcagttgtagtctttccattagttcctgttattccgataattttcatcttttcagaaggattaccataataatttgcgcccataagtgctaatgcttttcttgtatctgaacatttaactattgttattcctgtatcctctatatctacatcatcttgtataacaataaccttagctccatttaaaacagccttctcagcatatttatgtccatccgttgcgtatccctttacacatacaaataaatcatctttgcacacttttctgctatcataatttattttgtttatctgtacgtcctctgttccttgtaaaagttcataatccagtccgtttaaaatactctttaggttcatgtaatcctctcctaacaacttttttcagttaacagtctaaaaataacagttaacaattttgctaaaatctatagcttttattaattatcaaaaaagctttgcttatttgatttaatttttcacatttaacttttctttattaactatatttatctataataatacattgttcaagtaaataaaattctattaaatatcaccttctatatatttctacactttaaaaatatagcatgtgagcattaacccacatgctagcatttatcattatgatcataattttaatctttataatctaaacttaatgttaacttaaccgatgttccttttgttataacttcgccttgtgttacactttgcgtttcaaccattccagttccttcaaacgcaggtacaagacctaaacttgttaataactcatttgcatcttctttggaataacctctaacatctggcattacaacattattattataattcccatcaccacttgtgtaaagatttatttttgatccttctttaacagtatagccaggatatggtgtcatagatcttatagtatccccatctccttcaatttgacaatctagttttgcctcagacattgcctttttagcatcattaacactcattccacgaacttctggaattacaatatcccttggtatctggcttaaattctcatcagaaaatttatcatcaaggtaactaaaaatatcactaaatagagtctttgcagctggtgctgctacctgacctgcataatatgctccattacttggttcatctacagttatcataactgtaacctttggatcatctactggtgccatacctacgaaagaagatatatatttacctgaatatttaccattttcaactttttgagctgttcctgtttttcctccaatatgatatccatcaataaatgtgctctttccagaaccttctgtaacaacactttcaagataagatcttaattcagctgttttttcagcgcttgcaacagtagtttcctttggttgaaatgattcatctactacagtatttccattaccatcaacatgagttatttctttcataacatgtggttgaattaatgttccaccatttgcaatagcatttaatgctgtcatatattgaactgaatttacagtgttagtttgtccaaatgaaatagttgctaaatctgcttctgttactttatcaacaggctttactataccttttgcttctcctggaagatctacaccacttacttttccaaaaccaaatttacttatatattcacaaagcttctctttaccaatcatttgtccaagttgtataaatgcaacattacacgaattcttaataatatccggaaatttttgagcaccatgcccttgagttctccaacattttggatgtattcctcctactgccattgaacctccacagaaaaaatcagtatttgcatttgcagcaccttcctctaaagcagttattgcagttacaaccttaaatattgatcccggttcaaaagtatcattaacaagtctatttctccacattttatttgtcttttcactttcagtatttccatcaaagttttcatatccttcaaaaggagtattaggattaaaatctggcttgttagccattccaaggatttctcctgttttaggatccataaccaaaacagaggttgctttggccttattttcatcatatgcctgctgagccaccttctcagcaaaagcctgaatattttcatctattgtaagaacaacatcctttccattttgaggagatgtaaatttagatattgtatatggataatctgtattacttttttcaagttctgttatcttcattccaggagttccagctaaatatgaattatactgaagttctactcctgttaatcctacaccatcactatttgtacttcctagaacatgagcaagaaaattattatttggataatatctcttagtatctggtgatactattactccccttatttttaatgcattaaccttatcagcatcttcctttgtaattcttcttatcaatgtagctgaacctgcatctgcaccacttggaagttttgtctctagcttcttttttacatcttgaacattaagtccaagggcatttgctattgctggtgcaatatcatctgtttttattcccgaatcttctgttggcaaaggtattcctgcactttttctctgttctatatcctggtcagtcaaattactaagctttgcccttaaatatgtttttatagaattcaaatcaaaatcgactctatatacattagctgataccgcaagctcctttccattcctatctaatatttttcctcttatggcatcaattttaacttcactcgtccattgttcctctgccctttcagaataatcaggtgccttaacaatcattatatatgaaagtctcatagtaagtgttgcaaaaacaaaggtgagtgccgctgcagcatatgacaacctttttctagtctgccccctgtctttgaatttctttttcttcacagctgtttcctccatcccttttctataatgataatttaagtaaactttttaatgtttacttaaaaagttttcctgctgtttcacaaaataatactcaaatcactttgtactataataatattcttattctgattttttattcataccataatatttatttaagaaattaaacataatataattttcagcatactttattgatttaataaacagggtttcttatacaacaaaaaagacataggcattaattaacactttgcctatgtctaatctttaatctttatacttactttctaaagtaatttttacacttgttccctttggaacaatttctcctgatgatatactctgatccctagccgcaccttcaccttcaaatgtggctgtaattccaagtttactcaataattcataagcagactctttagaatatcccttaatatccggcattgaaaccttattgctgttgtcagaacttcctgacgaataaagttttattatggaaccttcttttatagaagatcctggatatggatccatacttacaattgtatctccatttccctctatatcacattgaatcttaatatcttttaacgccttttgagcatcttcttttttcattcctcttacttctggtataactacctctttagcaattttaccaacatcatcttgtgagaactgattattaagataattaaatatatcagtaaacaatgtatgagcataaggaactgcaacctgacctgcataataattaccattgctaggttcatctacagttatcataactgtaacttttggatcatctactggtgccattccaacaaaggatgatatatatttaccttctatatatgcaccattttccatcttctgtgctgttcctgttttaccaccaatatgatatccatcaataaatgctgctgttgcagaacctgatgtaacaaccctctcaaggtattttctaagttcagctgttttttcactacttgccacttctctattttttgcttcaaatttttcatccacaatttcgacaccattatcatcattgtgagttacttctttcattatatgaggttgtatccatgttccaccatttgcaactgaattaaaagccgccatatattgcattgaattaacagtatttgtatgtccaaaagaaattgttgcaagatctgttggtgatatattctgaggtattttaactataccatcagcttctccttgaagatctattccagtaaggtctccaaaaccaaacttctttatatattcataaaatttttctttaccaagcatttctccaactttcataaatccaacattacacgaattctgaactatttctggaaatgtctgtaatccatgaccttgagtttcccagcaattaatacgcctgttaccaaaatcaagaccaccaccacattcaaatgtagtattttcattaactaaattttcttctaaagctgctattgcagttattactttaaatatagatccaggttcaaatgaatcacttactaatctatttctccacattttttggatcttatcaccttcagttgctccatcaaaaccttcatagccttcataaggagtattaggattgaaatctggcttatttaccattgcaagtatttctccagttttagggtccataaccaaaacagaagttgcttttgctttgttgtcttcatatgcctgctgagccactttttcagcaaaagattgaattgtttcatcaatagtaagggtaacatccttcccatttactggcgatgtaaactgagaatctccataaggaagatcattattatttttatcaaattctcctattttaactccaggaattcctgaaaggtaagtattatactcagattctattccagtaagacctttcccatcatttcctgttacacctagtacgtgtgctaaaaaattattattaggataatatctctttgtatcttttgaaactactattccattaatttttaaggattttactttatctgcatcctctttttcaattcttcttataagagttgctgagccagctggcagaccactttcaagttttgtttcaagctttgcttttaccgtttctacatccatattaagagccttcgcaattgctggtgctatatcgcttgttgttattccatcatcgcctacaggaataggaattcctacactttttctctgttctatttctttagatgaaagctgatctactcttttatcaagataagctcttatagttgttaaatcaagatccactctataaacattagctgatactgcaagttcttttccatttctgtctagaatcttacctcttactgcatctatttttacttcgcttgtccactgttcctctgcttttcctgcatattctgggcgttttactatcataatatatgataatcttcctattaagaacacaaataaacaggtaagagccactcctgccataacagcttttttctgcattatactcttacgtttataactcttttttttcactgctagttcccccataactcttcttagtaaatacttaagactcagatgaatcattaaatcatctgagtcttatatttaattatttaaaaattccctctaaaaatgataaaaatgaattattacttttctttactgtatgattattgcttgttacatctttaaaataattattagaaaaatctatctttaccacatcatccccatgtggtatatgcattccaagaccattacttgcactttcttcaatattgcttaaagacgaatattttaaaatttttactcttaaagcttcattttcttcgctagtgctgcttatttgattttctaaagttgtcactgacttttgcattttatatattttgctatccccagctacagtaacacatccaaggcctaggataaccataacaactgtaagcatatattttctgtcattttgcttctgttttttaaatagtttttttctattgttcttattttttcttatttgctcttcacttttttttggcttacgtatagtcgtcctttttaaaggtttaacagctgtattaccctttataccataactgtattgtcctcgtggcatcttcttcacatccctactcatttatatacatattaaatattataccttctctacaacccttacttttgcacttctacttcttggattttcttcaatctcttctttagaaggtgcaattccttttttattcaaaactttaactaacggctttttaccgcatatgcacataggaaattcccttggacatgtacatggattttcaagttccctaaattttaattttacaattctatcttctaaagaatggaatgtaattatagccattcttccatctttatttagtctattgactccatcctcaatagttttattaagtatctttaattctgaattaacttcaattcttattgcctgaaaagttcttttagctggatgaggtccttctcttcttgccttagcaggtatagctgccttaattatgtctacaagttcaaatgtagtttcaattggcttctctgctcttctatttacaataaaattagcaattctcttagcgaacttttcttcaccataatctcttattatcttataaagctcttcttcgctatagtcatttataatgctatatgctgaaaagtcattatctctgttcattctcatgtctaaaggtgcatcttgcatataactgaagcctctttctgcattatcaagctgatatgaagaaactccaagatccattaatattccatcaaccttttctattcctaattcgtttaatatactgtcaatattataaaaattactatgaacatacttaacattatcatagtcttttaatctttctttagcagcctttaaagcgtccgtatcttggtcaattcctattaacaatccatttttagataaatgctttaatatatgcgatgaatgtcctgcaccacctaaagtacagtctacatatataccatcttctttaatgtttaatccatcaatgcattcatttaaaagcaccgatacatgtttaaattccataataaaaactccttatattcctaaatcattcattttttcagcaatgtaatcaaaatctacatttaagtcgttatagttctcccacatttctttgctccatatctctactctggataataccccaatacttactatgtccttttctatctttgcatattcctttaaattttgtggaataagtcctctaaattgcttgtcaagttcgacttcacatgctcctgaaaaaaagaatctaacaaaggttctagcatctttgtttgttaaaggcaacgtttttaatttatcctctagtatcttccactcttcaagcgggtaggcatacaaacaaccatcgagtccctttgtgatgacaaatttgttaccaagaccttcccttagcttagctggaacaattattctattttttgaatctaatgaatgttgatattctcctatgaacaatatgctcagcccccacaaatagtggtttatatatatttttaattacataaaaaccactttcaaccactttaacccacttataaaatacttattctataaatttaacacatttcctcctatttatcaaaaaaaaattgatacttttttaaaatctttttattagctttaataaaaaggctgattttttggtattttattgttattaacccttatttgctccatttttttctttaaaagtcaaaagtttaagatcataggaaatattacatcctgttaaaactacaaatattataataagccatagtggtccattaagtggagattctatggaatcagtagctgccataaaaagaaaataataatatataagataattaaataaaaatataatattaattgtagtttcctttctattattcattttataaaattttaatataagataaaatgtataccaatttttccatataactattgatgttataagtataacaataactaaatccacctttacccctccaataattatttccttaattattaatactttcttaaaaaaataataatacttgaatttagtatatttttattaatttactcaataaaaataaagctgataacaacatcagctttattttaactatattggatttatataataacatctaatctaataattgtttaccccataactattacgttatttgtgcttaactacaaattatagtatctcttttatatagaggcaaaaagacatttatgtaatataaaatctatttctcttttcaattttattagagtttcatggtctatatcttcaataacatcatctgtttcatcttcactaaattcttgtgtcaattcatcaaacaatgacataatttctcttctgttagtttccttaaattcatcaatgtattttcttactgctccttcaacatcttgtgcccagttgtcgattgcttccattgatatttcttgtattttgttctgccatgttaaagtatcatatagatatattattgaatctgtgaatacacttaaataatgagttataccttttaatgatgttgctcttattgccttaatcaatttagctaaaccattattatttatatcatattctgtatctgtactttctagtctcttgaagtttgttctagatgaatccttgtttccttttttcttgctatcaaaacttctaaacatttcaccagctgcctgtttcattgcatctccaatatgtttttttaggataccttccattacttcactataacatggaatattaactttaactttatcttctaaaactgtggctgtcttattaagtatttctttcatagccttatccaataaaattatttcatcttcaatgtaacttaatatgtgttctgtttcttcagttgtaagtttaggtacgtaataatgttgcataaatgaatatgtttcttctcttttagtccacttagtctcatcttccacatattttcttacatcttcttttattgtagcagctgccttgtcaataagtcttacagatttaacttttgttttagtgaatcctctctcaaggattgcagtaatttcttctttacattcaaaaaattcctttgtgagttttttcctctcatttaaatcattttgagcagattcaatacttgctatctttgaatttacttttatttcacattctcccaagacataatcctgataatttttcaaagcttctccaagctcttcaattttttctggattattaactctttcgtaaatataattccaaagtttttgcgcatcaggatttttttcactactgctttctattaagaaagtttcaacatctctatgtatgcattcatttatattttttcttatttcagttattcgtttattatcttctgtaatgtctttaggacacatatttattgcaagtataacttctactttatctgaaattatttcaccaacatatttaaggaactgataatcgtcatcatttagtcccactctgtaagatacaacataaacaatgaaatctccttccggaataaattcctttaaaatatcttcatgataatctacaagtgatccatatccaggagtatcaaataatcttattcctgcaaatttatcctctttgcttcttcctttatatcttaatctgtgtatatcagatgttggatttactaccaatttatcaaattcatctttttctaactcagtaatacttccatcttttccaactttactccatatatcttcttcgtcagaaacaacaacttcagcaacaacccctgttgtaggtcttacactttcaatcattatctttttttcaaggatactgtttatcaatgcactttttcctgaacttgtttctccaagcattacaacataatgagatggattaacaactctttcctttactaaggaatttttatctataatatctttaattccaagtgttttaacaatagaatcgattttttcttgtctcttaatacagttgtcaaaaatattcatctttattctctccttttttagactagagctttacttattagctcttatttaaactttttctcaattcattcagagttcttaaatcctcttcaaataaaagagtgtgattttcattataatctttttcatattgttcttctacatttctaatatcttctttaaaggttttttcaatttgttttcttaatcttttaatagaataatctacttcctcttgttttgctcttaaatcatctaatatttcttcttttagatagttttctaaatcttcaagcataggctctaaatctcttattgtataatttgctcttgtatggagtatctcttttctaagattttcaccaattattgaaaagacaaaaccaatacccatgccaaccaaaattccaagtgggcctccaagactacttatagctccaactgtaccaataagacctgaacttacacctaaaagtgatggaagtgatttttcaaattttactgtacttcttttattaaaaaacgatatattttcataagtaccgtcaaatcctttaatttttatatattgaattttgctattaagatttctaacaaggtcacttgttatatttaaaacctcttccataatgctatttattgctttatctgatagttccttatatattgaacttagtagttcaccatctacaatacctctgtttattattctctttagctcacaccttaagttttccatattataattaattatatctgtagcttcacttattatataatccattctatcataagaatagtctctaatattcttaaaatattctttattttctgctaagatttcctttatttcatttattcttcttattttttcaagttcattttcgctggatttattaagtgatgctgaaatataattttctattctatcattaatactaataagtacttcatctattttaccttcaagagtttgcatgagggaactattatactttacagatatactctttatctcatctaaaacattttctattccagaatccttatatagttggctgtcctttgtaaattttccttttacagcttcatatacattgactatatttacattaacatgcttatcatccttgtaagcactacttattccattaagaacaccttcattgtgttccttcgcatcctgtgcatcttcgttactttcatcattccatttattctgaacaaatattgtatttgataatttaggccacaatgcatttatgaaattcttttctgtccttgttataggaggattagtccttatcataaatatacctgcaactaatttattgacataatctagtgttgttttttgattttcaggcgtaagactcccaacaccaggaaggtctaccagcacaatattatcctttaatatttcactattattatataatactattttacttaccccaagttcatttgctggattataatcgttgtgaacatatttttctaactgttcagattttataacttcctttggccttccaacaaaatatacttcagcttcattaatattttctccataatgaacttctacaggcacacatgttgtttcatcaacatcggttggaagtacattttcactcataagaatagaattcaaaaaactactttttcctgcgccctgtattccaagtacaggaataagtatctcctttttatctagattctctataaaatgctcaaaatattctctataatcaaattccgaattttcattcatatacttttttaataattcattaaatctagaatcattaactatatcaatatatgtcattactgttctctcctctttttataaaaagctaatctcttttcttaccaaaaattcttgaaaagaatgatttattactccattctacttcttcttgaatacttcttattttttcacttaattcattttcatatccatgaattatttttattaatatttctttttcatctattttatcactaattcccttaattttttcacacatcaactgtttgctgctaaagaaattactttcaattccatgctcaagttcagttattttactttctatttcttcagttttaatattttctatcttttctaaaatctcatttttattcttacttgcatctttaactatttttattcctaaaatagcaagtttatcttcaagctgctcaaaagtcatctcatcaattttcgaatctaactttttaagttcttcattaattattgtatttgaactttcaaaactctctttaattttttgtgtatcttccatcaatttgtgtaaattctcattaaaaagtttattatgttcaactaccatcttactctgttcacttataactttgattatcgctgattctatggttgtttcaattccttttgttatacggtccatactaccattaatagtttcaatcatctcttgaaattcttcattgtcttctaaaaaatcaccaagttctttttttaagtcatttatttttttctccattggtttgattttttcaataacttcagctgtcatgctttttgatactttagctaaagattctatcatttccccttgaagttcacccatcatattttttgtcatttcatcacattgtattaatatagatttatcgtccatgattctcctccacattttgtccattttctaaaaagaagcttaaaatttcttctattgtttctttttcttctgctccacgtgataacatatttctcataagattttcttttatatctttataagtacttaaaacaaaattacttctactttgacactctataagtgccatattatatattggattttttgaatttataagcactttcccaattttatctttgttaaattttttaataagctttctctttaacatttccacttcaactaaaagttctttaatatttcttccactaaaaaattccttatatgaatcaacaactagattcacaataacagaattgtattctaaaaattctcttaaattcacattatttattatatatttttcagaattggcaatttgaattccattaaatataacatacatattgtagctttcaccataaatagtttttaacttttcataaagctttattttatttatgttattttcatagacaacatttatatttttgtacttaaatataccaaattcttttaattcattaatctgttcatttgataaatatattccacttattcttgcaatgaatcttaccgctgtctcttcatcccatgtccagaataaatcagtgctattattttttaaaagattgtttgataaatcattcatatatctaccaatgaatctataatttttttcacatatatcatttattattttataaacattataactacttttatctataatagcgcttactgttttaaaactctcattattatttaatgtattcaaagatttcgtttcatttaatgttgctgctaattcaagctcctcatttgtaggattttttcttagtataagttcatttcttattttttctaggtcattaaatatctgttttattttatatatttctatatcttggttctttttatcagttaattctttttcacgtttgctaacttcattataaaaaacattaattgatctagtgtattgtttagtccattctcttaatatacttacatattttactctgttaacatcacatacattttctagtttttttattgtagctgatttatctataattttctcatcaagtactttttcttcatatccccaacttttatcaaaaacattagagaatattcttttgcctttgttaaatacaccctgtttctttatcatttcagttttttctttatacttatgcataacttttacactttcataatccatacttggcagagcataactatatatgacatccatattaagctttttatataaaatatttttcttatattcacatgcttttactgttaaaagaatttcttcttcaataagttccttttctctattaattctgtttattattttctcatatgcttttaagttatattcttttgagttttttatgtcatttatacattcatataaaatcccatcaacactttctatttttaaagtaacttcttcttttaattttttaaaatttctgaaagcatcatcaatatcttttttagttacaatatctgaactttcatttatttttccatttttttcgtctattatttctctatcagtttttattatactttcaattttacttatgagacttatgcctctttccctatttattttaggcgccagtttactcacacacttttcaattccatgtataaattcattaaaattagactttctataaatttcctcatctttattaatgataccttttaaagcattcaaagcagaaatctgcactacttcaaaattttctgctgctatattatttttttctttagtacttactctatcattggaattacattgataaattgctgattttaaaagattttctcctctttttttatgtttttttaatatatcaagtttactctcttctacaattccattcttccctattttctcttcaactgaatcaatcatattctgaacaagaattatttgcttgcctcttctatttactattctcattttctccgaatttatttcatcactattggcttttacagttgttaaaaataagcatatatcaattgtaggaagaagtatctccatagtcactttttcatgaatttctaaatcacacgcatcaagaccaggactatctataatatgtatattttcatcaagcataaataagggagttgttatgtctatttgtgctacctgaagttcattattaggatttttgctttcatcacaatatcttcctatattttcttcatttagttcattatcttttaaaaccataggatttttatcattaaaatatactgtagcctgccttaaacttccttttgaacatgtgataattatgcttgaacttggcttaattgctactggaagcagcttttcttgaagaagtgcattaactaaagttgattttccactgcttgttattcccataatagctatacgtacaatatttttctttataaattttgctttttccttaagccatgcaacgtcattataatatctttctcttacatattcatttttttgtaatacttctgttatttcatctattacacttaaaatataattatcttttttcatactaatctccacaaataatattatgtactattaattctatattagcataataacccttatttatctaatataacttaatatattacatcttctgttataaaatttaattttcccttaacccattctaaatattaatgtatataaaaagaaaattgtgcataactatattcaatatcacgcacaattttctttattatataataattctattttctattaaatttatctaaatatgatacagccgaaagtgctgcaatatttccttctccagctgctttaatatattgatatggcattccaactatatctccagctgcaaaacatccatttaaatttgttttcataaaccgatcaacttcaacatgattttctgttacttttaagcctggaacaagctgccctggtgatacactctctcttaatataaataaaccttctgtttcaatttctctatctttaaggattaatttttctactttattttgcccttctatttttattggtatacctttaataacttctatcttaggatctaattcaatattttcattatacataggaatataataaactttagaagcaatagaagccacaaaatttgcttcactttcttcctttttattatatgcaataatagttactactttatttttatataaaggtgcatcacacgttgcacagtatcctaccccttttccaagaagtctttcttctccttcaaatggctttccaaaattaacccctgttgcaagaattactgttaatgcttcatatgtcttatcatttgccattaatgcaaaataatcacccattgaatatatattgtttattctttcattggtaattttaatatccattgatttaatatggctatcgaactgttcttttatttcagctccactcattccataaaaccctaaatagttgtttatcttttgagcttttaccaattttccacttaattcatcatttccaaaaataacaaatttcttttttcttatttttgcattcagcgctgctgaaagacctgccggaccacttccaataatagctatatcatatctttcatccatatactattcctccttataccacagttaatttaaattttaatagcttaatcttttttatagtatatgctaataattttaatttctcaataatacagtatatattttccttgcattttattaatttctagtaaaattcaaagggcaattttatgtattcacataaaattgcccttaattattcttcaacaagattaatagtatatcttctaagtttatgtaagatatacaataactacaacaaacattttagtactaatatgttaattctgctaaaatcattcccattctatagttagtatttccagttccccgtcctttaaagacactttatatccattagatattagccatacagctagatctgtaaccatattctttcttaattcatctcgcttacttactgcaaagacagctgaaaccttatttacgcctgcctgcttcccctgctgaatgttcctcagtattatgttcttattttcattaagcttttcttcatactcagtcacaatatctcctccttattattaatctgacataataatctaattcgtagatcactttaagcagaccattagtcaatactttactaatataagtttatgagacaagtttctgttttattactttatttctatcttataaaaacatttatgatactatcctatgtacaaaagccattaataatattatagtaattattgaaaaaaatactattcttactatatctatttctaacaaacctataagatattttatgatattctttatcttattcattattcttatatacaatatttattgattatcctttcatattaaattaatatttgtaacattttatagttacaattaattatcgctatactcagccttaaggcttatccccctatgttcaacagcagtagaaaacacaatttgtgtttcagtgtttccaaatttctgcaactctcctataaatgcatcaagttcaagagttgtatgatatgcaactttaataagcatagaatactttccggttacacaattacattctaaaacatttggacatgatgctataaatggataaaattcaactttctgtttcggagacatttccaaattaataaaagcctttatattataacctagttttaacggatctaaatgcgcagaatagcctgtaataactcctgcttcctctaacttttctatacgtgctgaaactgctggcgttgataaaaagacctcttctgcaagatgctttaatggatatcttgcattttcctgaagaagctctataatcttataatctattttatccatattatcccctctacttctttttgatatattcttaataccaatgaaaaagagcatatcaaataatcacaaattattgatacgctcctttgcgttagtaactctatttatattttaaagttaataacgtaattttacaatagtttttttgtttttgattaaacaaattaattttttaacagtttatcaatattttcaacctgtttttctaatcttaatattatttttgataaaacctcatatgttattttataagtatttctagaattatttacgattcttccttgaatatcaatgaacaatgcaagttcatctactgcaatatttaatgcatgtttaagatattcttttggtgttttagtattcggtataaacatactattataaaattcagttattaaaaaagatattttatcatatgttctaaagtctatttcttcaacttcacaattactaatctctcttttaatatctttatagtaagatatcatcttaaaactttcttttcgaaaaacttttcctaataaatttatagtcgggagatttctattctcatctattaaatcattaatcataactattcttttttcttctatttttatagttttatctacaatatcggctacattataaaacataattctccctcctatacttaatctttagtaatattatataataattttaaatatttttctataactcactcatattaataaataataattattatatagctaataattgtctcgtatctgtttttatttcatattcgttaggaagaatactttttagattatatattatatttttaaaattaacccccgttgctatacattctgctgtattttttttatcaattataagtctgttattataataatttttctgtctctcaattcgcaatatagctttttctatatattcagtattgttataaattatgggtacttttattcttatatctaaaacatagtctataagttcattatcttttaaatagaaatgcttttttgtttcatttatatcttcacaataaaaatcaaaatcatactgatcactataaaaatcaaatcctctaactttcaactgaaaatttttatcacataaataaacagtacatttctcacatccaatactatcagtatatattgctggatattttaagctgaccatacttttcatctcctcaaaccctattgttatatcctatttctctttttcccttttgactgtcactataatataatatcacacttttacattttatggtaaaacttattaattacatttatcgctataattccatttattacaccaattatcattccacataaaacatccgatggataatgtacataaagatataatcttgaaagtgcaattaatacacttataaccaatgcacaaactccgatcttcttgttaaaataaaacaaaactacagatggtgcaaatgagcacattgtatgtcctgatggaaatgaaaaatccttaggtgcatttataagcagtccattaattaaaggatatgcatcaaaaggtcttattcttgctactaatggctttaatgcaaggtttcctattaaaaagcataatagtagagctaaaaataccatatatccatattttctgtgtttttttatggtgaatagtactactcccacagtaatccataaaagcgccatattccctaaagaagtgataacaggcataattttatccagcaatggatttgtgatattctcctgaatgtaatttaaaatgtttatgtctatttcttgtattcctatcatttattcctctttcttaaaaactattttttactcaattctataaataactcaatatcatcttcaattgtttttaatgaagatttccaaaattctttttttgttatgtctattcccatagtttttgttatatcttctaaattattttttccagtgatacttagaagtttttcatactcatctacaaaattttctttatcatttttgtatttttcatacaatcctctagcaaaaagtaaaccaaatgcataaggaaaattataataattatattctggatcataataatgtggtttccaagtccacatatatggatgtagataatccctatcaagaccatctccatatgattctttttgtgcatttatcataagctctttaatttcatctacacttaatgcactttcttcccttttctcaaaaaacttactttcaaaaatgaatcttgaatatatatctacaattacttgtgtacaatcacttatttctgcttctagtattgcaagtgcttgttttttatctgcattttttaaagctgctctttttattattgtttcacaaaatgtggatgctgtttctgcaataggcattggataatatgaattcattgttgtttcattttttaaacattcaccatgaaaaccatggccaagttcatgagctaatgtaacaacatcactgaaacttcctccaaagtttaataaaaatctgctttcacctataaattgaagattttcacaaaaagcacctccaaccttgccttctttaggcattacatctatccagttgttatttacagcctttaatacataatctcctaacttatcactaaatgttctgaagtttttctcaacaaattttacagcttcatcgtatgtgtactccatattacattcacatactggtgcatataaatcataaaaaggcaagccatttttatgtccaagaatttcagcttttctctttagatattttctaaaaatagggaaactttctttcattgcttcaagcattacttctaatgtcttttcattcatcctagattttaaaagactttcttctaatggagatttgaaattttttagtctgcatacagtaagaacttcacctttaataccatttaaagatgcacaaacaccttcttcaatcttcttataagaattaatttcagcctcgtatgccatttttctaatgttttcatctttatcataagccatatttaatacaactgttaatggaagttttctaacttcattatcttcttgtatttcaaccataaggttggatattaagttatcttttaatttaatccaagcatttgatccagtatttctcatactagctattatattttcttccttctcacttaataaataagagcttgtttttataatttctttcaatatatactcatgttcctttaaatatacagattgatttatacattcatctatatctttaatggaacttatatatctttctatttttgtattactttcaactataccagttaatttatgttccaaaatatcactgtattttagtccaatcttatcttgagtattaacactgagcttaagatttataaacatagataacttatctcttaaatcattaaatattgtaaatttttttatatagttttctaaattttcaacctggtgttctttatctcttggtaaaaagtccacccatacatttatatcctttataatcctatccaaagtttctaaatctgtagtgaattcattactttcaaaaccttcatatatttcttttaagctccaatttaactccataatatcgcttcctttcttataaatattacgtctaatcataatatttaatttcactaattaatagtattacataattagtttaaaagtattatgaaaaaatttcaatgattagtgtataatagttttgttagtaattattaaatggaggtttttaatatgtatgaaatgaaagatgaatttaaaactggaattgattttattgatgagcaacatgcaagattatttgaaatagcaaatgaagcatatactcttctaaaaaatgattttacaatagacaaatatgataaagtcatagacttagttgatgaattaagggattatactgtttttcactttaatgcagaagaagaatatatggacagcatcaactataaaagacgttttactcaaaaaatagagcatgatgccttcataaaaaaaataaatgaagtagattataaaactatagatagtaatcctgataaatatattctagaattgcttgaattacttaatcaatggcttactggtcatattcttcataatgacaaactaattagcaaagaaagttaatttataaaaagacaagccatattgaataatacaaaatggcttgtctttttaaaatgtccaattctactaattaatttttatttctcaatttaaatttatcatatttttaaataaattcttaaaagtactatttattatacctgtggattagtttcaatatcttgaataatatcttttcccaatagttttttgaaacatgacacagcaaccataaacccgagaactattagcaatattgcaaatagtaattgcaacccatcagtaagaaatgcaaattcaccagttacaaataattttttaaatatttttatcaatgcttgaactaatgctgtaaatgttacacataacatcattatcatcggtccccaaagcataaatccttttctgtttgttgtttttaagaaaaccgcaagtgcaataaggactaatgctgataacaactgatttgcagctccaaataaaggccaaacattgttataaccacctagtgataataatgctccaactgaaagagtgaatatagttgaaaagtatttattagtcataatctttgtaaatccagacatttctttatcattatctaatgtatcagtcataaaaaattcttgaaaagacatacgtcctattcttgcaactgaatctaatgatgttagtgctaatgctgaaacgcacattgtcattatgcaagttgcaacatgttctggtattccaagtaaccctaaaaaccctgctacatttcctgcaaaaatcgaaaacggagttcccttaggcataaccccaccttttgctgcataaccaacaacaactaatgcgattactcctaatagtgattctataagcatagccccaaaacctattggaagcatatctttttcattcttaacctgttttgaagatgtttctgatgaaactaaactatgaaatcctgaaacagcaccacatgctatggttacaaataacgttggaaataacatacttccatttacttcaaatcctgaaaaggcaggaagattcattgctggatttgcaactacaattccaagtacggctccaacaatcatacctattaataagaatgtacttaaataatctcttggctgcattaaaagccacattggcataattgctgctaagaaaagatatacaaaaactattgcaagccatgaacctttacctaaaaatataggacatgcaattcctgctgcaagcatagcaattaaaagtataactccaattccaaattgaagaccttgactaggcttcttatacttgataaagagtccgaataccattgccacaactataaataacattgatattgacgcagctgctgcatttggtgcattttgtgttccatctgcattaaatccattgaatgtattagctaccatatctgcaaatgctgcaataactaaaagtgaaaaaatccatgcaaacaagaagaataattttcttccagctttacctatatatttttcaataatagctcctatggattttccttcattttttacagatgcatatagtgcaccaaaatcatgtactgccccgaaaaaaatccctccaattaatatccataataataccggtacccatccaaatactgctgcaagtattggtccagttacaggacctgcacctgctattgatgaaaattgatgtgaaaacactacccctttaggtgttggtataaaatcttcaccatcttcttttgtatatgctggtgtctttgcttttgggtcaatcccccatgtattggctagccatcttccatatattatataggctccacctaaaacaatcatagctagtccaatcattaataaaccattcatcttttcgcccccaatatttaataaatattgtgtgattaattatcttatacttcctacaattaatcacacttccttataatgacataacaatattatcactcagttatctatttgtcaattttaaactatatatgttgtatttatatcacgtttacatgatattatttaacactttattatttttatcctatattaattaattttcaatcaatatatacttattaataaattaatttactatattaatgcatatacgcttataaatgatatctatttaatgttataatgtttttataattacaaaatattccatagaaagagttgataccttaatatgaatccagaaattgaagatagaataagattgtattgtaagaaatgtcacatggactgcactaatttagaaataattccactagaagattcctatttagcaaaggataaaacagttaagatgttatttgataagaatgggaatgttaattctcttcccatgaattatacttacggtgagcaaacaacaaaatttattggaaaatattcaagtatttttatatacgcttcatttttaattgcaatattatttctagtattgtgtggactattaaagaagttctaaccttatctcacatatatatcagtgtcacttttttagtttacaattaataatgaacaattaacaatttcggtagaaaatataagattttctatgcatcaaaaaagagtacactcgtattttcaagtgtactcttttctttaataaaaacaaattacaggcgttcctacgcttatattattgtaaatagtctgtgcaagggaatatggaaggtttatgcaaccatgtgaaccattattcttgtatatatctccaccaaaattccatctccaacttgcatcatgaagtccaatgctattaccaatgaaaggcatccagaatgatactggtgattgataatcaggccctattaaaactgtatctttctgacgtgagtttaatgtatatactcctgttggagttgggcaaccttcaagactcatattacctgttactatatctccttcagcaactacatatccatttttatagaaccataaatattgtcttcccatatcaacttcaacaaatgtatttcctaaagtcttataatagcttgcatatgaattctgaacgaaagcaggattttttgttatattttgtccattttttatattttcaattaatgcagaagtttctgctactctatcaacactccagctatgattatttccactgctaccacctgaaacaggtattgtgtatcctaaagatgagctgtaattatcagctattgaatcaacatattctcttacttttccttcaagaattgttatctgaaattcaccattaatgtatatccaatcctttatagtgtttccatcaagaacactaccatctgtaccatagttatatgatatctttgaagaaacatatctattaagagtattctgtgcatttataactgcttgtgaagtagaagtatatacaggatccttataacaatttatagaatttaaattaattgttttttgtccattctttattgcgcttacaatattttgatataaaatatttttatcaatttcagttccataaatctcttttcttattatatatcggttccctacatattctagctttgcattctttgattcaattatattattttcatcaaaacatgaaagattattaataacattatttaataaattataatcaaaagaaacttctttagattgttcattaatagtttttaaatttatatctgatcctgttattttttctttaatgtttcctcgttcaattaaagttaaaacataactgctttcagaagaagctgctattttactttcatcatctttgcttgtttgtgcataaactgtttgatagcttaagcatagactcccaagcataataaataaactacaaaaaactgtagcaaatactcttgaaaatcctattcctttatttgcttctgttatcatttaaatttctccccccttactttataagttacttaatacttattctatatctacattaaatttcctttattatttttacttttttccttattaactattatattgtaatttaaaaatagatttgataaattcgttatagtataatatttataacttaatataaggaggttctgcctattatgactaatttctttgaacattcattgataattaataaaaagcaaacacttattgatataacatcgtatataaatgatgatatttcattaagcaaaatacaagatggaatagtaattgtatattgtccccacaccactgctggaattacaattaatgaaaatgcagatccagatgtagtagacgatcttatttatggatatgaaaaagcttatccttcaatagattctaattataaacattttgaaggtaattctcatgctcatttaaaatcttcatgtataggtgcatctcagacattgattcttaataaaggtaaacttgttttaggaatgtggcaagatatttacttctgtgaatttgatggtcctagaaacagaactttttatgtgaaaataattgaaggttaataagacatttacataaaataaaagatagttaaaaaaaataaaattccctcaataatttgaaggaattttatttttattttaatgaacaggatgacctgtattttcaatacattgttttatttctaatagagttgcagggctattataaataacttcaacacttcctctagccaagtcgacacatacattatttactccatctattttttctaatgcatttttaacctgtgtcttcatattttcattagcgagtccatctaccatataatgtgttctttccatattatctgctcctttcaatgtagcctaaaaaatgagtcttcattttaaaataacagttatagtataatcagaaaggaacaatattattatatttacttaattattacgagtttatatgttttccttacaattattttaccttaagaatttttttactaattttaaattacttttattatatggtggaaaaagcatagtaaaactaattttactacttttcttcaatatacttcttttatgggaaaatgtactgtagctttcttctccatggtatgatcccattccagaacttccaacacctccaaatggaagattagaatttgcaagatgtgttatagtatcattgatacatacaccacctgaagacatttcatttaaaatatgtttttctatcttaacatcttctgtaaataaatataaagcaagtggtttagataaacctttaatttgttttatggcttcatcaatattatcataaccaataatgggtaatataggtccaaatatttcctgggacatactttctccagtaaaagcatttttaacaattaatgttggttctataaacatatcttttttattataattccctccaaaaattatattttccttttctttgtctattatattttttagtctattaaaatgattttcatttattattcttccataatctttattgtttgaaatatcctctccataaaactcctttattgtttgttttgctttttttataaattcatttattacatcattatgaacaagtacataatctggagctacgcatgtctgaccattattaacagttttaccccaaataatccttttagccgcattatctatatttgctgtcttatctactattaccggacttttcccgccaagttctaatgttactggaataagatttttggctgcattctccataacaatttttccaatcctctcacttccagtaaaaaatatataatcaaagtggctcttaagaagatttgatgatgtttctacagccccttcaacacaagcaacatattctgggtcaaacacttcatttataattttcataagtatcatagatacattaggacacatttctgaaggtttaactactgcagtatttccagctgccagtgctcctataagcggttcaattataagctgaaatggataattaaaaggtcctattattaaaactgttccataaggttcatttattataatactcttagctggttgtaaaaatattggagtctttactttcttaggtctcgaccatttttttatattttttataaagtcctctatactgctgtaaataaatccaacttccgttgtataagactcaaattcatgtttcccaagatcattatttaatgctttaataatctcattttcatatttttttattacttttttaagatttttcaatgaatttattctaaaatttatatctttagttttattcgtatcaaaaaacttcttttggttatttaaaatctccataacatcatcaagcattaattcactttttcccataatatatcaccttttttcctattttataattaatactatttctttaaacaaaaattataatataaatataattattattacttaaaaaattatttcttactttttattagaatatcacctattttaagttcttcatcgcactgaatcgtaaaaatcatttgaggtacgttagcactctctatactttccccatcagattttcttctcatatcttttaagtttataattctattctctccttcagtctctaaaacttctacgtctacaccatttaaaactttatttttttgatttattgttgctattttattttcagaatcatattctattacaactccaacaatatcatagctttgtatatatgtagcacttccataggtttgcttaacttcgtcatcaaaataaaatcctgttgtaaatggtctatgacttggttttaaaagataatccatccattctggatcatacttataattttccggatcactcatatatttatcaattgcttgtctgtaagcttttactacagatgcaacataataaacactcttcattcttccttcaatttttaatgaatctattccacactccataagttctggaatatgttctatcatacataaatccttcgagttcattaaatgaactccatggggttctatttcaattttgctttcatcatctacaactttaattttctgtgaaggatcagtacaaaaattagtattttcgtctaatatatctatattattagaaatctcatgcatttcaccattctcatcttcttcgtaaagatgatatttatatctacatggctgtgcacatgcccctctatttgaatctctacctgttaaataattagaaagcatacattttcccgaaaagcccatacacattgctccatgaacaaatgcttctatttcacatgtatctggaagttctcttcttaattcttttaattcatcataagtcatttcacgtgctgtaactactctactgacacctgctctatgccaaaattttgcagcttcataatttaagcagtttgcctgagtgcttaaatgtatttctaaatctgggactgtattttttactattgtcataagacccggatctgcaacaagaactgcatcaacttttaattcataaagttctcttaagtaatcttctattcctgcaatatcactatcatgaggtattatgtttaatgtaacataaacctttcttcctcttgcatgagcatactctactccctcttttaactgttcatttgtaaaattatctgcaaaagctctaaggtttaacttgcttcctcctaagtatacagcatctgcaccaaatgttattgccgttttaagtttctccaagtttcctgctggagctaaaagttctggttttttcataagtaatctttagtaagaaatcctagttaaacttatatcctcacaaaacacttttttagcgtcttgctatttttctctcacttaaataaaaacagacattacttaaatttacgtttaacatagtctattttacctattgcgttagaacactacagaggatagaaattagataaatttttagattccttaccaaattcaccacctttcaatatgtcatgtactatatcccttattctactctaatctactaatatagtataatatagacataaaaaaatgtatactgctattagggtttatattcctccttaaaacatagataattataataacttataatattttttttattttcttcggataagttggatatatcaagaattgaattttgtgtattctctgaattattatttattaatcttttagtatgcctattaaagaagaaagttgacattgtacttgtaagcatacttaaaaaaccaactcctgttatcataagaatacaggcaacaatccttccacctcttgtgacaactgatatatctccatatccaactgttgaaactgttactatactccaccacagtgcatcaccataattattaattccaccattattattgacttcaaaaaaatacattcctattgatcccgcaatagtaataagaattgtaattccaagagcatagataaaattatttgtaaatacaacttcttttatatcaccaatcaaccttaataaatatgtaacaactcttataagttttagaacacttccatatttgacagaagcaaaaaatcctaatggaaatattgcaataagatcaattatattatgtaaaaagaacttctttttattttttgaaagaatcatccttataaaataatctgctacaaatgaaaagtaaacaatattatctattatatgtatataatataattctctttctgtaaaagaacttgaaaaatccatcatgacaattaatacagcaattaccgccattattcctgccacaacatcatatattaactctgccttttcatttttagtgaattccaaatccctcacttttcatctctccaaaataatatcacaatatttttaaatattaatatcttatccataaatactatatattagtacttaaaagacctattaaaacagactcataacacatatgctttagttttaatagatcttttactataaattgccctaaactttccttaatacactttttattttttttatttccttatagttcttttctctaatacctttagctgtttctatgattttttcatcatcactatacttaataaagatttctgtcagttcaattaaagattcatgctgcttaatagatgactttaaaaaaatttttcctatatcatcatctcttttacactcaagatttttaatcatcttttcatatgattcagcatattcatttatgtattcttcttctaattctttattaattgatggcttttggtttatactgtttaaaatttcactaagttctgtagtacattccattgcattctttattaaagcttttgccatatttcttacgttcttatcatctccacattttataaaattttctgacatgcatatttgaatctcattataatgaataacttcttctaaaaaatcaattcttatatcacctttcttatttatacattcagtacattcttttattgactttaatatttccgaatgattattcataaattcttttgtttgagcatccgattctgctaatatatttatggaataaataaacaaaagcataatgcttataattccacaataaagatatcttatatattttttcatgcatattttgctaaagtctaattatactttagcaatttttcacctcctgaataatagagtataatttattttttataaatcacagactttttattcataaaagctgaaaacatagtaaaaatattcaaggccagatatataaatatctagccctgaatattcttatagcaatgtaactattctaatatatatgcggtagccttaattctaccgaacttttcaacctgctcatgggtcggaaaccatacgtctactatatatgtcccatcttcttttgttttcactgctccacctctatcttccacatcaaaaactgaatcagctttataatatgaaagttctggtatatacaatttactacctaatgaaatactagatggtgctgcaacaactcctactcttgtttctgttccaagggctgttttccccccccattttccagaacacttctcatcattacagtatgcagtaagctcaacattaatcttctttccctttggtgtttctgcagacttttcctctactgaaacagtttcaacattaacttgattttgtatactattttctgcttctgattgagaggtattagttaaatcttgtaccggcgcttgtgaagtttgctcttctttcatatcggttttaacatctaatgttactggctgatactcttgattatgctcttcaacataatcagatttaacatatccgacaacgttatcatttccttctatttcataccatccttctttttcatcaacaatattaatagtttctccattatccaatgtattacctattggactatctacagaaggttctcttcttacatttaatatactttctacattaaccacagttccttttttttcatacttactataatcatctgctacaatatcatttgttttattagaatataataattcttcatgatattcaaaagtactgttatgtttataaacataatctccaccaataataactgtacctaggcagagcactgcacatcctctatagatatattttcttaatttattcaaaaaaccactccttgttactttttgataactgcatcagcatttaaattatttatgctaattttttaagctgctatctattcctcaccgatatggcatgaacacattataagttatatattttttcttttcaaaagaagtattttcaaattatgtacatattttttttacatactaaatcatatgtgttaggacaaacttttttaatatatttttttccatttattcaataaatttataggggtttatacaaaaatttttcttgaaaaacactaaaaaaagtgatagttattccttatttttttgtttttatacatatataattatttatatttttacttcataaaacaaataatatatctatctatattacaattataaatctacataagttctatttttaataacgagaggaggttatgcagaattcacattttattctgcatatttttataatggcaaaaaatatgacttttggtaatccaaataaaatattaattacttttgcacttccaatggtaatgggaaatatttttcaacagttatacaatatttctgactctataattataggaaattttttaggttctaattcacttgctgctgttggagtatcttacccaataacttttctctttatatctatcgccagtggacttagcataggttcaagtgttgttatttctcaaatgtttggcagtaaaaattatatagaaatgaagaattcaatttatacttctctaatatccttaatatttttaagtatattattaactatttgtggcgtattttcttctcatatgcttttaaggcttttgaagactccttataatattttttccgatgctaatttatatttaaaagtttactttttaggtcttcttcctatgtttttatataatggtactacttctgtttttaatgctcttggagattcaaaaactccattatatttacttatattttcttctgtactaaacatagctttagatttattttttgttacaattatacagcttggaattttaggaattgcttttgctacttttactgctcagcttgtttctgctatattatccataatatttctaaagaaaaaaatcaaaataggttttaatcaagaaataaacaataagataagtcttcatattgatataaatatattgaaaaaaataaataaaattgctattcctacaatgcttcaacaatccactgtctcattaggattaattttagttcaggcacttgttaattcatacggagcagatattgtttcaggatatactgctgcaacaaaaattgattctcttgctgttatgcctataattaatcttagcaatgcagtttccacatttacagctcaaaatgctggtgcaaaacttatagacagaataaaagaaggttacaaagcagctttaaagttaaccttaattttttctatatccatcactattattctttttgtctatgggaaaaatttaatagatatgtttgtagattcttctgcaaattttcttgtaatcgctactggaattgaatatttaagaactgtttcattaggatatacattaaaaggtattagcagtactgcaaatggaattttaaagggctgtggagatatgaaatttttcttattaagtactttatcaaattttggaataagagtatttgctgcatacagtctttcatctttaataggtcaaaaagctatatggtactcaatacccataggatggagtattgagttgttaataagcaattacagatactttagtggaaagtggactcaaaaaatcaaactttaattttcaattaaataaattactcccttatttcttccaaactcttttacttgttcgtgatctggaagccatatatctattatgtatgtgccatcatcttttaatcttactgccccacctctgtcttcaacatcaaaaatgcagtcctctttataatactcaagttgtggtatgtataatctgcttccaagtggtatttcttttggggctgcaacaacaccttttcttgtttgtgtctgcatagcagtttttgatccccaagcttctgaacatatactacagttacaatatgcagtaagttcaacacttataggcttatgtactttctttaaaagattgtttactatattttgttctctttcttcatatgtttcattaggaggaatatcttcatattctgcaacataatcttcatttacataaccaaaaatatcattatatcgtatataataccattcatttttcttatctaatatgtcaaaagtcattccttcatataaaacataattaacttcactattaatatctgcatcttctcttatacacaagttggaatcaacttttataacttgtccatatttcttaaattcatcttggggctgattttcttcaattttattttttgatgatgcaatattaatttcctccattgttaccacataataagcacctgtaacccctaaaactatagctatacatatatataaaaaatataacatgtattctattttcgacaataaaccacgtccttacttttgtcacaataatatgactaaaaatataatttacttgagaataaacagtatattacatgcttattctcaactttctaaaaatctttatatataaaatttaatatatatgttgcagtaattattctgcatataatttcaaaaaatcctgtaaggattttcagcttaattgtcaattctcaactgtcaattgtcaattgcaatatatatatgttttttaaattaattctatatctgccattagtggataatgatcagatggatattttccattttcattatatctcacaatttcaacattattgactttaaattcttctgatacaaaaatataatctatatgaagtcctttttctttccccttaaacatactcatagttgaattcatatacaatcgtttatcatattcctgtactgcacttactttcttgcttccataaactccagaagataaattttttataagtttactatcaggtccagaattaaagtcacccataattattattggaagatcttcttttatctgctcttcttctattaattccataagcctttttaattcatattctcttgcttttgatgtaaaacaatctaaatgagaattgcatactcttattttcactttattacttaactcaattacagccgttgtacaaatccttggaaatacggaaaaccattttgaactgcccactgtatctggtgtatcggacaaccaaaatgtttttgattcaataatcttattttctttttttattaaaatatcatttctttccacaaaaaattttctacttcttggggtacctattatattataattatcggaattcttctttatatccttatacatattttcagtagcttcctgagttcctataatatcgcatttatatttatctattatattataagtaatatgtcttctatttttccaacgattattaatatctaaaggaaaatcacatcgcaaattaaaagtcatcactttcaactatatcacagcctcttataaatttttctatacttttagtattaaaaaggcagactaagtttatacttaatctacctataaattcttctaaaattttattttccttcaccgcttacaactgatgacacatcagtatctgaaactgctttctcagctgtctgtggaatgttttttgtattatctagtcctatatttttagataatataattgcagtattagtaaaatcatattctctactttctacttttactaaatcagttaccatcttaccattttcatcaaaataataccataagcctccatttgtcatccatgtattatatgccatagtaccatttgaccacatatagtaccagtcgcctttatcttgcaaccatccagttactggaactccatctgcacctagataataccagaaattatcaataaaattccatccttgtttgatgccacctgcttctacccatacattattattatatgcatctttcttccatgcagcttgtgcagatactggtagtattccaacaactgataaagaaactaatagtgatgctattatctttttcttcataaaaaaaccccctatttttgaatatacatatgttacttattaataataaatcataacatatatttttttatatttttacttgcataagaaaatagacatatgatatatgtaaaccatatgtccattctcaaaaatgctaaagtttgtctgcaattgttcctaataaatgtgctgttgaatttagttcttcaacagatgctgttatctgctgtaatgcagctgattgattttgagatatttcatttgtactatttaagctgtcatcaatacttgaaatagaattagaaatatactttataattgtatcaattttattaattgattctttagatgtattagaaagctttcttatttcctgagcaacaacagcaaaacctttacctgaatcaccagctcttgcagcctcaatcgaagcatttaatcctaaaagagttgtctgctttgatatatcttgtataattccaactatttcatcactatttttagccttcttattagcttcatttgtttctctaagaagttgtgtattcatttctgctaactgttgtaccccaacagcaacttcattaatacctgctgaaatttgcgaaagagattcaactaagttttttgtaatattcttaacctcgtcttttatatttacattgttgtctaattcgttactcatttttttccccctctataatataccgcatttataaatattttatattatgtaaagataataattgttaaatttctttaatataatatgacaagttcattatatcattatattattttcgtgtaaataattatcaattaatgttatgatgacgattttaagccatattttcaacattctaaccttattatcccaagtaatctataacagtctgcataaatagagctgctcctttatataaaacagaatcatccatcataaatttagaattatgtgctggatatataactccatcatcaaaaggaagaggattataaagtaaaaaataacatcctggaactttctcaaaaaagaaaccagcatcttctgctcccatattataatcatttaatacatgaatagattcctttcctataattttttcagcagaagtaataaacttatctaccatgtctctgttattaacaactcctgagcatccacctaaaaagttaatctcatacttagctttcattatttttgtaagtccatcaactatttctactattctgtctagtacatactctcttacttttgaatcagtacttcttagtgttcctttaacttccacaacatctggaataatattattagatcccctacctccttgaatacttgtaaaacttataagtgtaggtattgtttgatctatttctcttgttaatatatattgtatattattaattatcaatgtagctattgatattgggtctatgcaaacatgaggtgtagatgcatgtccacctttccctattatctttaaatttataggatcttcatatgcagacatacttccatatcttactataacatcaccattttcataatctcttatagcattatcagtatgtagagcaagcatagcatcaacttttggattttctaaaacattgtcttcaatcatagccattgctcctccaggaccacactcttcacatggttgaaaaatcaatttaacctttccgtttagttcatgctcatgattttttaatagttctgcaagtcccaataaaatagcagtatgcgcatcatgtccacatgcatgcatattcccattttccgatttaaattcaagatttgtttcttcttttacaggaagggcatccatatctcccctcacagctattgtttttccctcttttttacctattactgcacaaattcctgagtggctatcatatgttttaaaatcaatatttaattttttcaatctatttataacatattgagctgtttttggaagtatcattcctgtttctggaatcttatgtaattcccttctatcttcaatgattttactgcttatattttttgcttcttcaataatattcaaaaaatttcccccttgtcactcattgctctaaaattattttattaatataaatattatactataataatataattatttatattagtttaccttaagtataaatttcgtacttaatcacataataattatgattaaatatttttatacgaaagatgtgatttattatgaataaagtaaaaagtaaacaatcccatgatttagcaaaaaaaatgattattgaaggagagtcttttgattccataatggaagctacaaatttaagattaaaagatttaaaaagaattcagcaaaatgaaatagatccacacttctaaattataatgcttaagaggattaccacaaaagtaatcctcttatactatctcttcttattatttttttcttttataatattccttattattttgttaataaatccaatcacatatattattattagaataaatacaatttcaatattattattgattaattcttttaatccctccattttttatcctctccttctgagaaaaacactatacatattccaacttaattctccctgtaagtactatttgtgaacatcttatatttagtgttgaaatctccacctagaactttcaattaaccggatatagaatttttagctttactttattcatttatcaaaattaattagtagttatctttaaatgctttttttagtagcagaaaatcttctaaatcatttagaaattgaaatagtaatgctctattttcaaattcttctctattcttagggaggtccatttttttatattcatttcttaaaatattaagttcattgataagttccacacaattattatctttatgaatattaaatgcaaccttatatgtataatctgataataattcagtttgagaatacgtcatataaaatcttgaaaaatgttttttcattctctttattgtttcaaattgactagctctcatttccatatagcttaaataataataatcattttttaaaattaagtaattatttaaaatatttttagctatttttctattattctctataagtttttctgtaatttcaaaaatttctttttcatcacttggaaattccctaacaattaagcttccagccatatcacttaaaatagttctatactgctgctctattctttctctattaacttcaaattcttcctctaagtctggtgtatataaattaaataacatagcaacacatacaccgattattgcaagtgctccctcatttacaatccagtaataatttatatttgaattagttaaaagatgtgttgataaaactgctccaacaaccatactttcttgtattttaaacttaatagttattggtatatacattattaaaaatactccaaatattattggattacttccaagaacaacatataaaacaaaagaaaaaattattgctataaaacatgctgctattcgttttaagcttattaaaagagcttctcttttagtgtcttgaatacttaatatagcaattattcctgctgttacaccaaagttaagtttcatgtaattagctatcaaaattgctatagtagctgataaggccatcttaaatgtttttgattgaaaatattttatcattagtttactcctgtattttttaaatattcaattatataatacctaactttgtaattatatatattgacaataattaatttatattttatcctttccattgaaaggagctattatgaacgaacaatattatgaacaattactaagtataaaaactaccggtgaacaaaagatatttaatgattcacttcattaccatagatatgaagcaacttcttataattcactccatacattgaccaaagaatattcctttaatgaggatgacagcattatagattttggatgtggaaaaggacgtcttaacttttatcttaatcatttcttcaattcttatgttactggaattgaaatgaataattattattatgaaatttgtactgataataaaaaaacttatttaaatgataataaatctaatgactacaacaaaattcaatttataaaatgtcttgctcaagaatataacataaaaatttgtgataataagttctattttttcaatccattttcacttcaaatttttatgaaagttgtaaacaacattcttgactcagtagatgaaaatatgcgtattgttgatattattttatattatccttctgaggattatattttttatcttgaaaataacacatgtttttctctctacaaagaagtgcctgtttttccagaatacctaaaagacaatagaaataaatttcttatttatagactagattataattccatataaaaacataagcttaaagaattatataattcactttaagcttatgttatttatttattaaatttttcttttaacgcacatttagcaatttcaagtccatgtgcggcagatcttttataccaactatacgcactgcttaaatttctctgtacacctttacccttataatacattcctgcaagattgtattcagcataagggtacccaaattctgcagcttctttgtaccattttatagcttctttataatcacgttttacgcctaaccctttttcatacatatatccaattgtattctgtgctttttcatatccctgcttagcgctcttttcataccatataaaagcttcttcgcagtcttcttcaacacctttagaatgcatatacattcctgcaagattatattgtgcaaaataatctccttgaatagcagcttctgtataccattttagtgcttctttataatcacattctataccttgaccttcttcatacatacatcctagattacactgtgcattacaattccccttgctggctgcttttttgtaccactcaatagttttgcagtaatcctgcgccactccgagtccacaataatacatatcacccaaattatacatagctacatcataaccagaaaaagctgcttttttataccattttacagcttccttataatcagtatcaactgtatctccattaaaatacctatctcctagtatattttgagctctagcattacctctgttcgcatattttcttaggctagcagtatctataaattgaaactcaacatcagcttctttataaaaacttaacttactagctaaagatacaactatacctgacaacccaattcccccatcataatttacttttcactcaaatccctctaacaaaccctagatatatttaattctacaatacttttataacacaaatttaatgatttggctacacatataaagtaacattataaatatattttcacttaaaagtcaataataaatatactaataaaacaaattcatattattaatatacttattgacaataaaaatacaaatactacataataaactttatatagatatatgtgtattatattttaaatattcataatatacataattaaaaacgaataataattagtattttgataatactaattactgaataattctctatctctcctaaacgaaatacaaataaagaattaaattttattctttatttcatattactatgagtaataatcataagtagtaatatttatattatataattctatcaaagtttaataataattattaaagtactttttatttaacaatttttcttgaagctattcttgttataaccaagtgactgaatttcagtattaaataattcctacatacaaacaagtaaaatggtacccaataaaacaggtaccattttatttttatatattttaattgagtttttctcccaaatatccacttgttcctccggatacatttataactctatatcctgcatccgctaactcagctgctgtaataaaactccttcttccagtttcacaaattaaatagtattcttcatctgtattcaaataatcatcataattctccaataattcatgcatcggtatgttcttagtgtatttaagactttttaactcatattcatctttttctcgaatatcaatcaaattaattttatccattatatcttctagctcattaacattaatatttctaaattcattcatttgtttcttctcttatatacaaatatataagaatcctccttaaattaaaattttctctttatttaatattcacacttgaattgtttatcatgcgcagttatagaatataaataaaaataaaggactatcaaaaattagatagccctttattatttattttagtataaaggatgtttatcacataaagcttcaactcttgctttaagacctgataaatctccctctctatttgcaatcgcttcatccataatagctgcgatttcagccatatcttccttaacaaatcctcttgtagttattgctgcagtaccaattcttattccagatgtaacaaatggacttcttgtttcatttggtactgtattcttgtttgcagttattcctactgaatctaataattgttctgcttcttttcctgtaatatccttattatttaaatcaactaagaatacatggttatctgttcctccagaaacaatcttaaagtctctctttattaattgttctgcaagttcaatacaattctcaactacattttcagcatattctttaaatttaggatctaatgcttccttaaaacatacagcttttgcagcaataatatgttctaatggaccaccttgaattcctgggaatatgtttttgtttaagtccttagcatatttttctttacaaaggattaatccacctcttggacctcttaaagtcttatgagttgtagttgttacaaaatcacaatatggaactggagatggatgaacccctgctgcaactaatccagcaatatgagccatatctaccattaagtacgctccaacttcatctgctatttctctgaatttagcaaaatcaattgttctagagtatgcgcttgctcctgcaacaattaattttggtttacattctaaagcaatttgtcttacattttcataatctatcatttcagtttctttgtctacgccataagaaacaaatttaaataactttcctgagaaattaactggagaaccatgagttaaatgtccaccatgacttaagtccattcctaaaactgtatcacctggttctaatactgtaaagtatacagccatattagcttgagaacctgaatgaggttgtacatttgcatgttctgctccaaataattgttttgctctatcaattgctatttgttctatttcatctactacatgacatccaccatagtatctttttcctggataaccttcagcatatttattagttaaatacgatcccatagcttccattacagcttcactaacgacattttctgaagctattaattctattccttttctttgtctgtctaattctttttcaattagatcatagatttctttgtcttctcttttaatgttttcaaaattcattttgcaatcaccccaacatattaactatataagtaataaattatattcttttataataacaaaactaataaaagaatatccatatttattcttaactatatacagattatattatttctgagtatatttatcaacatttttttatgtttactttaaaatttcttatttataatattaaagatgtatattttttttaatttttcaaaagttttatgaaaaattttaaaataatctccctataatcaataaattatttatgctataattcatttgataaaaaaaatgtgaggaattaatcatggatttaaataaattgctaaatatttcaactttagctgggaaaataatgcttgagagtggtgcagaaacctatagagttgaagaaactatagtaagaataggtttatcttttggtgttgatgatgctgaaagctttgtcactcctacaggaataattacatctttaacaaaagattctacaactgttactcttgtcagaagaattacaagtagaggtgtagatttaaacaaaatagatttaataaataatctttctagacaggttcaggctcaatcaatgactattgatgagttgaatactgagcttattaatatttctcaaagtgacagatattcagctgcacttacattattttcatcttgtgctgctgcaggttgttttgcacttatgtttggtggcaacataaaagatttttttgctgcttttataataggagcttgtattaagatagtttccactgtttgccaaaaattggatataaatagttttttcatcaattcacttggtggagggttgtgtgcaatactagctataatactcatgaaattaaatatttgtgctaaccttgataaaacaattataggttccattatgcttcttgtaccaggactaacaataacaaatgctattcgtgatactattgctggtgatttattgtcaggaatcacaaaagctgctgaggcatttttagttgccatatcaattgctgtaggtactggtgctattttaagcttattcttaaatacaattcaatcataagttattataatttttattcggaggacaatgacaataatgattattcaaacatttgtatcttttattgcatctttaggatttggaataatttttaacataagagggaaaaacctattatttgcagctctaggtggaggattaagttggctctgttatttattttttagcagattcaacattagtgatgttcttgccttctttctatcttcagtaatatttagtatttattccgaaatatgcgcaagaattttaaaaacacctgttacaacaattgtagtatgtgcactcattcctcttgttccaggtgctggaatgtactatacaatgtacgaaacaataactggaaatatttcaggtgccattgaacttggtcttacaacaattgcaaatgcaggaagtctagcccttggtgtaatatttgtttctaccataactaagcagattacaaatctaaaaaaagtaaaagcaaaactttttggaaaacaaaataactctatgtaataaccaaagaacgtattctgactatatataagtagaatacgttctttgattattaggtaggtgtatgtctagcaattaattttttggtctaagcatatgttttttcatgtcttagccttataatatattatatttaatttattctataatatgcgtaatttatctttcctgtctttcaattgtctttacccttgatttcacatcatctaattcatctttcatgtcttttataatacaatataggctttcaattaacttttcattatcactactcgtttcattttgagaattgctgtttgtattgctagttgatgtagtctgattggatgaacttgttggacataatggattagtaacatttaaattttcaggactataatagcgtcctggaccactttgaaaatactgttgctgtccagaataagtttcaatagcctgtcctactagttgtatccagtttcctactgcattctgaacattaaatggaagttttcctgacatcaaatcacctaaaatgtcacctatgacaacaaataacataggatttattttctgaaatccacctggcatatcattacatccatatccattttcatttgtgtaaaaaaatccataattaaaattattcttgcagttgcttttagaatcttctttttgtgaatttttattattatcataattagtattattttctgaaaaaattgcatcactatacttttttaaaaattcgttaatttcatcataattcatatgaacctcaaaaacactttttattcattatatttataataaacattaaatgtaccacaaacaaatcaaatagactttagaaagcattcccaaagcctacttattctcctttttttatattatcaagatcccttttcatttcatttatttgactctttaaatatcttatttctttttcaagatttttgacctttgctttatcttttgaactttttttgtgatcacttttaacttctccatcctgtacataatctgtatcagtacaaaatgaattgcttacattataatatttaggattaaaatatcttccgggacctccttgaaaatattgctgttgtgcattatatgttaaaattacctgtccaataagctgaagccagtttccaaaggcattctgcacattaataggaagtttttctgaaattatagcgcctataacctcacctaccaaaacaaaaagctgagggtaaacactttgaaagccacccgtcatatccttacatcctatataactatcttcatcaaagctgcaccagtcaatatttccatcttcatcaaaagaatatccacatgctttcattatatcttcaaatgaattaaaattgcatttatccattttaccctctaaaactaatgtttttttattatattaaattaaaccttataatgttctttacgttgctataataaactatatttatatactttaattaaacttcatacattttttagctgataatataatcatctaatttctcatgtgccatataaataatttcttcatgacatttgttcaattcatttaattccccactttttatatgtaatatttcatttgcgatttgttcaattctactcaagaactctttaaattcaatttctttgaaagaatctagtttattgcatatacctttaggcaactcactttcttcatctataccatacatttgtctattttctttaatcctaacttcctccatcacaattgtaattatctcatttatattaaagatttttgcattactcattttccttcactccttcatttatttcatagattttatattgtatattctctggtgaaattcacactataatttatctcatattaaattataacatctattaataattaacttttttataattttccaatcataagacctccacacgttaacagataagttccacacgttaacaccttttttatacattttgtattgaaattgtaatttttatgtatttatatatacaataaagttaataataaaaaataatgaaatatttatatacatgcggggaggtatttttatgtttttattaagcaaagatactataacaaaaaaagttatcggcaccgtaagcgaaaaagattgtccatcatgtaaaaagaaatcttattgggaactatgcattgtcactcattggttttcaatattaaccattccaataattccttataaaaagtctaattgtcttgtatgtgacaattgtgattacttttttgaattaagttatgatgaatttgagacaatacacaatgagatactttcaggtttaaaaagaacagaaccagatgcattaaagtacattaataaaaatcagcttcagattaattatctaaagactttagaagcttataagtaaaattttaaccttataccatctaaatctcaaattacaccaatacatgttttctttacattatggtgtaatttttttatattcatctttattaatatatcaatataaattataattgtatttaaaactagaaaaggagatgaaataatgaagattgaatttgataagaaactttttaaatatgcagtttacataagtattacagctatagccatatatatagtatttttactgctttttaatataaaaaatattttaggaaatgttttatcagtaattttttcaatcataagcctactgaaacctttattacttgccattgtaattgcatacatactttatccaattacaaaactaattgaaaactttcttgagaataataaaatattaaaaatccaaaaatttggtacaagaagaattactgccgtaattctttcttatgtgagtgtattggctattcttacagcattaatctggggaatatattttatgattggaggccagctttcaagcaatactacaattgccaatattatatctgatattaatctttactttgataataacccattttctgcttcttctatcaaagaaacaatagaaagtttcaattcaccaattataagtgctcttcagccttacattgttgatggctttaatttaattcaaacttatgttatgaaaaacttaagcaacatgacatcatcacttgtatccattggtagtagcattgctactttcttcattgcttttattataagtatttatcttcttaaagattcagaatactttataagcatatggaaaaaattatactacttgattttcagaggcggttctgctggaaataaactgaattatatatttagcataatacacgaagtatttggtaagttcatacgtggccagcttcttgaagcattctttgttggtgttttatcttcaatcgctttaagcattgcaggtattaaatattcatttgtaataggtactattgcaggtatttcaaatatgattccttatgtaggaccaattgtaggaactgttcttgctgctgtcatgggacttttaagcggaaatcctataaaaatattatatgcaataatagctatgcttattgttcagcaaattgataatcaattgcttgctcctcaaattgttggaaatagtgttggacttcatcctgttttcacaatgatggcaatacttattggtgggaatgtaggaggtcttcttggaatgcttattgcagtaccacttgcggcttcatttaaagttttattcaccacatggtatcataagcacattgaagtacattaataattttattaaactttaatttcatttgactatttaattataaatctctccttttgtgaatagatataaatatattagtatctatttaaaaggagagatttttatgagaattcctatttacagactacataatcttattattaagcctgtagaatctatagcatcttcaaattctacaagaattattcctaatttcactgatgaaaaatataaactagaacaaaatatacaaaataacataacagcaaacattgcaaaaaaacaaacaaaaccaatatcaaaagactataatacattacctgaatacaataacaacctacaaaatcactctataaacacacaagatccatatgacttccttcttctttcatcttcttttaaacaattaactaaaagtgtacaaattacacttaacataagtacaaacgaagaaaaatcacaaaatcaacaattcgttaatattaacaacataaaatcaacattattaaataaaactatagaccatcaaaaaaaacaaaaattcactttatatgaagctgaaaatgctttaaaagaaatacaaagattaataattgattctgcctcaccttcattacttttaaatgcatcatatttattgtcagcaactgctgtaatttcattgttaaatcctaaattagatgatgaccaataataaaatcccaaacattagtctgggattttattattgggctattttactaaaccacaaaatcacggtatccctaaactcatttttgcaatgaatcaaattctatttattattttaaaaacataggttgaataaaaaaagaagcataagcataaaagcttaacacttcttttaattttcatatgtaaaattttgaaccattttaattattggcatacctgtctttaatgatatatattcttgtccttttgtttcaaatccaaatcttttataaaattctactgcataaacacgtgcatcaagggttatatgttggactttaatttctttagccttttcaattagcttgttcattattccaactccaattttcattcctctatactcatgatctactacaacctgagtgatttcgcctattgaatcatgaacaaataaacgagcatggcctattaccttttcctctatatacgcaacaattctcatacttttatcttcaaactcatcaaatatagcttccttagccctatttgatgtttcataaaactctctataccttaaatctattgctgaatcatatagctttgattccttatcaataaatttgtattctattatcttatgtaactctttcattaaagtcattttcctcctgaattttaaataaaaattttaagtatttttataattcgttttcattagttcgtcaatatgctctttaggtattaatctatattccccacattctaaataatcaagatgaatattcataattcttattctttttagagatatcaccttatatccaagtacactactcatctttctaatctgcctatttaacccctgagttaatataattttaaatgtatcttcatttatcctctctactttgcacggtcttgttttaacaatgtcttttttcatttttccatttttagcctcatcaagcattataatttcatcttttccatctttaattacaatcccttctgaatctgatattctttttacaccactcccagatttagctgaaatttcgacaccggttctcatagacaatagaaagttgtcatcgaaagctttatcaaccttgactatgtattctttttcatgtttattgtcacattctaaaatatgatttgaaaatactccatcattagtaagaataataagaccttctgaatccttatctaatcttcctactggaaaaacatattgattataatttatatattctcctatatttccttgggtatttttttctaatgtgcatgtaataccttttggtttataaaatgctaaataaactttttccatagatttaacgcgttcaccatcaaataaaatttcatcattatcttctacccattgtcctaaaacacagtactctccatttatttttattcttttttgttcaattaatttatttgtttcttttcttgaacatattccaagattactaaaaagtttatttattctcatttcatataacctctctgttaatatcacacttcaatttattattaattagcctaaattttttattattaatctttctaactaaaattaaacaataccgtaaaaaaagaaacagtattgtttaattaattccattattattttatactaaaaattcacctaaaattcaatataattctttaaaaaatataaaatcatttttatatacaggtatatattttctttatttttacattttagtcgaatataagactttttacaactgcaaatccttctctcaaatacattactggaatcagataccacacagtttcacttgaataatttgttacattattatatccattcttctgtgcaagaagcttacttctaaaagcatgaaaatctgttgttactaccttcacattaatttcatcaatttctttattactgtcttcttctatcagctcttttgaaaatttaaaattttcgtaagttgttgttgatttattttccattagtatttgtccttctggcattcctttacttacaagatattttttcatagcttcagcttctgatattttttcatcattccctttgcccccacttactactatctttgaatgattattatagtcttttatatactctattgctgcatcaagcctaccagataatgttaaactaggttccgaaccattgcttaatcctgctccaagtattaaaatataatctgattttgaaatattgtgttttggataaacaattataacaccttctattacaattaaaactgctataattaatgctatacatatttttattatctttaaaaatttttttaaaatacttttactttgtataaatgcatatagtttatcatacataaatccaaccgctataataactacagcaaaaaaacaaataggcttagaaaatgcgattttagaactgcttattgtatttattagaattatatacaatagtaatacaaccccaattattatgcataatttctttctagtattttttaattttaaaaatactttccttttatctgaccttgtatttttcatgagtttcaccactttttttataatttatacttaaatcttttttacccatatagaatgtgaaccgttttgaacataaaactctccaactccatttttccctataactacctcttgagaattatttcctgtcacatcattccatgtttctcctgcatgattgatacctacatacatttttttacttccacctaatgcaactgttattaatgcagcaagacctgaatttttatgttcacaatcaccttctcttgtccatcctataatagatttttcattaatataatcatgttcaataccatatgcatatgtttttcttactttaagaataatatccaaaatttcttttattccatcatatcctttatcaggaattccataataatcgccataaaatatacaaggatatccttcttttcttgtcaaaataaatgtatatgccaatggtttaaaccaaggactcacccacgattcaagagattgtcctaattgagtatcatgattatcaacaaaagtaacagtatattcagggtttgatttaagtaatgtattttcttttattttactcatatcataatgccctagcgaattactagctgaatgaaaattataatgaagaggtgcatcaaacaaactcatggaataatcgcacttatgaagataataatttaatcgcccaacatcccaagtccaatattctcccacagcaaaaagttctttattgctattctgtctcatttctttcaaccattcattaaaaaagtcaaatctaatgtgctttattgcgtctagtctgaatccatccacatgagtttcattcatgtaccatattccccatcttttcagttcttctataacataaggactatccatatctagatctgcaaacattaaaaaatcataatttcctttttcttcatcaacgtctttttcccattcttttcccttaaacttaaatattccagattgtttagatatatcatcataatcaactccatcaaaatcagttgctgtccatttatatgcagagtatttttcttttctacctggaaaagaaaaaacagtatgagcttttatctgcttttcttcaccaataaatatatttctattattttcatcaacctgacgtgcatcaacaagctctgtatcatctgctcctgctttatgattgaatacaacatcgccataaatctctattccatttttgtgcgcttctttaatacattctacatattcatctttagtcccgtattttgttcttattgttcctttttgatcaaattcccctagatcatataaatcatatgcagaatacccagcatcatttatgccattatgagctttatatgctggtggaagccacaaagatgttattccaatatcttttaagtgttcgcattcttttttaacctttttccataatgaaccatcattaggataataccactcaaaaaactgcatcattgttttattataatttatttcacctttatctctattattttcatatgaattttctgtaacttcgcctaacgagaactggcattcagccttctttttatccttaagattctctacccctagcaaaaatgcttcatcaatatttaaaagggtactcttctctggcaaaccaatactattattatctctattgttttcatcctcatctattttgatagaaccctctttttttacatattcatatatgtatttataaatatattttttaacgtatttttcaattgtcctatcaaacatcttaaaaaaagactttttacggaataataattcattacttttatattctttggttatttcttcatttatggtattgatattattgatttcttcatcaatagagtctatttcataatctatatttttaaatttattattaaaagcatcattagaccttcttaaattatccatttgcttttccatttcaataaatctttttcgtattctaaaatagagataaattaataaaaatatcaatagtgtcattatgcttataatcattaaaattatcaatttatacacctcttatacataaagctctttaaaattatttattaccatagtttttaacataattttatactaccccttaaattataccatattttactattattatataattaaatatttttttacaaagtaaaatgatttgaacatagtataatatatattcaaatcattttaaaaaatattataaatttattatttttaattgttcataaataggctatttatttaaagttattttttctattatcataagtgtccttaatgtcatctttaaccttattaaatgtattgtttatatcttcacctaatatatgtgcatcgcttttcatgttatttgttactgttccaactttctgttttacagcattggttacttcttttactccacttccaacattatgagccatggacttcatttcgtcttttatattttctcctttttcttttatttcttcacccatcttgtgaccttcttgtttcatcttattttttaagtctcccatagaaaatacctcctcatactgtatagttggtaatatattttacctgtatttagtttctccaaaaagcattaatttattatttatttaaaataattcaaataaaaaatgtccagctataaaaattattttaaagccagacattttattatttaattaattagtttctgcttattatgtatactatatatccagcatataatgctaccattattataccttctagttttgtaagttttttttctttttgcttattaagaaaaactactaagtataacaacaatgtaatagctattaaaaagccaaaatcaactataagtccagattcaacaactatagggcttataacagatgaagtacctaatataagaagtatattaaatatatttgatcctaacacatttccaagggctatttcattttcaccttttaatgctgccactacagaagtaacaagttctggaagtgatgttcccattgctacaattgttaatcctactaatttttcactcattcctaaagaagatgcaatattactagcactatttacaactagctgacctcctataactattcctgctgcacctactataatcaataatattttaataaatacattaacatttaattcttcttctgtaggtttaggcatatctgttttcttagcttttactacaagcattaccatgtatgccaaacatattattaataatattagtccgtcaaatcttgatattatatttgatccttttccaaatagactatcaaatgttagtatgaataataaaatagtaataactgtattaacaataaaatcatttttgacattctttttatgtataattataggaagcacaatagttgtaactccaagaaccattaatgtattgaaaatattcgaacctacaacatttccaattgcaatattattgcttccatttaatgcagaaatcaaacttactgctagttctggagcacttgtgcctatagaaactatcgtaagtcctacaattacaggaggaattcccattttcttcgctaaagcagatgcaccatctacaaaaatatctgctccttttatcaatagcgcaaatcctaccaataatataatgtaattcataagcgtctctccttctactttattttctgctgaattttacacttttagtattcttcatgttcagtattttatactcaagtactaatatatcatattattgtgttaattttcatttttatttgatcaaattttctattttaataatattatcccataaaaaaatattaacttttttactaaaatatttgtaattattataatcatatattttttcagcaattattaagtcaaatatttcagaaatttactttgacagtacacattagtatcatttaaactattattatgtctattattgcaaaatttatattataattaataaagactaaatttaaaatataaatcattttattatgtcaattatgtttatagtaaaaatataaataaactttaaataatagtaattgtttaggaggaaattaatgagcgtactacttgttaaagatatgaaccatggttttggtgacagagccatttttgaagatgtttcttttagattattaaaaggagaacatgttggacttcttggagctaatggtgaagggaaatctacttttatgaatatagttactggaaaacttcaaccagatgaaggaaaagtaacatggtcaaataatgtaagagtaggatatatggatcagcatgctgcattaactaaaggtcaaagcataagagaagctttaagaggagcttttaaatatcttttcgatcttgaagcagaaatgaattctttatatgagaagatgggtgactgcactgaagatgaattaactaaaatgcttgatagaactgctgtaattcaagatttacttgataacaacggtttttatgtaattgatccaaaagttgaagaagttgcaaaaggtcttggtcttttagatctaggactagatagagatgttgatgatttatctggtggacaaagaactaagatactattaggtaaattacttcttgaaaatccagatatattacttcttgacgagcctactaactatttagatgaagaacatatagaatggcttaagagatacttacagtcatatgaaaatgcatttatattaatttcacatgatattccatttgtaaactcagttgttaacttaatttatcatgttgaagacagaaagcttacaagatatgttggtgactacgatgaattccaaagaatttatgctgaaaataagaaaaaattagaagctgcatatgaaaagcaacaaaaagaaattgctagacttgaagatttcgtggctagaaacaaagctaatgttgctactgcaaacatggctaaatctagacaaaagaaattagataaaatggatgttattgaattatctcaagaaaagccaaagccagaattcaacttcaaaactgcaagagctgctggtaaagttatattcgaaactaaagatttagttataggatacgactcgcctcttacaaaaccattaaatttatatatggaaagagggcaaaaaatagctttagttggagctaatggtcttggtaagtctactcttttaaagagtttacttggaaagataaagccattaagcggtgaagttcatcttggagactaccaatacataggatattttgaacaagaagatagaactgataataaaaatacttgtatagaagaagtatggcaggaattccctagttatactcaatatcaaataagagctgctcttgcaaaatgtggtcttactacaaaacagttagaatcacaaatcagagtattatctggaggagaagctgcaaaggttagattatgtaagattctaaacactgaaactaacatactaatcctagacgaacctactaatcatcttgatgttgatgctaaagatgaattaaaaagagcattaaaagaatataaaggaactattcttttagtttcccatgaacctgaattctatagagatattataactgaaacttggaattgtgaagactggacaacaaagatagtttaagaaaataactaaaagccttgaattacttaattataagaattcaaggcttttagtttatcttattatatttctacttccacgagagtttagatagttttgtgtaattagtatttttatcaatttattattactggaaattttgatttccagtaatatttttttatatttaagaaatactaataatgttttttattaccttttttagtatttcaataaaatctaaaagtatgcatattaatcaataaaagtacaagcttctaagctaattcatcttttaattgatcttcaaatattattgatagctccgctagcgtagcaccccaatttggagtaggttgactccatttttctattatttccatcgtagctaagtaaacacacttatttaacgattcatctgtaggaaagatcactctaaccttagtaaatttacgtatttgacgattaaacccttcaagtgcattggtagtatatatcatctttcttatgcttggagagaaatcaaaaaatgttgatagattactccaattattataccaagaatcaataactatagcgtatttatcaccccagaaagattttaaattgtctagctgcgccaacgcaagttcttcagttgatgctttgtaaacttcttttaaatccttcataaatgcctttttatcctttgaagctatatatttgattgaatttctaatttggtgaacaatacatgtttgaatatttactgatggaaatactgttttaatagcttgtggtaatccttttaaaccatccatacatgcaattaatatttctttaactcctctattttttaagtcattacaaattcctaaccagaacttagcaccttctgcttcatcaacccatatacctaaaatatctttatagccatccattgtatatcctaaacaaatgtaaacagctttattaattatctttccattacttctaactttaaagtacatagcatctaaataaacgataggatatattttatccaaagctctattttgccattcggtagcgctagcaagtactttatctgttattttagataccatcgatggagatatttttattccatatagatcttcaatctctgattggatatcacttgtactcatacctttagcatataaagatataatttttttatctaactcagtacagacagtttcatatttctttataatttgaggttcgaattctgcatttctatcacgtggtacgtctaagtcaacgtcaccgaaggagcttcgtagatttttactgctatacccgtttctatagtttctattgctttgattatttgattctgtacgctcatatttatttcttccaagatgctcttccatttcgccttctaatatattttcaaggacatcttttacaagtttctgtattagcccattcttacccataacatcatcgatggttttacatttttttatttcttcattgtagtcaaagttagtatcaattttttttgtcataataattcctcctaaacttatatgttttattattccaaaactaccaactgttcatacaaaaaaacagtagatagattttgtttttacacaaatctatctactgtcccacttccactcaaatccacattctctgcaatggtatttattcagcaagttttctgcctcttcagtagaagcaatacaacaaccacctaaaatacactcatcattatcactatcttcaaacatttcttttgttggatatccataaagtataggaatgattttttcagaaccacattttggacataattttttactcatacataacactcccctatatcctataattaaaatgtatcaatataaaatctttatttcatccttcgtaagacttctgtagtctcccttttttaaaaactcatcaagagccaaatttccaattgacattcttttaagataaataacatggcagccaatacttttaagcattctctttacctgatgcctgcgtccttctgaaattgtaatgtgtccacaaacaactggctgtatataatattcagaattaacatgataatatttttttaaattcaatttatcttttaattcttcataagttccattttttaaattttctattttagcgggctttgttataggttcattttcacctatgcttactccactttctagattttttttgtttttttcatctatactgcctaatgctataaagaaatatttcttatctacatgaaatttaggagacataagtttattattaaaatcaccatcatttgtaaaaagtaataatccttctgtatctttatctaatcttccaacatgaaatactccatccatattaatctctttaaaataatcaaatacagtcttgtcatcagcatcttttctagcagtaatacatccacttggtttattaaacatgtaatataccttttctttatattcagtaatttgtccattatactcaataatatcttctatttcattaatttcaactgcaggctcaaaaatagttattccattaatttttactaaaccatctttaacatattctcttacaatttttcgtgtacctatttgtgattgtgccaaaaatttatctaatctcatattacctcttcttttaagttcaatatatttaattttctatatgtatacttatataatcttgtattttcatacaataaatatttataatttttattatatcataatttaaaattcactgataatcccacatagtataaatacattactctaatatgaattgattgattaaattcattaaaacttgtgatttacttgataactcttcagatatagctgaactttcttctgctgttcctgaattatcttcaacaacagaggatatcatttcaatctctttaacaatttgatttattgattgagcctgttcattggaaccacttgatatagaatcaaccaattctgcaacttcttttgttgtttctaaaatactccttaatgtttctactattttgtctgaaccttccattccttgttttgctgcatttgaagattgttctatcaacattgtagtattttttactgattccatagtcttatttgataaaatcctgatttcatctgcaactacactaaaaccgctacctgcttcccctgcttttgctgcttcaattgcagcatttaaagcaagtagctcagtctgtgaagatatttgttctatatctttaattattccttttatttcttttgaagattcatcaatatttctcatcgatttaaccatttcttttgtttgttcttcactgattttgaatgtattctttagggctttatcagaaaattcctttgcttttaaagcattttttgcatttaaattgactctttttgaaactgtatctattgaatgtgataattcctgtactgctgtagcctgattattagttccttcagctagattttgcgctatttgtgaaacttgttttgaaccttcagttatttcaccagaagcatcatatatttcatttatagtatgtgctaaaatgctttttatgttctgtattgaaattttaattttttcaaattcaccagagtaatcgcatttaagttgaaaaataagatttcctttagcaatctgattcaaaacttctgcaatttcatttatatacattatatagttacgtaaacgactgactgtcatatttaatgattctgccaatcgtccaatctcatcatgactatttatatttatattagtattcaaattaccttccgcaatttcatttgcatttttatttaatcttaaaatgggatcaacaattttctttgcactattcttaatcataactatagaaactgttactgttaataagaatattataaaaagtattcctactaaaatataatatactttattatattttagtgaaggtaatacagctgtaatagtccatcctagatctccaacaggtgcaatatatccatatgcagtacttttaatatctttaaactttaaatccccatattttttctcaacaattgaatttattagcttttgatcaaattctgattcacttatatttatatcctgataagattcatctggataataactaattgaattttttgatgttgtaagcacacaatatccattaccaccaagagtatactcattcataatataatttaatctttctaatttcatgtcaatcccaacggctccaatgatttcaccagtttcagaatcaaaaataggtgtagcacaagaaattactattaatttagtttctgcatctacatacggctcagtaattacagtatcattttttgctgacatctctttaaaccaggatctttcattaatattccacgtagaataatctgctataaaattcgttgatgttgcaagttggcttgaatcagcatctgccatccatacagctaataaattatctttatctttctcacttatatttttcattgtactcaataaatcttggtacttatcaattgatgaaattgctattcctggcttgatttcttcaaatgcctttgaaaattcaatattgtttgccatttgattggtaatttctatgtatttattaaaataattttctattttatatgatgcagattctgattgactttcaagataagctgcattaagcatacttactgagtatcttataattaaatttattcctataaaagcaataactaaaatcacaataatcggtccaataatcttttttaacattttttctgatatgctcgtaaatcctttatcttttttcataatatgccccctaaatattaatttaatataaaaaaagcatcaatattcagttttacgaactgatattgatgcttccatagcaaattataatttttaaaatactattttttattataataaaatattcattaatgtatattttttaatattgtaccaaatatatcttaatatgtaaaataaaattaatgttaatttatattttttacttttataaacaaattataccaactataaataatgtacccatacatttgactggtatgtctttgatgctataatatctatatcaatatagcctgtctaattttagcaggattgattttttgcttataaaaagcatttttataatatatttagctaaataaaacaaaaaatatttttatctaataataagcaataatataaactattttcaaaggggttttatttaatggaaacgacaaatataaaattaaaaaaattaatgcaaactgcactactagctgcactttgctatgtatcttttacttttttacaaattaaaataccagtaccaggtggagattcaacttcacttcacataggaaatgccttctgtgtattagcggcattattacttgggggttcttatggtggacttgctggagctgttggaatgacaatcgctgatttaatggatccagtttacatcacagtagcacctaaaactttcattttgaaattatgtataggtcttataactggatttgtagctcataaaatagcaaaaataagtgaatctaatgataaaaaatatattttcaaatggagcatcatagcatctgtatgtggacttgcttttaatgtaatagctgatcctgtagttggatttttctataaacaatatgttttaggacaaccacaagaatttgctaaagttttagcaaaattaagtgctataacaacatttgctaatgcagttgtatctgtaattttagttgcatttttatataatgcattaagacctttattaacaaaggcaaatcttcttcttcctatatattcaaaaaacaaattcactatctaaataatttgttgtgcaaaaaacatcagtataatatagccttgcttttatactgatgtttttttctttgtatttataaaaactatatattctgctaataattttttaatttgcattctctatgaccacaatttggacatttgtaattactcttttcttctggatcactattatagtcatatatatatttatccataagttctccacatattggacattcaatactcttctctttttccatttttctcagctctcctttccactaggactattctttttttatctttatcattttaaattgataaaaatgatctattctagaatttaaatatgattatttggaataataatatatattactgtctacaagtaacaataaaagtttaatccggttttttaactcacattttaatttataattgcaatatatattataacaataatattttgctttgagaaaggaagtattattatgacagatgaaaaaaaatatgataataaatttcataagttccaatttaaaactgattcagaaaaagacatggaattaaacaatcctccaataagtaaaaatattgataccttaaagataagcgatgacttttcaaataaacttggagtagaatataaatactctggcgaaggtgaagatgtagatataaaaaaatagcacttccttcatagcagctgattataaattacagctgcttcttaatttgtttcaattttattattaacaaatttaatattatttctttatattcatgacattatcttataaaaacacttatattattattacatgtttaaataataccttgacataatttcctaaaatgatatcataaaactattaagttttaagcaacaatagcaaaaggggttataaatatgatgacattagataaatttgaacaagcctatgaaattgttcaaaaggtaatattaccaacaaaattagtatacagtgattatttttcagatttaactggaaacaaagtatatttcaaacctgaaaacatgcaaaaaacaggtgcatataaaattagaggtgcatattacaaaataagcactcttacagatgaagaaagaagcaaaggtcttattacagcttctgctggaaaccacgcacaaggtgttgcttatgcagctaaagcatacaattgtaaagctataatagtaatgccaacgacaacacctttaatgaaagtaaacagaacaaaagcctatggggctgaagtcatattatatggagatgtttatgatgaagcatgcaactatgctttaaaattggctgaagagaaaggatatacttttattcatccttttgatgatttagatgtagctacaggccaaggatctattgctatggaaataataaaagaacttcctactgtagatattatcttagtaccaattggcggtggtggacttgctacaggagtatctactcttgtaaaattattgaatccaaatattaaagttattggaatagaacctgaaggtgctaactgtatggaggcttccttaaaggctggagaagttattacacttccaacagtggatacaattgccgatggtactgctgttaaaacacctggttctaaaatcttcccatatattaaggaaaatatagatggaataataacaatcccagatcatgaattaattggagctttcttagatatgcttgaaaatcataagatgcttgcagaaaattctggccttcttacagttgctgcactaaaacatctagactgtaaagataaaaagattgtttcaataataagtggtggtaatatggatgttattacttttgcatcacttgtacaacacggattaatagaaagagaacgtatatgtacaatttcagtacttcttccagataagcctggtgaacttacaaatgtatcaaaagtaatcgctgaagctcaaggaaatattataaaactagatcacaatcagttcgtaagcataaatcgtaatagtgctgtggaactagatataacaatggaaacatttggacatgatcataaagaatcaataataaaagcacttaaggataatggatataatccaaaattattacaacctaaagttgtttatcaataaaataatttattaaaaaataactggaatcttcatattaaattttctttgaagactccagttattttatttattcctttttcttttcttctactctctctatccttatgcagaacccctcaggtccaactttaaattcttttttcactttaattccttctgttggtatgaacaaaattgcaacaaaaaacataagcccaaccatacatattcccagtgtttctattaatgacaaaattactatattcatttttatcctccttttgtctctcttttatatacttattccattaagaattaagtatacgtatttcaataagtctaaatactttcaagatatgtttttacatctgataaactgctacatatcttgtgtgcaagcttcttcatattatcatcaggcattttcatatcaggtacatttatcccattcattcctgccctagatgctgctagtatacctgcatctgaatcctctattacaatacatttttcaggttcaattccaagtccctttgctgctttcaagaaaatctctggatctggctttgaattttctacctgatcaccacatataatgtaatccactttatttttaatttttatttcttctagtagataatgagctctttctcttcgcgtagaagttgctactgctattttataattttcattattaaggtattcaacaatttcatgaacacctggtttcactattactccatctcgttctattgttgctactgctatatctacttttttcttgtatatctcatcaaatggaaatctgcttccgtactctttcatcataacttctttaatactctttaagtttctacctatcatagtaagataaaacttttcactcatttcataattatatcctttaagcacttctttaaacgcattaaaagaaattctttcagtatcaataagtacaccatccatatcaaatatgaccgcttcaaattttttcatatgttttacctctcctgcttgtactaattatagtgaaaatttcttctgtatcaaaataatctctatatttatattttatcattgatgatataattttccaattatttttaaaaagactacatatgatttattctaaatatataaatcatatgtagtccatataaaagattaattataaataatcttttgtttctatatgcaatccttttttcttaagctgtccttcaacaatttccttaagaagtgaatatactacagcaaataaaggaactcctattatcattcctactaatccaaggaattttcctgcaacaagtattgcaaataaaatccagaatgcagatactcctatagaatcacctaatattttaggtcctataatattaccatcaatctgttgtataactaatattataacaaggaaccataaagccttaacaggtgatacaaataatattattataaatgatggtattgcacctataaatggtccaaagaatggtattatatttgtaatacctacgattacagatattaaaatagcataaggcattttagatactgtaagtataaagaatgttaatattccaattatgacagaatctaaaattttacctactagaaactttccaaaagtgctgttgcttctatgagtaatttctatacttttttctgccactgctttaggaaatactgcatatgttatctttttacttaatgcacaaaatttttctttatcgctcaaaagataaatagatattataattcctaaaactatattccatattttagatgctacacttgttaataaagttccaagtataggtagaagatctgttacaaatcttattacataatctataaatctattaaaattttcattaattaaatcaagatactgtctttcaatatttagctttaataataaatcatcaataaatttagttgttttgctaatatacataggaatatcatttataagacctactatactatccattaattgtggaagaacaaatttaataaatagatataaaacaataaagcttacaaaatatgtaaccaaaagacctattgctcttttagaattacgtttaaattctaactttttcacaaattcaaaatcaaatattgttctttcaaaaaatcttaatataaaatttaatatgtatgcaattgaaaaaccaatgataaatggttgaagaattccaattactccgcttattttacctaacaacattccaatctgagatattccaagataaaataatataatagcacttgctactataaaagtatatgttgcaatagttgtgtattttgtgttccagtcaatcttcatactttaatcccttctcatattacgcttaaatattttggtaattatactcacatatcaatcattatatccataataacaaaataatatatagtatacatgtctttttttattataagttattaaaggtatatcctcaatgtatttaattattaaagttctattaattttttaattcactctatacaaaatgtattactttaaaattaaatgctaaaaagaaccatattataacgacctaggccaataatatgattctccaactaaaattctaagttatgtagatttaatatataaaatatgtatctaattatttatgaaatttcttattttttctagaagcatgcctaatgcaacatcatttgctccaccttctggaattatgatatcagctcttcttttacttggttcaacaaattcttcatgcataggttttacagtacttaaatactgatttactactgaatcaagatctcttcctctttcctgaacatctctaagaagtcttcttattattcttaaatcaccatcagtatcaacaaaaacctttatatccataagatcacacagctctttattttcaaatataagtattccttctactattattacttttgttggtctaacttctaccgtatcttttagtcttgtatgctcgacaaaagagtatacaggatgataaatagcttctccttcttttaaatgctttaattgctctattaaaagatttgtatcaaatgaatcaggatggtcataattaagttttttacgttcttccattgaaatattatcatttgatttatagtaataatcatgacaaagaatagaaaccttatcttcaaaaacatctttaattttttgagctaatgttgttttaccagaaccacttccaccagctataccaattatcattacatcttgcatattttcctccaaaaactgattaatatatttaaccacagcatattaatcgtaataaatttattttgctgctattctcataactcttcattaatataaaattccactttaatatatagtaaaattctacttattaccgtactcagtttaaattcacccatatgattttattataaataagaaaaaaaaacaactcctattaattctaagttaaaaaacttaatgagttaatagaagcttataaatataattattatacaattcttataattttatagtaaatactaaggatttaattttatataatggactttaatatgatattaacatctataatacattgtcttgcagttcattggtcttcttatataaatatacagttaaatttttatcttttttattaccaccttttaaaacaactgcatcttcttttctgcttttatcatcaaaaaattctatagccctatttaccttttttatctctccatcttcatttttatataaaatagaataatccgggtttaatttacttttatccttatctattgaagttttttcatcatcttttttatgactttccttaaaagatagtgaatcatcgcaagttccatagacatattcatctgtccaatttcccttttgtttttcgttatgcatattctttattacttcttctatttttactacaaatgcttcgtattcattaaccatataaacaagctcgtaatactcaataatgtcatccccatattttgatttgaaatcttttatcatttctcctacactgcctttattgtatacacctttatgcgcaagatctttagccatattatttacaatcatatgaatacttctgtattttatgagttgtaacattctcacaagaaaaaaagtcgctataaaacaacaaggtaaagaaaatgctggaaaatttataaacaacacactgcataatatgaatactgtaaacttaaaattctcttccttatacttttttattccattttgtaaagttgtactatatgataagattttttctaccataagttctttattagatttatttactttaatttctcctataaattctaaaccgcttctaaatactttctgggtagtttccatgatgtctcaaccctcctctttgtttttttattttaatctgaactgttactttagtttacttgctgtaaaccttaaactatagatcatttattatttcctttattttacaacagttgtaaaaccttatcaactttgtatttttgttaaacatatatattttactccaataaattatattcttcttttgcttacaccttattctcttatcgtataagctgaaaatttgtctatttaacaagttattttttgatttattttttatttttcttcttattatatttttcaccattacactacataaaaatacctgatattataatttctttatataatatcaggtataaaaataacatatatattataatgtaaaataagcgactccaattgatccgggtcctacatgaagtcctattacaggccctatagattttatacttataggtatattaaggttctcttcaagcttctttgcaagagtcattccctcttcttctgcattaatatgatgaactattactccaccaacttcattttctctacaatcttctattactttatttaaaataacatccactgctttcttcttcgttcttaccttgtcaaaaactgttgtttctccattttcaacagtaagtatggggcgtatttgaagtattcctcctaaaagagcggatgctcttcctattcttccacccttttgaagatatttaagagtatctggtacaaataaaaatctactgttatctcgcacttttactactttatctactatttctttcatttctgcacctttcgatgcacattttgcagcttctattacctcgtatcccatttgcattgaatttgtagctgaatccactatttctattctggcagatggatatttttcaattatcatattttttacaatatgagcactagaaaaagttccactcatttttgatgatataaatatacataaaacttcattaccttcatttacgcacatctctaaggttttagagagttcatctaatgatggttgtgatgaagttggtatttcactgcttttatccatcatttcataaaattctgagtttttcaattcagtttccctataactaatattattcattattacatttaaagatactacctttatatcatatttctctattaattctttaggaatataactagtactatctgttattatttttactgacattttattcgccttctttatctatcaatataattatcacttattatatcataattatatttattttttctatttttaacataggaatattttttatataatagtgaaaaatatttatgaaaatcatcttatgaggaggtcattattatggcaaaagacagtcaaccagataacaaatatgcaagaatggaaaagtgtaattatcaaactccaataactgaggaaaatcataatcataatcctaacagaaaaaagcattcagtaaaaagggaaggctttaaaagtgatcatataaattagcataaatactctagatataaattcattatattttaaattaataatttatatcttcagttcaagtgcaatatatttttgtatattaaacaaggccataagagttaaactcttatgacctttacaacaatatgaattatcttctattgttttgttgctttctagctcttctacaatctgggcatcttactggttcattttcgaaacctttttctttgtagaattcttgttctccaactgtgaaaataaattcctttccacaatctttacatacgatagtcttatcttccatttttcatttcctccttatttaaagacttagtcaactaatactttctcataaggagaaatttttaattaaattaaatctttgaatattattgtttccttttggaacaataacattatatcataatcaaactaataatacaatagcttattattaatttttatctctgcttgtaaatattatcatttacactatatcttaattttagtacaaacttttttacataatgtcaatgattttattatttatttaacataaatttcacaattaaattttaattattatttttttcatcttatgaattagtatcattcaaaatttcgacatctttattttcttcttgttctttttgttgctgttctacatttccaagagaattatttataaacgaattcactattatatatctacttgatccaacttttataaaattcatttcaacactatcaccaactgtagttaatgctgcatctcttgcagtctctgttgaaacttggaatatattatcattatcttttagtttcatatcgtaaatacttgttccatctttaattacaacaccgattctttcaacttcacctgtaattacttcttgtttatttccaccttcaagtgaaatacttgtattagtaagtccttcaagatatttatttaaagttccttgaagtgtatctccaacccctacagtattataatttttaacattaaccattgcatactgttttacaagaccatttgaatctttaagtgtcataaagtaagttggttcattttgtatatttataagatatgggaattttgctgtatatccatactgctgaactttaccctctgctgatttcatacttgcattttctgttgcacctgatgttttataaagttttgtttcaccagttcttgtatttgttaaagtgaatcctacaagagactcatcacttcctacagatgttatacctgtatagtaataacataaatcatcattatatataatgttcattccacttgtagttgttagcttatctttatcagtaaaattaaatactccgtgtacaagttctccccatttatttatatatctattcataaaactcttaggttgaattctatctatccacttaggagcattttctatgtcatacacttctgcttgaccagtttgtgcatccattactaagacccctattgcctttgcttctgaaattccaattgcattatcatatcttgtaactacccagtatggtcttccagtatcatcaagttcaaatgtataatctgtgtgacctgcttttaaatctcttaaatatgatgcaagtcttaaatcactgaataaatatgctgaatctaagtattttatatttacaggttctccatttaattcagtcacaagttcaacatcattttgattcgtagcacttaccttaatatatccttctgtaccttctctattagtaagccactttaagaatgatgaatgttcaagtggtgctacataataaagttctccatttatactttgaagatgaagatctcctacagtaacctgactaccaagacttgcaatttcacctaattttttatctgctaattttcctgcaagttctttgtctatagttggaagttgatttaaatcaatatattttatttcactagaaaaatctacttcttcaatatttccaattaaatttctatgagccttataatttgctacgggactacaaactattgctactgcaacatacactgctgctactgcaaaagctgtaatcatatatttcttatttctaataaaaaatccatatcctagtgtacatattacaaatactcctgttattgttaatgcattaagacttaagtctaatacaagacttccattaaagaatactagtatacctacaataagatatgctgctattaatatttttataaacctaaacaaattaccttttgtgtccataaacactcctccattcattttatggtttatattataacataataggtttttaaataccatataataaatgataattttatcttaattttttgttaataataaatttttttcaaagttaagttgctaaaaaaagcctctgtatttaagctgtcaaaatacagaggtccatatattataaaaggttatatttctaactaaatacaataatatatgtggaaattgtatttattaatattgtgacaggcaatggcatagcaatcactatattatagaaatattccttttgggggcttaagtaatttaattttatataacgaaaaagagataatgaggtctttaactaaaaatttgagacctcattatctctttctttgattatgtatttatcatatcatatattgcttattttttcaatacattccatatacttttattatttaatattgaaaaatagaggattaaattcatttaatcctctattttgatacgacaaacatgttattttatcgtccatcgacattcctacatgctacaacatctatccctgtacctagtacattcttaattatgacatctcctaattttactggtgcagttaataccacactattaatttctttcatacactcaaaattaagaccttttggaattggattttttgttttcacaggaacaactggtaaaactccattttcaacttttgcagtagtagttattaccctaacaggattggtaacttcatttattccgtactcaatccctcttttacatccattacctgttactttttcctcatctatatttacttttaaatgacatcctttaggacagcatatacaaattaattccttttccatatcatttcacactcccacttattcagttaacagtattttttaatatactctttaatcaaaaaactgtttttacagccaaattatataatgcttaattttaagcatcttccaatgatatagttatatcaccagttactttttcaagtaatactttgcctaaaattactttttccatctctgatggtgctaaatgagccctcttaaatttagctattacttcatctttacatcttacaacaagagccttgtcatgatatatattatttactctcataaatatagtaagtttatcagaaacagcatctatatttaatctttgtggaactgtataattaacatttgttccattgataatttcaacatacttatctttgtttaactcacctttaatatatttagctgcacattcacctgcatgttttgattcttctgtaacaaaatcaacaagatcatgaacatgtactacatttccacatgcaaatattccttctacagatgtttccatgctttcactaactttaagtccattagttcttctatctggttcaagacctgcattatatgaaagttcattttcaggaattaatcctacagataataataatgtatcaacatcaaatgtcttttcagtacctttaattggctgcttatttgcatcaacttctgctataacaaccttttctaatctcttattaccaacaatatcaactactgtatgagataagtataaaggaatatcatagtcatttaagcattgaactatgtttctgtttaatccatttgaatacggacacaattctactacagctttaacctttgctccttcaagagtcattcttcttgccataataagcccaatatcacccgaacctaaaattaatacttctttccctggcatatatccttcaacgttaatgtaacgctgtgctgctcctgcactaaatacacctgctggtctgtcccctggtatatttattgctcctcttgttctttctctacaacccatagcaagaattatagcttttgtcttaagctccatatatccttctttactatttattgcatgtacagtcttgtctttttctatatctaataccatggtgtcaagttttacttcaacattagtatcttcaaccatttctataaatctctgtgcatattcaggtcctgtaagctcctctttaaatgtgtgaagtccaaaaccattatgaatacactgatttaaaattccaccaagttccttgtctctttctaaaatcagtattttctttactccattactatatgcttcatatgcagctgcaagtcctgctggtcctccacctactacaattaattcataactcatatcaataacagcttttttcagttaataattatcagttgacaattaacagttttgattcatattccttctataaaaatctttgaatacatttctaaatctttatatcttcttaaaacagttgtgctgtttttctcttaactgtaaattgttatctgtcacctgttaactgattaagcttcctcccttctattgctaatttattagtccaagtaaacttacaataattatatttaaattctattttgtttttcctgttaatatataagatccatctttttctaatactatatcttcaagagccacattacattctcttgctattatttcctgaactctaggtccacagaaaccaccttggcatcttcccattcctggtctgcatcttctctttacaccatctaatgaaataacgtcaaagcttctcttaattgcatcaactatttctccttcagttatgctttcacatctacatattattcttccatatctaggatctttctttataagttctgctttttcttctgatgagagttccataaaatgaatttgttctctttttccattaaaattaggattttcaactaaatctaatcctgaatttttaataatttcaacaactcctaaagctattgctggtgctgaagaaagtccaggtgatttcattcctacaacatcaataaatccttttaccttatcattttcttcaactataaagtcaccagtacttggttgtgctctaagtcctgcaaaatttcttatactttctctgaagttcactttatctgtagtttttaatgaagttcttcttatttcatttagtccttcacctgttgttccaagatcttctctatcttcaatatctatagcatcaggtcctactaaaagatttccatgtactgtaggagttacaagtactccttttccaagttttgatggacattggaatatagtatgattcactacagttccctgactcttgtccataacaaaatattcaccacttcttggtattatgttaaaactttcttcgcatactaaattatgaattttatctccataaagtccagcagcattaattacatatctacattcaataacttcaccatctgtagttgttattttaaatatttcatcattcttttctatgttacatacttctttttgaagtttaatttctccaccatttgccacaccattttcagctaaggcaattgtatattcaaaaggtcctactattccaccagttggtgcatataatgctcctttaatttcactacttaaatttggttctttttcaagaacttcttctttgttcaatatctgtaatccctttacgccaatcttattaccattatcataaagttcttttactgttttcatatcttcatcatcaaaggcaattataagtgatccatttcttttaaatggtacactaagttccctgcacatgtcttcaaacatttcattacctttaacattatattttgccattaaagttccttcttttggatcatatcctgcatgaactattgctgaattagctttactagttcccattgatacatccttttccttttctaaaaccacaacctttaaattatactttgttaattccctaaaaattgaagttcctataacccctgctccaataattgctatatcatacattttgtctcctccttttacacatcaaaaaagccaggctaaaaatatggtgcagtatatcaccattattttcatgcctgactctatattctctcagcatttatattctttttatgtcttcattataccatgtaaaggtatacttgtctaccattgttttagatttttatatttattttttaattttattcttcttcccaaccttttgctctatctacagctttcttccagcctctataaagcttttcttttacatcttcatcaagattaggtgaatactcctgactcactgcccatttcttagctatttcttccttagatttccagaatcctactgcaagacctgcaagatatgcagcaccaagagctgttgtttctgtaattataggtcttacaacttcagaacctgttatgtctgcttggaattgcatcaataaattatttctacttgctccaccatctacttttatgcttgtaagcttacagcctgaatcttcttgcattgcatcaattaaatctcttgattgatatgctatagcttcaagagctgctcttattatatgatttctattagcacctcttgtcaatccaaagatagcacctctagcatacatatcccaatgaggcgcacctaatcctgtaaaggctggaacaatgtatactcctccattgtctttaactttctttgcaaaatattctgtatcagcagcatcattaacaagtttaagttcatctcttatccattgaataacagctcctccaacaaatacagatccttcaagagcgtactgaacttttccatcaattcctacagcaattgtagtaagaagtccatttttacttctaatcattttttcaccagtattcataagtaagaaacagcctgttccatatgtgtttttaacactaccttcatcaaaacaagtttgtccaaataaagcacactgttgatctcctgccatacctgcaataggaactcttactccaccagttcctcctaaattagcataaccataaacttctgatgagttcttaacctctggtaataatgatttaggaatattaagcttatttaatatcttttcatcccattttaaatcttttatattataaagcatagttctagatgcatttgtgtagtcggttacatgaactttaccatttgtaagcttccatacaagccatgtatcaactgtaccaaataataattcacctttatcggctttttctcttgcaccttcaacattatccaaaatccattttattttagtacctgagaagtatgcatctaaaagtaatccagtattatctttaacatactcaacaaattcttcatcttttttttaactcttcaactataccagcagttcttctacactgccatacgatagcattatatactggctctccagtgttcttatcccatacaattgttgtttctctttgatttgttataccaatagcagcaatttcttcttgagtaatattagcctttgccattacttcttgaagaacaccgtattgacttgaccagatttctaatggattatgctctacccatccctgcttaggataaatttgtgtgaactctttttggcatacatctaatatattctgatctttatcaaaaattattgccctcgaacttgttgttccttgatctaatgctattatatacttttccatgtaaaacacacccttctctaatactctataaatatattactaattaaataatattaagcttttctatattcctattatacaataaatacataaaataatgctccaagaactcctcctacaacaggtcctaaaacaggaatccatgagtatgaccagtcagaatctccttttcctggaattggtagcaaagcatgagctattcttggccctaaatctcttgctggattaattgcatatccagttgaaccacctaaacttaaacctattacccaaattaaaaatcctacaaataatgtcccaataccattagttaaattttggtcacctattccaagtataccaaatactaaaacaaatgtacctataacttcactaataaaattgactcctaaatttcttactgcaggtcctgtagcaaagactgcaagtttatcttccttactttctgtagccttaaactgatccatgtattgaatgtacacaagaactgcacctataaatgcgccaacaaactgtccagctaaataaactggtacttgtgcccatgcgacctttcctattgctgcaaatgcaattgttaatgctggattaaaatgagctccactataaacaccaaatataagtgctggtacagctactgcaaaagcccatccggttgttattaccatccaacctgctcctgtaccttttgatttttttaatactacattggctacaacaccatcacctaaaagtataagtaataaagtcccaactaattctgcaagaaaaattcccataaaatcacccttcctcttttataaaaatatataaagagccaggtaaaaacctaataacaataaataattactgttactttagttttgtgcctgactctatatctcttatgcacttaacttttcttattttcataacaacgactacatatcccatatcttttctttagtagttgatacgcatgttgcaccagaactcaatgcttgtattacttcatctttgctttcaattaatcctccacatattattggttttgaaggataatatcctgaaatcgttttaattacttttggcataatacctggaagcatttctattgcatcacactcattcattatatgcttcttagcattatttaatgatatcgtgtcatataaaaatactctttgaaccgcatacaatcccatactctttgcatatttgaccatttgtggttttgtgcttattataccttgaaattttgtctgttcttttaaatattttagtactacttctttattgcttaatccctctactaaatctatatgaagtatacccactttattatgactataaatttcttcacttattttagttatatttagcaaatctccccaaagtacaaaaataatctgaacattagaatccaaagcttttttcaattgctcctcatccttaactgctgctatgactggattatcttctaaaataattttaatacccactttacacccctcaatgtaattgtttacttggactatcattagtatctcacagttaatatataatgtcaaacatattattgaatttttttgaaaagaatccataattttaatttttatgataaatcattaaaatttaaaacatattcttaaaaatcatttactatttattagtaaatacagattttattgcaatagggttttcttttaaatttgtagctatcaaataatttttataagattgcattataaaaatatctcttcatccataattcttatatctttatcaataacaggtctaaactccattctatttaatatatctttttctatgtctattcctggtgctgtttcaacaagatgaagtccatcttcttttaattcaaatacagctctctcagttatataaataacttccttacctaattttttagccatctttccactaaaagtaatttgttcaacatcatttttaaatttattgttctgtccttcattttctatagtgagtcttccgtctgaaatatctacttttaaacctttagctgtaaaagttccacaaaaaactacttttttagcattttgagttatatttataaatcctccacatcctgcaagtctgccgcaaaatttactaacatttatatttccgctcttatcacattctgccaaacctaaaaaggcaagatctaaccctccaccatcataaaaatcaaactgattaatttgatctaatatacattcaggttttattgatgcaccaaaatatcttcctccctgtggtattcctcctataggccctggttctacagttaaaacaatatgttcattcatacctatttcatcagctacttttgaaacttcttcaggtactcctattcctatatttacaatattacccttttttaattccatagcagctcttctgcctattatcttttttgcatttaatttaaccttaattctctctttatctgagccttcatttttttcctctttgagcgtttgatttttatcacaatgaactgctgttattaaaggagtatttttcatccccaaaacttgtctcttgtcttcttcttctgaaacaaccacaatataatcaacataaatcttcggtatttttacacttttacaaagcatcttgtcactagatatcttttcgtcaacttgtactattactgttcctccacaatttttcacagcctgagctatagcaaaagcttctgaataagttgcttcattgtctaaggatatgtttcctttttcatcacaatagctgccttttataactgcaatatcaatcttattatgtttatataataaaaactccttatcttttatctctattaattccactaaattttcctttgttaataaattaacttttccaccatctattcttggatcaacaaatgtagataatccaaccttacttatagtaaactctgattttcttgcaatatctctaaatatattacacataactccctgtggaaaattatatccttcaataagattattagacatcatcttagcaagctttggagccaaattaaaatggccccctataactcttttaacaagacctgtatgtgctaagtgatttaatccttcacaatctccatctccctgtgctgcggcaaacataagtgttaaatcctttggacttccactttctaaatatctcttttccaccgcttttagaagactttctggtactgcaagtccagcaaacccagaaacagcaactacatcattgtcctttataagtaacatagcctttttagaatcaataaatttttccatactataaatccctccatatgcaatataataaaaaccttactatcttaattcttctatatccaatctgtttggttcttcaaatttatttaacattattgttttatagtatatttctgcaacttcttcaacatatcttcctttggttacaacttcatttatatctttacttgttattacaacaccatgtctttcaagaagacatgcatcattttttcttaatggtccaattacactttttgcaagctctattgtatgagctttttcataaggtgcgacatatatatatccaccataatgctttgaatctgatactataggaggtataaccttattagcaactgcaaatatagtcgcatataaggaatgtacatacattacagatttaatttccttattttctttatagatttcaagatgcattaaaatctcactacttggtttcttacctttttgaacttctatttcttgtccttcaagatctacaatgcatatgttttcaggtctcatttcttttctgcttatctgagatggagttataagaacataccctgttgtagtatctctaatactgaaacttcctgtcttttctttacataaaccatatttttcagcttcctgtgctattgttactaattttattcttaaattatcaagcatactgaatcccccttaaaacattataaatatttttacacagataaattttgagattgttatttttttatcattttataaaataaaaaaatcaacggcaaagtattactacagatcactgatttctcttaatactctatcattgatttattatttcaattattattaaatttttattactatgttcctttgcaaataacaaacttataatcaaaatactttttcatttacttataattttattatttacaaatatttctttataagttaaatatatcaccacatgaaaatgttgtcaataatttctaatgagttttttattttatatattatttaagtatagaatttaataattcaacttcattggtaataatacagtctacacctgccttaattactttaagcatatgatctttagtatttattgtatatgggttaaccattatacctccacttttaatctctttcatatattcttcatttagtatactagggaaataaggatgataacactgcacttttatatcatttaagtaccttggtacatttgcaagtgttgtctctgtaagtgcacctagctttatttctgaatctaattttcttactttaactaaacttaaatgattaaatgttgaaattataactctatccattaaaccatattttaaaatcatatctaagactttttcttccattccttcatattcaactatactgtttttaagttctaaattgagaagttttagatctgattctgctacaagttttaataattcttcaagtgctggaatttcctctccatcattattattaaaatgctcaatttcttctaatgtataattagattctacatccttctttaattcttttacctgtcctacactcttagttctaaaaacttttaattcatcaaatgtaaaatctttaacaaaaccttgtccattagttgttctatctaaagtttcatcatgaattattacaggtactccatcttttgataactgtatatcagtttcaattccatctgcaccatattctattgcttttttaaatgctatcattgtattttcatcgaattttccactatatcctctatgtgctatatttaatatattcactttgatcattctccttaaaaatatataatatgtaattttattctttattatacgacatgtgacagtcacctgtcgaattgtcacctttttcattattatatcaaaatgctaattaattacatttccatactaaaattaaatcttcttatttcctcatcaagaattcctgattcccttgcaagttcatttgccgataattttgtcttttcaacaatttcaagattagattcgataacacatgatatatcatcaatttttcctgttattgaatttatatgaaatagctgttcttcagatgacatagtaattttttttacaagattagagacattatttacatcttctgaaataacatttaaatcttctgatatctcttttacaattccagttccttctattattgaatttattgaatcattaattatccttgtagtactcttcacagcatcttgagattgttttgcaagctttgagacttcgtctgcaacaactgaaaaacctcttccatattctccagcacgtgctgcttcaattgctgcatttaatgccaataaatttgtatcatctgctatactttttattgtatcgattatttcatttattttttctgatgacttatttattttatccattgattgcagtagaagattcattctatcattttcatcatttatcattttagttgtattatcaaataacttatctacctcaattgaattttttgtattgtcctttatcttatcagatatatctataatactttcaacaacttcttctatggacttagcctgatgatctgatccttctgataaaagttctcctgtcacagatatttctttcgcacctctagatactatacatgatgcattattgatacttaagaagacagagctaagtgaagttattatattcttaagagaattttcaatttctaaaaaatcaccactatattttatttttaccttagtatttaaattaccttctgataattcttttaatacatttgatatatcccctatataactatctaatatagatattgtcccatttaaatttctactcatcattcccatttcatcatttgaatcatagtcttcacttgtttttaaaacaccatttgcaagattattagaaacatctgtaacatgacttattccttctaaaattttagatgtaatatactttgttattttaaaacatataaacattatgaatataactccacataaagcaactacaattgcaatatttctgcttatgtttgatacttttataaacttctctgcatctttatgtgatagattgtatatatcagaaataaattcttcacaattttctattttagatttatatccactgtccataattattcttgctgcatacttatcaccactcaataaagaatcacttatttttttcctatccttaagagcttcatctaagtttatttgaaaatcatttaataattgtccatcaacattatctgaattctttaatttagttactttttcttgaagaacattttcctcctcatcagcaagttttataaattttcctattctattctgatcactttcaagcatggaacgatacatgtatctatctatatttaataatgatatacgtgtatcccaaacactattattagttacaaaaggaccattataaagcctatttatcttttgtgacataactcccatgctcactaaaagaaaaatcataaacacgatgtttacaatcataatgcttccaaaacctaaagttaatttcttttttaagttataatctttaatctttccatagaacttgatttttgattttgaatttccctcagttttattaaatctttgtaatcttttcgtgagttcccctaagttttttatagattttttcaagttaaatccaagcttaaatttacttttattcaacatcataagctgtagttcccctttattatgttttatttttgttaatcttttaccaaaacacacttactttcacaatatatgtaaactatttatatactttactatatagtttcatagttaacactagtttacattcatgttaatatagcgttaaaattataagcaaacctttaatatacctagtttaaacgtatttatggtcaaaataacaaaaacacttattcaaaaataagtgcttaatctcatatctaactacaacattccttcatatgttaaatttactttaatttaatcaaatccatccaaaatacttacatgcatactctataccatcttcgtttgattttttagttataaaagatgctatatcctttatttcttgacatgaattccccatagcaattgaatttttaacataattaaacataccaatatcattaattccatcaccaaatacaacaatatcatttatatccacattatatttttttatgatatattctattcccttttctttaaagtcaaattctattgttctccatatccgttcattgtaaattgtatagttatttaaataatctatttttccaatatgtctgctgttaaaaaagatgattttctgagtaggctgatttaagaattcttcctcacttagagtttttatatcagtataattagctccacatcccccttccacagatccaatcctaaatcttttacttctagaatacaacttcatcaataaaatgtatggttttagccttaatccattataagatgtataacatcttccttcacctacacttaccattattacattgtattttttacattcatataatatatttctaagttcatactttgaaaaaaattcttccttttcaaccttattatcaataataattgttgcacctcctgagcaaacagcattatcaatactcatattagacattattttcccaatttcattttttcgtcttcctgttgcaagaaaaatcttgtgtccttctttctgtaatctatttattgtctctttagctgattgtggtatcttctgaccatatggttttaatgtaccatcaatatcaaagaaaaaatatttcataaatacaccttaccaatcttaattaaaattttatagccgacaatcatcttcaactcattagattgtcggctatactatattataatttcttctatttttctttaaaatcttctattctaataatgttattaatattgttaactccactaagtttttttatctcatcaactgatgacattaattgtccttcaaatgttttgtgagtaattaaaactatagtaactacaccttcttcttcatcacccttttgaattacagaacgtaaactcacattattattactaagaattgttgttatttcactaagaacaccaggcttatcaactacagtagctcttacataatacttacttcttacttcattcatggctttgatttctctcttccataaattattcttaactactggattttcattttcgctgttaacattacttcttactattgatacaatatcactaactacagcacttcctgttggaagatctcctgctcctcttccataaaacattaaatcaccaactgcatttcctttgataaatactgcattgtaagaatcataaacattagcaagaggatgttttttaggaatcattgttggatgaactctaagttctactttaccatcaacttcctttgctattgcaagaagctttatagccatcttaaattcactagcatatttcatatctactgcagttatttttgttattccctctctataaacatttgccacatcaattttagtaccaaatgctaatgctgcaagaatagcaagcttatattgagcatcataactttctatatcagaagttggatctgcctcagcatatcctttttcttgagcttcttttaatacttcatcaaaagcagcaccttctaattccattttacttaaaatataatttgtagtaccatttacaataccatataaagtttcaattttatttgctgtaagactttcatctattcctttgattatagggattccacctgcaacacttgcttcatattgaaacattattcccttttcatcagctttttggaatagttcatctccacctgtagcaagaagcattttgtttgcagtaacaatatgttttttattatccatacatttaagcatataatctcttgctggctccattcctcccataacttcaactacaattttaatgtcatcatcatttaaaatttcattaaaatcagttgtaacaatttcatctggaacctgtacaggtcttggcttattcttatctcttacaaggatttttgctacttcgacttcatagccgcatcgcttcattacttcttctttattagaatttaaaatcatccaaacaccacgaccaacattccccaatcctagtagtgctatttttatctttttcatgttttgcccccctcgaatttactatttaactaatagtatactatttcattataattccaatataaaattttggctatatctttttataatatctttataatttattaaatattttacatctttatttatttttttcattaatttttatattattccataagaaaataagagatttcaaataagtttccctatctgaaatctctttatttaattttttaatttataatacccattattaagtatacttatgatactttattacttaattcatcataaaaatttcctattgttatattataataaggcataacccataatagtccaattccacaggttatttctccaaggataaaccatcctataaagcttagcatcaaaataaagaaatacattttatttcctttcatcatttcacagcttgctttaatacaatcaatagctgataagtcattattatcagctaaaataaaataactttgtgcaaacataatacttaaaattatacctggaacaattaatataatatagccgattccaacagctattgttgttaagatcattataataagtgatttaacaaaaattttcccattaaatcctgcaaaaatatcataaattgatgcatcttttcctctcgtaatatttaatataaatgtacacaacccataacttataggacctgctactataacagcaataatcataccaatcgtcgttattgcatctgattcagttacagaacctataatactaatgatgctcggaattattgcgctaataataaatgcggctattgcgagaccccattttccacgtaattgatcttttgaattacgctttaaaactgctctttcaaccattaaaatttcctccatataatattattaaaatgccaaataaacatttttacaataatatatatgctaaataatttttatgtattcctacttattaccaactaacaataaacagtatgattatactaccactttttatgagcaccgtggaaaaaccataatataacaatgactaatattaaatatattattaatatactcatcgaaaacacctctgctttctcaaatctacttaataaattatcgactattttcatctactcttcagtatatttatattcatttaattatgtaatataaccatttacataatataaattaattataccccttcatgatacatataaaactatattttgaatatactttatatgtaaactatattaaggatgtaataattatgaatagaaaaaatataccaaatgtaaaaaaaattagtattattatatcaatattatcaatattcttccttatatttactctatcagcttttggtaattacatgaataaatttaatacagtaaatatcaacaaagaaaaggttatacctaaaaatatgaattctcaagttgataattctgatcctgttcaaccacaaagcagaatgcagaataagtacataaaaaatatagccttattgggaattgattctggagatgataatgtaggacgttctgactgtattttaatagctacaatagataccgaacataataaaataaaactatcttcaataataagggattcttatgtaactattccatcaaaaaataaaaaagataaaatcaatcatgcatatgcttttggcggaccagagctgactttagaaactttgaatctaaacttcaacctaaatattagtcagtttatctctgttaatttcgcatcttttcctaaaatcatagataaaattggaggaataactatcgatattaaagaagatgaattaaaatatataaataattatataaatgatttaaatgctcataacaatacatcatcttctgatattacacaaacaggtcctcaaactgttgatggtactcaagctcttgcttatgcaagaataagatatactgatggaggagattttgaacgaagtcatagacaaagaatagttctagatgaagtatttaaaaaactaaaagaacttccaatattaaaatatccagatgctctagattcacttcttcctttagttgatacaaatctgagttcatctgaaatcctctctttatgtttagatttaacttcatttgataactttaacataatagaagaaagatttccaaaggatgaagatgctgaaggaaaatctatcaatggaatttattattatgtttttgatgaagatgctactataactaagatgcatgattttatttatgactgatatatttaatgaaaccaaagtatatgatctttcctatatactttggtttcattattttttatcgataactatgtttttttatatcttccttaaataaaaaagaaagagtatcacaaaatatttttctttgtgatactctttctttttcaattatttcatccctaagatttatgaccttcaaaatctccatagtttgtatgatatatagtcccatcatgtattggatttgttttgtttgctgcctctgtgttaactacagataaatccttaaaacttggatcattccattctaatttcatgttttcaccccccttcaagaaagtattctttaagatattaaataatattattaaaatcacttataaatttataaaaaatatatatgcttataaatgatctaatttcatactttatttcatcagtgtattcaactggaagtgatttatatttatctagataataatttattttattattatcacaaaagtattctattgttttattacctttcatttttaacatatcctgataaacaacatcccacttatctcttaatctttcaatccaatcagctgcttgtattccccttgaaatctttccttctataaactcatcaggaattaatcctttcatagctctttttattaaatatctttgctgaccatctctcacaaattgatctataggatatgataatattaactcgattaatcgtatgtcccttgttggatctctttttaataatccagtttttaaactgactttagtttcatactcagaaacatgggataatgtaataggattaattatcatctttctttcttcatcccagtcaaaatacttttgtggaaatataaataaattatttttttctaatattttatttatattccattttgacattaaattatcattcagtaatgacatctcgtatggattaaaatccttacattttttataaaataaatattttcttatcttatatggagttgataattttaatatatctttaatacaccttttggtacttactccatatctattttttatacctttgttttcttttattattcctaatatatctctttttcttattagcgtcataagtttagtgtaatattcaccataagaaatagttagatttccatattgtccatctaatagtattttacatccatcttttgctgcttcttctgcaattcctaaataccatgataaattttcaattgccttataaggcatttctaacatactaattttgtcatttatcatatctattgcgcttgtaccttttaattcacaaaatttagaatcaatattttcatacttttcttgtaataattttacaccattgctttcatctgcaatgccacctgtaacttttatatgtttattttcttttagtggaattgatgtataagattttaatttcttattatcttttttcaaatattttgctgctaaagctgctactgatgttgaatctaatccactactaagcattattcctatattctcattacttcttaatctacacttaacagcttctgagaagacttcaataaaatgttcctcatattgagaatccctcgaaaatttttgttgatttatattttctccagctgaccaatatttattatgtctaataccgttttctcctattatcatataagttgctggttcaagtttatagatatcttcatacattgtatgccttaaatcagcagaactaagaactcctggtattgctaaatactctgtaatctgctcttcgtttaatttaacttcatccataacttctaatataggatctattaatgtagaaaatataattttattattcctgtaataataatagaacgtcctctttccaacttgatcccttgcacaaaataattgtcttttttcataatcccaaattgcaaaggaataatcccctattatatatctacaacaattctctccccactctttataagccattaatatatattcactatcagtaaagtcttcaacttggctattttctaaatttaatttattcaataattcctctctattatctataattgcatctgctgttaaaataatagcattttctttgtctaatacaggtattttctcatttatagattcaaaagttatatgttgaagcccacatcctataaatatgtttttataatttaaactattaaatctgtctattttatatgccttcataggttctaacattttttcacctatattttcatctatattttcattattaaaatctatatatccatatataataccactcataaattctccttataattacacttgtattattatttatactgtaattattcataacgaataatatgcacttctctaaatttagcctaattaaattataattatttttgatttagatttttaaattataatttgtgttgtttacttaataatctatattatatttattatgtttttttgttaattattccaactatttcatattaaattaataaattttatgtaagcaaaagtaaacgattatcatatattaaatatgtaaacacaaatttaatttatcagggggatacaaatgtctgattatattagtaacgaatatttagatttattaaatgtccctaccttatggaattttggatttactggcaaaggggtaaaagtagcaattatggaatcagcaataactactttgcctggaaaattaaatattcaaggttggttcaacaccgaaacaaatgtatatactgaaactgctcctaattttgattctctttctgatcatggcttttcaacagctagtataatctctggatatgctactggcgttgctccagattgtaaattatataatgtaattgtaaaaacagatatgactaatatatccaacagtctaaatagtttaaaaaaaggtttaaaatggtgtatagcaaattctatagacataattaatataagtcttgagattccatttgcagatgctgaattaatttcattaactaaacttgcagcagaaaaaaatataattatagtaagttctttgggtaatagctcatctgaaacctgcacttcatttatatcttctggttctgtattaagtataggttctgtaaataaagataaatcattaagtagtttttctaattacggagattgtattgattttgtgtcatttggagatgcggttcctgcctataattctaaaggagaaaaaatatcttttgttggaacttctgcatctactccactagtttctggattagttgcactaattaagcaacaaaataaagatctttccttcaaagaactaaaatatatgttaatggataatgccgaaactttaaatgctaacttaaataataattctatatcatttaagtttccaaaagcttgcttgattccttgcaatcataaacatgacctagatatagttgaaatagaaaaaaatattccaatacaagatttgaaaataataaccgattcaactattaatattaaagatacaattactcctataattcaaatatcaccaaaaagcttagataatttagatgtattagtaacttcttcaaatgaaaaactaactcaaattaattatttttcaaattctataactgcaattgatagtggatatgcaaccattaatttttcaataccacaaagaaattttaataaatctatagtctttcatatattgtctcaactagaacagcaacttagatattcattaaatctttacaatataactaatttacaaaataaaaatctatctggacaaaatataaaagtagcaattattgattctggcgttaatatagtaggtaatattgattctgtaacttatggaccaaactatataacttatcaaccaactacagctgtaacagacacatttggtcaaggtacaattacagcaagtatagttaaagctattgctccaaattgtaaattatattcaataaaaaatcaaagcaatgctggatattcttatgttggagaagatttacaaaacaaagctcttaagtggtgtttagataataaaatggatgttgtaattgctagaaatcttcaacttggattatatgacagcaaaaataaactttttaaacaattaaatgatgctggaattttaactatagtttcacaactttcaggagattctcttaaattcgaatcttctgacagaagtaattttctttgtgtaggtccattaaacagtaacaaatctaacaattttggttacttagatgtaacttgttataatgaatctttccctgcatatactaaagatggtatttttcaattaatatctaatgacacttttcaatatatttttggcattatcggtggaatttgcactttactaaaacaacaaaattcttctttaaatgcatcatctttaaaatcacttcttccaactttatgcactaatatgggtgaatttaaatatttcggctatggaattctaaaagcttatcttttataaaaatagtggatgtttatcttaataaatttattaaaataaacatccttaaaagttcattgtaaatttaaaaaattctctattaaaaaatatagaaaaaattcttagatatattttttaataaatattgtttacattttaataaatatataactgtaaaaatatactattattatagtttaaaaataagaaaggagtactacatgaagttattaaaaaaaataaatcataacaatataaaaaatttaataaataaattcaaatggatactaaaacaatcaaaaccaattattatttttatagtgatgataacactaataaattccttaatatcattttcaaatgtatataatgctattgtttcaaaatctcttatagactctgctataaatggacaaacgcacgaagtatttaaatggttatttataatggcattaattataatattgaatatggttggctctccaattacttcactgataagtacacatgcttctacaaaactcactcaaaatattcaaagaaatttgtatgaacatttagaatacagcgattggcttacccagagtaaatatcatagcataaacttacttacacgaattacttctgatgtagatacaataatttctatgcttttaaaaactatcccttctgtaattacttttacacttacattaattgcttcattctatacattaatttatctggcttcttcaatcgcaattgtggctatcgtaattggaccagctattataataataagcaaaatttttagtaaaagattaaaattaatatataagcaagtgcaagaagccgatataaaatataaatcatttattcaagagtctttacagaatattatgatagtaaaaacattttgcatggagaaagtaaacatagaaaaaattaaaaatatacaaaaaaataattactctctttctatgaaaaacactaaacttttatcattaacaagcttttcaattgatagttgctcatctgctgcatattttacaatattctgctggggggctctaaatatatctaagggaagctatacctatggcacctttacagctatgcttcaactttattctcaaattcaatatccaatatcgtctttagctcatttatttccatctataatttcatcattagcagctgctgaaagactgatggaacttgaaaattttcctattgaaaaatattctcaagactctacaatcacttttaatgctcctactataaattttagaaatgtttcctttaaatataatgatgctagtacggttatagataatataagtttacagattaatccaggagaaactatcgcattaattggatcttcaggagaaggaaaaactactttaataagacttttattatcacttatacaaccttcaaaaggtgaaataagtttctatgaagataatatttcgcaagtaataaatcggaatcatagaactcttatttcttatgttcctcaaggaaatacacttttttcaggaactatcgaagataatttaaaatacggtaatacaaacgcttcccacaatgagatattagattctctaaaaaaatcatgttgttttgactttataaatgatctcccaaatggaattcatactgttataggagaaaaaggtctaggactttcagaaggacaatctcagcgtattgctattgcaagatccttattaagaaaaaagcccattttaatacttgatgaagctacttcatctcttgatcctgaaacagagataaaaattctaaaagaaatcaaaaatttatctcataagccaacatgcataataataactcatagaccatcagctttaaacatatgtagtacaatttataaacttcaaaatggaactttaataaatatagaaaaagatactctacttgaaatcgcaaatgaattagtataaataaattagggagcatagtaatactataaaaataaatattactatgctccctaattttctaatttaagtataactactttgaattatattgatatatttttaaggaaccctataaataaaaatacatttttctatttattttctctcctttaaattcaatgatctgattgttcaacaatttttctgaattgctttcaaaataatcttcacagtctacattcaccttttttaaaaattttaaagatttctttatgcctgtttttcttttactattattatgtgcatctgacccaataaaactatatatattatgtctcatcaatattctagctcttttcttgactttccatccaaaatttccttctatacttccagaatttatttgaaataaacaaccttcctttattaaagaatttagtatatttgatttctttaatataaaattatatctttctggatgtgcaataataggaactatatctcttattctaagctcataaatcatattgagcatagtatgtgaaaatctgtccatattaagttctatcaacatatatctagaatcattaatagttccaattttctttttttcatattcttttaatatattttcagtcagatatacttcctgcccataaaagattttcatgtccaaattttgtttatataatagtttattaagcattcttaccatagccttaacttttctaaattcagcactactacaatcataataatgtggtgtggctataatttttttcacgccatcatctgaacatctcctgagcatttcatatgtcatactcaaaccttgtgatccatcatcaattttgggtaatatatgtgaatgaatgtctaccataggcttaacctttaattattttactaagcataataatcactataacttttattaatagtttgagcttcatttaaaaccataccaataatattagcatcaactttttttaataagtttactgcttcagttactctttttgcttttgtttcttctgctctaattactacaagagtaccatctactgatgctgatattatttgagcatcagttaccacccctactggtggactatctatgataacaatatcatacctttcacttaaaaaactcaataaatttatcatactttgtgatcctaaaatttctgaagggttaggtggtatatttcctgctgtaaggatatctgtatttgaattgtaatgttgaatagtttcttctaatttttcttctcctagaagtatatctgttatacctgctgaatttgatatattaaagaacttatgaattgaaggttttctaaaatcacaatcaagtataataacagattgaccattttgtgaaaatgtcactcccaaattactgcatactgtagattttccatccttagaatcagcacttgttactaacaatgtttttatctttttgcttattgacgaatattgtacattagttcgtaatgtcttatatgcttcagcctctgctgattttggtctactctctactattaacatattaactatctcctctaatactatttgatttctgcatctaaagtatttttatatctagttagaaaattttgctacaacagtaaacatctcattattttctccacctgttacaaaatatttcccacatcttgtccaggcatgagctataatattatttttcttatctttaagtacacctaaatatattgtagttgatatatttttatcccttaacaatttttgtgctgttaaagcttgtacaaggcataaacttttccaaaaagtatattttgatgcctttgaaactatacttcctattctttccgcttcaaagtacgtatctttatctacttcctctggagattcacattttacttttcccattctttttgctaactttctaaatggaataaacaatatataagctctaaaaaatccagtgtatatataagccttaataaactcttttttacttttccattctaattgattaaatttttcaagcaattttaataaggtcatcattatataatctctctataaaattcattgtggattctctacattgttcttcaccaacttcatattcacttaaaagaacatttataatgtcattaatttttatcttatcttttgtgagttcccagattttacttcccacctcatttaatgcataatactttccattttcaatatccatcataactttttctccatcaatatctgcatcgtctatttctaagttccttataacttcacaatttaaatttagtttaattttaaaatcattgcttttattcatttcacgcctccttaactacactttctactaattccatctgatcataaactgtaaattcatttttgggccttattatcttataatatttaatatctttagaaatactaatacattttttcatatagttcgctgatattccctctatataatctaaatattcacccctataaatagactttattatgttatttaatttttcaataccttttacttcttctatttgtactgtagcaatatctctctgttctagttcaattacacattcaagaggtacatcatttaagcaaaaatcatcaattgctggaactagatactttatttgttcatcccccataaatgacttataattttttttatcataattaaatttattcatagcatctgcacataatttttcatacggaaaaccatgctgcacttttagaggttcacattctgaaatagctgctacatcatcagataaaaacttaaaaccgctttctcttaatgctgtagtcaaagttgattttccagaacctctctccccagttattatgatagcttttccatcaattataactgtacctccatgaagagcgattttctctctttgaatcattataaatcctaagcaactacaagtaagatataattgaactacatccatatctgcattttcatatacttcaaagtttattgtatttccattaagcatttggtatattcctatatttctaacattaaaccatatttcattcttactgaacatgctgcaaattccatcacttattttatcctttatttcctctccaagtttacacttatttatttttactatagattgatcattaaattcatgtacttttataaattcttttatctctatatctgattctatattcattccatatactctatataaatatcttaagttttgtttactatttttatccatgctcctctcctttaacttaatctactttatatactattcaaagttaagactatatataacattatgttatttaatagctacatgaatttataaatcaaattgatttaacaatagttttcttctttttattactattcttaaattttttcctatacatatctttttaaatttttcgattaatttctttagtaatctgttaaaccatgctacgattaacatgaatttattaattgcatagggaaaatctcttttcaaatcttcttctttaggaaataatccaactaatatctttttcttttcctttttaattttagctgctgatcttatactaatatttcttctttcctcattatatttatcataagagagtatttcttcaaataatacttctgaatcataattatctagtttatttcttcttagtgcttcttcaaaaaaacttagattaaacaatttatttatcaatttaaataatccaacagaaaatttcaatgctccacattcactgcatttactttcaaatatgttccaatcaatattatctttttctttattacaaaataacacaatatcatataactgccttaatccaaaaccactatttctaagatgttttgccatatgaatacacaaatgaagtaaaaagttctctttatttaatgtctttacttttacaccatctaaatcaaattctattaattcatcccatatatatttttcaaaatttattgtatctgctatatagttttcattatttataagtttccaatgaacttcaatacatactccattttcattataaaatgtagcatgtactggatgattatcttcaatataaataaaatgattttctaaaagatactcctttatcttctgaaaatcatttttgttaattaatatatcaaagtcactcattgtcctaagttcatctacagggtagtattttttaagtactatccctttcaaaactattatatctatattcaattttaatataatatcatcaattatatttctaaatgcttctgtaatttttctttgtgcaataccacttaaaattatgtcttttttccatttatttaatatatcatttggcacatttttaagattattttttccaatcaaataatatattaatgctgaaatctgatgttcatcagctttctctacaaactcaccccaattaataacattatcatctaatatataattttgctttttaattgaatattttagtatgtttactatggtttcatagctgttattcataaaagctctccccctaataattacaaattacattttacttctttattatattagctcataaaatctacacctaatggcttaactagtagtttctatttttctctttttatctaaccctaaaattgataaaaacatattaatttcttttgtaagatataatgatagtacatacccacttccacaaatcacaaatttatacgctgcagaaatcatacaattatttatattaatttcaaatataaccataaacaaactgcatattactaagattaatattgtagatctaaattccatcatgaactcagttaattttctattgaaaaccttctttattagtaagtaataacatgttataaaattcaacatataagctataactacccctattgctacatattcaatttttccttttaatactcctattattatcattaatatattagcacccgcacctagaagacctgcataaaacatcttttttgtttcatttgtagcttgaaatatcgttcctgaactagataataccatttgaacacaaattgaaatactgagaattttaaaacttgcaactgatgtcccccattgatttccaaacataattctaattatttcatctgcactaaaaaagcaatatacactaataaatgcccctagcaaagctaataactttactactttaatatatttttcgtaaataatatctttatcattttgataatccgataaaattggatgtaaaacaggtgtaattacaaatgttaaatttgatactggatataacattaatttatatgctttatcataatatcctagtggcacttgtcccataaatttacctattaataaattatctaaatttctagaaaaataatttataaaattaaatgaaaattgataacttgaaaattgttttattttctttatactactaaaagaaaattttatttttaaatttgatccgtagcaatttattgaaaatgtaaagaagcctactaatagagaatttattactaaagaataatactttgcacctactaaagctaatgctattgtaatcattccacataaaaaatttattataattgttctaactcctagcgttttaaatttcttctcttttagcaataatgaattaggtacaatatttaatatgttaaataaaatagatattgataatatcattccaagataaatatatacattattatcatagatttttgataatggatatgaaaataaagcaaatataatagatataatcactcctgtaagaatagtaaatgtaaaaatttctgatacatctctattacttaattctttattctgtataatcgccggaccaatccccatatccgcaatcattgtaaaaaaacttataaaaactgtaattactgcaactattccataatcatctggagttaatattctagccaatatacagttcactaataattgaatcaatatattgctgtattttgcaataaaattaatcaaagctgcttttttgatacttatattagccattacaaccccctaattttttaattttcaaagatatataacttttaattctactaatgttatatattatatctggacacacaacaaataatttaagttttaaatttttcaaattcttcttttctaatattgatttttttatttttccttttaatggagtatactttttatcatccaaacctaatatataacagtttttaaatgaattattatatagctctactattttttttagtaaaattttataggttattttatcatttatagtttcagaaaattcatataatttctctgctacaacataatatccttctatattttttctacctattttctttgtcataatagaatcatttctaactcttctaaagaataaatcttttggtatataaattattctgtttgattttattaatgcctgtggtgtaaataattcatcttcatgtattattccattataaaatgttaatttattattttttagaaattgtctattgtaaaaaaataaccatactggagatttatagattttcttttttattaattcacaaaataattcctcaccttttaccacatttgatcctagtacatcttttctattataattaaagttcaaattattattcttcaaatctttttctaaaaatacacctgcatcaaacatggcaacttctgctctattcttttcacaagcatagtagcaaagttcagctagttcactatcaatatagtcatcagaatctaaaaaatacacatatttaccacttgaacaatttaacccagaatttctagctccactcaatcccatatttacttgattaattactttaaaatttttatacatattctcatactcatttaatatttttaaactgttgtcagtactaccatcatttaccgctattatttcaatattgtctaatgtttgatttaatgcactttcaatacattttctcaaatatttttctacattatatactggtattattatacttacgttaatttcttgactcatagagttcccccttattatgaaaactgattgtttataatatacattttaatttgctttcccatgtaagataatttaatgcataatcgtacattttttctttaaaattttcatctacttctattttttcataaaacttaattatttcattaatgtctacatcactttcatctgctctaatatttaaacagtatctaaaatcctcaaaatctaaatctttgactgtttttataaaaggtattccttttgcacagtattctcttgattttaaatctgctaattgataaattttatttctatgtcttccaatactagcgatagctatatcggctaaagaatatattctttccaatttatcacccgataagtatccataaaacttaacattgtcattcaatttttgccttttaactatttcctttaaatttttcaattctgctccatcaccaacaatatgaaatattatattcttatctccttcacctttaatataattttttattcctctaataactctgtcatatccatgatatttagcaattcctcctactccaattatatttaatatctttgtatctttatttttatttttatagcatcctataatttcctttgatatgccattactagttcttatagttggaactttaaaaatattttcatcttctgaaaaagtaataattctatttacatactttctcaatttttttctatatattctatcttgtactattcttaatatatatcctaatttactcttcaattttaatgaattagaaaatacattatcaatttcttctttatcataaggatatgttactatctctaagtagatttttatattattattattaaaacgtatattatctaagaaattaacaaatgatttacttgatcttggatatctaatataaacacagtcaaaatctttaattatatttaacttcattatagtttcaaatattttttttattcttattttttctttcaaattcatatcatcagaatacagcaatcttgtattattattctctataccttgttcaattatctcatcatctttccaaaaaataacttttcctgttatactcaaatttttgaaggcttgtctttgaaaatatattttttttgttactccatcacactcgttactcatattatgatttggaattatatataataatttcacaataaattctccttactatatctatttttaagaattaattttgtatacaccattcccatataacctataggtaaagttattatacatagtaatttattactagcttgttcaaagagattttttattttttcttttccacacaatccatatctaaaataattcgattgatgatatattttttttaataatggaattttatacttaatttcttcattgtgataatagcatcgtcctctataattctgtattgataaagaaagcatatgtttagttaatccatcattttgataattccccaaataaatcacttcattaaaccatcttattttatatccatcattagctattttattccataaaacagcttcattaagaaatttttctcctgaaaattctggaaatctatattttttaagaactttactataaaatacttctgctttatcaccttttaagttgtatctatatatagattctaatgctgtagcatcgatcacatcacttttcatcgtatttgataataattttccattgaatgacgctctcattcctgctaaaccacaaaaattatctttatcttttattccattttcaattttaatgattctttccaaagaattattaactaattggtcatctgaatctactataaaaaataattttgtttgacacatttgaattgctttgttaagcgccctatgcttaccaccattttctatttttttatatactatatctataatcttttgatctataaatctttctattaattcttcagtattatcagtcgatccatcatcaataacaatccacacaaaatttttaaatgtttgtttcttaagtgagttatacaaattatctaataaatatgccctattaaatgtacacgttactacagatattattttctctagagtcatccatacatacccccattaaaatacttgtaaaaaacaccaatataatcatattatctggcttaaatactaagccattatatgtattaatatttaccacttcaattacaaaggcaaataaaacatagtattctttactttttataaattttattattggtattataaaaatacatattataataaatgctgcacataatattccatattttaaagctattacttttattggatactccaaatatgcagtagttgtactattattaaaaaaattatttaatattctatctaaatattcaccatatccataaaaaaaattatattgaatacaattataactgtttatatgcaatgctgcttccgatcttccagatgttaatgtttctccttgtagtcttacaattaaagtattaaaaaagcctaatacatatgatcctaacactatagctattggaataagcttatcacgtaaaatatttatcttttgtgatgttaataatattgatattaatattaaaattgcaccagtcttactacctgttaacaatactcctattactgaaattattgtgactacattcctatttagcaactctacattatatttttttaagatcacattatttaatagataaaaaattagaaataattcttttgtaaataatgaatgccccatataagatgtatatctatatctaaaatatgttgaactagctatccatctttttaatccagggactaaataatatcctaaaaatttcattattttaaaacctatgaaccagtcaattaaacctattagaaatataataaccataaaaaaattaataatttttgttgatgtaataacaacttgtttaatttcttttttaggcaactttaccgccaacatatataaaggtaatatcgtcataaccagacttcttaaaattgaatttattggattattatttattattctatctataaaaataatgtatataccaataaatgttacataaataaccataactccactaactctattaatatttaaaataatatatataacaagtaaaaataaaaacaaaatatttatagctccaaattcacccaaaaatttttctctcatataatatgagttaataaatactgaatatagcattaacatataaattatattattagtattttttttcttcattgttaattacctcctaaaatcaggagttatataaaatatataaattactaatcattttatctatactaaagttttgaaacgcataattgtaagtttctttaattttgtttttcctactgtcttccgtaattacttttacaagatttaaatatagatcattataatcttctgatttaaataaatagccaaaattattattaactattatttccttaggaccatcaatgttagatgctataactcgaaccttagcagccatagcttctataattgatattccaaatccttcgaatcttgaaggtaatacaaatatatccatattattcaaaaacataggaatatcattaatgttacctaaaaattcaacattattttccaaatttaaattttcaaccatagttactaaattattcatttcattttgatctttagattcatatgttccagcaaaaaaacattttatatttggataaacttttacaagcaaatttattgcttgtatcaatatatcttgacctttctttaaaggttgtattctggcaacacatcctatattaattttctcattcttctgttcactgtgttgtttaaattttgaaaaatctatcccattatatataattttaactttactttccttaacccctttcaataatatttctttttttaccgagtttgatatagctattatatttttcacaaataatttatcaagtaaaagataaaatatacttagttctctataaataggaatatcatgtatagtatgatataaatctatatcacccaaaaaaacttttactacactcgatacaaaaacactttctttatcatgacaatgaattttatttatttttaatcgcttgattaaatttaagtattgtattaaaaatttaaaattcatcttatctggttccctatttaaacaaacaattctactttgacatgtaattgttgataacaattctttggaataatcattattaataatacataaaaaaacattatcctcttttctattccaattattcaataagtcgcacaatagtttttctgcaccaccagtattgaatgatattatagtatttaaaatattcattactcacctcactgctatattacttttacataactataaaagaataattaattttcacgttacaatttagttatagaaggcttgaatataattcttctattttcttcaaatatacagaaataccatattcattttgtataatctttttagaatttgtagaaagtgttttccataattcgctatccttaatacacatttttattttttcttgaattttattaatatctcctggttttacagtatatccatttaaattatctataacaacttcatctatacttccaacagtagtagatattacaggcaaaccataactcattgcttctaaaattgatagtggtaagccttcattatatgaaggtaatacaaatagctggcattttttaattatttctatttttttctctccacttacccaaccttctaatctaaagtaactttgtaaatttctatcttttatatatttcttcacttccttttcatcttttccacttcctgcaactataaattttaaattatacttctttaattcattgtcattaataatatttgatgcaactttaacaaaatcaaaaattccttttctcttaataattactgctaaaaataatatatttatatttataccatcataattgactttttcttctctaatttctactgaatttcttataataatagtatttattgattgatctatgcctttaataaaatcattccagcttgttcctaaaacaataacagaatcagctataagaaacattttttttataacacgttgtaaatatttattgttattatagaattctttaaaatcagctccatgtaaatgaattataactttcttaccaaaaactttacatattaatacaactattaactttctgaaaaaacttcccctttctgataaatgaatatgaacaatattaacatcattaataattaaattcttaacaataattattaatgatttaataaaaaataaaattttatacattttacctacattttctatatgtgttggtacataggttatattaacatcttcaaaattattatttaaaaaacttttaactactgtagtcattccacctttaacagataaatctgatccaatcatcaatacatttatcaaattcgtactaacctcctaatcaatctatatacccaaatttgctttgtaactgttcaatcataattctttttttttcttctgtaactcttcctcttagtgtccaacttttatcatataaattagtagttttcattctttctttattcttatcaataaatagctctaatttatcaattgtttttgctggatttcctgctacaacagtattttctggaacatctttagatactaaactattagctccaataatagaattatttccaattgatacattgggtaatatagtagaatttgctcctataaaaacattatctcctatatttacttttccaattttggtatatccaacatgctttttacaacttgcatcatgtgctaatatatagaccttagatgctaatgtaacattattccctatgctaattagccatgcaaatggtgtgtcaatctggcaccctttttctatttgaaaattttcaccaacttttaatcctaaacgtattaatttatacacatatatcttttttataagatttcttattctattaatcataatcttctactcctttgttaactcacaaattttaatttttatatttaagacttattcctaatattttcaaatcatcaactagatatctcctaaacattctcttaggttccatacataacctataaaaccactcaagtccgtttttttgcatccaaatcggagctctttttatatttcctgcttcaaaatcaatgctagctccaattgctaaagaaactggtactttcaatttctctttatacttatatataaatttttcttgtttaggtgctcctaatccaactgccaaaatatctggtttgcaattatttattagttctattatatgattgatttcatcttgattgttttcaaatccataacttggtgaataagttccaactatatttagtccatcaaattgttgcattaatctttctgctgctttttcagctactccttctgctgctccaagtaaaaataatttatatcctttaaccgcccctaatttgcaaatttccggaaataaatctgaccctgatattttttcttttattggagtagattttaattttgaaatccatattaaaggcattccatctgttaatattaagtctgcatcttcatatattttttgcaattcagcatctgtttcaagtttaacaatatgatctacattaggagtaacaacataactatttctatctgacgctattaatttatcaattctagtgattgcttcttccatagttacattatctatctgtgtattcaaaaatttaattcttgacatattgttcctccattaatattgattaatttaaatactctctctataatctctaagattatccatataccccttattaacaatataaatgctgtcatcagtctcaatagtcataacatcttcaattccaatcatcacaactcttttatcattattaattgcaatatttgatttagattcaattacccttgcatttccttcaataatattattaaaatcatctttctttttatatctctctactgatttccatgttccaatatcatcccacccaatatctacaggtacaacatatatctctttagatttttctaaaaccgcataatctatggatatagcttccgtcttattataattttcattaattacatcttttatttcatttatatctacactttgaacaccctttaaaggttcatatatacttggacaatattctcttatttcatttaatatattttcaaccttccacaaaaacattccgccattccaaagataattaccatctcttaaatatctttttgcttttactaaatctggcttctcaacaaatttatctacctttatgaatctttcttcattcacgtctacataattatcactatattttatatatccatatccagtttctggtctatccattttcattccaacagtaattattgctttatcatttttattaatgaaattactgcaatttacgataatatctctaaacttttcttcattttttattaaatgatctgaaggtaataccgccataactgcatctttaaatcttctctttattatcattgaagaaagagtaatgcatggcgctgtatttctcccctctggttcaactattatattttccactggaagttctggaagttgttcttttactaaatcaacatatggagaaacagtacatataaatattctttctattggtattattggctttactctatttacagtcatctgtatcattgtttcatcacctataaggtttaaaaactgtttaggcttttcttctgtggatagtggccagaatcttgtcccttttcctcctgccattatgagtgcacataacataacttcaccttccttatcaaagtagttattttttagtagctgcaacttctatatttaatgatttctcataatttaatattgtttttcttcctactgaatagtaatctactttttcattcattatgtcagctatcttatagcagtttcttccatcaaaaataattggagtattcattaggttacaataagtatctattttaatattctttatttcatcccactctgtaaaaataaatacaacatcagcccctgcaattgcctcttctggcttattaacatattctatttcacttggataaagctttttgaaattattctctcctactggatcataagcaacaacttgtactccttcatctaaaagtcttctaatattaggtattgaaggcgcttctcttaagtcatctgttccaggtttaaatgttaatccaagtacagcagctcttaaacctcttaaatttccaaatcttttctttgcttgtctaaataatttatatttctgattttcatttacttcaatagttgcttttattgttcttatttcatttccattatcatttgaaagccagtgaagtgcctttgtatctttaggaaaacatgatccaccatatcctatacctgcttttaagaatttatctccaattctaggatcataactcataccttttgttacatcttcaatatcagcgccaacaaattcacaaaaattagcaatttcattaataaatgaaatctttagtgctaaaaaatcattagatgcatatttgatcatttctgcacttcttctatttgttacaacaattggctgattatatctttcataaacttctcttaacaattcttctgcaccttttgattcaacaccaataacgattctttttgcctcaagtgtatcttttacagctgttccttgagataaaaattcaggattagatgcaacctcaatatgaactttgttttttaaactttcccttaaaaactcttcaactctatcattagttcctattggaactgtagacttaacaactacaagacagtcattttcaacattttcagcaatttgtgtacatacgttgaaaacataatctaagtttgcagaaccatcagacctttcaggagttccaacccctataaatataatatctgcatctttatatgaatttttataatctgttgtaaaatttaatttgcctcttaaatagttatttttcaataattcatctaaaccaggttcatatataggtgaaatgccttgtttcatcatctctaccttattttcatcaatatctacgcatgttactttatggtctttttctgctaagcaagctcctgtgactaatccaacatatcctgttcctgatacaactattttcataattaccttctttccaaaattactgtaacatattgttatatacattgattttatgtgaataaatttgtatttattacaaaaaaatcaggaatatcttaaatagcataatattttagatatccccattaatatttaaatattacaatcaaaaacaatatatagtattttaatctttactatttcatatattccaattacttttcttctcctatatgtggtattaaacctattacaggaattccaatactagtttctatctgttctcttgtcttaaatgtattgcttatatattccatgaataaaactaatgttatacctaagaatgcacctacaataattcccattaatatattcctaatactgtttaaattcccaggatatataggatacttagagctctcaaccacttttacacttccatttggtattaattcttttgcttctttaataaattcctgagttactgcatccaatacatctttacttaaaatactattagcatttttgtatttgattgtcattatctgagtttcttctccttgactaacagaaagccctcctgctactgcttctggcaatacatcaagatgacttttctcaactgccttttcaattaaatcatcagtagtgattaattcagaataagtttttaataaattttgatataaagtaacatctcctgtactgtactcctttttttccatagtatcctttccaataaacacctttaagcttgaagtatatactggtgttactaaaaagaaactatataatgcactgattatggtagctgttagagttactattataattattttccacttagattttataatctggattatttctgaaatactaattgtttcttcctccataatttcctcctttcaaaagctatattatgtatatattcttatgtgaatcaaattattactttttttagttttatatctaattttcaactataaaaaatgatttaaagctaaattttcgtattttaataaaaaaaactatttctattatcaaactattatgcatatgtttagtaatatattgattaacatatttttcaaaatatatatgaaaggctggttttttatcatgaaaatgaaaaagaaaactaaattaaattttattatattatttttagtaataatattaacggctgttttatttatgggtataaaaaaagagcatgccctgatagttcaaacttctcagcaaacatataatttaggaagtcctatcaattataattctgataaatataacagtgtgtataataaaatcaaagcaaatgaaaatgtaaaaattcttttattaggagatgagctgacttccggtcttatttcagataattccacctatccagtagctgaaaatttaagtagcttttttaaaacaacttataatgttaactgtgattttcaatatttgcagcaaaaagatgctactattataaatggatttcaacttttagattcaaaccctgaccttaaagactttgatctcgttatattatcctttggtcttaaagatgcaaaagataacagttcattaaagagctttgctcaaaactacagtgatttaataggaaaattaaagagcagaaattataattgcttaattacagcattactacctccaagtcttaataacgataatgaatatgtctcagaaatgaaacatatctgttctagtaacaacatatcttatgcagacacaaataattattttgaaaaatcagatgccgaaaaagactccttaattgtaaataatcttccaacatcatcaggatacgatttagtagtctcatcaatttgtaatttaattagaaataatatatattgattttaaaaataaaattccatcttatcttgaattgacaagacaagatggaattttatttatttaatacattaaagtatataatagaaaaaagcttccttaatatatgcattatttttcaattcgtcttaatgttaacgtattctttttatgtagccaataaaaaaaacatcccattaaaacaatgaagatgcttttgtgttttcattttattaaaatttttaagaaaatatttttaaatcaacttgcattttggtcccctaaaaatacgaaaaatgttttaaatatcaactttatatctaataaaaaatttctatccttaacgtacttcacatcaagcctcatccaatcttcaaattctatatgatcacgtccttgaacctgccaatagcacgtaagtcctggttttacctttaatctttctagcatccatggttcaaactgtattacttcttttggaagtgatggtcttggtccaacgatgctcatttcaccctttaatatgtttataagctgtggtaactcatctatacttgtcttccttatgaaccttcctattgtagttacccttggatcgttcttaattttaaacattggtccttttctttcattttgtttttctaattttcccttcatatcttcagcattcacaaccattgatctaaatttgtacattttaaactttttattattaatacctacacgttcttgtgaaaatattactggaccttttgactcaatctttataagtatggcaacaactataagtataggtgctaatactatcagtgctgacattgaacatataatatccataagccgttttaaaaattcatacgtatttcttgataatttctttttttcaagcattattctgttattgtctaaatttaactcttgcaataaaaatcccctcccttaaccacactttataagttttatatttaatcttatgtcgatgaatttttatttattactttaaaaaacataatattgtaaattttaactttttacttttttttaaaactaaattcgctttacatattatttcgtattatttatttctaataacccttgtattctactcaatctaaatatttacaaaatttaaacttaataatgcctatgtaaatctataattcacctaatttttacgatttcattaatttataaaagtttgcaaaaaaatttatataattgtatactttccatatataaattttttaattattaattttatacataaattcttattgtggaggtaaggaaatggaaactagaataaatattacagctgaaaaacatgctcaggggtataactgtgctcaagcaatactttgcacatactgtgacttatttggaatggatgaagaaactgcatttagagtttctgaaggatttggacttggaatgggtggaatgcaaagtacgtgtggagctcttacaggagttcttatgctcgctggtttaaaaaatagtaatggacttgttaatcctggtagtactaaaggaagtacttatgctctttcaaaaaaattggctgaagaatttaaagaaatgaattcaactacaatttgtaaagaactaaagggaattgatgatggtattgtaaaacgttcatgtcctggatgtatagaagatgctgctaaacttgtagaaaaattcttatttgattagatataataacaaaaaatccctactttaatttttaaaatagggattttttgtttaagattttaaattaaaatctgtaccaaatatattattattggtaaaaatatagcgggcaataaattagctacttttattttactggcaccaatcatatttgttcctagacccataattaaaacacttccaatggcagacatgtttcctataactgtatctgtaagtacactagataaacatcctgcaagaagtgtaatgcttccctgataaactaatattgctactgatgacaacattactcctattccaagagaagatgcaaatattatagatgaaactccatctaatattgattttgcaaaaagtgttgaatgatttccttgaagaccactttcaagagaacctacaactgccattgctccaacacaaaataaaagacttgatgttacaaatccttctgatatagaaattttttctgaatctttatttttcttttttaaattaatcttattttctataaaattacctaagtcatttaatcttttgtctatatcaataatttccccaattaatgctccaacagctatacaaattattataatgagagtatcctgtcctttaagtgctccacttattcctatgtataatacacataaagctagtccactcattattgtattgctcatcttctcagtaagcttttcctttactattaatccaattatacaaccacctattactgctaaagcattcactattgttcctaacatattatccccctgttattttgtatatattctttactctaaattatattctatttttaggatataatctattttaataaaatttataaaatgataatgaatttcatttacatttatctttttttatgttatattatttttgggcttaattttatcgcggcaaatctttaatatggagatgataaattatggcaaaaatgatgggaccaagatttaagttatgtagaagattaggattaaacgtaaatggtcatcctaaagcaatgaaaagagctggaaatggcagcgctagagattcaaaaaaattatcaccttatggtacacaactattagaaaagcaaagattaagagcttattatggtgtaatggaaaagcaatttgtaacttacgcaagaaaagcatttaaagataaagaccaaacaggctatgcccttattaaaagacttgaatgcagacttgataatatagtttttagacttggattttcaagttcactagcacaagctagacaaatggttgttcatggacatattttagttaatggagaaaaggtaaatataccatctttcaatgttaatattggtgatgttgttgctttaagagaaaaatctcaaaagaatgaaatgttcagagataatttcttatctaacatacttaatgtttatccttatttaacaaagaatgaagctgaattttcaggtagccttttaagatatcctgaaagaagtgaagttccgattcaaattaatgattcattagtagtagaatactactcaaaattattctaattgaaatttatactccttagaaattattgtgtatttctaaaccttatgagagagactccctctctttcataaggatacaactaaaaaagcttattagtgatcttttaaaaagttcattgatatatataacgcaataatgctatattattctaatcgccattaatgatatagccattatattacaaaactccaaacacacaaaaagcacatagattatcttttggtgcacaacaaaagataattatatgtgcttttaattttatcatggtttactatactttctttaaggaatacagtaccttttactttcttgcacaattggatgctgtaccttttaatatcttcaaaccatgatccaattcacttattatatattgaagacattcatctacagccttaggacttccaggcatatttataattaaggtttctttacgaattcctgctgctgcacgactaagcattgctctttttgtgatctgaagactgtatgaacgcattgcttctggtatccctggaacttcacgttcaacaatgtctttggtggcttcaggtgtccagtctctttttgaaaatcctgttccacctgtagttaaaataagatctgctatattattgtctgctattctcatcatctcatctgcaaggatttttctttcatctggaagtatgattgtatgtacaacttcataaccatattctttaactattctttcaatttcaggtccgcttttatcttctcttttaccttcatatccactatcacttgaagttattactgctactctgaacatattacaaaatcatctcctactttaatctttcctccatgaattactcttgtaaatacaccttctcttggcattatacaatctccaactctatggaatatctcacaatgggaatgacactttttcccaacttgtgtaagttcaagaactacatcattacatttaaatctagttccaacgggaagtgttttaaaatcataaccttcaattaaaagattttcaccaaaatctccatcagttacatttccacctttttcattgaattctttaactctatcataagataaaagactcacctgtctatgccagtttccaccatgagcatcattttctaatccatatccttcaaaaacattgcactcttgaatatttttcttaacagttcctcttttttcacttatacatactgctataacttttcccatttcctatctgcctcttctttcttttcttgttctaaataaactatcaattttcaactgtaactgttccttgttaactattaactgttaactgaattcatcctccaatttgcgacattgcacgatgttcaaccttttcttcatgatcttttataagtttaaagttatgactttcaggtttattatatatagttgcttctattgcattcattatttcctcatcactttttccactacgaagcatttttcttaaatccgtacctatatcgtattgcagacatgcctttaagaagccttcacatgtaagccttactctattacatgtttcacaaaacttatgatttacagcacttataaaaccaatttttcctttatatccttcaagagtaaaataatcactaggaccatttccaagctttccatcaaaagctgttaattttccaatattatcttctattaatgactttacttcttcatcattaagtccattcatatttttaccaagacctattggcatcatttctataaatcttatacttatatcattgtcctttgataattttaataaatcaataagttcatcttcgtttttaccttttatgggtacgcaatttatctttacctttaaatctttatattttaaacattcattaataccattcaatactttgtttacatctccaactcttgttaaagacttataggtatcatcttttaatgtatctatacttatgttaactgcatcaagaccactttttacaagatcatctatcattccctcaagtagtattccattagtagtcaaagttacattttcaattccttcaacttcctttattcctttaataagcttataaacatctttccttacaagaggctcccctcctgttatcttaactttacttattccaagttttgaaaacatcctacataatcttattatttcttcatatgataagatatcatcgtgtttcactagatttattccattttccggcatacagtatacacatcttaaattacatctatctgtaattgaaattctaatataatctatctttcttttgtaaatatctatcatataccgcactctcctatatattctagcaggaattctgcaattttatctatatcattcaaattaagtgttttaattaactcttcattataatccatatcacttactattgctaaaagtgtttctttcttacatacacttttatgtgaatttccttttcttattatttctaatttaggataatctgaattcttaaatccttctaaaagtatcacatcagcttctttaaagtatgatatcaattcttcttccttcgtatcttcctgctccttaatcatcataaacttatttttcgaaaaaattgcagttccataggctcctgcttttttatgcttgtatgtatcagttccacagacatcagcatcaaaatcatgtccatcatgttttattgttgcaactttcaattctttttctattaattttggtataagcttttgaatcaaagtagtctttccagaatttttaactccactgactgcaattaaaacaggctttttcctatttttcattaatgaaatctccactttttccacctgttttcttagctaagtgtacttctgaaatttccatagttttatcaatagccttacacatatcatatatagttaaaagtgcaacatttacgcctgttaatgcttccatttctacacctgtttttccattaactttagctgtgcatactgcttcaatataattttcttcttcatttacattaaaatctatactacatttagttatcataagaggatgacacattggaattaattctgaagttttctttactcccattattccagcaactcttgcaactccaagtacatctcctttttcaacagtatcatttactattgcttctattacagctttatttacatatatctttcctttagcaatggcaactctttgagttatattcttttcagatacatcaaccattacagcatttccttttgaatcaaaatgagttaatttattttccatatttattctttccttctatctttcatatctatattaaaatcacatttactttgtcgccaatttttaatttctctgttccttgttttatatcaattaatgcattacatccaatcatagatgataatattcccgaggaatgttttccattatttaatttaactataccactttcatagtatcctcttataaatcttcttactttactggatttattaaaatcactatccattattgcaataacccttttagtattaattctcatatctccacttatctttcctaaaacaggccgtgcaagaagttcaaaagttgcaagggatgcaaatggattccctgaaagacttaaaataggtttcccaccatataacgaaaacattgcaggtgttcctggcttaagattaactttccagtacagtatctcagctcctatgtatggtagtgcttcatgaaggatatccttctttccaacagaaacaccacctgttgttaagactatatcaatttcattaattacagattttattttatctccaactactttataatcatcacctaaaacttcacactcaacaacctctattccaagttctctcagcctagcactaaatacatgcatattactatcatatatttttccttctttaagtggctttccaggtacacatacttcatcaccagttactagcagtgcagctttaatttttctcttaactttaatcttgtcatatcccattccagacaaaatacctatatgtatataatttaaaagttctccttttttcattaataaagtatttttctgtacatcttcgcccataaaacagtaattatcatgctttttaagttcttcatatattttaacagcctccataccttcatcagtattttcctgcttaattacacaatcacaaccttctggcaattttgcacctgtcattatcctgattgcttctttatgatttaaaactttttcagaatatcctcctgcaaatacttcatctattactttaagagttacaggattatctctgcttgcatttttagtatcttctgcaataagtgcatatccatctaaaggtgaacggtcaaatggaggattgcttataggtgcatatatatcctcatataaaacccttccacatgctttttcaagaagtatgtcttcagtttcatctatttcttgaacattttcttccattattgaaactgcttcttcaagctctattctaaacttcatttgttatcctgctccttttattataatgcgcctttaccaaactcacaccttggataagtacatactttacatgaaaaacataatccaccatgacccattctgcttatgtctatttttgttaccttaagtcctgctgcaattcttggaagaacaagatcaaatactgttgcttttgaatacattacacagcctggaagtcccataattggtgttccatcattgaaatatccaagaagaaacattgctcctggaagaactggtgcaccatacgttattatttctgctccactttttttaattgcaccaggagttaaatcatctggatcaacactcatacctcctgtacataaaatcatttctgctccactgtcttttatttcatttatggcatctattatcatttcatttttgtcatctacaattttatgccaacatacttcaatgccatattctttaagcttatttataattacaggtgtaaaagtatcctttattcttccatgataaacttcacttccagttgtaacaactccagctttcatctttctatatggaagaagttctaaaagcggcttaccattagctattttctttgcttcttctaatttagattcttcaataataagtggaataactcttgttccagctaatttatcacctttttttactgcatagttagtatgtcttgttgctatcataatctcatcaagatcattgatcgcatctaatctattaacatcaactctgaataaaccatcacattctgcaattaattcaatttttccttcctttatttctgttcctttcatattttcatttttacatatttcaaaaagaatttctgctgcttcattttcatgaagcataccttctttcttttcccatatataaagatgttcttttcctagtgaaagtaacattggtatatcctcttttgttactacatgcccttttctaaatggagtgtctttaacaacatccttaactattcttgttatatcatgacaaagtacatgccctacagcatttactgtttctatttttttcatattatattaaaccccttttttaatctatcgttaaatcttaattctacatctacgaagaaaataagtttgtttttcattttaatattaaaataagctgaatcattcatcacctcaataaaaaggatatgaaaaattcagcttataacaatctttaatgctaaaattatcataaaactattcaaactaaaatattattaaaaatacataaaagcaaaatcctatcattgctgttgaaataataataagtcatatataacatcatttgtaaatgtattgttgtataaaatgtataaataatattttagtttaaataatcctccttttcaaacacggaaggcaatatagtttcccatagaaccctgaaacaaaatgtagtatattaaactatcatcatacattctgtttgacaaaagcatcatagatttactccttagatacagttgttcggagattatttaattattcattatatatatttatttaaatcattatactcatttggagtattgatatttagtaattcttccttatgaagccccacatcttttaaagatattatctttccgttaacatatttaacaagatcggtcaacttataattcttactataaatcattttttcaataaaaggaagacattctttggaatagattcctccaagaggatatatcctttcattttcatctttaaatactatgcatttatcatctttatttaaatttctccttagaatttctataattctttcagatatttttggcatatcacatgcagtaacaaaaacatactcttcatgaatctcacttaatgctgagtatatacctccaataggtccaatttccttatatttatcttctatgagttcataatttaaataattatatttttctatgttatctacagaaatataaattttattaaatttttttaaaacctctaatatattttcaatgaaagtcttatcttgatattttaaaaaagccttattatttccattcatccttgaactttttccacctgcaagaactaatgcacatatttccatagatatctcaccctttctcaattgacattttacaattgacacgtgatgttaaaactttatatcactatagcgttttttattagaacttatatagtttttattttttatagcttctaacaagcattcttgcaaaattataaagcacaaagcttattattgctgttgtcatataaatttgaattccactaatttgttttgcaatatttcctaggaattcataaccttgagctgttaataatcctgccatttttgttgatgcaacaattcctattgccattgggaatgttaaccctgcaaatcctggattaaattcaaatgagaagaatcctggcattttatatattataaatattaaagcacataatactgcaaagtataatgcataagctaaaatcatatttggctctttaataaagtttatataacttacaagacaaagacttgatggtgcaagaactatagcctgtgtatgatacataggattctttattggatgttttgctaatctataaatcataaatggaattataagagcaaatacgcatattccataataaacaactattttgcagataaatggttcattcataactccacctactactgtagaaaccattattccattataagttacaaaccagcttggtacaaaagtatcaatattaacacctttaattacatttctgtatgtaaaaactaatatgtggatagcatgaaggattaatcctataaaccatacagctttaccaattgtagcattaaaatcaaatatataagaaccaagtatcattgtaagcattgtgaacccagcatataaactcgccggtactgtattactatattctttaaatacagtcttattatgtccaaatatttttgcagtataagcaatcattattactgcaactgcaaatattgttatatgctttattcatgtaaatcctaaatttgcatatacagttccaagtgttgctgcacctaccatagtcggcagaattgcaacaggtaaattttctaacttttgaaagaaagttttattcattggtgttcattcccctttttaatatttttatatttatcagttaaaagttgtggttgatattatttcagaagatctttatatatttttaaacttacaacttaatagaattcatcctcaaattgtaaattattaacttcaactgaatttaaacttcttcataatagaattcaaaatttgatttttcattaaagaaatcagaataatctattttaaacaatggtttttctattttagatacatctatttttctttttataagctgagttaatacgcctgaatatgataaatcaccttgaagaatagctccataaatcttcccatccttatgaattattttcttgtagtttccatcatcatcactttcaatttcaacctgataagtttcatctggaggagtatttattccaagtgacattgttggaatacctaagaaattcattgttgacttacttgcaaagaaatctgtcatttctgaatttataccacacatattatttgcagctattataccttctttaacagcagttggccagattgggtttctacctgttacatctcctgctccgaaaacatctttaacattagtctttccttgtgtatctattactaatccaaacttatcacattctatttcgctattttgtaaaaattctacattagctcttacaccagctgcacatattaataaatcacaaggaatagtttctccgcttgttaataaaatttcttttatatttccatcctcatcaacaataagttcttttacacctttttcataatactgttttacaccctttgcactatatgcttcttcataaacagatgcagcttttttatcaagctgaattgaaagcattctatcctgcatttctactaaagaaacattgcaatcagtatgtaaaagacctgaaataacatctattccaacaagacctgctcccataacaactatgttcttacagtttttagacatctccataattttttcacaatcatcaaagttacggaatccaattgaattttttgcagtttttaaatgaggtattggtggaaagaatgtatgtgctcccgttgcaataagaagcttatcatattctatactattaccattttcaagagttacatatttcttgtttacatcaacacctgtagctgaaatacctttaatccagttaatattatttttttctatgaagttatcttcaacaaattcaagcttctttacatctcttatgccttccatatagtgatgaagaatgcatcttgaataaattttatcatcctttgaaactaaagttatatctgcatctttatctaaagctcttaattgcctcgctccgcttattccagctgctgaagctccaagtacaacgtatttcataaactaaacctcctgtaaagttatagcacccattgggcatttttcaacacacattggtttgcttccatctttttcactacaactagtgcacatgtcacatttcattatttccttctgctttaatctatctgccttaagaacgccataaggacatgccattatacacatataacaacttgcacatctgtctttgtcatattcaacaaagccattttcatcatttttatgcattgctcctgtcatacatgtgtatacacactcaggtctatcacagtgacggcagaaaataggagctgctttagtcttactgtcaattgttactctgtttcttgaatcacagctttcatgacttactacacatgctgtaacacaagttaaacatccgatacacttacttctgtctatttttattctcttcatgaagattttcctcctaaagtttctctatattaatcggtgtagttttatatgatggttcttttgaatatggatcatatattgatggagttaacttattacattctaaataatgcattggagcataaagttcttcatatctttgattatctgtaattttaaccataaaatctgcagattcaccatttatagaattaactcttatcatatcattttcttttatatttttttcttcagcaagtttagtgttcataaatatatatgctgtatctatgcttacatcctcaataaatcttacttctcttgttctagtttgagtatgccattgtcctactgttcctcttcctgtattaaatattaaagggaattcttcacttgtaggtaacggattttccttaacatcttcaaatatgaatttagctttcttagatggagtatagaaaagattatcttcaaataaacgtctttgatcttctttcaattcttctccttctctaaacggccattgtattccgtttgaatctactaacccatcgtagtcaacacctgtcatatcacatggcatgtttcttgaacattctttcataagattaaaagcatctcttggtgtttgccacttatcaagtaaatctcccattcctaatgctttacctattccaagcattacctcataatcagtcttttcattttcttctttttcaagcgctggtctcattgctgaaatacgtctttcagtatttatatatgatccttcttttttaattcctggaactacaggtaaataaacatcacagatcttagcactatccgtatcatcatatatgtcttgaactacaaataactctaagttttctacagctttcataaatgtcttattattagtccatgaatgtcttggatttgtacatactacccataaagcttttatttcacctgaaattatcttttcaactattacattgtatggtgctgttggcttctgggctaatacgctttcgtctacgcctaaaacctctgcaaccctttttcttcttacgggattatcaaagtctccaccaccataaagtcctgctgtgttgctatatgcacgagagcccatagcattacactgtcctgtaagtgaatttgctcctgttcctggtcttccaatatttccagtcataagtgctaaatttattatagcttgagctgttctaacagcttcatacccttgattaacacccattgtccaccagaatgaaactctttttccttcatgaattaactctacaagttctaaaatttgttcttcttttaatcctgtaatttctgaacctttttccaatgtatatgccttagcaaattctttaaaatcttcatatccttcagtataattttctatatattctttatttacatatcccttttcaataagaatatttgctactgtataaaataaagccaaatcacttttaccttttaatccataccaatagtcagcatgttgtgctgtttctgattttcttggatctattactataagttttttattcttgttacttcttattctgtcccataatataggatgcgcaacaactggatttgcacctattaaaattactgtatctgaaagttcaacatcatttaatgtgtatggtggagaatcaaaaccataactctgcttatgagctacaacggcagttgccatacaaagtcttgtatttccgtcaagattagcttttaaatgatttctcattacatgtccaagtaatgcaaactcttctaaagtaagctgccctgtactaatacctgcaatactttcacttccatatttctctttgatttcaatgaatttatctgcaacatatttaaaagtatcatcccattccatagttttaaaagaaccatctttttgtcttacttttggaagttttgatccttttactacagtctgttgcttatctagcgaaagtcctttaatacacgaaaatccatcatttacaggatatcctttagtgggtacaacctttactattttgttgtcttcaacatagaaatctatgttgcagtccagagcacaaaaattacaagtcgattgaactcttttcataagtattcctcatttcttcttaagatatatataaatatagctatttatatgtttattagtttaaacatatttataagctttattacctgttatttagtctcttttataaaaataaatttcacattctacattgttctttttttaacaaagtttgttaaaaaattaataatcttttataaaaaatatttattctctaattaatctttaaagattatactccaaaggaatataatctagatatatcattgttgaaatctccttatggagatttcaacatcaactatcaactaatttagttatcaattgaattaaagtttattccactccaatgtacacaatgtttcattattgtctttggtccaagttcaactccatcaagagcccatttcttatactcttcaaatccaactctatcaattatataaccaatatgttcttttcttgctggtgcatttggatcaatatacttatcaacaaacttataagtatttaatattattttctttatactttcttcatcaacccaaattaagaaatcttctccaagcctaggatttttcttacctgttctacccattatagttaacttgtagtatttatccttgcttcttgtaaatgctcttgtaggacatttagtaacacatactccgcatccaatacatttttctttatttcttacaactctgtaattttcaacagataatgctccaacagaaagacttttacatgctttaacacaagctccgcaacttacacatctattcatatcatactgtggttctgtcatccctattattccaaaatcatgcattctagcttttgcacaatcatttgaacatcctgttaatgctattttgaaatgaaggtcatttgggaatactgccttttctattctcttagcaaattctgcagtatcatagttagcaaaaggacataccttattacctatacatgcacttatatttcttgttcctgatgcagtataccccttatcagtttcatttaaatttatttcaagactttctattataggttgaagcatttttgttacttcatccatatgttcatattttataccttcaatttcaaaaccctgtcttgtagttaaatgtactaatccatttccatacttatcagctatttcctgaaccattcctagaacttcagattttaaaaggccgcctggtactctgattcttgaagctccaatacctcttaccttagaaactctaaaggcatttttcttaagtttctttgtattaatatccatggtcaaatcctcctaattaatcaactaagtttttacccttagtgtaattgaatactggtccatctaagcagatgtaagtatcatctattttacagtgtccacattttccaagtccacaacacatttttctttcatgagaaatccatatattttcttctggaactcctctttttaatatttcaagtactgtaaatttcatcatcattggaggtccaactactatgaatgcagtattttttatatctttaatttcaagttctggaataaatgttgtaacaagtcctgtatttccagcatatccttcgtgtgctttatcaacagttaaaataagattcatcttatcttcccataatttcaagtcatctttgaacaatatgtcttctggagacttaaatccacagatcaagttgaagttttctgcttcctctctgttttctgcaaaatattctacaactcctcttactggtgaaagacctgttcctccagcaactactgttatttctttgcccttatagttgtttacatcaaatccatttccgtaaggtcctctaagaaataatttatctcctacgtaatttgtaaatatttcatttgtaactttaccaactcttcttatggttaaatctactgttccttttcctattccacttactgagattggagcttctccaaacttaggaagagatacttcaaagaattgacctggctttacatcaccttcataagtcattctgaatgtgtattcaatatctgtatgcttaataacttcttttatttctgatataaatgggatatattcgttcttcatttattccacctctttaatagcatcttcaagtttatttatacaatttgagaatgatatgtattcaggacatatatcatcacaacgcccgcatcctacacacatatgatatccaaaacgttttttataatcgtaaactttatgcattactttaaatctcatcttgtcgccttgtggttttctaaatgtaattccaccagccatgtccgtatatccatttatctgacatgaggcccatattcttctacgttctcccacttttccgttatctctataaaaaatatcctgcattgtgaaacaagtacatgtaggacatacaaaattacatcttccacatccaatacatctttcactatattcattccacatttttgagttaaacactttagtcgaaatattatctggtatgttaactttaattgtattttcactaacgaaatctggtgtaacattttcttctttaaattgttccatctttataagttcttctaattccgaccacttacagtctatgcttgcaaagtctttatctacctttacatatgcatcatattcatttgttttgttacttcccatatctaaacaaaaacaattatcaaatgtttttgtacatcccataagtatgaatttagtattttctcttagccttttatagtagaaatcctctggtccattatttaaataaatctggtccattctctttaatgcatgcatatcacagcttcttaaaaatactattgctccctttttaggtgtgcttggtacagttacttcatcttctgtaaaataaaataaagtctgtgttattggagaaataacttctttaaatgaatattctgactttttatcaaaaacaatttcttcaactttagacacttcaccatatcttataacatcaacatctgaaaaagtcccatctccttcaaatacctttggtgcataaatgcagtaatctttagatagcttttcaaaaatcgcgtttaagctttcattaacaattttgtagcccataataatactcctttgtcataattttgcccttataaatatccctttgttatttttttcaccttcctatagaaaacaaaacccacacttctttttggaatattttcaacatagcttaattataaattacaaaaaaaataaacaccgtgataaaaatcacgatgttttaaaaaacaatgctagtttttcaaaatttgaaataataatttttttacttttataatttataagattatttttctgtaagaccttcatagctcttgatacggtctcacgctgacttccaagaagatctgccatataagttattgatatttccatatctatcactattccatcttcatgttctaccccataatcttttgcaagcttatataactttgctgcaagtcttttttctatttttatagatgatggagtatttttcagctgtctatacaatcgtcttgttttgctagataaagagattattatattcttacataaatcaaaatcttccttcattatattgagaagcttttctttttttattcctaaaatcactgcatcctcaaaaatttcacaattaatagatgctggtagttcctttattataacttcattaattattttcccttttccaagcataaatattactttcttctgtccacactcatttattttgtataatgatactataccattcaatacaaaatatacagtagatacatcttctttatcttcaaataatatttcaccagctctatgttctttaacatcactttcttctaatattttaccaattgtactttccgaaatattgttaaacatctcaagattttttaattcttcaatttttacttccatgtacaaactcctacacacttttttacactctctacactaaacagtaaacaatacatttactatcatcttaaaaatatatagaacataattatttaataataaaattaacaagagaaaaagtcaattaacaaattatacaaaaagcctttcatattgaaaatactatctttttctataaatagttgctcattatcgtttatatttcttttttatatcttaattttgaataaatcattttttatagcagatattaaccatataataattattttaagaggtgattttacttatgataaaaagaaaaaaattcaatgttttattatctgcatttttagtatctgtatcacttttttctttaattccatataaaatagatgcttttattcaagaacattctaatacttctcaaaataactcagaaacatcctatcttgttgaagataatgaaaattatgatactatgccatttaaattcagaaaatcaaacgaacttcaaagcatagcaaataatagtgctcttaacttggcaggccttgataatttaaatatatctggcagccaacaattttcaaaaacgaatctctcattattactaaaagcaattaatactaatcttcctataatagattttgacttaagacaagaatcccatggatttataaatggtattccaataagttttgaaaatgagcataataatgctaataaaggcttaagtaatgagcaggtgttaaaaaaagaaaaagcccagttagattcaataaaaaaaggtgtacctatttcgtttcacaatcaccctaataaaactataactccagaggaagtctttgatgaaaaaactcttgtcacttcagataacattaaatatatgagaatttttgcaacagatgaagaacttccttcagttgaatcaattgattcctttattacaataataaaaaatttgaaagaagatagttggctccactttcactgtaaagaaggaattggaagaacaactacctttatgattttttatgatatgatgaaaaactataataatgtttcagccaatgatataacaaacagacaaatagaacttgctgattttgatagtaatgatgtacatcttctaacaagcgaaagaagaattgctttatacgattctttttataattattgtaaaaaatatagtcctgaatttaaaacaacctttggcgagtatataaaaagtctataataaaaaatatctatacgtataatttttaactgcttcctgtctatttgaccggaagcagtttatactctagctggtttttactattttattttttcctgtcttttttgctacatataaactttcatctgcatactttatcccatctgaaaagcttatattatcatgaatttcaaaaatcccaatacttactgttgcatttattgatctatcaccaatattatacttgctcttttcaatgcatctacgtaaattctcacaaatatcacttgcttgttctatattctttttattaaatataataataaattcttctccaccatatcgacctatataatcattataaccaatattttttttcattatcctagcaacactttttaaaatgtgatctccagctccatgaccatagttatcattaatggacttaaaattatctacgtccaccattgcaacacataagtcatatccattttctttactctcatcatatattttctttcctaatgataaaatcttatttctgttaaaacattctgttaaaacatcatattcagcaaaatgttttacttcattgaataattgtagatttctcatggcaattgcaacatatgaagccaatatcttcaactcattaaggtcttcatttgtatatgcattaatcttatgactttgtactgtcataattccagttgcctcattatctaataacaatggaatacttattattgatttcgcttcttcttgaagctgctttttatgaatcttaactttatatatatattttgaatattctttcgccatattatttattattacatcatttttattacatatacagtatgcaccaagacttttaccttcttctatattgcttactatccctggaagttttttatcatttttaaaaactattttataattaagctcttttttgtttttttcatatatccctattgcaaaagtatctaacattactagcttctttatctcttcatatataatatatgtaaacttttcaacgtcaagatttgcagttaaggtttttcctaaatttgatattctttccatcttgtcgtacaaagatttatatttttgtactgcatagatcatatctttttcttttaatcttttcaaactaacttgactgtcattctttaaaatatttttacattttactgaatttttaaggcacttatatgcattttcataatcaagtgatttttcatataatttgcttaaataataatatattctttcttttataagaatatattctctacaaccaatcctatttattgcatccaagaatatattttcacacttatcataattattgtttttcatatggtgtattccccatatgagtagtacttttccctgcatataaaaatttttatacttttcagaaactttaagtgcacttaaaaaatactcttctgcttcttcataccttctagtgttagaataaatttgtgccagtattaaaagagctttgtcttcccattgaataaacttattttctttaatacactcaagaacctttatgcaacatttttctgctttaatatattttttagttcctagataacattcagcttttatgacattcatctctacttcataatctagtctatgatcatacctatataatttgattctatcaagaatagatacggcttcaccataattcttatattcaacataaacagatgcagtgtttatcattaaagctactattgcgtcattatcattaaatttttcataaaattcaattccccttacgccattttctatacttagctctaaataaccaatctgtatataatctaccatgaatgcattatatacagcagcacatccacaatcattattactattttcaaaaaactccaaagcccttttatgtaaagtaattgcattactcacgttcccttttatattttcactccaaccaatgtaaagaatacaccaactatgtgcagaataatattctttttcttcacatacttttattagttcttccattacacatctaacataatccggatctatatttagatattttaatgctagttccctaaaaaattgaaaataattttcgtcttctctgaattttttaatatgattatctaattctaaacacattttcatatttttctccaataaacaaaaaactcttgattgaatatagtatttatacatttacttattaataaagatggtatttattaaataccatctttattattatttattcgttatctttttgttcttctttaacattaatggaaattccaagatcatttaattgtttttcgtcaactatatttggagcttcacttaaataacaataagcattttgattcttagggaacgctataacatctttaatattttcagttccagcaaggaacattatcattctatctaaaccaaatgctaatcctccatgtggtggtgctccgaattttaatgcttgtaataagaatccaaatgattcccatgctctttcttctgtaaatcctaaagctctaagcattctttcttgaatagctgtatcatgaattctaattgatcctccacctaattcttcaccatttaatactaagtcatatgccttagatcttactcttcccggatcagattcaacaaattctaaatcttcatccataggtgctgtgaatggatggtgacaagctttaaacctttcttcttcttcgctgtattcaaagaatgggaattctgtaacccatgtgaagttaaattcatttttatctttaattaagtcaaagtctttagctaattgtaatcttaatgcacctaaacttgggaatacaacagaattcttatcagctactattaggatagcatctccttcttctgcattcatagtattaactattgcctttgtaacatcatcagttaagaatttagctattgaagattttacttcaccttctttaagctgaatccatgcaagaccttttgctttgtaagtcttaacaaactcacctaacttatcaagtggttttcttccaagtgaagcaccaccttttaaacataatgctcttacagatccaccagcttcaattgcagatttgaatactacaaaatccatttcttttacatcttctgttatatctgttatttccattccaaatcttaaatctggcttatctgaaccgtatttttccatagcatctttgaatgtcattctctttattggtaactgaacatccactcctgctactttcttaaatacatgtgctattaaaccttcgtttaactccataatatcttcttgttctacgaaacttaattccatatctacttgagtaaattctggttgtctatttgctcttaaatcttcatctctaaaacattttgcaatttgataatatctatcaaaaccagacatcatcaataattgcttatatatttgtggagattgtggaagtgcataaaacattcctggataatttcttgatggtactaaataatctcttgctccttctggagtagatttcccaagaactggtgtctcaacatctaagaaattatgttcttctaagtaatctcttattgctttagtagtcttgcttcttatatcaaagattctctgcatatcaggtcttcttaaatctaaatatctatattttaatcttatatcttctgctgtatctaagttttctttaattattattggtggagtttcagattctgaaagaacctttatagattcacactttaattcaacaaaccctgtaggcatgttttcattaacactttctctcttaactacttctcctgttactgcaatgcagtattcaggtcttacacctttagctatttcaaaagcctcagcatttatttcttcaccaaaaacaacctgcattatacctgatttatctcttaaatcgataaattcaagtcctccaagttttctgtttctttgaacccatcccattaaagtaatctttttacctacatgttcttctctaggttcaccacacatcattgtacgctttaatccgtttaaagcttcacccattgttattcctcctattcatctcagttaacagttaacatttaacaactaatagttattttttaactccaattagaattattcttgaactattaatttaatctattaatttataactgataaaaccgcttaattttataacttcacagttttaaaaacatcattctctttattgtataatataaatcaaaactttacaattaacaataatattttcttgttactatttggcacttattatcttaacaatttcttctgtgttttctaatgaagcttcaaagatttcaccatcactcattctctttaagtttattttcttattagctaattcatcttcacctaaaatagttgtaaatgccgcacctaatttgtttgcaaatttcatttcagcctttatgcttcttcccatatgatttatttcacattttccacctaacgttcttaagtcgcttgcaagcttaaatgctgttttcttttcttcttcgcctcttgctgcaatatataaatcaataagattttcatttggaatttctattccttcattttcaagagtcataattattctttctactccaatagcaaatcctacagctggcatttctggaccaccaagctcactaataagcttatcgtatctaccaccaccacatactgtaaaatcatcattgattatttcaaaaatcgtctttgtatagtagtctaagcctctaactataccttgatcaatttcatatggtatttctaatacatcaaggtattcttttacactattaaagtgggtttcacattcttcacaaacatagtctaagatttgtggagcattcttagttatttcgttacatctcttttctttacaatccaagattctcataggattcttttcaaatcttgatttacatgtatcacaaagattttcataattttcttgtaagaatttctttaatgcttcattgtatttagctctacatgttggacaccctaaattatttatatgtaaacttaaactctttaatcctaatttacttaaagtatccatagctaccttaattgcttctacgtccattgtaggttcttttgaaccaaacatttcaataccacattggtgaaactgtctaagtcttcccttttggacattttcatatctaaatgctggtgttatataataaagctttgttggctgagcttcattaaataatctattttcaacaaaagctctaactgctggcgctgtaccttctggctttaatgtaatacttctgtcacccttatcgttaaaagtgtacatttccttttgaactatatctgttgtatctccaacacctcttaaaaataattcagtatgttcaaaaataggtgttcttatctctcttataccataagtttttgtaacatttctaaatacactttcaacatagtgccatttgtatgcatcttgtggaagcatatccttagtaccctttggtgcttgaatttcatttgccattttatctatccctccaaatttaaccagttaatagttaacagttttcagttaacagttgttaattttttgtatctatttcaagaaatcttcactgaagatttcatcatcaaactgctacctgttaactgttaactgctaactatttatataggctgtttaataattctttttttctttcaatcatttcatcagttctagtaacatactcatgaagatcctttaaattcggaaatctttcaagtctgtcttcttctagaaatacaactttactaacagccgcagctcctaatgctattattgtctgtctttcctcaatcatctgaatgttgtaaatacattccttaccttctttagcataccccaaattctccatatttccaaccatatttttttgtctatacatataatatggtgaaagtccaagactttctgctaaattcttgctttcctcatacatctttacaatttcttcatgaggtgttataggtattccttttttaagaacaaaattttcatacattatggatcctctttttaaagcaagaccatgtactgtaatactatcaggttttaatttaaaaatctcatcttttgtcttaagaacttcagcatgaccttcacctggaagacctattattatatccatattaatatcatcaaaaccaagttgtcttgccatatggaatttttcctttatatcttcacaagaatgagttcttccaattaattttaatgttttatcattcattgtctgtggatttatacttattcttgttacattacaatctttcattgtctgtagttttgttttatttaaagtatctggtcttccacactctacagtaaattcttttacatttccatcttttatgaatccatcatatatttcatccatgaccatcataaattctccatcacttactgaagtaggagttccccctccaaaataaactgtttctacattaagttttttttcttttacgtatttacttatctctttaatttctttcataagactttgaacataaggcataaccatctttttataagatcctataggattcgatgtaaatgaacaatacatacattttgtaggacagaatgccatacctatatatattgcaatagtattgttatctttatttactattctttcctctgcttttgctacctccatgcatagtcttgccttgtctgcatgagctagatatttttctttaaaaatatctattatttcttcctcacttttcccttcattaagaagctttaaagctatcttagatggtcttataccaattaatattccccatggataaacatcatttgttaaatccctcagacatagaaaaaggaatctccttagagaattttttatatcttctcctaaagattcttctttaaaatattctttatattgaaacttcattatctgttcatcaatataaaaaatataatctgcctcatctttttctaaaaactgaatttcattcattggaaaatacacattaaataattggtacacttcatatctatattttaagttattcaaattaacttttatctccataatgtgacctttctttcatcgataatttattttatatatgtatgtacttcttatgattaattgaaactcacagttaattaagattttttaaatcttttaaaatacatgagttataagaaatcccatagagatttcttataactctcaatactataaactgtttataagtatggatttctcattttttcaaatttaatagaagaagatggtccatgtcccggataaacttctacatcatcaccaagtggaagaagtttgctctttatgctgcttataatttccttcatatctccacctataaagtcagttcttcctatagatccttgaaataaagtatctcctgtaaacaactttccatcaattaaaaaacataatccaccttttgtatgtcctggtgtttcaataacttttatttctctactacctaatttaactacatcgccttcttttaaataacctgaagctttaggaagtgttccaaaaactgaattatctttttccatgtattcttcatcaattttacttatataaaatggaatatcatatttactgcatatttctttcacaccaccaacatgatcaaaatgaccatgagttaaaagaagatatttaggattaccatgcatactttctactgctgctgatattttcccagcatctccacctgcatctattattgcacaatcttttgtttcttcatcaactaaaatatagcagttagcttcataaacacctgctggaactgtttttagatttaacatttaatacacaccctttcagtttatatagtcaataatttaaggctgtataatgccttaaacatatacagcctttgtatattaaactattatatgttctaacgtttaaaaatttttcttactatcaagtaaaattgttactggtccatcattgtttatttccactttcatgtgagcaccaaattccccagtctcaactttcaacttcgattccttcagcatttctataaacttatcatataatgccttagcatcctctccacccattgcttccataaagttaggtcttctaccttttctacagtcgccatataatgtgaattgagaaatagcaagaatttctcccttaatatctaatattgataaattcatcttgtcattttcatcatgaaaaactcttaagtttattattttatcctttatgtactgtaagtcttctattgtatcatctttacatatgcctattaatacattaaatccttcgtttatacttcctattattttttcatcaactgttacagatgatgacgttactctttgaactactgccctcattttatacctcaatccaacttaactaacatctatatgttaactaataatagtttctttattctaatctaactattaactctataaacatcaagtacacctttaagtcttttaattctcttcattaaatcatttaaattatctacacttgttattttaatcttaatgtttataaatgcaaagccttctttacctaaatttgcgttaaccgcacttaattgaagttttaaatctgatattacactcatagtatcggctaaaagattctctctatcctctgcctgtacctgtatttctgcaaaatatgatgtatttagtgattttccccagtttacttcaacaactttttcaccatcggtttcgattaaattttgtaagttgctacaatctcttctatgaacagatacacctcttcctttagtaatatatcctaaaatatcatcaccaggaactggtgagcaacatttggcaaatctaaccataagattactttcacctttaactgttataccataactgttcggttctggctgctttgctgttttagctatatgctcttcaatcactttgcttaatatttctttattttctctttcttttgcatatttatcaagtccattatcctcttttaatcttacaatataagaagatgctccaagacttcctattcctataagtgcgtataaatcatctattgaatgaatattatatcttttagcgaacttttcataggcatcaccttttgctatatcagcataattaacaccttgtttttttaattctttttcaaaaagttctttaccctttacaatattctcttctttttttgctttcttgaaccaaagcttgattttactctttgactgattactttttgcaatatttagccaatccatattaggaccttttgcattaggtgatgttaatatttcaacgatttctcctgtttttaaagtataatcaagaggtacaatctttccattaacctttgctccaacacatttatttccaacatcagtatgtattctgtatgcaaagtcaataggtgtagctttactacacaaattaattacaacaccttttggagtaaatacaaagacttcatctgaaaataaatctatcttgaaaccttccataaactcttctgcatcagatgtttctttctgccattcaagcatatctctaagccatgcaagcttcttctcaaactctttctgcttatctacctcggttcctccagctgtatctccctctttatatttccagtgagcagctataccatattcggcagtcttatgcatttcaaaggttcttatctgaatttcaaaagtctttccttgtggtcctattacagttgtatgtagtgattgatacatattaggcttaggcatagctatatagtctttaaatctgcctggaataggtctgtatattgtgtgtacaataccaagaaccccataacagtcttttactgagttaacaagtactcttatggctgtaagatcgaatatttcttcaatactcttatttttattaaccatttttttataaatactgtaaaaatgctttggccttccatcaatgtccgaatcaattcctgccccttctagctttttatacaaatcatttactatatcttgtatataactttctctttctactcttttttcagctatatcttttacaagttcataatattctttttcatgaagatacctaaaacaaagatcttcaagttcccacttaatctttgacatcccaagcctatgagctaaaggtgcataaatatctagtgtttcttttgccttatttttctgcttattagctggcatgaacttaagggtcctcatgttatgcagtctatctgcaagctttattattattactcttatatctttcgccattgcaagaagcatttttcttacattatcagcctgttgttcctctttagtcttatactccatttcacctaatttagtaagttttgttacaccatctactaaattagccacttctggattaaacatccttgatgcatcttcaaacgaacaatcagtatcctcaatcacatcatgtagtagccctgcaactatagtatttgtatccataccaagttcagctaaaatttctgcaacagctattgggtgaattatgtacggttctcccgattctcttttttggtccttatgtgcttccttggcgaaattatatgcctttttcaccaactctatatcaacattatggcaatttttattgatgttttctaacaatttatcaaccataaggaatactctccttctatattaataaaattcaaaagtaaattcaaaggctggtttcataaccagcctcactttctaataattatatattattttacttttattttcaacattgcacaaaaaaaatactttaataataaaaaaagtcatgcaaaaacacgacttttttaatttcttttaattttagcaatcatactcaactaatgacataacatcgtagccttgtaatttatctcttcctcttaaatctgttaattctgtaacaaagtctacagaagcaacaattcctcctgcctgttcaactaacttagtaacagcttcaacagttcctcctgttgctaataaatcatcaactattgcaattctttgaccaggttttattgcatctttatgaatttgaatttcatcacttccgtactctaaatcatacgttactgaaattgtttctgctggtaatttccctggttttcttacaggtacgaaacctacgcctaaagcgtatgcaactggaactccaaaaataaagcctctagcttctggtccaacaattaaatctatgtttttatcttttaagtaatctactattgcatcaattgaagcttttaaaccttcaccatctccaattagagttgtaatatctttgaaactaattccttcctttgggaaattttcaattactctgatcttttcttttaaatccattttgattcctccacagtacctattttaatataaaaaaataaatttttcgattaaatagcacattatatataaattaaaatgcatactataattataatattcatttcatttatttttaatataaaattatattcttttaacttgtttcattggatggtttttctttaaactatacagatacttaacaatctgattagttctatccttatcatttgtagttaaaagctctaatactatcctagcattatcagtaatcccaactgcacctataggaggtattagtgattctattattttatttacgccacaatcgtcgaattcctttatatcattaaattctattattgacctcaacccattattgttagtattcattaagaacttatttccttctttaattaatattccattttcccctttagctgatcctctagaccattttgctcctattaatattagatctagatatttgttgatacttttcatattgtaataaattgcaatagcttgcatcaacttaaaagttatcccacttgttgataaatctttgtacctatactgacaacccttttgatttggatttatgtaaatataatcattcacagtatcacttatttcattttcaataacaattaaatctatgcctaacgttttgcataaatctacttcttcttgtgatttcaatcctacacctaaagttattaaaagctcagcacccaaaaaatcaacattatcttttatgtctaccgaatttattcttgcatcattttcttgtctatcatatattaaatactcaacatcagcatttaaatatctaaggacgagaattaaagatgaaactgcacaaatcccatcaacattatatgtaccataaacgacaattttctgtctattattaacagctaaagctaatctctctattgctttgttcatacctttaagtataaatgggttatatccagtaatataatttggataatatatactttcccagaatttacgcatggcttcttcctccataaaattagaaaacacatatattataaatgattgtcgacatttttacaattgttttattacgaaataaaaaaacctccactttatcatggaggttttattttattaagcccagtaattaagccctcttagactttttcttgcctgtcttttcttttaaaagcacatatactggagaagctataaatattgaagaatatgctccacatataattcccacgattaaaggtatagtaaactctctaactgatggaactaatatattaatagctactattgttgccaatgtagatagagacgtatatactgatcttgctaaagtttcagttaaacttgtatctgcaatttcatatgtattcgctcttctcatttttttagtattttctcttattctatcaaaaattactattgtgtcattcattgaataaccaactattgtaagcattgctgcaataaatggtgtatttactggaataccgaatatagcatatacacctatagtcattaatatatcatgcagtgttgctactaatgcagcaactccaaaggtgaattcaaatcttattgcaacgtatataagcattaccacaccagcagcaaaaagtgcaagtaaagaatttcttgttagttctttacctactgaagctcctatttcttcctgagaaagtaaagctgtatcttctaatgaatatttatcttttaattcattcattatagatgataatttatcactatctaaatcagtggatttaatttcatactcattattatttgaaatagttgtacttgcatctgcggcataccctttaacaattgtatcaacatctgatttgcttatttcatcatttaattgtatcgaaacctgagtaccacccttaaaatctattccaaaatttaatcctttaaaaaatgtaaaacctaatccaattactactattattaaggaaattgaaatccatatctttgatttttctattatcttaagcatgtttttcagcctccttcttcactccaaaatgttctggtttacttaggaaaccacaatctacggctaaattaactaacaattttgttactataagagcagtaaataaacttactaatatacctatcataagagttatagcaaatcctttaactgatcctgatcctatgaagtataagattaaagcacataaaattgtagtcacatttgagtctacgattgaagaaagagcattttctgaacctctcttaattgccgttttaactgatactccctttctaagctcttcttttgttctctcaaaaattaatatattcgcatctactgccatacctattgtaagaagtaaggccgcaatacctggaagtgtaagtgttactccaacttccacaaatattattaatattaagaaaatatataatgttaacgcaatatctgcaaataaaccttcacgtctgtacataacaagcataaataagaatacaagtcctataccaattgcacctgctttaatagcattaggaaatgctgttgcaccaagctgtgcaccaacattcttaactgagattgattttaccggtactggaagtgcaccagagttaatcattcctgctaaagctttattttcttctaaagtttcactacctgtaattgatgctttaccatctgttattgcaacttgaactgttggttctgatattgcttcatcatcaagataaattcctattttctgacctatatattttgatgttgcatcagcaaattttactgttccttcatcgttaaattctaagccaacttcatatttcccagtctgttgattaagctgagctgtagcctttttaacatcacttccgcttaaaatctcttctccatctggacctttaaataccaaattaccagactgactcagactctttacaatttcattagaatcaaactgtcctgggatatcaactcttattctcttatccccttctgttgtaacaactgtttcagcaactcctaacttatttactctaagttcaagatgttgctttgtactttctaattcttctttagtaacatcatctttttgaatttccataagaacagaaactccaccttgaagatcaagtcctctagttattgctgaattaaatgatttaaatgcataatcaccaatgactaatcccttaaatcctgcaaaagctaaaaatgctattacagcaacaataaccccaagaagcgctgcacttttgccgtttttcttcatcttatctccctccataaattatgtcttttaattcccgcacttgttgaaaattcagtacgttttttgttgactttatttattattatgtaaaatataaaaatattataattacccctgttaatacattgttaattatagcacactataatttcttaataaagttttttattgccacaatcttatttactttgctactatatgtaaattttaatacttatttctaatattaaaaaccatataaaaatctctttaaattaaagaactcttcatctaaatgtgcaatacttttttatccaagataatgaggaactatatgattattttaatttcttatatgctccaaatatcgattcatgtatttaattatgttcaataatagtttactctattcctgcatattaactccaagtactcctccaagtcctccaacaataagtgcagcaacaagtttaaatagttcaaacatattaaaactaaatcctccatttattataaggcagacaatgtatatgattacagagtaaaatactgtaacaccaaaaccaacaagcagaccttttgactgttttttctttgcagctatcatagcaccaaatgcaagacttattaaagaaataactaaatataaaacgttaaacatatgtttactaaacactaatttagtcattaaaaaagataatactacaattcctgaaaaagtaaacaaaagggtacctacagttcctttcaaaacacatttaaaataattattattttccataaagcaacacctcctaatacttcattttatgaggtacaagaaggcattatgattaatatttattatataaatctgctttatattaaatataaacaaaacttcatatgtaattacaaaaattaatttataaagttttattaatcgttattgtttatacttatgattctttacttgttttatatgcaataccgctcttatcgaactttatttttgtctttgcattacttgtttcaatagttacatatttttcttcgatattagttattttaccaactattccacctcttgtaactatttcatcatgaactcttaattcttctatcattgtttgatatgttttctttctcttcttttcaggaactatcattaagaaataaaacactgctaaaacaactacaaaaggtaatacattaataagaattgctcccatagtaccattcattatatttttcctccaactttataatattttataactattccatgttaagtagtttacctttattacataataatatcaaccctgttattacaaatttaatgatttattcatattatgtttcatatatcaatatattctcccaaaaatttcattttattcttgtaatatcttataattttatatatttattattaaaatctacgtataaaaacaaaaaattcctttaggattatttatcaaatcctaaaggaattttatttaactacttaactttccattcctgtagtttcttttccttaaattctttataatatccgccatctatagcagttcttatctcttccattaacttattatagaagtataagttatgtaacacgcaaagtctcatagcaagcatttctttagccttaaataaatgtcttatataagatcttgtgtagtgtttacatgcaggacattgacaagtttcatcaataggcttctcatcaagctcaaatttagcattcattaaatttagttttccttcgcttgtataaacatttccatgtctaccatttctcgctggaagaacacagtcaaagaaatcaacacctctatcaactgcttctaatatattttctggagttccaacacccattaaatatattggtttatcttctggaagatgtggtacaacagcgtctattattctgtacatatcttcatggctttcaccaacagctaaaccacctatagcatatccatctaaatccatctttgtgatttccttagcatgtgctattcttatatcttcataaactccaccttggtttataccaaaaagcatttgttctttatttattgtatcatctttagaatttaatctatccatttcaattttacatctttcaagccatcttgtagttcttgctacagatctttcaacgtattctcttgttgaaggatttggtatacattcatcaaaagccattgctattgtagatgctaaattactttgaatctgcattgattcttctggtcccataaatatctttttaccatcaatgtgagaattaaagtaaactccttcttccttaatctttctcattgctgataatgaaaatacttggaatccacctgaatctgttaatattggtctatcccaattcataaacttatgtaatccacccattttattaacaactgtatcagttggtcttaaatgtaagtgatatgtattagataattcaacttgacatccaatatcctttaaatccatacttgaaactgcacctttaattgctgctaatgttccaacattcataaacacaggagtctgtattgttccatgaggagtaacaaactgacctcttcttgcgtttccatccttttttaacaacgtgtatcttttactcacaagcgtcacctcttaattataattttatatataactacaaacacttgactatgtcacctcatcaattgttcaactgtcagaattatttttcctgacaattacagttgatattccatctgaatatcagatttatatttaaaaaatctaaaaagactttctatttaattgttattgataaattcattcttgtcaattattttatgaacattgcatctccaaatgagaaaaatctatatttttcttcaactgctgttttatatgcattcataacatgttcttttcctgcaagagttgaaactaacattattaaagttgattctggtaaatggaaatttgttattaaattatctaccactttaaacttatatcctggataaataaatatattagtccatccactttgttcctttacgaatccattttcatcaccaatagtttccaaggttcttgttgatgtagttccaacagaaataactcttccaccatttctttttgtttcatttattatatctgcactttcttttgaaagcatataaaattctgagtgcatttcatgttcttcaagattttcaacctttactggtctaaatgtaccaagaccaacatgtaaagtaagataaacaacatttatacccttttcttttatttgttctaataattgatttgtaaaatgtaatcctgctgttggagctgctgccgaaccattttcttttgaatatacagtctgatatctttctctatcttctaatctttcatgtatatatggaggaagtggcatttcgcctaacgaatcaagtacttcttcaaaaataccctcataatgaaattccactattctatttccattttctttaacttcaacaacttctgccttaagttttccttcaccaaaagtgaattttcttcctacccttgctgatttacctggctttgcaagacattcccatctatccttttcaactctcttaagtaaaaggaattcaatttttccacctgtttcttctttttctcctattaaccttgcaggcattactctagtattatttaaaactaaagtatcccctgcatttaagtagtctactatatcatgaaaaaccttatgctctatttctccagtttttttatctaataccataagtcttgatgtatcccttttttctaaaggatgttgtgctatcaactcttctggtaaataaaaatcaaaatctttaacgttcattttattatctcccaaccttataattgacaattgacagttatagatgacattcttacagaatattttaaattttattattaactttacattctaagtaaacatccataaaatgcacaaaatatcaaatatctattttaaatttaaattaattatacacttaattttctttatcaaaaaatgttccctgaattttaggttcccttttctttgatggattaactcttccaagatgttcataagctttatcacttgcaattcttcctcttggagttcttattataaatccttgctgaagaagatatggttcataaacatcttcaattgttccaagttcttctcctataaaatatgataatgtttcaattcctacaggaccgcccttaaaattatctataattgcttccaatattttattatcaaccctgtcaaatcctagattatctacttctaataattgtagtgcttctctcgcttcttttaaagatataatcttattagattttacttctgaataatctctaactctttttaaaagcctgtttgcaattcttggagttcctcttgatcttcttgcaatttctattgcaccttcttctgtaatagagcatccaaataccgatgcacttctcactattatttctttaagttcatcatttgtataatattccatggcacaaagaacgccaaatctatcccttaacggtgctgtaagcataccaactcttgttgtggcaccaataagagtaaatttaggaagatctattcttatagatttagcactagcaccttttcctattactatatccagtacataatcttccatggctggatataatatttcttctacacttctattaagtctgtgaatttcatcaataaataaaacatcataatccttaagtgtagttaatattgcagctaaatctccagctctttctattgcaggtcctgaagttacttttagatcaccggtcatttccttggcaataatattagcaagtgtagtttttcctagtcctggtggtccatatagcaacacatggtcaagtgcctcatttctatttttagctgctttaatgaatatatcaagtctttctttaactttctcttgtccgatatactcatttattttttgaggtcttaaacttaattccgagttaaaatcactatttaattcagatggatttactattcgttccatgttacaccccacttttccagttaacagttattttaaacttattaaaaccttacattttaaataataatattattacaatataaactttagaaatccccctaggaatttcataatcaacttttttactataaactttcaactgtattaattaattcataagcgcttttaatgcatttttaatcatgttttctacagtttctgttttatctattgttttaagtactttttctgattctttttcactatatcctaatgcaataagcgcacttaaaacttccgaaacggccataagattattttctccattattatctttatttgaatcaacagccacatctaataattcatctggttgaagtttatcttttaattccaaaataattcttgctgcagtttttttccctattccaacacctctgcatatgtgtttctcatcaccagtcattatagcatatttcaagttatttaatctgcttatggataataatgataaagctgctttaggtccaacaccattaacagtaagaagaagtttaaacatagcaagttcttcctttgaatcaaagccatataggccaataaaatcttctctaactatctgctcaacatataatatcacttcttcaccacactcaggtactgaggacatcgtcgctcctgatgtgaaaattttatatcctattccactattttcaactactatatagtctttattaattcccatatattttccttttatgtattcatacatattgtcgtatcctccatctccctatgtataagcctaaattatactttatcattttcataataatctttcaacttaatcttaaaatgagttcctgtaaatcttttatttaattataaaccttaacacatttctttaaacataaaaaagcagcatcaaagttattaaaacactctgaatactgcttaagttaattctatgataaaaattctgatagattttcttctgcttcctctttagtatcatattcatatttaaaattttttatttttgttatatcagctggtgtaagactatctatagtttttctatcattatatacatcgtcactattttcgattaataaagtaccattttcatcagtcttatatattgcaagatatccatctttttcaccaatataatatttgttaggttttacagtctgagaaggatctcttttaaaagtaagttctttttcagatgttaaaaccaatacatatcctttatctttcaatgcttttgataattctgtttctgttaaatcatcacctatgtttaactgtttttttaaatcaccaagtgatagctcatcttccttaacgtcaccagaataaagacatactttagtttcatctgaaagatcgttacttgaatcattatttacaactgttgcattttctttttctacaattggttttgttatatatttatcacaaaaataatacgttaacgaaaatataattgctaatagtactgtcattacaacaaacattctttttttattcattatcatcaataatccctccttatttagggattattgactgttttctattgctttatacattgttatacaaaaatatttttaaattattaaattttaaacttttctatatttattattcaaagaatgaattttcaaataaaatagcataactttgaggctttgaacaaaccggacaatatttaggagcttcttttccttcgtatataaagccgcaattagtacacatccattttacatctatctcttttttaaataaacttccgttttcaagttctttagcatagcgttcaaaacgttctgcatgaaccttttcaatagaagctatattattaaaaagtactgctatatcttgaaagccttctgattgagcaatttgtgcaaattctttataaacaacatcatgctcttcatgttcattatgtgctgctgacataagaagctttaaagttggatcatcaccttcaattggataagtagcattatcaatgtctatattacttcccgcaaaatctttaagttttcctaaaaacgcttctgcatgagccttttcctggttagctgtatacttaaataaactttctataatgtgaagtccctctttttttgctttttctgctgcaatatcatatctatttctagcttgactttcacctgcaaatgctcttaataaatttatttttgttttactgtcccttaattccataaattttcctccttaaataataccaattatattattagtattctaatttaagatgaaatttattcatacatttattttaagttatcatctatcttactctatttataaatccacattttttacataaatcttcaacagcttttcttcctgaaaatccattatatatagcaacagctctttctgaatttactatactttctaaatcttgtgtgaatatgtttcctaatggtatacttccttcactatcaagacagcaaggaactacagttccatcaacaagaatgcctatttgatctcttaatccataacaaaaggctctctcgccaagttcttcatctttgagagatggccatttaaacttttctcccatacttatatacactctgtcttttaatttaaaactgtgtttttctttaaaaacttcattgagttttgtatctaaattaaattcctcttcaaataatttaaatatatctatattcatatcattacttgctttatatttaccatctaaattccataaccttaaagaacatattatctctgttttttctgatgtttccttgataaagtttattatattttgtatatattcctgaaaatttgtttcattatcattagcctcaaaactatgaagagaaatatttatttgtcttaagctcttggattgaataagaatatttttaacattatttatcaatgttccattagttgttatgttaactttaagattattttctccactaatatctaaaaaatgttctaagtttttatttaaaaagggttcccccatcaaatgaaaatatacatgatctgtatgacctttaattttttttattatttcttcaaaagaatctttattcataaattcatattttctagaagttttaggacaaaaattacaacttaaattgcacacattagttatttctatataaattttcttgaattttttcattcacctatctccagtttccgatttatttataatgtctagtatatagattctttatgcttatttcaagtttactatttaacatcaaatcaatcctagtttatcttaactattaaactttacttaaaaataacagtgagaaaactacatatatctctcactgcttaaatcctttcattctagtaaactttttcatattgcttattctttatttttaccttctataattttttcttcttctatctccttaatgccttcttcactaacatctgaattaattaaatctgttttcttctcttcattgccaccattcctgacttcccatgaatctacagccaatgaaatataataaaataaaagtaataataaaagtaatatcccgctcacaatcaaggtaacaaataacatgtttattgaagaacccaatcctgaagctatcataatattatccccttattaataatgcatagaaaaatattaatttaatcttaaattttcctatattgtattatatgaagctcatcttttatactttactattttttctctaatatataattttttatatttaagataatgattctatatattgcaattttaaaattcatagttcatcatatacctttaagcattatgctatcattataattttctatacatcgaaaagagccatcctttaacaaataaactctgttaaaatgatagctccttcttagaaactgatttttaagttgtccgccaacatgtgcatgcccttatgtcatgctttgctcccaggtttttttgttgcctggcaccaacatcatacctttatggatatgattctctgccggatttaagtgtcagttcactaagataaatcacttcttatcttgattacattatacaaccttttgtaaatgtttgcaacacattttcttaattttctgaatttttatgattttatataaattccaattataatatttagactttacaataaaaaagctaaaaacaattggtttatatattttaaattgttaaaattatatatatataatatggtatattgaggtaacatttatgattaataataatgaaattaataatattcttcagggtaattctcttgatgcatataatacttttggggctcatttttcgtatgaataccaacagcatggagtaagatttactgtatacgcacctaatgctgaaagagttttgcttgttggaacatttaatgattggtcaggatacgatatggaactccatccttctggagtatggagtatttttgttaaagatgtacctgaaatgtcactatataaatatcgcattttcactaaagaaaatgaaattatagataaaatagatccatttgcattttttagtgaattaagacctgatacagcatcaatagtatataatataaacgactttcaatggacagatgatttatggatgaattcaagaacaaaaaattttaactctccactaaatatttatgaagttcatctttcttcatggaaaattaaagataacgaatatgatttctataattataatgaaattgcagatattattatcccttatgtaaaggaaatgggatacactcatattgaacttcttcctattactgaacatccatttgatggatcgtggggatatcaagtaagtggatattttagtgctacaagtagatatggtaatcctaaagatttaatgaaattcattaataaatgccataatgaaaatataggtgtaatacttgatgttgtacctgctcattttgtaaaagattcattttctcttagcaagtatgatggaagttatatttatgaaagcaattctgatgaaaatagaagcagtgaatgggatactaacctttttgactttacgaaaccatatgtaataagctttgtacgatcttcacttgatttctggttgtcttattatcatatggatggtttaagatacgatgctgtatctattatgatatatgaaagtggggatttaaacaaaggagttaacgaagcaggtttatggtttcttagaagcagtaattttgcacttcaaaatagacatcaaaatgtaatgcttattgcagaagattcttctgtcttctccaagataactgcccctgtagtttatggtggcgttggatttgactataaatggaactttggatggatgcatgattcacttgaatattttcagttaactccttatgacagaagctctaacagacacaaattaaaattttcaattgaatatttttataatgaactatatctcttaccagtatctcatgatgaagtttcacattttaaaaattctgttgttaatcttatgtatggtgattatgatgaaaaattcagtaatcttaaatgtttttatctttttatgatgactcatcctggaaaaaaactcaactttatgggaaatgaaattggacagtttgaaacgtggcattgcaataaagaaatagactgggatattctagattaccctaaacatatgttatttaaaaattatttttcaaaactccaagaaatatattctaaagaatctagcctttataaaaatgaatataataaaaatagtttcaattggattcaaactgatgataacatgccatgtatctttgcatataagagaaatgatcttgaagaagattgttcttacacagttcttaatttaggtgattcagagtgctattctttccttctccaagttgattcttcaggatggtatgatgaaattattaatactgattctgaaaaatttggtggaaaaaataaaatatcaaaaaagaaacgtgctaaacttatagataacaactattatatctccatatatctaaataaatttaatggagtaattgtaaaaaaatcaaaaaaactgtgtaattagtaatctataaacctctttaataataaataaaaatacttattaaagaggtttatcaatatttaagtttatttttctaatctttttactttaaacttacctttatcctctattacttttattttaaggatactatttagagtacttaaacttctaatatcatttatatatttaatattgttatttctaacaagcttacctataacctttactatgtcttctatttcttcatcatctaagaacaagtcttcatttaaacattctctatttatatattttaatgtagtccatatctgttcatccgaaatattatttatatctaaaagtacccatgtaaaatcttttcttctttcaccctttggatatgcttctttaaaaaattcaataaatgtactttgcattttaggatccttcaacgaaacatattttcctagcttttcctttaatttattttgcaaaaacattaccgtattaggcttaataattgcacccatttcatctatttttttatatataaaattgtatgttgattcaatttgatatatatcaactttttcttttataagtattcctgtcatttctatgtactctaatatgtttttctttgtatttagctctttattataaagtttttcccagatttcttcaccatttaaattttcaaaattaaaattatccattttttcttcatcctttatcctaaatttttctaagtaaaatttattacattttatcattatatatcaaacttaataaaagtaatatattttataaaaaaataatgaaacctatctcaatatataagacaagtttcattacttataagttttgtgtgttaaatgatatattttaattcttattcattagatgtctcttttttattaaacattaatacactattaacaaaaagagttaatgtaattattaaaaaataagatgaataataacttattgctattgatgttaaactccaaaatatagatgcagttaaccccctcaccctattcttatttattaattcatttctcgttaagggcatagacggattaattatgggagcttgattataaatggcaaatatacaaaatattaatataataatatttcctataaatgtgaaattacactgactacttaataatattattccacccgaaatcaaaagtgaacacataaaacatttcatttgagtatcttcatgatatcctccaatgtatggtttagttgtaagcattactagtaatacaattacgatttctttaaaataccctagtgcagcaaaactcaaaacctctcctaacacctttagtatctcaaacatagttgatctaaatacatattccatttgttctatttcttcttcattataattattttccgccaaataattaacaaatttcctcgaaaattctctcaacatttcatcaccatttttttacataatatttattatattccttattcttatacatttcaatatgtttttttatttttaatcatattatttattttatataagcatttgtgtaaattctaaattatcaaaattattttctattaaaaaatctaatatttcttccatataatttttatcgtgctcaacggtcttagaaaagacctggataaatttaattatctcttcagatgactcagtgttattaataagatattttcctacaagataaaatcttattaatgaatatctcataataagcatcatatacccttcaaacatagaatcactctctgaatacggaaataaattattatacataaaattaactaaataattctcgaaaatatgctcattttcttcaatgtaattcctactatactctataaaagtattaatatatctattgctgtctttctctaactgttctggactctctatattaaatccatctatagtttctttagtatattttttaaacaattcactatctgtttcctcatatatttctaaagaatttattatattatttaaaagagaaatctgcattatgtaattatctttatttcttctataatttttagctacatcatgtatattataagtttttataaatccacaaatcatttcactatcatcacagcttttctcttctacttcatataaaaaatcaccaagtatatataacctttcactcaaatcaaactttctatttttaataattcttatacaaaactctcttatttctttaaaatattttattggatgatcctcatattcttcgtcatttgtatcaatctctccagctattatatatttctttaattgaatgtcatctttttcaaatttaaatccacttctatttccaagaacaatcctagcagcttcagggcatgatacatcaagtgatatttcataatcttcatctactttgttcaatactcttggaaaatggctacatgtattagaaagataatcttctccaagttttgaatgtataatacagtaattacattcatttagaaatggacatcttttttctttattaagctgaacttttccataatcaataaattcattgctacactcatgatttttttgcatattctttgctaaaatagtattgaattcttcgttatctagcttcatatattgtctaaatgttttttcatcaacatctatatcccaaccaatacaacagctatcttcacactttcctcctatacatttaaattgtttaaaataatctggcattactatttttaatttttttgtcattttcatcatacctctgttattacgtttaatatttatcaggacaatttaaaactctaaatgtattatatcagtaaacttatctatttaataaataacaatattcattttatagaaaaatccaaaatgaaaattatataaatgaattcttattgacaatattaaaatccattttatacaaaatataaagactgaataatttacttttagtatattagcataatttctatatactattataagtaaatattcagcctatttttgttctgttcatttttattcttcactataaatcaattcattcattagttttactatttattatcttttaagcaatctaatatggctcctccaataaaaagcaatcgtaatactactagccctataccacaaaacataactgtactgcaaatagaaggattaagactgttaattatcataatataattcccttctttaaaattattcaagcatacagtcaaaactttaattgcttatttatgcttttcctcaatacattatatgcttgtttcacatattttttactagtagtatatatttttaacaatttattttttctaaaaaactaatactaatttttaaatctcatccaagaaatttttaataagagtttctggtacctctaattgtgataaatctattttttcaggatttgtaagaagagaatattcctctatccaaaggtttccttctattattttgctttcaaaaaaatctttattattttcattatcataaacttcttctatagtctcatttttcgttattattgcaatccttctgcaaggctcttcaaattcatcataaatattataaaaactattatatgaatcaaaatttcttacagctgttactaattttaaatataatccatgttcctttgctactttaagagcatttacagatttcatacttttcctcctgttatttaacacctgatccacatcattgcttttttccaattgcatcttacaaacaattattagtatatactatatttatccaaatctcaaaatttttattgattagtacaaaagcccaatgtaacattatcaaattacattaggctaagtcttatatttcttcatatttaaatatatattttactttaatattataattatttttcaagataaattaccctttctatatgaagaataaaatcattttcgtggaaaccttctagtttttctattacatcattaatacttaattcactttcacttatccttcctgtaataagtcccataaatagtactttatatttctcgctctcaccatcatccatatgcttccaccattcaaaagaagctatattatttatttttcttatgcacgcaacagcatcatcatacatttctttatcagctaacaaaagtgctttatttatatttgccatatcactgccttttacagctgcactttctatcaaagcttcacaatctggatatatattagcatttttaacttccttccttcttatcatatatgcaatattaagacacatgttattatttaacctatataaaagatagtaatacttttctgccatattgaaatttttattcatatatgcatctgtaccaatattacctacaatggcttcaatttctttcttaatattatcatttcttctgcttaagcctatagcattatcttctataagattaaagtcagcatctttattatttataagtatgctgaatccagctagcaatacttcatcttcaacttcataagaagaatttatacaattatatttaagctgttcataaataagttttgcactatcaaaactgtattttgctatgctttgaataaattcacgtattgttcctattattttagcattatctttatatgttatttctatttcattatatatttttataccttcatcaacatctccagatttaataagagaatcagcctgattaagcattgtctcaactacttttgtcttagcctttttcccctcatcagatttacataaagttattatttcattacacatttccttggtatctagtgtttctgtattatcctttaaacaatatgatttaaatattctagcttccattataagagatttcatttttatatctgcatcttcttttctagctttaattatatcgttataaagttccattgcttctttttgctttccactattatgaagtcctatagctttgcacaaagttacttgaagacaaactaattttatcttttcatcattttcatctttgtatatatttaaaatctcattacattttctaactataacctcatccttttcatttttagtcaaaattacaagtttatttaatcttgcctgtgctgctgctcttcgcagttcatcatcattatcatctttatatctatttattatatcattataaacttctattgcttcgtagaaatcctcatccatttcaagtacttctgctttatttataagagctttaacagcctttcttcttatattttcatctttgtccatactgtatttactgtatatctcatcaaaagattcttctgcttcttcaagcctcatattttttttaagtatagatccctttaaaatcatagtgtcagcaagaaattgcttcaatttcagatcttctctatcataatatctattcttaactgcatcaatttctgtcagtgccttatcatattcttctaaatcattatacaattctgctttccttaatctgcataaaataaatacattttcaagccattcatcatcttttacatacgaaaaatatttttctgcattttcaagcatagctactgaaccttccatatcatcatcttcttcaagaaatatggctttttccatatacatttttattaataattttctatcttcaggttcatcccatttttgaatcttatctattatactgttatataaatcatcactatcttcttcactatgagataatttaatatttatacattttctatatacatccttatatccttcactgctttcacttatggtgttcataatatttaatatactgtcaatttcacctttaataacattataattatctaaagtcaaaatttcttctagtctaactttaattaagtcaagcttgtctttatctactgatgatttttccatgtatttatataattttttatataaattaattactttttttaggttgcctttctctagtcctgcaactgtgtgctgttctattgttgtaacaagatagtttagaagaatccttacattttcctctccatgagcatctaaattatttgcaaaattttctgttttatttacgatttcaactatatccttacttattatagcttcctttatggcctgaatttctttatcatttccactttcattaaatcttaaaagaagaaaatcagaataaatattttttgaaaaattttcttcaaagtattttttaagaaattgtattggattttgaattatatctggagattttatattaaattcacttataaaactgcttaatacctctcctgaatctaaaacatcattaaaatcagagtattttaaatcatcatctatttcaaatccataaaccctttcctcttttggaagcacaaaaataacgtcatctcttactattcttttttcttcatctgaatatttgatccataacggaaggttcttgtagtcctcttcattatggcagaaccaatacattttatactttaatggcattttaaatctttcttttaattcactcattataacatcattttcccatccactataacctataacaagtggagacataccatttagagcagttcttaaaaaagaacgtactgaaaacaattcatctaaatccttatttctttcatttgaatacttctgactaacacaatcgtaaaattcatatgttccatatacatgtaatatgtttaagctgttgctttcaatattgagcttccctgcactcttacaagtatcagatattataatattattttcaccaaaaagctttaatgtgtcatatataaatgtatcaaaattaggagtaacaactaaattgcttacttttctagataaaagtatattggcaagctttattgcactttcaggtattcttttatccttaataagattttttatatacctttttcttgtttctttatgtggaaatgctttttcaagccagtatgaatactgttcttccacatttctacttctattgtattgattttctttacatatccttttacattctgctgtaatctgtgcagatgtctttactgactctgaacttatacctgctcctgcaataaaaaaatatggatattgctttattgatttattataaacttcctgtccatatactgcatcagactcatcattatttataaaataatatgctttggatatttcatgaaccgcttctttgtaatctcggataatgttatcatccaaacagaatccccccttgcttctgaactaaattctaaactaaataaaatactccatatctatatatatttttattcataaacaaattatgtgatatatagtattatttaataaaaaaattcaaagttatttttacttaaatattaaaaattgtgcttgacaaaatcaatataaagcattctatactaaaaacttagcattatactttgtaaattcgtcaaaagcacattttaatttttagaaacttatttttgctattcttgtttctattatataatcttattgagtttttgttgcaactccactattattaaagctatatccatataattcacaattacgcgccatctgaccatcactatacaacaaataatattctccattatatttcaaccagcctgtctgcatttctccatttgaatcaaaataataccattggttgtttatctcctgccatccaacttgcatagcaccttgagaattaaaatagtaccactttccaccagtcaacacccaaccggttttcatagatccatcatttctacctcctaggtaataccagttgccaccatctgaccactgccatccataaagcatatatccttgactattaaacaaataccattttccatctattttataccattcatttgttggataagttccatcattaaatttataccaccaaccaacattatttaactgccattcaccttgtttagactgtactaaacaattttgactaaagtaatcacaatctccagaaaaacttcctatagttccattttcagtatactgccatcctacaatattataaaaaaatcctgtatctacattattatatgaagaagtataatttgctatccatagttttctactctctatataatttgatattaatgttaaattacttataaaaccactataggtatagatgcctatttcaacatttgaaagttcctgccatctgtttataaatcttaaaacataatcacaaagagaatcaaaattaacttcaacgtctaacataaatacaagatcttgagcataagtttttgtagcattatatgcattttctgcctgtgcttctggtaaacttgttcctactaaaaaatgataaaatcccacttttaatcctaaattcttagcttgtacgtatctagctggtgttgtttgatctacaaaagtagctccttcagtactttttaaatataagtactgaactccattttctgtaagagtagacaaatttgatataggattattattacttatatctacaccttgaatattaagcgccattcactttacttcctttctgtatttgttacataatatgaaagagtaatgttattggacactattaaatttaaattataaatatatagtttagaagaatataaaaaataaagaaacattgagagaattcagcatttctttatttttaatatataactttgtattatttatcaaatatattattataaaaataattagtatgtggaatacgaattgatacttttgtattatcaagtgtatattttgtatccgctacaggatccttataattaattaagttcatcccaacttcatataaagcttttgcataatctttaggatcttgatatactgagcctaacatatatcctttttcaataaattctttagcttttggaatcacatcaactccaacaactggaatggtttttgatttttcacccttattataaccatattcttgtaacgctttaacagcgcctattgccatactatcatcatttgcaattataacatctatatctaagctatatttttcaaaggcttcttttgtatgttcatatgcagctttctcagaccaattagcaaagtcaatccctacttgctgagtttttatccccgatttctcaattgtagaaataacatatttagttctttctgttgcttctgtattatcaccttcaccttctagcatataatattgtagtattccatcattatttctatctatatattttttatttgaattccataaatctattagcatctctccctgtaaaatacctgcctgcaccggatcagttccaatatatatagctcttccatatgattgtattggcacagatgtaagaggttctctattaaataaaatcacaggaacattatttgcttttattttatctataacagctttagaatatgctctatctactatatttaataatattaaatcagttccttcttctaatacctttgcaatttcttcattttgatttttctgatttaacttcccatcataaaaattatattctactttatcagaatttttcttttgaatctcctctagattttttcttatttctgaaatcaaatcgtcattgaaatctgataaaaatacagagacttttgctggatttctttctaaacttaaaattctaacatttgttgtttgatatattaaaaacacagtgctcagtacaaatatactcataagtaataataatctttttaaaactttcatttttcctccataaagcttaacaacatatatattaattttttatcatttcaatatttgtacaataatatattttattattagctatttgaaaaaaataatacttacttttctaatttcatattgttaattataatattcacaaaatatttctcattaaaaatctcataattactatatgatataattatatataaagttaactaatgataattacttattctcaaattaaatacggttcttttataagaattaatactaagggggctaataatatgaatatatcaaaattattagataatttaaaaagggaaggttttactgtttcattctttgaaaataatgatagtgcagtaaaatatcttgattcacagctaaataaaaaaacaatagggtttggtggtagtaaaacattagaagaattaaatttatttgaaacattatcaataaataatgaagtttattggcattggagacaaccacaacaagaagctaggtctaattctcagacagcacaagtctacatttcttctgccaatgcaatagctgaaacaggtgaaataataaatattgatggaagtggtaacagaatctcatcaattatgtatggtcatgagaaagtatatataatagctggcgtaaataaagtcgaggaaacttttgaaaaagcattatggcgtgctaaaaatattgctgctcctctcaatgcaaaacgacttggtttaaaaacaccttgtgctgtaagtaaagaaatgaaatgctatgactgctctagtcctgatagaatatgttgtggtgtttctgtattaataaaaaaaatgaatggaataaaagaaatggaagtaattttaataaatgagcaaatgggatattaatttttctataaataaaagagttcaagaaaagactaagtaatattgtcttttcttgaactgagagtttagatagttttgtgtaattagtatttttatcaatttattattactggaaattttgatttccagtaatatttttttatatttaagaaatactaataatgttttttattaccttttttagtatttcaataaaatctaaaagtatgcatattaatcaataaaagtacaagcttctaagctaattcatcttttagttgatcttcaaatattattgatagctccgctagcgtagcaccccaatttggagtaggttgactccatttttctgttatttccatcgtagctaagtaaacacacttatttaacgattcatctgtaggaaagatcactctaaccttagtaaatttacgtatttgacgattaaacccttcaagtgcattggtagtatatatcatctttcttatgcttggagagaaatcaaaaaatgttgatagattactccaattattataccaagaatcaataactatagcgtatttattaccccagaaagattttaaattgtctagctgcgccaacgcaagttcttcagttgatgctttgtaaacttcttttaaatccttcataaatgcctttttatcctttgaagctatatatttgattgaatttctaatttggtgaacaatacatgtttgaatatttactgatggaaatactgttttaatagcttgtggtaatccttttaaaccatccatacatgcaattaatatttctttaactcctctattttttaagtcattacaaattcctaaccagaatttagcaccttctgcttcatcaacccatatacctaaaatatctttatagccatccattgtatatcctaaacaaatgtaaacagctttattaattatctttccattacttctaactttaaagtacatagcatctaaataaacgataggatatattttatccaaagctctattttgccattcggtagcgctagcgagtactttatctgttattttagataccatcgatggagatatttttattccatatagatcttcaatctctgattggatatcacttgtactcatacctttagcatataaagatataatttttttatctaactcagtacagacagtttcatatttctttataatttgaggttcgaattctgcatttctatcacggggtacgtctaagtcgacgtcaccgaaggagcttcgtagatttttactgctatacccgtttctatagtttctattgctttgattatttgattctgtacgctcatatttatttcttccaagatgctcttccatttcgccttctaatatattttcaaggacatcttttacaagtttttgtattagcccattcttacccataacatcatcgatggttttacatttttttatttcttcattgtagtcaaagttagtatcaattttttttgtcataataattcctcctaaacttatatgttttattattccaaaactaccaactgttcatacaaaaaaacagtagatagttttgcttttacacaaaattatctactctctacttgaactctttctatgtataaattgtgtgatttttatattaatgaactaaaaattaaaagttgaaatatgttgttttaactcttctgttttttccttcaatatattcaaatcatgtacaaatgtctcggttgatgcattaacttcatgagcagatgctgtcacttcctcacttcctgctgctgtttcctctaataaagctgagagatctccaactttatctaatacattatctttcatagtatttattacggaaatactatctgctataattgatactttatcacttaaactttcaacagaatgaactatatctttgaatattttttgagattccataacagcttcttcctgctcttttactacattcgtagtatttgatactttatctacagccttattagatttttcacttatctcttttataattgaatctatttcttttgccgaaactgctgtttcttctgcaagttttcttatttcatcagctacaacagcaaatccttttcctgcttcaccagctcttgcagcttctattgcagcattcaatgccaaaagatttgtctgttcagttattgctgttatactactattaatattttcaatcttttcaatactgcttgatacttcattaacaacagaatttacttcttccgtactgtttttagtttcatttgatttatttaatactaatttagcaatttctaaacctcttccgcctaatttatttgtttccaaagcaacttcattcacattattagtttcattttttatttcattaatagaagatgataatttttccatatcagatgcaatattttcaagaccatctgctgatttccctgtaccttcggaaatttcagtcatagtgtttgttacctgccctatagactcagatatttcttcacttaatgcaattgagtttacagctgtattatctacatttattacagaatcatttacacggccaagtaaactagttaaatttcccgacatattattaaaactttcttctaaaagtttaaattcttttattatggtattgagctttattttttcttttaaatcacccttagatgctttcgtaatactttcaactaatttttttatattgttggataccatttttgtaccaatattaattataatagaaattaaaactaatataattaacataattaacatagataacatcaattgatatctctcagaggctcgtatttcatttgtttcagtctttaaaataatcttccatccagtcgtttttgtagttgaataatatcctaaatactcatttgaactatattcaaaatcaacttcaccactatcattacttataatattatcccatacatcatactctaatggttcttgtccacctattttactttcatcagtattagaaattactacaccttcatctgtacatatcataagttgtcctgtttcaccgtatttatattccgataatatatctgcaagctttgtcaattcaatatccatagaaacaacacctattgcagaattatctttagtaacagctttagaaatagtaagaacaatatttcctgttgtaggatcagaatatggactttctactataaagttactctgatctgccatagaatttataaaccatggccttgatttagcattatagccctctggaagttcatgatctaatgactgaacgtaagatccatcggattcagatgcgtaataaatattaagtatactttcatctcttttttctaataaatccatagatttttttaatttatcaaaatcataaaaatctccatcactagataataattgtataatgctatagtattccccaattttattatcaattgttccccctgcaattttaagtaataaatctgcattttctttataattcttattagcattatttctatttataacacctgatgatattgttaataatataaccggtataagaactaatattaatattagtccgaataatattttcttaaattctactacttttttcatttttcccctcacttttcacttttttataataattatatcttattaattataatttttaaattaaacttcatattttttataattttataaaataaaacacttttattttttattttataatatatatgataatttttagcaatatatattataaaatagaaatctaatatagaaagtcactcgcatatttatttaaattcaataaatctatgtttaaatttcacaatataaatacatattcaaattaccaaaagtatttatatatttaattgaaaataattatcattaatattgactttggtgtttttttatagtattataaaagcacaggaactgataagagttatcatttaaacacaatacatcttaaataatgttcctaataaataaaaaagtaattaaccacacaataaaaagaacagtgcatatttaacagcatttatttattatcacacactatcttgacgcataactattagttttatcaaattttttctgttattcttccaaaagaaatgcacttttctttcatattgttttccatgacaaatgaataaaccagcacatagatgttttgttaacacttgtactggtttattttgttctaaaacttaattctaataattggaaagtagcttttagggataaactactaatgaaccctatattttatatatactacataaaatattagatttttaaatacatttcattcaccttttttacatttttttatggcaataaaaaaagagttgcgataaaatctcacaactctaacgttcttctattatcttctattattttgttcttttcttgctcttctacaagctgcacatctaacaggttcattttcaaaccctttttctttgtagaattcttgttctccaactgtgaaaacaaattcacttccacaatctttacatactaatgtcttatctgtcatattaacttcctccttattcttaaagatattaataatataattctctaattaaggagaaatgtaaaattaaataatcttttaatattttataagtataccactattaatatataattgcaagctattattcaattattttctttactagtatgttatgaaaaacttaataatccataaaatcatttgcattctaaaattcttaacaaagcatcagcatcttaccataaggcttatatttatttcttctaatttcataggtatcttgagatacatgaatattatattttccattaagattatttattttaatttctctcgaaatacttgatttatttctattgagttctttggttattttagataaaatcaatcccaattttaaatattctactatacaatagtgttcatttatagtaatatgtttataacttatataatcacgtccttaaaagtagttttctagcaattattactttagcataaacgtactagtatgagttacttttttcaactaattagtgtcacacttgatattgtaaattatcataataaaaagatttaacccatgaataagttttattatgattttcacaccattcaataaatttaatatttgcattttcacttttataattaaaccaacttttatataagtcatcgtaatatttcatatcttctaaaataaactttattttatcaagtttatccttatatttatccaataattgttctaatttttccaataaagaatcaacttctttttcttctattaaaatatactccggtaaatggtgactcccaaaccataatctatccatatatactttaattaatagcactacagttttaatatcagtaggatctatgctatttgcacgtataagtatatcttttgaattataatactctatattatctatgttcctataattacagcaactatataactgcaattgatatatccatcttaaatatggcatcttgtcattttttacagcatcaacaactatcggtaatattattttctctactattggctgctgaaaatccttaatttttcctttttcaaatctttgattacaaagatactcaacaaatttttgcttatcattttcactctttgactctaaatactcaattagtttatccaactttttatttgcaattttcttcaaacctatatttctcgtctccgcataatcattccaaagacttgttatttctacatctgaatactctattaaattcattatttatctctccccaaccggcttccactgcttatcttttacatcattttcattaggctttcttacactattcaaacttttttcatcacaagcaccaaattcaataaaattcctttgtgcttgtcttaaagaaatggtattcgctcccccctcataatctggattattaaactgaacaatgtcatcttcccaaaaacatatatcacaaatatcatatattgaaccatcatctaaagttttataaccacaacaagggcaagttttcatataaatcaccttctttatcatcatttaataattaatccaaccataatgaatgtattttatatccttcatattaattacatccaaaaccaactttattaactttaatccctaatgttccatttagcaacacttctggtacactaggattacctttctttaatttataaatcttaactttagttacttcaggtatatattgaatacttttaccaacaaactcgctatcaaatattttcctatataggttgaaccacacatttaaattcgctggttcctcttcattatttccatttaaaaatgtataatcatctgcatcataaaatatcatcaaagccgtgtccaaatcacaatttttattttctataattagtttaggaaacttaaacccatcatcccaattatatttacatgctataatatggagcgctattgaatcatttattttatcaattttctcctctaattttgaaatatcatcataaaggaaatcacttattcattgataattatcatccatatacatctcctcatcttataaccctattcaaatatacgatcaattaactcttcaaatttttcacaataactttcataactactaatagtatctttaaactgaattgctacttcatctaaatcaccataagtaccactttgagccaaataaaaagaatcatctaatccatatagatcataatattcatcctcataagatagacttgtgtgaattaataacatatcagtacattttattgcttttacaatacctatttcattattactataaatttgtccttcctaatttcatttaaaatatcttctcacaaatcataatttataagtactttctaccaataaaattatctcaatcttattacaataaaactttagttcttcattattctcaaaatcacttacaatgctagagtactagcaaatttttaaatgatctacctttgtattcttgtgtaattaattattaaaatttcaaactgttagattaatattaaattactaaacatcacatttatatgatgaatgattatatacaaaaaattaaatttgaatttttgttttaagtgctgatagcagcatacaatcaaagtctttaaatctttcaattaagtctccacttggtttatcaagttctgcaaaactcatctcacaaatatcataaacataccatgaaatatcagcatctcctaaaaataaatatttatgtccaaaagattccccattaaaatcccatgcctcattttcacttattaaattactttcataatcacttgccccatagaaaattaacccttcaaatttaaatccattttgtacttttaaaaattcttcataatcattaagccataaatctttagaaatattatcaaaaccccacttttttaacgtatcaatactaacttcagatgctatgtttctatttacagtctcattatattttttgcaaattatattgatttcagtgatatatttaacccattctttttcaattttcataataattccccttttaataaaatacactaactttatttcaaatttatataatcttttataattatattttttatatactctagttgaactattaattatctaatgaattaaacatcttcactcagtattttgaacccctgatgttctattaatgccctaaaagcactagaaccaccataaggccaagaccacggattaaattcaattcttcctttttcatttgatattcgttcgcaagatacaaaatcatattcaccattagagaatgcatctatcattgattcaaaatcccatggatgttgtaacttcggagatgtaaatcgttcatttatcggagtttctttccatagttttgcatattcgttaagttcatcagaagttggccaccagaatttcataagaacgtcttgttcaaaatagccaatccattttgaatcttttgatataatattatcttttgctttctcttcttttagtgcataaaaaaaatcttgtaatttactaaatctatcattattattaatttcaaattcaaaataaaatttttccattttttctctccttaacaattcatctacctataaattgattagttcatcaaaaactttataaaaccaaaagtaggtttcattatgtaaaatgttatattattcttctaagttgtaccaatcttcaacctttttccatgatgcttctttattttccctctcatatgcagagccaatttcacttttaactatttctaatagtgtaggatctttatctaataaataacctacactaactatcctaatattatctggattattagtatattcctcatcttcttcaccagaaaacactctccatccactatcttctactttatctgctttttcacggtaaagccagcatataacccccttattctccatacactttctagatactagtgcctttttttctgctatctcaagccaacgtggatcttctttctttataaaagttcttgcaatatgctttggctcaaactcaatttcatctccaatatttaaatcctttatatatacaggaatattagtaagaataccaatgtactttttaccaaacatctttttccttgaaatctcaacccacattctctccgctcttggctcaccgtccttaggattagtaagtaaaaaatgtaatctcactaaatctccctttttttgtgaacttcgctcttttaatgatggtataaaaaaggtatttggattttccttatttacactttcaatatcttctaatttccaccctgacataataatacctaccttaataataaattttacttattaattttttatctcagcataatcttttgaaattaattaaaacttgtactctactggataatcaatttttataagttcttccattgttttttttatatttctatctggatttattttttttatcatctcttctgtaattggttgatggttaaaaacttttttaatttcctcaatagtcaatctatctcctaattcccaataatattttgcccaatctacataaccttctactgaaaatattctactaagcatataatccgaaccatccttacaaccttctggaatttctacttttccctttcgccactccttatggttcttatcctgccaaatacagaatgtcacatcatctttttcaatggcttcatcctcaagtaagtctaataacacctttggaacatcatcataaattcctttccagacttcaaagtcttcctgagcatgaggtgataactcagattcatgatcaaaccctttgataatacatccatcatttgaaaatactatatgcattgtatctccacagccattatcaattactgctaaagaacttttttcatcccagttaggataccatgtatatactcttaaccaatcctcctcactaaaaatcatatcaagagcagacatagaaataaggctttttttaattatatctatagttggcaaattctttagtgtacagtatgtttcattaaatgcataattccaattcaattctttataatatgaaatttcttcccatccgttttcattttcaaaagaacctacataaagtatttttccatcacagattgtccactctaatccatgttctatttcccaatcacaatctaattctaaatgataggctactttattcttatcttttggattactgattattaagcatgttggatttatataatttaatatattccttaatgcattaaactcataagtttcttccccaacatcattgcaaaaatcattacaataatttatagaatattgacataatttatttacaaccgcttcatctaacttttccaaattttcagcacacaaatttgcatattctaaatctatatcttcagtcattaatacattaatagtcttattaaatagtgtaaattccattttcccttctaatccataatttgttttaattatatctgtaatcattatatttaatcctctcttattaatttaaatattcattctcataaatctataatttataattactttcatcaactgaaattatctctatcttgttacaataaaactttatatcaccatcttgttccaaatcatgtactaaataatttaatgaactccatccatcatctttaatatcaactatatcaaaacatactatttgaacaaatttacttactatgtataaattcatattctcaacttcatgaaatctaattttaactgaatattgcttgttatctattgtaaaaataataaagacaatatctaatagaaaaacttcttcataatattcattaaaatcttgataataatttatttcatatatatatttaatatcttgccaagaaaagaccttaaccttttcttgaatataattgtaattcaatattatttccattatataaatattttaacattttagtttgcaacatcctactattaatttacttattctttatctatcaaaaaataaaaagttatgcaaaaataagaattactcttgtcttaatgcataacctttttaatgattttctttataaaatatttaaatatacaaatggaaaacaaaaaagttgtgaagtaacaaaggcttttccttcatcatcttcacaacttttaacacaactttattttgctgtgacatagtataatttattacctacactaactaaaatatagacatctatttgatatgctattaataaaatcgtcctttatgaatatttcaagccatcttctattctatctgtagttaacccatactctttcgaattctaattgttcatcaatgctaacaaattctatgcctccatcataaccaaatatatcaatcaaagttaaagctatattttattagttctttataatgtttttcagttttgggccttaggttttttaactgacaatgttctaatataaattcattaaatccctcctctaaatactttccatttgacttatttttcatattaattttcttcattttcttcactccctcctccctgcagatgagagtaaggttttggaaaaaaaagaatgcacccatccataggtaataatacctattagatgagtacatctaaaacagtctattaaaatgtactagaatcctctaaataccttataattgtatccgcaaaataaagtcatgtcaaaacttcactcttatcctttctctctaacttcgcagttttacaaggttacaggacctcaaataaattataagtaaaataaagtcgtgttgagtttttcgtctattttttcaccgttcattcccaattttattctttagcatacgctatttagcaaaataaagtcgtgttattttatggtgatgttggaacgtggcttcgccgacgcggtagcagttttattccttatcttcttcctatcttccctcattctctctttcttttcgtcgcctttttcttcttccctcaaacgaaaaagaccatgcaggtcctcgaagtttccctcgatttctcctacatgatctcaacacaactttatttttcacgacacgacttttatgagcctgacatgactttattcagttgtaacatagttataacatttcatttacctataaattcattaaatttcctaattgtttttgtaaattgtctaatatatcttttgcttttaaataaatttcttctgatttgtctcttgctatgtcatcagcattttctagaactttatctgttaaatcttcatcaaaaccattatcttcttcatactctctaaaccaatcatcagaataatttttaatattaaaatctgcaacttttcttatttcatccaaacttataattttttctatttcagaacaaatgtcatatactttacctgatatagttttattaaatatattagaaatttccttaataccatcacatacatcagcaattctttctagcatttcttgattaaaagcatcacaaatttcattatcaggtaactctaaagtttcaactaaatcataataaatttcatcagtatcatttaaataactttctagactgcttaaactatctcttattttaatattatcgcttgaatcatcatttatagcatcattttgaaacttaatttcaataccattaattataatcttatttttagatgctatatactcaaatatattttttaaactatttttcaattcaatagaattatttaaatcattttcaaaatttttatgattatctttataatcccaagttacaacattataataataatactcaccttcaattataattttatcatatttattttcgagttttagcataattaactttgatgtagagatatcattcataatatcattcataatatcaacaaaatcatctatattatctttattaactataaatgaattatttttattaattttaaagttattcgatgcttttatttttgaaagtaataatttatagtatccagaaaacttacttcctctgcttccgtagtattccataacaactattctatcagcagattcacctctaacataacaaattctatctacacctgataaagatcttgcattaggtccataaaaatttgcattattccactgtccaccaagactacaataaccactattaatattcttcaattttcctttaaaaaaacttgatattccttttgcttcagttataatagtattgattggacctgaataatccatagttgaaattaatgtacttgaatcataaagtagagtttgttcaattgttaaatatgaaggatcttttactccatatttttttaattctaaattatttaggtttactattttcataaaaatacctccgtacatatttttattttcttactaggtggctctagtaagaatctagttatattttaactctaattagaaaaatatgcaaggtatttttatgctcttttatatacaaaaaaaagaatacatttcttggcaatttaatgatatgtgttctaatttatgtataaaatttatttttttgttaaattaattatttgtctcaacccttgttacttcaagacctaaactattagcaactttaataaatctatctatattctctactccccattgattacataccgcaattttaatattatctgaagtagttaatatttcgctaggcttcatataaaatcttctaggatccttgtttttaacatattctacactttgaactactcctgaacttccttgtatctcatctttaaaatcattttttaattgttcaaaagtcatcttcttagtattgatatattcatttaatacctcccaaacaaccctacttttagcatacttctttcctttaaacaggcacttactataatcttttcccgacttagtatatattgtatttatcatattatcaatattctctttttcttccttgttaatattgtcatcatcttttagtacattcaacattgctaacagtaatggtttatttccttcccaaaagtcaagtaataattttctttccttatcattaatagccattacaattcctccttgcttcatagtcttttcatctaaagatggataacttaaacatctaaaatagttattaattaatgattgagcctctgttggtaactgttgcattctacacggttctaataaataatccactatatattgatagttcacttgaatatactctttgcatttacattgttgttcatttaaatcatataattcattattagatattggtgtaagataaacaaatattaattcagacaaaccattaaattttttctttgcccatttataatattgaagtgtttgttctgaatgttcctttgaatatactttattttccaagataatttttaaattttttaccatctcttcttcatcataaatttttattgttacatcaatataaatgtcaattcttttgttattttcaattactttttcacgctctatttctacattcaatacttcgtaattacctgtaataatataatcaacaagatactctggaaatattttttcattttctttgctatacttacaatcaaataatgccattattagcatctctagaaattttttaatggtatagtaatttaatccatgatattcacttggatccaataaccatgctaaaaaattactatgaacattttcatttctcataatacctaaaatatcaaaaatacttttagaattataatacaattttaactcatgatattctctcgaattaaataatttaatcatgctttttcttatatcaaaattttcatttaattcattgcaaaaattatctatcacgtatttacctcacttatttactaaacatatttctaattatttttttctaaataaagtttctttaatttctctccttcttcagtagttaaagatattttagttctatttaagagtttcccagatacttcttttctataatcagatgctgtaattatattttgctcatcaattgaatatttaccttcatcatcaagtatcaaagactttttatcaaattctacacttacaaaatattcatcccatatttcatattgtattttatctccatcatagcattttactaaactataatcatttaccatataattagatttgactgtacctgctcctacaattccttctccattcatatatataaatacataatccccaggtttcaatgttgttattacatttttaatatctccccatgcagatgctctatttccattcaacatatgaagatgtccttctggcatatatgaattatttgaattaattataaaatattctggtttactgatgttttcaaaatcttgtacaaatgctgcagatatatcactaataatttgatttttagaagtttctaacttgtctgcaatctgagataaattatctaatacattatcatcaattgtaattgtaattgattttttcttttgagtttgattttttaattttttaatatattcatagttatttaccatgactattcctcctaaaatatatattctctatatttatattatcacaactaattactatttcaatatttaatcaatattttttcaatatttttttaataaaatatatttattttatatgcacattaaattaaaaaactcattggattaatatccacccaatgagttaataatcattaaaatctaattccatcatacatttctatcactttactaacacttctaaaagataattgtatatccttccattccttccaattatctattctcttctttacccattcatatgttctatttattgtctcctctttgctttctgttaattcttgaataaattgtttatcatctaataatatcgcaagaaatgaattcattaaattttcaatatgtatgtctttaataaccacattactacatcttgtattttgtaattctttttttacagtgtttactgatatttttccatttttaattctattatataaagcaacatcaacctgctttacacataataaaaaaatcataggatatacaaataaatagttatcttcattcatttttattattaacaacagtctaactaatactttttcaatatctctaaatgataagttagttaattgaatgcaaccaattaatatatttctaaattcttcaaaattattttcatagcaatctcctatttttctgtcactatataaatcttttattttatatttaaataataagtaatctattattttttcttttgaatcttctttcaatttatattctaaatcaataaacctgcttaaatatccttcaacttctgtttcttctccatatattacttttattgaatttgataatgcttttttatccattcccaatacaaaaataatgtcttcaatattaaaaaaatgttttatacgctccaataatttaattgcataatttggtctacacctatctatttcatcaacaaaaataactaatggtttatcggtattttcaaaattttttcttactttcttctttaattcaagtttaaatttctcaatagaatcctttgaattcttatagttctcaaacttgtctgatatcatttgttttacatcatcatcagaaaaaatttcgtctaaatcaatgttagttttattttttataaaatattttgcaactgatggaatttgttttaataatactgaaccaatttcttttgatttttccacaaactctctatctattatttcatttcctaaagtatttctaatttcttctataaatgcaataaatggctcatctataaaatcattctcccaacaattaaaaaatactgttgaatatccttggttctctaaatccttcctccacattttcaagaatgtggtctttcctgttccccacggagaatttattgccagcaccatttgattttcaacacttttaaataagttagtcaatttatttgcttctgttattctttctaatttatcatttttaaacggattatcttcttctataataatttgattattaaatattcccaacattacacctcatacactataaccatattaattaaaacaaatcaaattcatctgtatcacttgtttcaatacttcttgtttcaacacttgaattataaatattaaattcatcaggatctgattcttctattgttgcagttgctacacttgaactcatcatataaaactcatcattatcagaattttctattgtaaacgtttgctctattctaattccatgcataaattcatcaggatcacttacttcaatggtatttgtcactttactctctgccacaggcctacataactttttagaaaaatttttatctatataagacatctgtgttagtccatcataataattattaattaaagtactataattttctttcttactgtatctacttaaaatgtgttttttcataccaatcactccattaatattacttttattgtttcttcattatcattacaattatctttaaccaattgtatattttcttcttttaaatggggctgcatcaaaacaagtttgatactagccgataaaaaaagagaattcataaatttgaattctcttttttgcgcataatattaatatgaacactaataatattatacctatgcatcaaataggtttcccaataaatctagaaaatattatatctgatagtgattcagtaagagtgctttatgatgttatggagggattagattattcagaattaaatagaacttactctactattggtagaaatccagcacttttacctaaaactatgtttgcaattatagtttatggatatattgaaggaatatattcaagtcgtgctcttgaaaaggcatgcaaaagagatataaatttcaaatggcttttacaaggtcaactaccaccaggacacaattctatagatagatttagacgtgaacgattagctggctgtatagaaaatttatttaatcaacttgtgaaaaaacttagagaacttaatgaaattcaatttaaaaatatattcattgacggaacaaaaatagaatcagctgcaaatcgatatacttttgtttggaaaaaatctattgataaatttgaagatagactacaaaagaaaataaaagaaagcttaataagaatgaatcatgatttgaatttatgtcttattattactaatgctaaaatatcagttcaagatgctaattatattttggatagtatcagaattatgattgaagccaataatattgaatttgtttatggaaaagggaaaagaaaaagtaaattccaaagatatactgaacaacttaaggaatttattgaaaagcaaaataaatataatgaatacaatagcatttttaatggacgaaacagtttttcaaaaacagatcatgacgcaactttcatgcatatgaaagaagatcacatgaaaaacggtcaattaaaaccagcatataatatccaaataggggtagagggtgaatatattgtaggagtagacatttcaagtgaaagatctgaccagcttacttttataccatttttagatagattagaaaagaatttaaatcaaaaatatgaatccgtaactgctgacgcaggatacgaaagtgaagaaaattatgcatatcttgaatctaaaaaacaagaagcttttattaaacctgcaaattatgaaaagtcaaagacaaagaaattcaagagtgatattagtaataaagaaaatatgtactataacacagatgaagattactacatttgtgcatacggtaaaaaaatgcttctaaaaggaacaaaaaagaaaaaaacaaaatctggatatgaaactactgttagcatctatgaatgtgaagattgtgatggctgtgaatataagagtaaatgtacgaaagcaaaaggtaataaacaaatacatgtggctaaaaattttatgcgtctaagaacaaattcacttaaaaacatcactacacctaaaggaatacttttaagaatgaacagatcaattcaagtcgaaggagcatttggagttattaaacaagattatggttttagaagattttttatgcgtggaaatattaaagttcgtactgaatttttgttaatggcgtttggttataatgttaataaattgtaccataaaaccattcaaaatcgtaacggtgagctgcttcataagcagcaagcttcgtaattttaaatatataattaaaatatggataataatatttatcctttatttgtgttatttcaaaatgaaatatttggaaatatatacatgaataaaatttacgtttataaaaataggctgtatcaaattgaatttaaaaaatttcaatttgatacagccccttttttattaatcatcagccatagccagtcccatttctttcatctgttcttttgttacgcccttattaatcactcttcgtgcttcaccattttcatcaatctttattgttgtatatttttcagcggcctttgcatattttagttttgtcttagtcaatttatcattggttgatacaaacaaagttgctggtatctctccattatttgctttaattaattttttacaatattcatttttttctgcctctgtcatatcttcaccttttttatttgcatattcatctattactgattgtacttcagcattgtatttcactttgcttaaatctattgtatcactatccttagtttctttattttcatcattatcatctacttcattttcaacttttgtagtatctttattctcttctttagtatcattcttagttgaagaacatcctattaatcccccacacataatacagcatagtaataaacttaatatcttctttttcataattatactctcactttctctatatcatcttttattaattctaattcttaatatataaagtttcattacataattatacaatgttgataaaatataacatataaattatactaaaataatagtaataaatgttacttacatattcaatacttataaaaatacggggggaatcttatatgaaaagaaatctgataaaaacaatatccctatttactattttaatgtcagttggtactagttcttttgctgctgatattgatatgaatgatcctgcatttaattctagtttgtatgaaaacacctcaactgaagaagccgtctatcatgatgatgtcatcgagagcactcctgaactacccaaagatggcgatggtagtaaattaaaaatcggatttacttctactgactatggtttagtctactgtcaagatgaaaaacttttaaaagtaactggttggcaacaaattaatggatactggtatcattttactaactacatcatagatactggatggtttaacgataatggaacattgtattttttacaatccaatggttctactaatgatggctacggccgtatgaaaactggatggtacaaagattctaacggaacttggtattacctaacatcaagtggtgcaatggctactggatggcatcagatcaataataattggtattattttgattctaatggcaaaatggctcatgatacatatatcaataattattatttaaattgtaatggtgtttggataaattaaactctaatagtataactacaatatcacttagaaatatgtttttagatattataaatggattcataaatcacactattaagtttttcctataaggaaaccgttttttgaatccatttttctaaaacatgtgtagattttcttttacctattaaaaagactgtacactaaagcacagtctatcattgaaggtatttaaattaaagtaatattattattattatagatattaaattcctaccactattattataaaattaatatctatatatagtccattatagattcaaattttttttacttgttttttatcaattttaactaaagtcaatcatttttaactaatctgacctatttttgttcaaatcaattcattccataccatttattataattatctttcattcttcaccaattccttttaaaagccaattccaacatgctaattagtataaaataattcttttctatatttattaaaatatagtataatcacctttatttttatgcatgtttttctattgaacacctaatgccttaaatacagcatcttctgcaccagaatagaacattatttgaaatttggcaaatagttctggtggtactacaggtatatctgctgcattaaccataggaagtagtattttcttagcacctgcatcaaaacatacttggagagtatttgctaagtcttctactttgtttatagtacctccaatacttacagaacctaatactgctaattggctttgtactggtttattaagtgctccagagcacattgcaataattgctgcaagtgataatgaagaggtcatgcctactccatttacatcttgtacatgcatcaagtagtccttacttgtagttgaaatagatgcgcttatactcctgctattagccttgaaatatctaaacgcagtttctatactttcttttgcttctctacacgtaccaagtcctgttctttcaaatttaccactaccagagactacttctgtttcaatcttatatacaccaatcattccagaatctccaacacctactgtataaacatgccctgcttttcctaatccctctgggattaatgagcctgagccttgttcaggcactgatacaaattcttcttccattgtatctaaatctatgtaagaaaaatgaacatcatagaattccattccacctattttcttcaattgctctttaactcttcttcttccaactaaagcgtacttgagaatttcttcaatatcctcttttgtgaactctccatgaggataaatcaatttaactaatcctgatactgtctttcttaccgcaataacatctctttgatttaagttattaccaagtttaaagtatttatcaatggcatccccatatgttctttttctcatatctcttaaatattctgctaaataatcagtaataaatccaaaactatctgttattaattctggtctcatctttggaacttcccatcctggaagataaaaatgcattctatcaaaaaatgctgaatcacaagccattgcttctgggaatggttcaaataaatgagaagttttcagtagcacgtctacactctgatttatattgcctacaaataccatagatgcagaggctgccttttcttcttttcctcttgcaaaagaaccagaagccatataatccttcattatttgaattccatctttatctttaaatgttattcctgctacttcatcaaaggcaactacatcccacatacctacaagtcctatttttctctgagacatgttataaaataagtttgctactgttgtctgtccaccagatactaaaattgaattaggtgatatttctttatataaatgagacttacctgttcctcttggtccaagttcacacatattgtaattattctcacatagtggaaccattcttaggagcatatgccatttcacttcattttttaattgtgtaggctccataccaatagaacgtattagaatatctatccattcatctttagtaaaatgctttctaccttctattaattcatctatatccatgcttggcatttgaattggagtaacttgatctataataaaaggattttgatccttaactccttcttcataataatattgaagttttattatacaccaaatccctgcacctagcagtttttcatattccttcacatacttagcacttatttcaacatcttttagacctaaatttgagaattctgcaacataaatatctttcttttcatttaactttactgttaacttatctataacagtaaatctacccatttctcttattttagatttaatcatttctgcttcatcaggtcttacaaaattatctgctaatatattcttaactctttctacgccttcatttatgctgtcttcatcatcagttgcacaatacataccaagaagatattctagaacatatattggcacatttgcaccttgttttagtttctgagttaggtcttttctaacaacttttcctgcaaaattctcatttaattttatacttaaatcatccataacttatacccctgtttttacataaagttcattttctataacataaaattctttttctttactgctatctaatgaaaacatatttatgttgtttattaagttctgaacattattacttaatgtactttttcgttcttcatactgcttattagattctaatattttgtctgacaccttatcttcatttagtaaagcacctttcttagtttcaattaatacctcattacaagcatacattagactttcaatactaacctcaatttctttacctaactttaaaaaatcatttatagtattgctataataatctttatcataaatttcagcaatttttacttctaacattttacctacacaaaacaattcatagcatagtgattgttggtgcattagattttcaatttcattatttaattcttgaaccttatctaatctcttactagtaaatatactatccccatttaccttatttaaatcactaatctttctttgaatacttttattataaaatttcacattagaattcattttattattatttaattgcaagtttgataaaactgatattcttaatgattcattctctacaatagttgtcatattatcttttatgtattcataataatcatatatagcatatatatctgattctttttcatcatagattaactctattatttctttgacatcctttgaaataactgaaaggctcttatctattcgtgccataaaatattgacctgtcactgcagatattgccgaaaatatcattactggtgttaaaacctttgatgcatctaatgggactaatcctgcatgacctgcaatttttccgttttcaccaataaaaggtgttccaagcattccatttttatatttcatcaaagtccctgttatcccttctgggaaaactactttataagcccccttcatttcctggctctgaaccatgttcgccactaagggcaattgctgcaaaaacatatctatttttgcggcattgcctattttatttaattcttctttattaaattcactattaggtgtaatacttagaaattgtttcttcgttcctggttctataaaacaaatatcattaaatttaatcatttcattagaatcagtttttttattcttggtaaatatagaaaaaatattaatcacaatgtttccccctctttaatattgactacactttaaaatccgaactcatctactatagcaatatcaatattaaatggtattctatcataatcaccattagaatcttctgcatcttctattactaagaagtattgctttgtcttatcatatggcatactctttaatacaaacttctctctataacttctttcctttggattttctgatcttgaatctcctatgattatattctcattagaaattctgtttccttcttcgtcttcaaaataacattttactttctttgaaagtactttatcctgaatcatttcatcttggaaaaactctaagtaagttattatattagttattttacgagtaatacttgttaatgttatcttaacttttcttatgtcatttacacttgatgaacttctatcatttttaaatattattacaggtactataatctcttgtggcattgctccaccatgtatataattagcacctgctccctgtactttaaatctacttgttccttttggtgtaattacatatttatcagagtcttttccaagaagataatccatactaaaagtaattgttccctctacattttctttattagacgttaataaaaatcttctattatcttcaccatcatctagttttattcctgttaacttattactttcttccattgtacttctcttatacaaatatccatgatctgctgtaatgataatacttgctgcactaactctgtttactaatttattaacaagtaaagttatttctttaaatgcttcttctgttgcactaaatacttctctttcagtacttgcatgatcgccacgagcatctattgtattatgataaatatatactatatctaatccagtaaaggcttttcttatttctgaatctttcatatccataaccttatcataagttactgctaatgatttaggatttgataattttaatattttatctctattttcagttccattgctattaatgccatctactaatacatcataattatcatttatttcaatagatctattaggtagtaatgctgccataccaagttttgtataagaaggcagtaccccttgaatatattctattttcgatttaccttttctttcatttacaagcagagtattaagttcatcagcactttcatatcttaatccatctgaaataattacatatgttctttctttacgttcatactttacaaattcagaatagaatctatcctgctgctttaagccatcaattctccaaccattattttttgataatgcttcattccacttaattgataattcttgaagataccagttattatataagttttcaactatatcttttaaatcgcacaataattctttgtcatcacagttgtcataatggtagtagaattttctatatgctttatctatatagaagtaattattagcataagatttaaccatatcatatatactttcagtctttattaacgaatcaagttctttctttttctttaataaatttattgaccattttagtgccttatattcacttatatattttttatagtagtgcagagttcttcttgatgatagtaaatttaaatatttatcatattcttctacaccttcttttataagattagtaattcttcttaaaatcaacttatctacatgttcaaatgtatcattagaggcacaagtatcactatcatttttatctaataaagcatttatcttcattttttcgccgataatatgctgcatcttatcatagtaaacactgtcattaacattgttcataaaatgatctataaatactatacagtttgtaatcttttttgatataaatgaatcatattgctttggaagatcaaactttatcgtttcattcatatttgttataagaagagtagccataaatctttctaaactcttttcttcaaatgaatatccataatattttcttataaggttccagagttcttcttcacttccaaacttagttatattttcatataatctatgctcatcatctaaatagtcttttattaaattctttaatatctcttcaaaatccattatctttgttttcgttaatacacataaaacagccatatgaaccttttcttcagtgaaatctgcaacatttaaatttttaaatgctgcaattctctctttattcttaaagaatgtgttatatagtttaaattcatcttttaaggctggatttacaactcctaattcacgcataataacagttgctctatcagtagagaactcttcactataacagaatatatcataaagccagtcttcatttggctctggttttttcatattagaatatataagaatattactttctgtattttctttctctatataatactttgtatgaaaagcattattttcagttaacttaataactttaacgtcttctaaatcaaaactatctatttcttcaataaaatcttcattttcatcataccaaaatacaatgttacgcttcttaccatcacctaatggcttagaaaataaatcttttagaaaatttcttatttcttgtaaattcactatttatccacctcattaataattcatcttatctcctcttaatgaatttaactccaacaattgcagccataatcattgctatactacctgcacaattagcaaaaatctttaacatatcaagaaattgcagtctatttttctccccaatttcaggtataatttttacaatttcacgcaacaaatcgataagtttatccttctgattacccgttaatttatcatccttaagaagttcttttatgctatcgcttatattattcaaagtttctatttccttatcacctaattcttttgatgattttacaatttcttttcctccatctaaaaattcattaagtacattattaaaattaggtatttgttctataatcttttttataagtttccttatctaaagaatttgacattgttattaattcaattatcttttcttttttcacttctctaaatgagtttatatttaatattcttttaaccttttcttcatcattatagtaattgttcttcattttatttccccaaaaatcacttaccttttatatttttgccaataaattcattttaacttctttattctttgaatttataactttaacatcctggaatttagcataattaaccttaactccatcatctaaatcaatagatatcttttcatttgcaaaatatgctacaacttcatcatattccttgcattcttcaatctgcttattaattctatcaatcttcttcttagcaacagccttatcctttgcgctactatcacttgaatctagaaccaactgctgcctgttaatttccgcttcatattttctttgtagcgtatgaagataatctgttctaacctttgctatagtctgctcattgtatctgtgcatataaactaaacatttaaatccatcatttttaccactgtcaaacatccagtaaataggtctcttttgataaatttttaaatggtccttatagaaatcttttataaagtatcttctaattgcctgtcttgcactttcagaagtctttcttccaatagaatctgcaatataatctaggttttcttcaagattctcttctccatatacagttcttataaattctataaatctcgcaactatatcatcttcaaagtactcatcttcagtaattggaataatattatctttgtcaggtacaaatgtagcatcaccccatgaaacacttatcacattcccttcatcatctttattaatacttcttactttacattgattactatttattgaccacttgtcaccaaactctccaccagcataaataagcccttctgcatctatagaatatcttccgaacatacagccaactgcataagaaataagtgatttaatctctcttgttctatccgcttttctaatagtaatatctttctcttcaacttctggagttaattcgtcctgtaaaccataaatatcaatgaatattctgtttaactcctcttcattagattttaactgtacaaaattttcttcacattcagtttcccatatattaaatatcgaacttaatttatattggcttccaatatccaataatttcaataatggatgaactttaaaatcccatgatgtttcaaaagaatcccaatcatttttcgacagattaatacattcttcaaaactggaattaattctccccttaaatctctcttcaattattattggtattcttgcgatgtttcccttttcgtaatttatcgtttctgatatcgctgccaaaaatttattaactatttttgagtttagtaatgaaccaatatatgatagatttctttcatccatagtgattttcattcctgcatcactaaatacataacctttatcacaatatctaacagagaatgtgttagtgctaactttagtccatgtcatcccctttttaaaatagaattgttttgatggtaatttatttccttgcttagataatatctcgaaactaggctgatcaaattttataacactttcattattgccataccattttctaaatagtccccctttatttataggtgcatatttaaaacttgactctaaaaatgattctgttgatggaaaataaaatccaatctttgaataatctacttcagtccatattctaataaatttatcattatcccctgttgctaatccttgcctagcctctcctaaagtttctaatttattagcaatagaaaaaatcgttcttactttattactaatccaataatttataggcattccatcaattttcaaataatctatttgtcttgtttcacaatatctattcttattattaaaaaattcaatctcctttcgatatctttgcgaatcataaaaatcaacaagtttaatatatgttgctttaaaatctttaattgatttctttcttgatacccaactaacagtttgaactacttttccattaataccttcaaatgcctcaaatcctagttgtactaaagaattaatcgtaaaatctgttattattttttttcttaaatctttatatgaattcaaaaacatccatgaatgcattgtcactaatgatgttaaataatttgatttagtatatttaaatgttttttcaataaatactgaatacatgtcacttttagaacttggatactccttaattacaaagtctcttaatttttgactcattccatctgatcccatataaggtggattagttatgcaaacctcatataatctgctcattgtcttcccttgcataacaattgctggcaaattatcaagtatagcctttctataatccccaaacataagattatcttcatcttcaacttcttttaatctttgttttattgcatcaaaatcaactgactttacttcaagaatagaaccatattccttagcatcagtaaatacatcaactaaatatttaacatcattcttcaattcttcatttccatttgcaaaataatctattgcttcatcagttatttcattactttcctgtattgaacataaattcaactctaaatgctcacgttctatttctctaaataatcttctattataatgtctagccttcattattaaagcaaatgatgcaagttgtgctgctctatcatctatatctaaaccatataaattgttttttaatattaatttaggtatttctctttcactataacccgctgtcttatatatttcataaagaacatcgaaagcataaactaatatatgaccgctacccatgcatggatctaatactttaatatcttcaggggttagtcttaaatgttcttctcttattttttgtaattcttcttctacttctggctcctgctctacttcttctaagtaatatttccattcactttgtaattcatcatttggatgaccttcaatccataatctgcctagtgaattttcaaccatatactttactatccacttcggtgtgaaaagttgagttgctgctggaatattttcttttgttatctttacattcttttttagtgctgcaaatacttcatctttcttttcagatatgtagtactgatacatccaacctattatttcaacttcttctttccagtcagactcctcaatatcttctaccatttttcttattacagaaccttcttcaagcaagttatctggtaaaagtaattctgtataatcacttattttttcaaacatctgaggcattatcttacctaactcattacattgctttactaatatagttctataagccttttcacgatcacttgtagttccactatctaaaagttcatatatttcttcaccattcaaacttaattcttctattatttcagataatttacttaatacatctggttcaattctgccatcaacagatgatgaaaggatccttactccagaaggaagataatcgttaacttccatatatctaagtcccatgaatctattaaaccaagtataggctacttcttccattacttcttcgaagcccttttcattaatctcatgtatcaaagcatttctatgtttaattgatagataaaaagtttcttcacctaacttaaatccaccttgcacttgttctacttcttctattttatcttgtgtaatacctattctctctgctttttcagtaacagattctatcatttttcttcttgcccatacagcaaaagattttatcttattcttatccactcttcttcctccaagtcttagttaatgtatagtcaatattattgtactgactatacactcaattcttaaattaaagttattatagtatctgtatctaattcttcttgcaatttttttcttaaagtttcaactatttcatcaatatcgctttcattctttattactttctgccctttaactagttctctcatacttaatgttttagtttttatttcaacttttacttctggtatagaacgttgttctaatggtttagatgccttatagtcatctttactttgtgtttcagtaattgtattagcctttgctatttcctgttcctttagtctctttatagtttctgcttcagaaacaatttgtcttatccacttaacctttaatttatctgtcaaatccttcattgatgaaagagtggtaaagttatctgctttttcacttctatctacatatctgttgaaatcatctataacttgtgtttcaaacttatctttcaaatcataattttctaaggcttcaataacttcttttttcgactgttgaataaattctattactggcttgctttcttcttccaataattctaaaaccttattattatatttttctataagcaatggaatattaggaatcttgctatatggttctttcatctttgtgatatcttttatttcatttacaatgttatctatttcatcattcacaaagaattcacaattttcatcaaaattgcttatagttttaagtgcattatcaaagattattctctgctctccttttgatgatgtatctatacttccattttccttcttaaagaagaatcctttgatgttatcaatcttatctacataatctaagaaatcatcttcagaatcatatacttctttaaagaattctaatgtatctttaatttctataacttccttaaataatttctggccattcattaaaacatcttcccctggatatttacagcctatactgaagttattaagcattaaatcaattctgtgcaattcacttctgctagaatccttaaaactagccatcattccatcttcgtcgctaggaattgatgagaatccaaaaatatctttatttaaatcctttaaaacttctatatatttatttggaactttttctcttgtttttaagataactctttcaacataatctcttttagtaacataattaactatttctctattattaggcgctaaaacttcatcgtttaatactgcctttatatcctgctttttaaataatgttactataatgctttgaatatctatgtccttccatccatatggtgcatttgagaacttgcttaatacactttttacagtaacctgaagatttcttgctgtacttgtctcaatgtgagttttaatttcttccactgctaatctgttaggatcattatcaactaaagatatttgatttaatttggcatccataatatcatataaatctttgctgctatccttaaattccttaatgtaatttatcttattatatttagaatcaataagtgatttaagtccttcattaatcttatctacaccagacttctcttttaattctaataaagtaccattaacatatatttcagatgttcggagtgactcttcaattaagaattttgctctctttaatctgtcttctctttctctgctctttttagttttaatatcttcaatagatgttgatgattttgttccgccttttaatctcaaatatgcatctatttttaatacattttctatttcctctataaacttatcatcttttgcaatacttactattacattattttctctaacagataactgttttaattcactttgtgatgttccaccaactaaattaaagtttgcagttattaccttaactcctacttcattattttgtggtcctctagtcctgtcatcaacaatcttattaaatgcaaaaatatattttctagaataagtgaacttgctttctccataaatatcatcaaatattatttctccagcctttaaagttatttcaccgctatcaatagaaatattctttatttctttatttacatcttgttcatcattagttaagaatacatattcatcaccatttttttgaacaagagtctgttttattaatttctttaatgcttcatttactttatctttaatttcctttttagaagcatctatttcatctacaagtagtgttgataagttttctatatttgcttttatttcttttacatatttaacaaggaataataattttaatacttcaacatcaaacttatctaagttttcatttttttctgcattcattattacagatctgattgaagaatctaagaaagtttctatagtactataaaatgctgaaaaaggtacaaggatattgctgtcacagttcatatactcttttgcgacctgttgatatgcacctagaaggcttctctcacctctagataaactctttcctgacgctccatgttctcttacaccattaaatgcagattgtaataaattaaattgatatgggataaatggatatacttctgcaaaatcttcactatttttatacaacttcatttccgctgtatctgtagtaaatgtcaaaaggttcttaattatagattccttctgttcatataatgcctttaaatggcttgtagcgccttctgtttttctaagtatacgtttcttgataacttcatcaacattagcagatgataaagataatcttgtattaaatctaccttgaattttagaaaagtcatttcctttaacctttgtaaattcatctaaaccttcttgtgaagtaactataacaaagcacttaccattacatttagttcctaaatcttcaacaactgtttgaagatttagcataagttgagtattatcacctatatattgtccaatttcatctactaagaaaactacgtgatgattcttccctttagattcacaatactcttcaactcttgaggcaaatttttcaatgctaagtgaatagttttcttcacatttgttataccagttctttgcagcatcaatgctcatcttagttgttttagataatgcttcaattatagaatcttcttcataatagaagtcttctcttgcctctatccatggagttcctgatatttcttcaaattcttttttaaattcatcatatactccatctttcaccatctgtctttctaagtcagcaacccaaggcatagaaccacagaatccttgcatttcattgaataccttgttaaatacattaactattgcatccttattagattttgaatctgaatctgactttgaatctatgttgaataatattacatctgtagaaacatcttctgctgctttcatattagcaagtgtaaaattatctaatcctttatcatcaaaatactcaattgcatttttaccttcaataactctgttttcgagaagatatgaaagaatttttaagaagtgagatttaccacttccaaagaatcctgatatccatacaccatttttatcagtatggcttattattccttccttataagattcaaaaaacttctctatatgtctgtttaattctcctgttactacatattcttcgagttcctgcttaatattttcatcatcagcctgacctactttaataactcctttaatatctctgtcaattggtttgtaaaacatctcttttaatttaatatccataatacttccattcccctttaaatcaatatttatctataagttgaaatgctctataataattatcatcttttaaataattaaaaagcataagtgaaccaccatcataagttcctgggaaaaacataataagtggctgtttttcaacaattctatgtaaattattaagaacagtatgtgaacgaataataggccatgccttacctattccagtaaggaatacaatatctgcatcatctaatctttcactaatatactgtactaacaaatcattatctaatgtaagtctcaatgcctttttagtagcagtaaatacctgctcactgccttttttctcttccatcatgaaattcttttttaaatatcctttagaatctaacagttctagcatgatttcatataaatcaaattctacaatatttaatccataagcgcctttagccttatctttaataaattccactctatctcttataagtaattcatactctggatcataatcaaaaatataaaatcctatttcattcccaagccccttattttctctaaaagatggttccacaatcttaggaagaatctcatccactctttcgtatatacttttcatcgcatacctctttctgatttacaatgcaatactattcgtttattccaagtatggcattaatataaaccttatctcctaatttataaatataatctttaacttcactatctataataggaagaactatttctctgtctcctttttgatttgcaataagtccactttcaaatagtattcttatgtaaacctgttttaactttttaaacgtatattcagaccaagaatcaaccttatcactttgttctcgtttattttgaaaaaatacaccaaaatctttatctcttatgaataaatccttcaatattattttttctttatatacctcattcataaattcaaaaaatagtttgtcatttttcaaaatagcatataaaactattaatttggatgtttctatgttgctactctctatcttttgaatcaaataactatctaattctttcaatctcgttcctattattgatgcaagttccttcattctagtttctgtttcaacttgaaaaatattattttctaaagattcattttttaaatcttttatttgaagtcctttatttataagacttgcagccttttttgtttctttatataaataaggtctagatttaattgttgacttatattccaattttttctctccttcatggtccagttttatattatatagtataccatatgtaaactttttctaaacatatttatatattatttttagccacaaaaaatcatgtagccttttgaaaacatcaattagccacatgatttcttagtttaaaaaagagaatccgaatagaagcctcgcaaaaaataacttgtatcgcatctttttgttccattttcttctataggataattatatgctaatgcttctgtaagaactcctaaaaaattctttatatccgaatgatccagtagtcttctccctagtatattcatttttattttaattcttcttataataatttcatcatttctagcattaattaaaaatgtctttattaaattctcttctgatattttatttgttgcatgtttacaaataaattttgataattgtcctaaccaaaaaaaatattcctcatcatttgttatattatttttttcttttgcactattaattgtaatactcactttaaattcctcctcaacttataatttctataatattttaccttactagcattcaactttcattttgtcactctcatgtttttccaaaaattcgcatagttcagattgttttataaattcaattttatctgtaaatctatcataataaaaatattttcttactgttttaaaagtattgttttcataccactcgtaaattccattttcatttatctgccattcataagaataccatgtggttttacttccattggtaacattaatttctctttctaaaaattctcttttgaatttataatatttgtcttcaccaataattttagcaatatacgcttttcctttcccatatccatgattattataagataattcacactcaattttcataaatttcacctcgttaatataaaattttataaaaaaaatacatgataatagtaaggacttgtttataaacaaattgactacgtcacgcaattatgtatatagatcctctactaaacatcatgtaaaaatttaagttatctatcaacttaacacatcataatatttcacatattttattatataacactttttttacttattgcaactttttccacttttatattatttaatatttttattatttaatatttttattatttacaatataatttcttcctaactatgtatccgcaaaataaagtcatgtcaaaattcaactcccactttttctctctaacttcgcacttttacaaggttacagggcatcaaataaattacaagcaaaataaagtcgtgttgagtttttcatatattttttcaccgttcattcccaattttattctttagcatacgctatttagcaaaataaagtcgcgttattttttcagtctatatatacgtggcttcgccgacgcggtagcatttttctttcatactttatccatctctcccctcattctctcttgctttcttcacctttttcttcttcctttaaacgcaaaaaagaccatgcaggcatcgaagtttccctcgatttcctacatgatctcaacacaactttatttatcatgacacgacttttacaagcgtgacataactttatttagttgtaacagttggtattactatttgctcatagcttcttcaacagaaactgcaacagcaacagtagctcctaccattgggttgttacccattccgataagacccatcatttcaacgtgagcaggaactgatgatgaaccagcgaattgtgcatctgagtgcattcttcccatagtatcagtcattccgtaagaagctggacctgcagccatgttatctgggtgaagagttcttcctgtaccaccacctgatgctactgagaagtatttcttaccttgttcgatacattctttcttatatgttccagcaactggatgttggaatcttgttgggtttgttgagttaccagtgattgatacatcaacaccttccatatgcatgattgcaacaccttctctaacgtcgtctgaaccgtaacatcttactttagctctttctccatttgagtatgctttttctttaactactttaacttcaccagtgtagtagtcaaattgagtttgaacgtaagtgaatccattgattcttgaaatgatgtatgcagcatcttttccaagaccgtttaagataactcttaatggttcttttcttactctgttagctttttcagctattttgatagcaccttcagcagcagcgaatgattcgtgtcctgctaagaatgcgaaacatttagtttcttctcttaaaagcatagctcctaagtttccgtgtcctaaaccaacttttctgtcatcagcaactgatcctgggatacagaatgcttgtaatccttctccgattgcttcagcagcatcagcagcttttacgcaacctttctttatagctatagcagcacctaaagtgtaagcccatccagcgttttcgaacgcgattggttgagtttctttagcgattgtgtaaggatctactcctttttcagcacaaactgcctttgcatcttctaaagttttcattccgtatttttctaatactggagtgatttggtctattcttctttcataactttcaaataatgccattttaaaattcctccttcacaaataattagttatgtcttgggtctaataattgagcagcatcgtcaactcttccgtattgtcctctagcagcttctaaagcttcattagcgtcaacacctttagcgatactttccatcatttttcctaagttaacgaacttgtatccgatgatttctttatcttcgtctacagctacttctgtaacatatccttcagccatttctaagtatctaggtcctttagctaaagttccgtacatagtaccaacttgtgatcttaatcccttacctaagtcttcaagacctgctccgattggtaatccgccttcagagaatgcagtttgagttcttccgtaaacgatttgtaagaataattctctcattgcagtgtttatagcatcacaaactaagtctgtgtttaatgcttctaatatagtctttcctggtaatatttctgaagccatagcagctgaatgagtcattcctgaacatccaattgtttcaactaatgcttcttcgattataccgtccttaacattaagtgttaatttacaagctccttgttgtggtgcacaccaacctataccatgagttaatcctgatatatcagttacttctttagattgaacccattttccttctgcaggaattggtgctggcccgtgattaggacctttagcaagtacacacatttcttcaacttcttttgaatacatcatatatttttgctcctccctaattaatagataatcacaactattaaaccttatttctaagttttcaaaattgctctgggcacaaattgacccagcggggcgtttcccctactactattctagcaaatgatttcacttggaacaacctttatttgaaaatttattctctaaatattcatttttttattttttctatagtaaaatgataaaaactaaactttttcattaaaaaaatatcaataaaataccattttcctttatatagtctcaaataatgtactccttattttactacatagaaaatattccatcataagttacaactgtaatcaaatgtaatttattatattattgtaaatttatttttaaaataactgttgaattttttatctattcatgctagaatattttttgtcagtaacatgccgctatgatggaactggcagacgtggtggactcaaaatcctctggtagtgataccgtgccggttcgaatccggctagcggcaccatttatttatgagaatggctgtattacaaggtttaaatgccttgtagtacagccttttttgtatagttcccacttctacagaaaattttttctttgcaacaataatggttccattataaattattttttctattaaaaatttagtagttaatgaaacttactttaacacttcatttatacatgtgatagcatttagagttcttggaaatccaatgtatggcatacattgtgttattacatttaataaaatttctttatcatttcctattgctgcattgcccccaatatgtgcacgaagttgattttcacaacctccaagtgttgctataatactgaaggttataagctctctaatctttatatcaagaccatttcttccgcaaatatccccaaaacagtaaccggataaataatcttgaatatgttttagattatctggtgcatttgctctaagattatcaatattttctgagccaaagattgatttttgtacttcaatacctttagcaattctattatcttctgttgttgttgattgatttccaagtggaagtttaacacctttttcttcaaatatttgatttgtaacaacaattgcattttgaacttttgaaaatcccacataaggagcacattggtataaagtttcttttatctctactggtgatataccaatattcaatgctgcttcaacatgttctgcacattgttccatattattatttgtaatattaactgcaattataattaactcacaaatcttaggctctaaatttccatgttgccatacctcaccatatataaatcttttcattatttcatagaattctgagtcacttgtcattaattcactatttttgtctccccataattgcttttgtattttttcactagatttaattctgtccatctttaatcatcctttcttaaaaatttatataaccttaaactctctccattttccatttttaaaacgcaacacataaattatagaacgtaacatccaatctgcccccatagcaagccacacaccaattactcctaaattaaatataatccccaaaatatatccaaaagatattctgagtataaacatagaactaatagatacaatcatagtaaaacgtacatccccagaagcacgtaaactattaggcaatgtaaatgatagtggccaaaaaattatcgccaggcaattatgaattataactaatatataagttaaattagtcacttccgctgataatgtgtacaaatttaatatccatggaagaagtaaaatttctgctaaacttataactatagttcctatatacgttattttcaataatttctttgtataaaaatctgcttgtgcataatcaccagctccaacacattgccctattacactaactattgctatattcatagctgttgcaaaactaattgatatcataacaagactgtttgttattccatttgcagcaatttgatcagtaccaaataatgcaatgatactaatcaatagtattcttcctaactggacaataccattttctattccatttggaattgctatatttaaaattttaataatcatatctcgcttaatagtaaatatttgtgaaaagctaataaatactttattctttttatttaatgataaatacaccataactaaagccgcaaatgcacgtgaaattattattgatatagcaatgccgacaacacctgcattgaaaacaaaaattcctattgcatttcccacaatgttaattgcattcattgcaattgaaactatcataggaactcgtgaatttccaatagatctgaataatgcagcaccagaatcataaattgataaaaaaggataggatatagaatatataacaaaataagtaattgctaaattcataacattatgatctacattgccaaaaagaatttttaatagtggtttatgaaatataaatacaaaacccataattccaattgaaataattgttgctatagtgaatagttgactagcagctatacaggacttgtttttatctctaaatcctatatattgtgatacaattacagctccaccagcagtaagtgctgctaatacatttataagaagcatgtttatcatatcaataagagaaactgctgatacagctgcttcccctgcatatgaaatcatcatagttgcaattatagatgctataataattaaaatctgatccataaatattggaataattaatttcttaagtgattcattcgaaaacatacttgtacctcaatttctctatattataaataattctaacttaatgttaacaccatatatttctaatatctaatacttataatctattgtctattatgcttaaaaagcatttcattgattaaaattaatagcttaaattttactaatcaaatacatattaatccttctcctttcttgttaatatttcataacgcaaaaatgtagatgttctatctgaacacctacattctaatatacacactatgtaatgtctaatacctataataaatcatttcaaatgcctaaagagcatttctaatacgctttataaattgatctgtcgcttttgaaaaagtttgattcttcttccatacaagaacagtaccagtttccagcttaggataaagaggtataaaacatagattatcatatacattttcaaaattaaagcacagagctgcacctaccttattttccaccataatagtcgcatttaaaataagattgtatgttgctgctatatcaagagaatcataataatctccaaaccagcttgccaactcattttttaccatttctcttttggccattattaaagggatatcaactaaatcttttggatatatacattttttagaagccaatatagaatcttttctcactaatatgccccactgctcttttttaggcatgcgaataaattcatatttacctatatctactggttctgttaataatccaatatctaatattcccttctcaattctatctttaatatcatctgctattccactataaatactatattgtataaggggattatctttacgaaagtaaagcatttgttctgatataaaagacatattcttagtttcagcacatcctattgcaatttcaccagtcaagttaccttctttatgtgaaaattcctgttctgttttattagctaacataactatttcttgagcccgacgctttaataacattccatcttcagtcagtattatactatgtttacttctattaaaaagctttactccaagctcttcttcaagctgcattaattgtcttgataatgtaggttgtgtgacatgcaaaagatttgctgcttttgtaatgttttcttctctagccaccattaaaaaatactttaatactctaagttccatatctacactcccttcaatatataaatcatagcatataaaaaagtccctttcaacataacttgccataagatatgctttttaagcattgataacgtcagctaacttaatctaaatattacctctaagaatttttaataaaataaaaacagagattctcttaaactatgaattctctgcttttattaaaattactatctattttctgaattaaaattcctctattatatttctttccgatagttcaccaattatcatttaatttaaccaatatttgttttatttaagtgttttaatagaaatggttcacctggtgccactacattaattcgttctggatttattataagtttttcaagcttctttggatctccattaaattctgccatatgcggagcatctactgttccccaatgtaaaagcaataatggagtattaggatatgcttctgctaactttacagcaccttctaaacctatatgccatttgctatcagaaaaatccataagtataacatctggtactggcatttccagatgttcttgtaataatcgtgaatctccaggcatccaaattgttccatcaggtgtttctaaccaaaatccacagtaatcttcaaatttaaataaacgagtagcatgttttgatgattcattttgccatgcatggtcagctggtgttaatgtaactttaacaggaccaatttcaaaggtttcctttattttatgcccaaaagctttaagaccttcttctttcattaattccgctacatattcagtggaatgatattcatcacatacatctttcatttcactacatgtcactctactatagtgatcattatcacaatgagtaattaaaacagcatctaagtgaggaacatccttgggcaaaattggtatatcaataagtaatggcatgtcaaatccctttaataatgggtctatcattatgcacgttccatgacaattaataaattctcctgaatttccaagccaacgtattgttgtttcctttgaagactcaaaagcctctgttccaaaaaattgtgttgcaggtgcaagggcctgacttttctttttattatctatcacaataaatcactctcttttcaaatgttatttggtcaatatcttacttaatatttctattaatcattaatacttatatcataatttaatttttataatattgctaatacctatgtattatttttcagtatgcttttcaagcattttttaataaaaactattttgctttattaattatttttattaatgtatttatactacaaataatacttacgtaatgaatatttaaggcacttttacttaaataaaattcacaacttttttagaattatttcatattatatataagattaatataaaatgaggaattatttttatggatattcgtaaatatcgaactcttcatacaaatgaaatcatatcagcactagagtcaaaaaaaatctgtaattttataactagttcagatactctaaatattgttccaatgttatatgtctttgattatgataatgacaattttacattttactttataaatattaataaggataaaataattcataatataaacaatctagaaaaaatctatatatccattgaaaattccatattaggattctatatagatgcatatcaattgataacagcttgtggaacttctgaaattattaatgatactaatgagcaaaattcaattttacttaaattcaaaaaaagatatttatcatattttaatgatattgattgttctcattgtgaatatataaaagtctctactgattcaataataggaaaacaatattaaaataaaaaatatgtgatgcctatttatataaatacctgcatcacatattttaaagattctattactttttagaaaactcttttattctttgctcaattattgaatatccttctttaacttgctgtttagtgtcttcaatttcagaattaattcctattattatttccttaagtttggttacatcatcataacctccaccaaggctgccttgaatcttttctttcaaatcatcaagtgcaaatagaattatagtataatttgtacttgtatttttcattgtcataaataacactatccatactattcccatgactattattaatgcaaacataaaacttataaaaaacacacttttttctgtttttgcaagcagtattataagacttattacaagaacaaaactcacaaccattgatattagatatgcattattactattttcttttaataaaacatatctttgtttctgttgctttaaatacaaaagtttctcttcttttgtctgcatttttaatatctcattcttaaagggttccttagctctctcaattttagaagtataatcaacattactacttgtaatctgcttattcttttcttcagtatgtgccatttttgcctccttaaatattgtatataaatatagcttaataagatttatctaaatttataagataaatcaattttcttatacaatctaagcttgtacaaaatctgtgtatattatatcatatttactatctttatttgatatttttacaaattattcaataattttaacatgcactgtttggacataatatgtattcacaaaaagcacattctgattttttatcttatatgtatttatataatataatttctcataaagaaagatacagtaaatttatttaattaaatttactgtatccatgattaaattcctaattattttatactgaaaactctctcataagcttgtataatccaattaaatctaaaatttacttttatttttctgttttctttacttcttctttaacaagcctacaatattctttaactccataagcaccatcagttttatatattttatttaaatcactgccaatcccgctacaatctgcaccagcattaatccattcaactatattttccttttttacgcctcctgttggcattatgcatatgtcattaaatattgattttgctgctcctataaatccttttccaactacacttcctgggaatactttaatgaatcttaatcccattttataagccctgtttaattctgacatagtcataagacctggaataactaaaacttttctttgattagcatatcctataacttcttcatctaaacatggagatacaataaagtcagttccattttctatacactcatctacattatcttttgatagtacagttccagcacctacacatacatcattatatttatcttttaattcttttattaactttggtgcatctggaacactcattgtaacttctataatttttattccaccctcaattgctgctatactaatttcctttgcttcttcataagtacttgtccttattacagcaacagctttttcttcttttaatatcttataagtattttcaaacatatatctacacctcttcttatttctatctttcaattgtctttatttttcctaaatgtgctaaaacgtcttcataataaggtagtccctcattatctccctcaattccaactactaaggatccaacagcattagcaaattctatactttcctcaaaagagtctccttttaaatatgcacttaagaatcctgctgcaaagccatcgcctgcaccaactgtatcaattaaggctttaggcttaattgctgctacatcataaatattcgaaccatctgaacctatagcaccttttgcgcctctcttaacaacaactttgtcgattcccagatcatgaaatttttttatcgcttcatttgtgtcttcttcatcaatcaatattgatatttcttcatctccaactaaaagaatatctacctcacttaaaaatttattaataaattctcttgcttgactctttgtccacattttcaaccttatattaggatcaaaagagattaataaattattttttttagctagttctactgctttcaataatatttctttattattatcattgattgatggaaaaactcctgttatatgtagaacttttgaattcctaaagtaattttcatctaacgactctgctgtcatagtacttgttggagagttttctctatagtaaaatgatctactgtcaccatttgccataacttctctaaaataaacagatgtctgatatccttctactaattcaatttgagatgtatctataccttctccccttactgttttaagaatatgttttccaaaatcatcttgtccaagtctacttatccatcctgattttaaaccaagtcttgcacatccaattgctacatttaattctgctcctcctatttttctttcaaaagtattacagaataatattggtcctttctccttaggacacattgcaaccattgcatctccaatagtaattacatccatacttcctacctacctttttgatttttattatttttaaaactctatatagttatttatttctaaatttatgttcaattttaatcttcttaatctaagaaataagatatgatactaccatcgctaaattataaaattcaaaaacttctttgatgcatcagattcgaaaataaagctggttaattatcttatattttttattatacaattatggtttctctatttcttgttaatttcagctcaaaatcttgcaaatattgaataaaattacctaattcattttccatataaataaacttaattaaaaaatatatattctgataaattgacatactattgtaacaattaatctatataatcaatagcataagataattattcaaaacttttcattatttatccctatttaaatattttaaagcagcttatttccccttatataagctgctttattttgcacaaaaaacagtactaagcatcatcaaacatattttgctcagtactgtttctactatatctaatttaattttttcaaattaaccttatcactttttaacttatatttttatcaagagacatgcttttcattgacatgttctttaatatatttcacatccaactttaattcattaaaagtttttcttaaatgcttaataaaaatatataaaaaaactatagatgaaaaatataacaataagaaatctaaatatatagctatatttgaattagatagtgaaaatcccaaatagccttcttgaacacttattattaatgctgctactgatactggtactattaagcctgtatactttaaaaatctgtacacacattttactaaatagatacaaagttctgaaaatcccaacatataaattccccctaaaatttaataaaaagtaacttagagtaaaattaaatttaattttcaataactagcataaaaagtagtcaattacaaatttcttaataattataattttctgtaaaccttttctttaatataattatattcctgtaactgttaaaatgcaataaatattgcaaaaattctatatttattttctttataaaattattaattataaatttttttaattctaataaactccaaataaataagctaaaaagtataatcctttttagcttatttactatccttatatgttttttatcctatttgttttttcttgtttttatcctttaatatatagtcagagtcttctccctcatccttaatatctccatcaaaaataagaaaaccaacatttttaacatcgacttcttcaacttttctcttaacgatagtttcttttacttcttcaatattaatatcatcatcatcaaatattaatctttcacttattttttcatcttcattagatttttttgagcaatcatcatcatttaaagtttctcctcttgaaaaaatagttttttcaacctctttacttgcaatatccttaagttcacttatatctagatgctcttttcttatatataaaacaggtatacaaaatccctctgccggttttgacaaatacatatttttctccttaaattaatagcttttaccttactatattatttaaatttcacatttttgtgagtacaaattaaataaggcattttgaaaaatattcaaaatgccttattataagtaattaatatatatttatattattttaatttaacaagtaattcaccagtcttaacttgttgaccttctttagcaaatattttttcaacagtaccatctactgaagctacaacatttgtttccatcttcatagcttcaacgactataagactttcaccttctttaacttcttgaccttcttggacaagaacttttattacattaccaggtatacttgctccaacttccatcttattgtctgtatctgccattacagttgtatttccatcaccaagatttgcttgtgctctttcagttttatctttaatctttatagatcttctgtttccgttaatttcgaattcaagagctctaaaaccttgagcatcaagtcttccaatttcaattaactgaacaataaggattttaccttctttaacttcaatctcacttgtttcaccttctgaaagaccatggaagaatacatcacttcccataagtcttacttcaccatattccataacatgttttatgaaatcttcaaatacatctggatataaagcataacttattaaatccttatttgatggtttaaatttatatttttcttctaaataagcagctatcttatcaaaatcttcaggaggtaataattctcctggtcttactgttatagcttcttcacccttaagtacaagtttttgtaatttttcagggaatccaccttcaggctgacccatcattcctttaaagtatgatactactgaatctgggaatgccatattagcagctttttcatatatgttttctggtgttaaatcattttgtaccataaagattgccatatctccaaccatttttgaagaaggtgtaacctttataatatctccaagcatatcattaactacgccatacatctttttaatttcatcaaatctatgcccaaggccaaaactttcagcttgtggttttaagtttgaatactgaccacctggaatttcgtatttgtaaatttcagtgcttcctgattttaaatctgattcatattcactatatactggtcttacagcttcccaatactcagatattttctgaattccagcaatatctattttcgtatctctattagtatttccaagtgcagcaacaatagagttaagtgcaggctgacttgtaagtcctgacatactgttaaatgttgtatctacaatatcaactccagcatctgctgccataagtacagttgctacaccattacctgtagtatcatgtgtatgaagatgtattggaagagatacttcattttttaatgcagtaataagttttttagctgcatatggtttaagaagtgctgacatatccttaattgctaagatatgagctcccattttttcaatttctttagctttatcaacataatattgaagggaatatttatctctagtttcatctaaaatatctccagtataacaaagtgcaacttctgcaaccttatttgcctttaatacttcatccaatgatacttctattcctttaagccagttaagtgaatcaaaaattctgaatatatctattccagtatctgctgcttcttttataaatgatcttattacattatcagggtagtttttatatcctacaccattagcgcctcttacaagcatttggaacattacatttggaattctctttcttaatgactcaagtctttgccaaggagattcttttaaaaatctatatgctgtatcaaatgtagctcctccccacatttcaagagaaaataaatcctgaccataataagcagttgattttgcaatcttgctcatgtcaacacttcttactcttgtagcaagtaatgactgttgagcatctctcattgttgtatctgtaagtaaaagtttgttttgattcttaatataatcaacaactccttgagggcctttttcatctaatatctgtttagtaccactaagagttttaacaatttctccacttacatgtggaataacaggaacatcaaattcctttttatttccttttgtaacatttactattctttcaccaataaactttaacactctatgctcttcatctgttcttggtgatatatcaaacaattgtgggttatctgcaataaagttagtatcacatgtaccctctctaaattgttcattatttaaaacatttattacgaaatcaacattagttttaactcctgttattgttaattcctttattgaacgtattgattttcttattgtatcttcaaaagttcttgaatatgcagtagtctttacaagtaaactatcataataaggacttattactgcacctgcaaatccattaccaccatcatgtctgataccaaaacctgctccacttctgtatacatcaattcttcctgtgtctggagcaaaattatttgccggatcttctgttgttattctacattggatagcatatcctcttggttttatagcttcttgtgaaggtattcctacttccttagaacttaattcatatccttctgcaattaaaatctgactttgaactatatctactccagttgtcatttctgttatagtatgttcaacttgaactcttggattcatttctataaaatagtgatttccatttgcatcaactaaaaattctaaagtacctgcacttctataatctactgattttgcaatctttaatgcatcgttacagatttcctgtcttttttcatcacttaaagtaattgctggagtaaattctataaccttttgatgtcttctttgaattgagcagtctctttcataaagatgaactacattaccgtatttatctcctaaaacttgaatttcaatatgttttggtctttctatgtacttttctataaatatatcatctataccaaaagcttttttagcttcatttttagcatttctataattttctacaagctcttcttcgcgtcttacaattctcatacctcttccgccgccgcctgctgctgctttaaccattactggatatccacagtatttagctgcttctaaagcttctgcttcagtttcaactggcttatctaaacctggtattactggaacaccaacaccctctgcaacgattttagattgtattttatcgcctagcttttccatcatttctgattttggacctataaattcaattcctgcttcttcacatcttcttgcaaattcagcattttctgataaaaatccataacctggatgaatagcatctacatgcttctttattgcaaggtctataatttcatccatgtttaaatacgcttcaactggacctttatttcttccgattaaatatgcttcatgagccttagttctaaaaagagagcatttatcctcctccgaatatatagccacagttcttatacctagttcgtgacaagctctaaaaattcttatagcaatctcgcctctgttggcaactaagactcttttaaattttttccccaatttaaatacaactcctttaattaaagtttttattaataaaaattactggcagaatacattcttttttgaaataaaaaaaattctatcttgcaataatttatatttaatattgcgtaaatttcaaacaacattatttagattatatcatacttattttactttatatatatataaatttgaaattatatgactttttatactatatttttattacttttttttaagtttttataagtataataaatagaaagtatatatttatacacctattgtataaattctacataacttttaatcttctacatcaaattaaaattgtaaaaaaagaaaataaataatgagcttgtacacaaataacctttgtgtgcaagctcattatttattttaattgttaacttttgaaaattagttgcaatttatttttttaaaaatttcaaattttaaaattcttattttacagcaacactgaagaataatgctttaccaacttctgttgattttatttgtgactttacaaatgaagctgctttttcatcatcaccgtaagttgattcaaaaaacatttgaagtccttgcttacttttgaatttgaaaggatttgtcccatctacttcaagtccttctacaattttaattatgtcgtcttgtcttaatgcgcaatttactaatatcatatttataccccatttctaaaatttatttagcttttatataaaagcatttaaaacattctataaatacattaattatatgttttaaattatttaatattatatacttaatataccatatgatatatcttttttcaatttcattttcagaaatatccaattactatatagtataaatataagtaacttatatatgtaatcttattcctacctccataaatcttttaacatatattacgatttacatcttattacagagtatcttcttagatacttcctataatcaattaaatttaaaatctctactgaaaatgtttctatcatttattatgtaactttagaattttaacatatatgttatttattttaagccttcataaagttctttaatactattaaatacatatttaggctgaattttagactcctttaaatcatcctctactgcttctccagttaaaaccaagcaggtatcaatatctgtatttatcccacatagaatatcagtgtataacctatctccaataataatcatatcttcatttttgcaattatatttatcaagacatatatctattataaatctattaggctttcctatgtattctggctttctcttggttgcattttcaatcatcatgcatagtgacccacaatctggaacaaacccaaaagatactggacatactaaatcaggatttgttgctatataatctacacttttctcttttgaaagaagttcacatattttttcgatttttttatatgtcaattcatcatcgtaagctacaactacacaacttattttttcttctaatttttctgtaatatttaaattgaactttttaagttcatcaataaatgattttgtacctaatacaaatattttattattattataattattcttcaaatataatgctgtagcataagatgcagttataaaattgctctcatcaactttaaatcccaacccattaaatttttctacatagtcatctatacttttactagaattattcgttataaaaatatattttccaccattaccaacaatatagtctaaaaattcaaaagtaccttctattaccttatttccaacagatacagtaccatcaatatctagaagaaatatttttttatttctaaacacctaaaactcttcctttcaagattatttataaaccttacaataatatattgttctcctatagaaaaaatatacccttaactagttatgccaagtattataaataaaaatatctcatatatgaatcttttttaattccatatataagatatctttataactctaaataatttacttaaacagtcccatttaatgatatatttctttataatttcaaaattttataactcattgaatcaatcccaatagtatctttaattaattcaaattttcctgtaagcatattcatatattcatgatctttattaatatttattttaacttttttataagtattatttattataactagtactttattatctttatcttccctaataaaagcaattatattatccttacaataaacagttttataatctccataaatcagaactttgttttcttttcttatttttatcatctttttataaaattctaaaagttcacaattctgttctttcgaatcccatatcatacactttctcgattgtggttcttctcctcctgcaagtccaatttcatcaccataatatatatacggtacaccaatataagtaaattgaaatactatagctaatttcattcgctctattttttcttcacactctgtcaaaaaccttgatgtatcatgacttccaatcaaattccaaagctgtctgtttatatcatccatataaatcactctattttttgcaagaatatcatcaaactcttctgcatttatacttctattaccgaaaaaatctatcatagctcccttaaaaggataattcattatactgtctaactggtctcccttcaaaaatgaacttgattcatgcattatttcacctatcaaaatggcatcctttttactatgttttatttttttcttaaaatctctccaaaaacagtgatctacttcatcacatacatctaaacgccatccatcaatcccaacttcgttaatccaatacgctccaacattcaataaatattcttttacatcttcatttgaagtattaaatttaggcattgtacttatataatctgcaaatgtataatagttacacttattaatatcgacaggatagttatctatgaaataccaattagtatactttgatttttgctgatttttcaaaatatctttaaatgcaaagaaatcagatcccgaatggttaaatactgcatcaaaaactatctttatatttctttcatgacactttaaaacaagttccttagccttatccagcgttccaaactgtggttcaatcttatagtagtcacatgtattatacttatgatttgatgacgatttaaatataggcgttaaataaatcaaattcactccaagatattccaaataatctaatttatctataatcccttgtaaatctccaccaaacttagaattggtcgttacatcactcccccactctaatgcttcttcaggatctatacttttatctccatcacaaaatcgctcaacaaaaatttggtatacaacagcttcttgaagccaattcactttctcatatgcatcactctctgcaatgtatggatattgaaaactagctgcttctggccttttttccatttgctttttaaatccacgttcatcgaaaaattctacttctccattattatcttcaagttcaaaataatatctatacctattacgctcaactgatatatctgctttataataatcaaataatttatttgtatcactttttttcatttcttttatattaaatggattttgccaatcatatcttgttttataatatatcctacaggattttatatcgtcttttgctgttcttattattacagataaagtattcaaatctttaggataagaatacggtgcatctgttatgtgatatactgcgtatttattcacttttaatcctccattttataataactttctaaaaacatatttttttattctttaactgcacctgcaacaagtccttttgctataaacctttgaattgatacaaatacaattgcaagaggaacagaaatcaatattgagcaggctgaatacattggccagtcagttaattttcctgcagtaaaagacttcataccaacaaccacagtaagtaaatctttattttttataagtgctgctgaaaatacaaattcgctatatactgcaataaatgcaaagaaaaaaattacaacagccattgattttgcaagaggtaatattatctttgtaaagacctgccatgttgttgccccatctattcttgctgcttcttcaaggtcatttgggattccatcaataaatcctttcataagccatatattataagcacttccagcacataaaataagagctaaaaataatagattatccattccaaatggtaccttataagcaattgaaagtattgctggtactgtcatagacgatggaaacatttgaagtattattaaaaacataagccatttgctttttcctttaaattttagttttgaaaaagcaaatgctgatggtatcgtcaaaaaaagttgaaaaagtgcaactgtaactgctacaaatgtagtatttaacatccatttactaaaacctacttcatctgaaaatgccttaatataattattaaacgttatactttcaggtattaagtttttctgcataaagcttgtaccagttgataatgaagctgttataatagcaaataccggaaacatcaaaagtaatatagaaaatatcaaaaatactctttttatatttagctcaatttttgctctcttacttaatccaattccctttttagttttaatagtacttactgaattctccttaaccattctctgcctccttaaattgacctgaagctctcatatttgcaaatgatattacacctattattatgaatataagtattgacattgctgcaccaagtgcaaagttgcccttactagttgacattttataagttgcggatccaataatatctgtccaccctgcaaatgaagaaccagattttgatggaccaccttctgttaaaaggtatgcagcattaaaattattaaaattaaatgcaaagtttgaaatcaataagggatatgacacattacttattgatggaagtgttatatttttgaacttctgccatcttgaagcaccgtcaatatctgcagcttcataatatgtgtcaggtattgaagataaagctccaatacatacattcatcatatacggataccctagccatagattgactattataactgctatccttgatgccattggagttgtaagccacaatacaggttctttaattaaatttatttgaagcagtaatgtattaattgctccatactcactattaaataaacctttgaaagaaattattgtaattgcacctggaagtgcccatggtattacaagtaaagctttgtatataaatgattctttcatgttcttatcatctaaagccattgcaaatatcaatccaataaaatatgctcctactgtggaaattacagtaaaaattaaggtccatccaagaagtggaaaaaactgacttttaagaggtccagtcaaaatctgtttaaactgatacaatcctacaaaatgccatcctttttctgttccgtaaccaaagttttgatttttaagtgtgtaatcagtaaatgccataaaaatagtgtataatgtaggcaatacactcaatattaatatgcttatcaatgctggtgaaaggtacttatagctttcaagattactttttctctttctcatatctaatcaccttacttattgtaaattttaattatttagacatttcaattccgtcttttactcccagttctatatctttagctacagttgctacatcttcaccattgaatattcttgtgatattttttaatggttcccatatgcattctatctctggaacattaggcataggaactgaactctgagcttgttttataaacgcttgactatattcattattttttatttcatccacttctaatttagatttaataacaggaagtctgtttccaacttcatataatttttcaggtgaattttcaacaagatatttaagaagattccatgaatcatcttttttatttgaattactacttacaaatgctgactgaactcccataaatgttttagcatcagaattattaatcttaggtattggaactacaccaaagtttactcctgcatctttaaatccactcacatcccatggaccaccaatataataaatagcatttccagttttaaaattactatttgcaatatcagtagttatgtctgctggcattaatttatctttttgaactaagtcttgtagaaatttatatgcttttattgaaccttcattaccaagtccaatatcatttatatctgttgtgccattcttatttccaaatacatatccaccataactttgaacaaatgctgctgtataataaaattcattcatagaaaattgaaatcctgaaggaccatatgcttttgcctcttccactaatttttcaatattttctggcatttgttttaccttatctttattataaaataatgcatatgtttccatagatattggaactgcaaaaggtttattatcataagaaacagcatcccatacagttgaatttacatatccatctttatttacaaaaccatcaggaatttcttcaagaagccctgcttcatggaatgtacctaaattattatgtgctattccaaatacaacatcaggtccttttgatgaatttgctgcctggagaaaattttgaaaatcagagttatctttaactactgtaacttttctattattttcttttccccattcttgtgctattttattaacttcctcaacttcattatccattaaatatgaccatacaattatttcatcatcactatttccatttgaactattcccaccaatgcttccacatccacttaaaagtgttactcccataagtcctgcaataattaatgacatagctttaaacttcttactcacgtatctcaccttccacttaaaaatttaataaattctataatttatcagtaaacggttgcaacccttacaaaattattatatcaacccatacttatcaaatttgtttattattaacattttttatttaaaattaaccattttttcatatatgttgtataatgtttacatatatagttggaatttttatacatgattaattaaaaaagtgataattattgattttgtatgttaataaaagtgataataaagaaaggaaatatatctatgtatgattcatatgattctgatgactatttttttaataatgaattttcatttttatttcaacaaaaaaataaagatgcaataatttctattattttaaaaaaacataaagatgaattacaagaagcatttctacctctttctaccaaaagaactgacttacttatttggaatgttatctacataagagaaatcataaaaaatggttcaacaaaacagtttcttcacaccctatataataaatattataaaacaatacagactctgacgaccctatcagatatgcaaaaagtagagttggatatggcagatacttatttagatatacttgtaaattcagtagaagtgacaaataattttataaccaataaaatattagcttttttgtatattcatttagaagaaaacttcactttagaagaaatatctaaagaattaaacatgtcagttggctatatgtgtaagtgttttaaaaataatatgggcatatcaataatgaaatactttaaaattataaaaataaatagagcgaaaactctattaaaaagtacaaataaaagcatcttagaaatctccaccaatttaagtttttgtgatcaatgtaatttttcaaaagtattcaaagaggttgaaggaattacaccaattgaatatagaaatctttatatttaaattgtatagtctgttttttagtatcaattaagcaatttatttttaattttttataaaaataaggcccttgtttttatgttcaaggaccttacgataatatcctaattaaattttattcataccttaatgcttctataggatctaaacctgctgcctttttagctggataatatccaaagaatattccaataaccatagaaaatgtaaaacttcctactataaccataggtgatataactggtgaattccccataacatgagcacctatgactcctataattattccaagaactattccaataatgcctccaattgcacatattatcattgattcaactataaactgcatctttatatgagaactttttgctcctaatgcttttcttgtacctatttcccttgttctttcagtaacagatacaagcattatattcattactccaataccaccaacaagaagggaaatagctgctattgccgatattgcaagagccattgttgatgtcatagaagtcattgattcaagcatactttccatattacttgcagttgctttatacttagtatttttaatatatagcttatctagatacgtttgaagttctgtagtaaatgttgtaatatcaacattatctttagctcttatggtaactgtctgataatttttatttgatgatgagctttttgctgctgttacaggaatatataaatctgttgtaagcttttcctctgattccgtacttcctccagacgatttataagtgtatacaccaactattgtataacaatgaattgcacttgaagtatatattttcacttcctgtccaattggatctgcaccctcaccaaagattttacttaccaatttatctgaaactactgcaaccatttttgagccgtcaacatctgtatctgtaatataccttccatctgccatttctatgttctttactttttcatatcctggatttgtaccagtaatgtttacattagcatatgctgttccatttttagcttttccagtatcctttgttgctgtaacactaaaagcatctatcttatcactaaagttttcctctaattcttttatctgactcattgttaaaagatctgagtcctttggtgtagaagtacttgaactgccaaaacgaccactatgacctcccatgccaccacctggcattccgcctccgcctcctgacattccacctccaccagacattccacctccgggcattcctccaccagagccacctccgggcattccgcctccagcaccaccttcatgggatccagcccctggcatttcattagtagaacttccatttttcttctcatttgtcttcgttttattattatttgtagatgtactatctctttctgttacattaattgtaacattagtcgatcccatatcagccattgaacttgttacattagctgtcatagcattaccaactgaaacaatacctattacagatccaatacctattattattccaagcatagtaagaactgcacgcattttattggatttaagccctgctatagccagcattatattttcttttataaacatagcttttcaccatcactatatcttctgtagaacttgtcattatattcgtcagaaactatatttccatctcttaaagttactattctttctgtttcttctgcaagttcatgattatgtgttataaaaacaatagtttttccttgctcttcatgaaccttatgaaataaatccattactaatcttccagttcctgaatcaagtgctcctgtaggttcatcagcaagtaaaatacttggatttgtagcaagtgctcttgcaattgctaccctctgcttttgaccacctgatagttcatttggctgatgcttaattctatcctgcatgcccactatttctaaaaaatacattgctctttctgttctctcttttgttggcacacctgcataaagcattggaagttcaacattttttagaactgtatttctaggtattaaattatatgtctgaaatacaaatccaattttcttatttcttacttctgataatccatcatcactaatatcttcaatattggttccacttaatacatatgagccagacgttgctctgtcaagtgctccaattatattcatcaatgtacttttacctgaacctgactgaccaactatagatacaaactctccttttttaacagtaatatctataccttttaaaatattaagctgatttggagtgcctatatagaaactttttcttatatctttcatttcaattatattttcactcatttaattacctcccattgtttatgtcaacaacgctaccaacgtgataatttgaaggatcatttaatacaatcattccttcttttaaatcttctccttctatttctgtattcatatctgactctaatcctgtagtaactgaaatttctttaactacatattgaccattctgctcttctgcttcatatatagatttttgtccatggttgtctattatagattcatacggtactgcaaacacatcatcagattcacctataataatatttacaactgcattcatcccaactttaacagctttatcaatatcttcactcgttatctgtactttaactgtaaaagtaacatcactacttgttgaattactacttgttgatgaagttccactacttttactactgctactgctactactgcttgttgaagtttctgatgctgcagcacttgaaataggatcaacagttacaacttcaccgtcaagaatttcagtagatgcatctgtagtaacctgtactttttgtccaactgctacatttgcaatttctgtttcatcaacactgacttttactataagatcatttaaatcttgaattacaaacaatgagtcttcacatttagaaccaactgatgcatttactgctgtcacaattccatcaacagtagctacaacttctttatcctttaatttttctttctgtttttcaagtgcaagcctagagcttgtatcatcgactgctgcttgagcactttcatagctctttttattcttttctatttcttgttcaacacttacttttgctgcacttaaagctatctgagatttatcataatcagactgagcattttcataatctattttggctaaatttacattctggcttgactcttctccattatcaagcatcatctgcttatactcatatatactctttttattatcaagagatagcttattctgatcaactgctgcctgtgcattaacaagagttgtatttaaattattttcatatagatacacagaattttcatatgtatcttttgcttgttcaagtgcaatctgagcttttttttcatttgcacttacacttaattcctgcttttcaatgtcatcttctaaagttgatgtatctataattgcaagaacatcacccttttttacttcatcccctacttctacatttatctgttgaacattataatcattaagattagaataaatgcttgttgatgttccactcttaatagctcctgatgaacttaccatcttatataaattagttttacttaaagatgtatatcttactctacttgattgtgtattctttttagctccagtctttactttatatactgtaaatccaccacctgcaactgctatggcacatattactgcaataacttttttgttaaatattttttttaaaattccagattttacaataccagactttactttaacattctgctttgtatccttatcatttttaatctttaagtccaccttaatagccctccttcatttgagtataatctagatactttaggtaaaaatcatttctttctgaattaaaatctgacattttgctatctaagtcaagctttgctttttccaattcattttttgtaataaaacctaaagaatactttttacttgatactccataatcttcctgactctgttgtaatttatcataactgctttttattgaattatatgctgtcataagattattatatttttccttaaaattaatttctgaagtaatagactgcttgtctaatgataattctttattttctaaagtatagttttcataatcattgtcatcatcatcgtcttcgtcatcatcatcctttgcccaatcaacttctagatttgaaaccgatatatctatactgttttttaacatttcttttaaatcttcactataattaattgacattactgaattaaaatcagattctacattattatcaagattaacatcaactccttgagaaattccaagagtaagttttaaattattcaatgctatttcgtttttactttcaagttcttttatttcattttcgctatcagtattatcagttatagtattttcataatctttctttgataaaaaaccactttcatattgtaatttacttatttcagatttttttgtgttatattccaatgtattttttttattttctaattgagaggtagtagaaagacaacttacatatgactgttgtgctttatatactgcatcttcaactgtctgattataagtaagttctgctttctttaaattacgttgtgctgtagttctactttttttataacccttaagttgttccaaagttgactgcttcttagttaaactcgcattcttatcttcatattcacttttaacctctgaatatgaaggatcactatcagtcaaagaatcaagttgactttttaaagatttaactgtactttctaattcttcaacttcatcttccaatgtacttatatttttactaatggtagatcctttatagctaccatcccctaaatcttctatactatcatttattttttgcaattcctgctttgtattttttaaattattgtctgcaattttcatatctatactattttcaatcataatagatttaatattgctgaaagaaattgtctgcgtatcagaacagtaagctttcgtacctgagatgctcaatgcagtaaaaagtacaagcaaaaatgctattaattttctcttcaatactataccctcctattgtagttctctaaatttatctttaaatactttttttattttacaggtaacatctaacttcactataactaaaatataaacaatttatagacactgttaaatttaaataaaaattaccatagacataaatgcctatggtaattttcattatttaaagactaaatctataaccagcaccccataccgtctcaatgtattgtggattacttgtatcaatttcaatcttttcccttattctattaatatgcaccgtgacagttgaagtatctccaaaagactcttctccccatattctatccagcagcgtatccttagaaaatactatgttagggttcgatgctaaaaatactaataattcaaactctttattagcgagctttatctcagtatcaccaatataaacccttctcgaatcagaatttatatttaatcttcctattgatattatattttgtgattttccatgagttttatccatggaagtaagtctctcatatctattcatatgagctgtaactcttgccacaagttcacttgggctaaaaggttttacaatataatcatctgcaccaattccaagacctcttattatataaatatcatcttttttagctgttactaaaagtattggaatttcttttacttttcttatttcctgacatatttcaaatccatctttacctggaagcattacatcaagcaaaatcagatcatattctttattaatagccttttctagtccactgactcccgtaagagctatttctgctttaaatccatttatttcaaggtaatcttgttctaattcagctatacttttatcatcttctataatcaatattttcttcacaaaatatcctcccttaagtactcatatactactccatataatctaaaaatataggaagttttattattatcattaatccattattatttaaggcttcaatttgacctctatgagcttcaattatacttttagagatagctagtccaagtccacttccctgacttggattagttctagatggatctcctctataaaaactttcaaaaagctttgatagcatttcatcattaactccatttccattgtcactaatttcaataacaatccattcattctcctcatgtattaaaatttcactttttttatcttcattttcattatacttaacagcattatcaagtatattaaatattactcttcgtatctctctacaatctatcttagctttaacattttctgaacattgatctatataagaaattttaagtcctctcttatataaatcttcttttatatcctcatacaattttttcaaatattcatttatatatattatatcaaaatcaaatggatacttcccagtatctaattttgagaataaaaacaatctatctactaactcatccatatcacatgcttttctatgtatagtgtatagatatttattcactttctcaggagtatttgcaactccatcaatcaatccttcaacatatccctttattcctgttaaaggcgttcttaaatcatgagaaattccggccataagctcttttctattttcttcatatcttaatttagcttgtacactttctcttagtcttattctcatttcatcaaaatcatcgcatacttgtttgaattcatcgtcatattcataattcatatcaaaatctaaattaccatttttgatttgatctgctccataacttaaaagttctagtggttcaattacatttttataaatttttgatgataaaattccattagtcacagtaactattataacagccaaaacaataacaacacctatgtatccaatcataaaagttgtcatttgctcccttatatcaatgcgcaatggtctataatctgaatttactgcaataatatttagcggcttgttattgtacataagactatttttcactaaagaaagttctttcttttctaaaacaagtgagtttgatttaattaaaatatcttcaccaatttctgaaatagacttattatcactctctgttaaattagaaaaaataacttccttaccataccttattataagatgatatccttttggttgtaaaattttctctaaatcctttggcaggttctcaagaaaattcttatcttctaatttcttcatatctatttttatagaatcttgaattatatatgcaccaggatgattttcttcaataaaattcattttctcttcgactaatctaaagaacggctctcttattacacccgctaagatagcaataagtattacaggtattataagcattaatatattggaaattgtaattcttctctttataaacattatttctcctaccttaaaattattgtatataaaaataaatttagaataatacctttacatctatcattctagatacatatttattatttgtaaagaattagaatatattattactccaacaaaattttatatttttaaaagtcagactaatttatttacataaattgtaaataaattgtttttattttagaaaaataagtgtaaactattaagtaagagaatttatgggataaaagtatgaggtgattgatttgacaaaattaaaaatactattaggagatataacaaaattaaagtttgatgcaattgtaaatgcggctaatacttctcttcttggaggtggtggtgttgatggcagcattcataaagcatgcggaagcagacttttagacgaatgtagagatttaaatgggtgtctcactgggaattcaaaactttctcagtcatataaccttacagaattagggatttattggataatacacactgtaggtcctatttttagaaataatggctctgaagaaaagtatttaagacgttcgtataattcagccttaaatgttgctgctaattatgctcatatatatcttgaacaaagtatgcaggttattaatgataacctataccgctttagtgctccaagttttattggaaataaaaagaaagaaaatttaattacagatgtaaaaacttatattgatgaacaccctattaagactatagcttttccatctataagtacaggagcatatggatatccccttgaaaatgcgactagagttgctttagatgagattacatcttttataaatgaatatcctgaaacttttgaggaaattgcaatgatatgctatgatcaaaaaacttttgatacatttaacaatgcttatgaaaaatattatgtaaataataatgctgctttataatacaatattttctataatataaataaaaaataggcattcaaatattaatttttaacatttgaatgcctattgtcatatagttttttaaacaatgaagcgtatatgaaatggggattcatatacgcttctataaatttataagggatttttatgggttttattaaactttaaatacatatctattgaatagggtgtttcaatacaaagttattttttaattatgcgaaatatctatctaataatcctttgaatgctttaccatgtctagcttcatctctagccatttcatgaactgtatcatgtatagcatctaagttagctgctttagctctcttagctaagtcagtcttaccagctgtagctccattttctgcttctactcttaattctaagttcttcttagttgagtttgtaacaacttctcctaataattcagcaaatttagctgcatgttctgcttcttcgaaagctgccttttcatagtacattcctacttctggataaccttctctatgagcaactctagccattgctaagtacattcctacttcacaacattctccttcaaagttagctcttaaatctgccattatatcttctgaagcaccttgtgctacaccaattacatgttcagatgcccatgtcatttctccactttgttccatgaatttttctggtcctactccacatactgggcacttttctggtgctgcttcaccttcatatacatatccacatactgtacaaacaaactttttcataattttattcctcctacacacatttataattaactatttgttatcttttgttttatcttcttgacagtttttattatataataattattatccgttgtaaataccttttttaaaaattttttagaaattttttctttcttattgattctcttccatatagtaataaatactgacatctttgtttatttctccacaaatatttcatttcctccttaccctttaataaataaatgttaaaattatctgaaattttaccttcttatatataaactatattgaataatagtttataattaagatataatttatgatatcttaatttatatgaggagtgtttttattgtttggatatgttactccattaaagggagaactaaaagtaaaagattttggcaggtttaaatgttattattgtggtttatgctgccacataaaaaagcagtttggaaacatacctagattgtctctcaattatgatatgacttttttaggcttgcttttagatgccttaaatcccgatgaagtagaagtcgcttctcacaggtgcattcttcatccaacagaaaagaaagtagttataagcaacaacaaagctgtatcatacgctgcatatataaatatatctctcttttactataaacttgttgatgatgttcaagatgacaaattattaaaaagcaaaatttttgcttctgtattaaatccatatagaaaaaaatttccaaagtcagttttaaaaattgataatgaaattaaaatgtatttaaatgaactttcaacattagaaaatagtaagtctttttcttcattagatgaaatatgtgatccatttagcaaacttgtaggtactgtttttaaaaattatccttatgaactaactgatgattctgatacacttcgggatacactttacacattaggatattctataggtaaatggatttatctaattgatgctcttgatgatttaaaaaaagatcttgaagataaaaaattcaatccaattaattttttatataataaagataatatgatatatgaagaatttatagaatctattaaacctcgtattgaatttaccatattaaattgtggatacagcataaaagataatttaatgactttaaatctaaatagaaataaagatatcttatataatattgttgaacttggattgatggataaatatataaaagttattaatcatcctgatgatactaatgaaacaaaaaggagtgacttataaaatgaacccatacgaaatattaggcgtaaatcctggtgcaagtcaggatgaaataaaaagtgcctatagaaaacttataaaaaaatatcacccagatcaatacggagacaatccattaaaagaattagctcaagataaacttatcgaaataaataaagcatatgaaatgcttacaaaagattctggtaaatcaaataattataacaataatacatcatcatcttggaattcaaattctagtaataactactctaataatactttcaatgattttcaagacgtaagaagaatgatacaaaatcgtaattttgcaaatgcagaacaaagactaaatagcattaataatagaaatgctgaatggcatttcttatacggagttgttatgtacaataaaaactggtatgattctgctctagaccatataaatacagctgtaagtatggatcctaacaactttgaatacagacaaacattaaattctctaagacaaagaggcaataatttttcaaatcaatattacagaactacaagaacaaataacaatgatgcttgcgattgctgtattaatttatggtgcttagatacattatgtgagtgtacaggcggagacttaataggctgctgctaataaatttaagggaggttcaatatgaaatcaaataacattgctcaaagcggaatattaattgcactaactcttgctgttctatattccacttcattacttcccataagcactttatcgattttaactattgcatcatgtttaattccaatatcaatcataagaacatctttaaaaaatactatactagtttatttatcatgtagtatattaagcttttttttagtaccaattaatatttccatactatatacattttttttcggaatttatggaatattaaaattttttatagaaaaaatgcacaacatggtttatgaaataatattgaagctcattacattcaatgtacttatgtttgttatttatatcatattcaatctttttgtaggttttaaagctgagatttcactttggcttatgatactaatagcacaagctgcttttttattatatgattatgcattgactctgataatatcttattttttaaataagattaacaaacatttataaaaagaaaaacataattcattattgtttgaattatgtttttcttttattacttatattaactatttccattatatatacgttctaagtctttaagaaatttcactgtctttactggagctttaccaatagatgtttctcctgccagtaaaaaacctgtaactccatttttaataaaattataaacactttcaacctcagaaagctgtggaattttaccagatttcatactattaaaaatatgtgtcccaataattaaatctttttccttattctttgatacttctcttattattctctcttcatatataggagtttcttcaattgaagtttcaggaatcaaatcccctctccctattacaattccatcagcttcctttaatatattttttatattgtttgcgccatttgaagtttctacctttgcccatatctttatattagtttcatcacctttatgatcttctataaatttttttacctcttttacatcttgggcactttcaacaaaagactgacatataatatttacattatttctaatcccccatattatagctttcttatcttctttactaagtgataacatactcctattaaagccctttatattgcatcctttccccttacgaataacaccaccttttattgcttttgctcttataagttcatcatttttttctatcacttcaaaaatcatagtgttatcctttattgaaatactgctaaattcattttcatgtaacatatcatttttaatattaagaggtattattttactcctatattgattaattactgtttttattatttcatatttatcttctccgcaaaagaatatttcctctccatcatagattttatatatatattgaaatttatttgatattcttaatttagttccagaagtatcaagcattatacttatatcaggttttatttctcttgcagtctttaaaaattctaggaattcatcattactaccatgagcaaagttaaacctgagagcatttgctccaccatctattatccccttgagcacagtcctatccttaactgttggtccaacagtacctataatatacatgtcatcctccaaaatatcactactgtttattaatattaatttatagaaataattatcacagttacttttataagtatttcaaattacttattgtctataatgtattattgttctaaaaaaattatgtcatgaataaattaatatggttaaaactaatatataggaggatttatgtttaagaagtttttactgccattattgctattactggttttaagtctaaatggatgtatttctcaaaattctaaatacataaattttacttccaaaccaaacaatcattactatacagatgaacttaaaaataaaatattaaacaacgaaaagttttctttatcagtatttgatacaaatttatataaagaaattcctgtaaacaaagatgaatttgtaataattgataactttcttacttctatttcttctgataattaccttcaatatgattctaagccagatgcaaaagagatatatagaatcactatttcatttgatgattttaaatatttaattcgcgtatatgactcttcaatcgttgccatttctccatgggatggaaattatcaagaagatattatttcaatggaaaatattcctctacgctataatttgcttgatttttgtaaccacatacaaaacaaacctattcaaaaaaattaagaaaaatactgcattagatatattcttatctatgcagtattttttttacgcaattcttattatatattcatatatttctataaatttctatacttttatttttaatattatgttatcatattattaaaattcatatttggcaaatagtattaaatcaaaactttatatcatatatatatttcaattataaatttacatatggccttaaaattcaataaggctttcattcataaattattaccttataaactgaaaaacataatatatattttataaaaaatacatagatctattggctagatatatacaaaaaatatattagggggttttattgcatggttaaagtagatttccatgttcatacatctgcttcagatggaattttatcaccaagggatattgttaaacgtgctaagatgaacggtgttaaattccttgccataacagatcatgatacattaactggtcttgatgaagcaatctctgaaggtcttaaccaaaaaatcaaggtaataccaggaatagaattatctactcagcataataatgaaagtgtacatgttctaggctttttcaaagggaattcctttaaaaattcagaacttattcatgaacttaataagataaaaaatcacagaataataagagcaaaaaaaatcatcgaaaaacttaaagatgaatttaatatttctataaatttcgatgatattgtaaaacattctaaagataccgttgcaaggcctcatattgccagagcaataatcaatgcaggctatgattactctcaagattatatctttgataattttataggtaaaggctgtaaagcttatgtacccactttaaaattatctactgaagatggagttcatttattaaaaaaatataatgcactagtttttctagcccatccaaaattaattaatcaatcttctataaaagattttttaaatatgaactttgatggaattgaagctgtttattatcaaaatacaactgatgaaacaacttattaccttaacattgtagatactaataatatgctatcatcatgtggttcagattttcatggtgatattgttaacgatacaagacatggtgatattggatctatggaactttcagaaaaatatttaaaacctttattagatgctttagacattcctatgactatataataatattattaaacaaaaaaatcgccaaggcgactaagttatagaaatatattaaaaagttaactttattaaaagtaattatttaaaaaatactaagattacacaatgtataacataggtaatcttagtatttttgttatgcttctattaagaatgctctataacccttcatagtttcgtaaatatcaactttactagctacttcccatggtgcatgcatattgtgaagagctactccacaatcaataacttccatattatattgtgctaaaatatatgctattgttccgcctccaccagcatctacttttcctaattctgctgtttggaaagatacatcatgcttttccataatacttctaagctcagccatatattcagcattagcatcattacatccagattttcctcttgctccagtatatttattaaataccattcctcttccaaagaatgctgaatttttcttttccattacacttggatagtttggatcaaatgccgcacttacatctgaagaaagcatttttgaatttgaaagacatcttcttaattttaagtcagaatatccttcatatttatctattatttctgcaactgcattttcaaaaaatctcgaatgcatacctgttgcaccaacgcttcctatttcttctttatctactaatagacaacagcatgttttatcactttcagttatatcaaacatagccatcaatgaagtatatgaacatactctatcatcatgaccataagccataatcatacttctatctaatccataatctcttgctttacctgctggaacaacttcaatttcagctgataagaagtcatcctcttcaatatcatatttttcttttaatatttttaatatgttagctttaactgcttctttttcagttccttttagaggcatgcttcctactagtacatttaaatcttcaccttcaacaactttgtcagcttttttacctaattgttctcctgataaatgaacaagtaagtctgaaacacctacaactggatcattttcatcctcacctacacatatatcaactatagttccatctttctttactactactccatgaagagctaaaggaagtgtaacccattggtatttttttattccaccataatagtgagtatctagtaaggataattcactatcttcatataatggattttgctttaaatcaagtcttggagaatcaatatgtgctcctaaaatctttaatccactttccattggttcacttccaacaataaataaagctactgcctttcctttattatttacataaaccttatctccagcacttaactttttattattttttattatatcttctaaatcctcatatccttgttgttttgcaagactaattatttcagttgcacattctctttcagttttgcatttagacataaagtccttatacccattacaaaaatcaaaaatttcttctacttgcttttctgtatatttagtccatgcatttttgttaaaatctttattattactcatataaaaaactcctttttcaatagtttgttacttgtcacttatattattcattctgctttctatgatgtctacaggcgtaatatctgacattaagttatatctataatttactgctgctgcttctattataactgcaatatttcttcctggtcttactggtacagttaatttttttacattaatacctaatatattcatgtattcatcatctataccaagtctatcataatcattatcatctttccaatgttcaaaatgcattacaagtcttatttctttttgttgaactacagaacttaatccatataaagtggtaacatctattattcctatacctcttacttctaacataccaattgttatcttaggagatgttcctattaactgaccatcaatttctcttatatctacagcatcatctgtaacaagtctatgacctcttttaataagttctaatgctgtttcgcttttacctattccactttctcctgtgattagtattcctattcctgatacgtcaactaatactccatgaagtctagtttcaggtgcaagcttatctgcaagatatattgtagttttactaataaactgtgtagttacaagactagttctaagtacccaaacattatgtttctctgcttcttttaaaaactctttatgtggctctagatctcttgtaatgatcaaacaattaatatcaaaagtaaaatacttcttaacccttttttttcttaattcaatctgcatgtcatctaaaaagctccattcagcttttccaataacctgaattctttctggtgcaaaataattataaaatccggccaattgaagaccaggtctatttatatcgtttactgatatttcaacctcttcatttccatgtactaagatttctaaattaaaatcatcaattagttttcttacattaactcccaatcctatcatccttttttactattttttaatttctatactatctaactgagctctaaaatttctttttacattatctatatatctttttctaagagctgcttgtaattctttttcttcattatttaattctctttcttgactagttttatataatgaatttatcttttctacaacttcctctattttcatcttttgaatatccataataatcatcctttctctcttatatcactaattttacctattttgaagtatataatcaatattaaataattcgacaccaaataatcttttagggaaattcgtgtcaaacgatttcattaacatttttatccatttatgtattattgtgtttattaatttattcttttttatactttttaaagatttttgattgatttttgctaaatattgtcattaattgtactacaaaaaccttttacaaattccccctaaatgtttataatatatttatacaatttatccatttatagtaaaaagaggtgaatatatgaattttttagtattaactaaacttaaaatgagtattttaataagaaaacatattcttagcatgttacttatatttctgcatcctactgcaaaaataatggtttttttatcacaagatttggacaagtacattgtgctatatcaaaaaaggctattttcaatatatatacataataatatgtctaacaagggaaataagtttgttgcttgataatatctattttctatcgttgttattaccaaatttgtatttacattagatattatctagaagatatgtcttagatgtaaatgttcaaaacaatagttacttattgaaaaactttaatcaataagtaactattgatttttttatattaataacaccataaaattttatgcaaaaaaacacctcatttctgaggtgttgatttcaaaagtatagttcccaacatgccgttcacttaaatattcaaaacctgcgcctcgcaggtgggttaagcgcaactcacgtctgtcttcttctgatacctaaaaagttaaatgaagcccgacatctttaagtatattgcaaatcccgataatgtaatgtaggttgaatatcgtaagtttagcgcacatctcaggaaatctatgattttattatagcataactttttatattttcaatagtattttcaatattctatgcttccattttttactgcacgtaatcgtttaaaatgtcttccatttcactttcgtccatttctgctgaaaatactgctacaaacctaagatatcctagttctccactttccattacaagagatttatatttcccttcaatttcaaattcctctgctgcatcttctactatagattcaacattatcatcagctatatcctttaaaaatggtatataatactcattataccattcatcactttctgcttcaaaatcactttcttcattcgaataactttttgctgccattaactcatctttatcaaagtcatagtaaaatttcaacaaaatatagtcatcttcttgctttatttcttcaacatcagataaatcattatcttctaaaaagctttttatttcagaaatatccaattttagtcacctcatcttttagtataataaatttttatattcttttttaattgcttcaaactcattatcatcttcaacaagattaagttcttcttttccttcttcatttatatcaattctaaaagcaaacatatcatcattatcttcttctactggagataataaaagatatccttgttcctctaaataaatctttgctattgcttcaaaatctactttatttccatcttcatctctaaatgacattatttctttttcttccactatgctcacctcataatttattagaataaaatatatttgtatcatagactattatcttaaactctaaacacaatatattaaaattctacatttttattttaactattctaaattcattatatgatatttcatatatttgtctatatgttttttctatttaatatttatttttaacaataaatcagtaaatttttctctatttatattaagttttttattaaaaattattattgtataatgtaattatttttaatatttccaaaacaaataaaatccagaatcaatttaagatgtatacttaaactaattctagatttctattgatttattattaacatgtttgttgtgtagtaaactctccaaaagccccatatatatctttatttcttgatttagcaacagcctttactattgcgtaagctattataccatcaaccatatgatgcataatacttccaactaaagtaacaataagagcccagttaagtgctaatcctataaaaggtatggctacaatcatttctaagaaaccatgaattggagctgtaataagaacagcttgtgcataacttctattttttataattattttagcaccaatatatccaactattatatgagttgcagctctagctactactacaattggaagtcctgtaattgcaaatccaagtgttgacccaatacctacaataacggctacaaaaggtgaaattaacattgatagcatcataggaacatgagctgccaaagtagctgtaaatgctggtggtacaaatatctttaaaaatgaaaactgaataggaataataattgctagtgcagtaagaagtcctgcatataccatttgtttaactttattattcattatataaatccccctcgatttttatataaatattatttttaatattcactatgtacgaagactcacatagcttaaattaatatacttggaaatgcattaatttataaagctatatttatatataatagtgtatatacattagtatatataaatatttttctcaagtaaagttatttgcataattttaaattatacaaaatttaaaacatttacatttatttttttataatattaatccatatttctataactaaattcataagtatgcatctttttaacagtacagttgtcttataatcttattaactttataatatatttatcatgattttcacaaaaggaggcgtttaaagtggaaaatataactatgcttggtacaggctctgctatggttacaaaatgttataatacatgctttaccatttctaatgataatgaacattttttagtagatgctggtggaggaaacacaatactttctaatttagaaaaagcagatatttcaataagtaatatacataatatgtttatatctcataaccataatgatcatatacttggagctgtatgggtcataagatctgtagctaactcgatgctcaattcaaagtataatggagtgtttaatatatactgccataaaaaatctattgaagcattaaaaagtatctgttcttttgttcttcaaaagaaatttctaaaactatttgatgataaaatacttttccatgaaatatgcaataatacttctgttaacattttaggaagacctacaactttctttgatataaacagtacaaaagaacttcaacatggatttacaactattcttgaaagcggaaaaaagctcacatttttaggtgatgaaccttatagagatgaattactaaaatattgctataatacagattttcttatgcatgaagcattttgcctttattctcaaaaagatatttttaaaccatatgaaaagcatcatgcaactgcaaaggatgcatgcataaatgctcataaattaaatgtaaaaaacattatcttatatcacactgaggataaaaatttagttcaaagaaaagaattatacataaaagaaggtaaagaagaatttaaaggaactatatttgttcctgatgatttagatgttatctcattaagttaatattaaatcattattaatctaaaatttgatatttttatttagatttacttctataaaactttagttgatttgtttgtaaatatgctcataaataacagtaaaaacaatggtcaaaccttgattttttcaaaatttgaccattgtatcacattgtttgttcttatttaaaattactcttaataataattcttatttatcctaataacttcttatatttagatataaaactgtctacatcatcatatagcccagattgatttgcatactttacatagttttttattgttctcaaccaatcaatagtggatggctttgtactttgaattgctttaactaaatcttccattgtaatatttcgttcaatacctgataacagaatttcattgataacattttcggttgctacttctactacattatctatatcagctccagagtataattctgttagtttagctaaaacctcataattaatttcttctactggtctctcttttaatttaagttcaaatattttaccacgagcctttatatctggaggtggtacaaaaataattttatcaaatctccccggacgcttaaatgctgaatctacatcccacggcatattagttgccccaataattagcatcttatctgtactagtatcaatcccttctatttctgataataattgatctataataggcctcatatgttcagatgaaagttttgacctattgtacccaattgtatcaacttcatcaaaaaataatatacaaggcttttttgctcttgctgatgaaaatatatcttttatattttgtgcacttacgcctaaatacgggtctagtatatctgttatgtgtaccggtataaatttagcattacactctccagcagtagccatagcaatatatgtcttcccacatcctggaggtccaaaaagtagaattccacctccaattttttttctaaatctctgaaacaatcctggattagtaaatggttcaataatcttcattctaataatgttttttaaattttccaagcctcccacatcactaaaatatacatcagataaaccatcatctttttcatctgatactttggttttatgccctccttcaataatatttaaggatataacattatcaactacttctgaactctgtaaaatatctttatcatctttttccttacttatagttatatcatatatatttttttcactcttataagatatattacctaattcactataaatcttattttctagctctttatcgcaatatttaagagcctctgaaaatgctcttaatgcttcactatccatttcctgctccttatactctatacccaataaataccacaaagatccattactaaaattttgttcaatcatatttttaataacttcaatcttattcatatttgcttttctccttttattagaatactcacctaaggaaaatacattatctgtattttgttataaatttatatatatatggaattatccatgtatatacacagattcctatgtaaaaaattgaaacaagtaaaacaacatttgatagattcaattcttgtaacactaatactgtaattatcatagcaatccaaatcataactggaccacctaacttatctattatacgctgaggtagaaatagaatattagctcctttttcagcactctgtagaattgttaaaatattttcatctgttggatctaatagaaatgcttgtttaaagttttctcgtgcccctttatagttgccacaataaaattccaccattccaatttttataaattttgatacttcactatccgcaacttgcaaatactcttgcaatattttaacctgatcttcacttttgttttttactaaataataataaaacctataatgtaataccgtttcattttgagaatctattcttaaagcttctttcataagcttgtccgactttctataattacctgtatctagcatcaagtaaccatatgtagctataatgtcagccctatgtggattttctcgtaatgattctagaaaacattcttctgccttaatatactgattcgtatgcataaaaataagacctagcaagtaattacattcacatattgaaaatccatagtttaatgcctctctgcaatactcttcagcttcattatatttattaagataaaatagacaacttgcctttttatataatgtataattatcattaggttttatagccattgattcatctaacttattaattgcttgctcatatctacaaattttataataatgacgtgcttcattcagtattttttcaaattcacaatcataagacactgtttataatcccccctactattaatgcaagaataccttcaactattatagcaataataatccatttaattgcatcctttaacattggttggtacgagtgatccattatattgtatagattaaacttatctctcatcaaaaaggaatatccaatataaataaatacacttgcaatcttatatatgtaccttattttcctagaacttacatctagataatttgctactaccaaaccacatacagtaaattttataaataaaataattccccctaaaatcatcataaaattaatatattttttatcaattcctaaccatttagcatttttacttccaagggcaatagttggtataataccaccaatgaatgctacataaaaaagttttgtaatattatacgactttaacccctcataattttgatttttcagtgatggctgaaataattcatctgacaaattaatctctcctttaaaattattaatacgacttcaatataaaacttctatttgatatcagtttatcaaaactgcctccttcccatcttaatattattcgtaatctattcttctgaattactaattttaaatatttcaaaatatgccattgttctattaaacttataataagcagcatacttcttgtaatatttaataacattattcaaatcatcaatagcttttattttatagttttcattaaaattaagttcattcaactttctcaatactgatgccctaaaaatcattatagaaatattaacacctttactatatttattgttttctttggaattttcataaaaaacttaatctaattcttccagcgacttttctaaatattcttccctatcgcaataattagatagttcttgataacaatatccaagaattctatgaatttcagtaataagttcttcttgatttttttcttcctcttctaatgctgattctaaaacttttatagatatcttcaaaatctcttcatcatttttaaataaccccaaattataatatgctattcctactcttaacataatatctactattagcttattctcttcaagagcaagtcccaatgcttcttcatataatcttacacattgcttcatatcttctatgtttccgcttttctaaattttatgttgaaggcaatgagccttataataaatacacctctggtaagcatattttttcttatcttcactgatttcttccaaatcatttgtcattaaatcctctatcttttctaaagccttatcaaaattcctcagttgtattaaaatcaattaacattagaaattatataaatctttaaaaatttaattatattactatgaaaataattattattaatattgctatataacttatcatttccattgatacaagtactttttgtgaaatctctctccttgctacaccctgaaataatcctatccataatcttcctccatccaataatggaattggtaataaattaaatgaaataactataactcctatataaattaataagattaatcgttctacttttaatcctgcaagctcagcagcgtgttttgttgctttacgctgagcatcattaaaatatgctggaacgcttataactgcatcaactacttcttcatctaaaaatgcttctgcatcagcttttaaagatttcagctgtcatatgtggatgacttataagcctttctttatcaatttgacccacaaatatttcaccattgtcatcaatgctaacaactgatggtgtaatgtttgaattaatcacatttggtattattacagctcctttatcactccaatacgctacaaggctatttgttgttcctaaatctatacctatcgcagtcattatcaaatccccctgttttttacatttatgaatattttaacataaaagttatttctattcaaaacattaaaaattagtattttatatttaatctctcttaataaatttttctgttaatatagaactaagctacagaacagaatatatgcaccaaaagcttctaagctgattttgcttaatctttgcagttataaatataaaatcttgctctaaatatttataaactaaaatacctcgcgaaaatctaataaaatgattttcatgaggtattttgttataatgtgtattccaacactttcacattcttctttgacttgcttttttctttttatgtttctagcaatttaggtttagtaccttgctggtaattcatcatcaaatagtacagatacctcataccctaaataataaattcaactgctataatcaaatcatctatttttacacttatcagtattaataatcataactatagtaaagacaacacataataaagctactatccccatacctatatcatataagtcttctaagtttgaattatgttgtgcaaataaacttctcattactcctattataagtgatagtgtattaactggtgctatacaaatatatgatataaaacctataacagacatcttattataatcaattgattctacaaattggtctcttgatatagactttgctattaatatatctgcaagaacgttattttttatatagatatattttttacatctacttcttggaaaatatgatgaacacatcctgcattcaccattaaataataagaaaaaaaatatcgtgataattatatttactattctattttgcatttaccgcctccatataactttgatttatctcattatatttctcttttaatttatactactatctgttcttacacttagaggtatttacttcagaaataaaaagaaaagtcatataagatatagctaaagtaataacactgcatttgtataaatattctaatttactatccagaataagctctttcattattcccagtattaatgtacataagtttggtattccaaggaaaatataaaatataattcctattactgatattttattgtagtcatacttttctacaaatttatctctcgatatagattttgcaattaatatatctgcaactctattatttcttatattaatatattttttacatttacttttcgggaagtatgctgagcaacgtctacatacgcaattaaaaaccaaaaaaagcataagtttactattatcattgttattttacttgacatatattacccaatctcacttcgtatatagttatatcttgtttctattttttctattgatttatttacaaaatcgtaaactccaactttatctaatactgtatctatgatacttactcctgcaccatacataacgccacgtttaactgaatttaaatttcaataacatataacacttttatcacaagtaataaatttcaactactataatcaaatcatctatttttacacttattagtattaataatcataactatagtaaagacaacacataataaagctactatccccatacctatatcatataagtcttctaagtttgaattatgttgtgcaaataaacttctcattactcctattataagtgatagtgtattaactggtgctatacaaatatatgatataaaacctataacagacatcttattataatcaattgattctacaaatttatcccttgatatagactttgctattaatatatctgcaagaacattattctttatgtagatgtattttttacatctacttcttggaaaatatgacgaacacatcctgcatacaaaattaaaaactagaaaaaaccatatatgtgctattatcattattgttttatttaacatttataccctccatattattctgtatctcattatattttgtttttattctttctatttaaatcctttcttttcttactttagtggttcaggtttagtaccttactatggttcatcatcaaatagtgtaagtaccgcatataaatagtagtaagcaatgtaacttactactatttatatttctatctatttttacatttacccgtatttataaaaagaactattaaaaaaataatatctactaatcctaagcatgccatgctaatataatttattgtttctaaatacaagctatttccttccataaaacctctttgtaagattattataaagtttgctagattaataggctcaattattacatatgatataatacctattattgacattttattatagtcaaatgtacttacaaatttatctgtggatacactctttgctattaatatatctgcaagaatattattctttatatagatgtattttttacatctacttttaggaaaatatgcagaacaggccttgcatgtataattaaatatataaaaaacaaataatgctacaattatcataattactttttttaacatattaaatttactcctctatttagtatgtttttcttttaaactatctttaataatttaattttgcatatacttgttcattttcaccatataaatctttaactttttcaatatctttttgtgcaaatgtatcaaaaaaagatattcctgcaccatagattactcctttttttactgcatttaaatcatcagtaacatataatctatctcccaaatgtaaggttggcttgtatccatttccatctgattttccagctatcattcctataccgattcctttcataatatctcctgtatctccaccattttatagcttgctatatcttctatttcataagactttttctggcttcttccaaaataaaacatattattgaaatctattatatcacagtatatctgttcttttaattcactacatatcctttttaaaaagttccagtctgtttctttatattgaaaaagtgcttttcctatcttttctccttttccaacacatatttcaaaactacatccataataatcctttactgtttctgctacaagttcatcatatgtcatatttacattttgaaatgatctactctttttctgtatatcaagcttggaacggaattattcactctaaattctcccagtttattaggttacatatatcttctatacttaatttactgctactaaaaattcctgtgctaattatctcggaactccttcaccagatacttttatttattgaagtattttatgaatcttatcaattttcaatctaaattattgaatctagtttttcttatgctactaatctacacattactttcagcctcgttttaatgaattctaaagactcaagtattgattagaaagaaaatcccttattagatgcttatacttgagtaactgttgaaaagataaaatgaatcagcctacttaattcagctgattcatttcatcttttcactgctttatttagattatgcagtaatttattttatggcattcattaatttttatatattttacttatacttagtattatgaagtcagacatatcataattttgtagttaaaatcttcataataattactgtttacttactatagtgtctataatatatgttaaattatcatacacttctttttctttagcttctttataatcataataagcttgtatacctctatgaataatagtatacatagttgggtgatattctctactagtactattaattaatgtttgtacaaattcacatgcttgtttttctgaatacttaaattcatttattaatactcctatcatcgttccttgaactttaggcggttcaattttttcatctagcgcatatgcattaatcataccaaatgcaaatgcagatattatttgtctttctatatctgttgtttcttctaaactaatttctaatattttaaataaatcatttgtcattcttgaagaatatattgagaatttattattcatattcaaccctccattactttagtaaattattattttgccattaggatatgttcccttccatccacaaggaatatttccattctcgtagattttaagtatttcttcatagaaagttggttccatatactcacaataagtgtatgccattattatcataagcatatcccactcaatctggtttattatttctgcttcatttactttaaattcatttgcattatttattatatcttctttaatctctggcaatatatttttctttatatctttcaccatatcattccatacttgatggtatttatccggataattcttaaacaagtaagatgtcaatctgtttttttcttcaatacctacattttcccatctagtactactaatatgcttaattacacttttaacatcatttgcataactctcatcatatataagtgttatctctaatttattgccacaattttgaaaccatttaactttttttattctctcaataacatatttacttacttccattataaaattcctcactttaaatttattcttcctggtactctaggtacattcattttactcgtcaacccataatccaattgttgcttgaccgcttccctcatagcttgaatactctgcaaggcttcatataaagccttattatactcaactatttgtggttgagagccgtataagtctccaccctttctatatttactccaaaatccctccatgcttttatgtgcattgtagtgtggacttcctatgtcggtaaatatatttccttctaactttattgccattccttcttctcttggaattacatctctaaatgctgcatcttgatttaaatgatgtgattgtcctactatatctttattattttttaatgttccatgtctttgaattagaatgtcatcagcttgtgtaacccccttggggcagagtctgtctttttatttttagtggtaggattgaatgttttcaacccttaccacagttttaggactacttccaactacttatcatttttagtgttatgtagttactttttcagcctttattttccttaatatgttaaccttattttatcatgctactgcttttatttctacattaggcattacatattcacttttatttttcatcattccatagatgatgttattaagccttctcattacacacactaatgcttgtatcttagttttaccttcggaaatctttctcttgtagtattgtaggaaaactggatttctaggagttccttttttagaaacttgtacctgttgcactgctaggaaatagaacactccgtagagttctctattaccttgtttactctttttatcttttcctttgcctgctgaactaaagtttactggtgctattccagaaaatttagctagcttatcagcgttacggaatcctttaatatctcctatgtgagcaacaagtgctattgcagttacagtatctatccctggaattgtttctagctttaggtctagtagttttagtagctttttcatttccacttcaactttcttgatttcttcactcttaaatgcaatgtctcttacaatgctctgaattatgaaatctctagactcttggtattctcttgttgtatctccatcaccttctacaatatctagtatttctttagcctttcttgttgagcaactattatgactaggatttcttagaaactctgctagttcttcatcggttacaccttttaggtgtttcggtgatgggtatttctcgtagaaagctaatgcagtttttccatttacatcagaaaaaaatttcttatagcttgggtaattatagtttaagttctcatgaagttgattggttaaattagttattgattttacaattgaatttcttctattaaccatcatttttatagtccagtataaatcttgtggattagcatctggtagtgtatctagctttcttaaaagtaatgatgcaatgcacctagcatcccagtcatcactcttttgagtagtagggtaactcattctttccatgtatgaaagtgctgaattaacttcctttactatcattcctctttcaattagaaatactgctagacttctaccgtaaccatgaacatcttcaagtccataaactggtactaaatcacctgcaatcttatttaccttattcattagttgtgtgaaatcagaaggcttattctcaatggttattgaacctaatttctcctcccaacaatctattataacagcggtatgggtatccttgtgtaagtctaatccaacatatatatgattttgcttcttatgcatatctactcactcctattcattattcatgcaggaacgcaggcaacctcagtttaaagcattcaatcaacttactagcaatgttactagaaaattattgtgcatgggggcgaaagccaatccgttcttattctgctagaagtaatgtccttgtagctttcaatgaactcactattgaatgtcttacttgggttacccactcccgcattagttactatttcttttaggtttagtatatctgctattgaaaaatatttctcatactcgaaccttgattttattagcttagggcgtatgggcgtattacttagtaaattttcttttatttttcatttattatttaattattttttattctatttttattgaattaatctgcccttatgcccaacctatttatttatctatgttctattcaatttctatctgcccacactttacccatttatgccctacttgtaactattaggtagattactccacaatgtagctgatgctacaccactagctttagctacttcctcaactgctccaactgatgacattccacttagtattagtagtattattcttgcaattagtattgctatttccatcttttctgtacctcctatattttatattcctttagaaaatcttcgttttctctgcctagtttatcgcttttatggtatagggttattccgaatgaatctcctagaataaatgttgttttcattatctcaacatcatctattacaataatttctgtaaactctggtatggatgttaatttctttgattgcttgtctattatgttatatctatttataacttctattgaatcatcatcttctagaagtactatatctccaacttcttttaggttgtacatcttccagtatttatctacaacactttcagctatttcttgaaaatgttgtagtatttcttccttcaactccaatggagttatctcagctatctctatgtcctctaatgtatttattattatcatttcctcaatcctttctacagtagatttactgcctttagtttttcttctctactactgttaatgtagaatgttgcagtagtatctacactgctatgacctgctagtttacttactgttgaaattggtactcctctatttattagccttgtacagaaggtatgtctaaatgtatgtggctttagtttatttaccattcctatctcatcagttaatctttcaagcattgtatttatagcatctcttctcaatgctcctctttgacctattattagatattctgaatcttttaagctgtaatctctatccttgatgtattccttaattacatcagctaaatcgaatttcaattgtacttctctatactttcctcccttaccataaatttttattgagtagttcagcaaatcaatatcttttatcttgatactacatagttcactcactctaactcctgtatatagtagtaacattacaattaccttatttcttttactcaccttgtcctcattctgaatgtagaataatatcctctcaacctccttatcactgtaaacttccacttgtttctctgaaccataagctatctttactctatctttagaattttctacaactatttctttcattgctccagttgctacaaggtatctatttagtgcatgaatgctatttatctttttattgattgttgctacctcatagctattctctactagaaagttcttgtagcttactacgtagaatcgttgtaaattaccattgaattcaactcctttatctcctagaaattctatgaatgctctaatgtcaccagtgtaactttcaattgttttagcactcttaccatcttcaattagacttatcttgaaatcttctactatttgatacatcatctttacgcctctcaattttcttaaatagaaaagagttaatgcttcctaaattagaaacattaactctgttatcagatttataatatatatttattatctattttaaattcagttgatttagccattatttacagcttttcaatctgaatagtattcttgttcacattttatgaaatctcttctttatgatgccttatcagttgtttttgatgtatttatctttactgatgtattatatttttttagttatttattccattgagtaattttattattgattggttatttaattatatttcctttattgattattactctacttcttcattgattagattttcttttactgatacatttattactacttcttaatcagctatatttattatcattattgattaattatattttacctattaattacttaattcttctttattctgattaattcttatttatcatttcttcaatttcttttatcctatttatttttattgaaatagatttttatttatctatttcaattcttttaagtccttattcccccctaccccccgttacaatttcctagtcccgagttccaagtctcaagttattctattcagctatcctatttatatgttctattctatcaattctttttattttttagtgtttttctactacatatattatgttcacaattccattaacttttaagtggaattatcgagcctaggttttcctagctcatcaggttacacacatcttctatgctcgatttactggtatctaaagtcactagccttaattagctaggaagtcctttatcagaagcttatgtctgtacaagtactaaaaaaataatgaactagcctacttaatttcagctagttcatttcatcttctcactacattatttagattatgtggtttaactttttattacatatattgatttaactacatttaaatactattactttttatgcatttaatttcttctgtgttatgcatttaaatataaatttaatttaaagggattttcaattcatctataaactgtctaaatgtatcagaaattttataaatattttcatcctcagatgaattatctagttcgaatgaattatcccagaaatatactccagatacttctggactgttcactagaacaataaatccgaaaccaataccatgccctattattaagcaatcatcaagtaaatcatcttcatactcttcgtaccattcccttaaatctaaattttcttctaaatctaatccatataatacttgtaatcctatattttcttctaactcatttaatgtgaatgtactatacttaacttctggtactccaccattaaaattaattaaaaattctttgtaatcatttggtaatgtgaatcctatctcatcttcaagttttaaaatttcctcttcttttacatttccatatccttttatcttcataatttactcctttacttttttattttggacattccacctctatgtctaaacctctcatgtaacttagttaaaacttcctgaagcgtaaccccatcttgatgatgatgccatgtactactttctgatattggtccattaggtgctaattcatcacctctaggaaaatctttattatatccttgaaatggtccaatattaacttcctgctcaaccataccagctgacttaaaatctggatatccatctggatagcttacagatttaccttcccagtcatgatatgtccatacgccctcatcatcaattgaaatagtaccatttttcttaaaccatttatctggatttggtgaatttttaggttttcctttaagttgttccttagttaaactagttaacctttcatcagcttgtgtaacccccttatatgcattattagtcaaatcatctatactacttgatgaattcttaacattcttaaattcatcaacaaaatcatcaacttttttagaaacattaccaaaattacttccaagtacaacagatttatttgctttactattcacattctctaatgccaatctagcatatttagcattttctgataacttggatgatactttattaaatgctttcttaacatatggtgatgcactgtctacagcttttccaccataatggaatgctcctgctgtaagtccaccaattccaccatctaatgcaacggttccccaatctatatcctgtccgttaagcttttgtcttacaatactttcaaatccatttgttactgctccaactgccattttcccgcctagtgtttcggctgctccaagtggtccaaatatagctcctgaaagtgcacctacaaaggcttccctcgcacctgcaaaagcataggccgacatatcacttacttctcctctggctatatctgaaactgccatactcgctactgctgctgttcctgatactgctccacctattgctattgctcctataactggtcctgctaatcctgcagttgctgctactgctactgcagcaactgttactgctgctactactgccagacctgctaatacattacatgcaagctttccccaattgaatggctttttttcttcctttggtggttctggcggttcaggtttagtaccttcctgtggttcatcatcaaatggtgaaaatgcttctgtacttcttccttcttttttcacattatcagataaaaaatgcatatcattttccaatgtgaatccactattagtatcacctttagatgcaagaatctgacttactccattaatcttaacatttttaggagttttcataattatttctgaatctgcatctaatgttagtttctttggacttgttattgttactcctatgctgtcatcaaagcttatgcttattggtgatgcacttccacctcttatgttaagtgcacctggtgtcatttctacttcactgccatgttctgttccaaagtatctctttgttgtatcacatgtttttgcacatgaacttccattatttcttacacaacctgttacaacaggttcttttccactttcatctggaaaatacagttttgcacttgttcctgcaactggcatggaatacatcatatttcctgtaggtggtgcataggtaaaccaggaggcttcagattcttcttggccttcatcaatattaagtttcagctttacctgctctccctgaacatcaagtactttcccttcaagtgatgccccacatattaatgaattatataacttagtctgccatactccattttttcggcataacctatacttatagattatctcatcttgatatttacatgctgcatattcacttacatacagtcttttattcttgaaccatatttcatctccaggatcatacttctctcttctatctatctcataatagaaataatccgtatcatgatatccttcttcatatcctcctgatctgtagaaactttttaggtcttttcgcgctttataacttgctatatcttctatttcataagactttttctcgcttcttccaaaataaaacatattattcaaatctattatatcacagtatatttgttcttttaattcactacatatcctttttaaaaagttccagtctgtttctttatattgaaaaagtgcttttcctatcttttctccttttccaacacatatttcaaaactacatccataataatcctttactgtttctgctacaagttcatcatatgtcatacttacattttgaaatgatctactctttttctttatatcaagcttggaagaacatgatattccttcaatttctaaataatatactccatctgtatttgttgtactaatattttttatatttccatagaataatattctgcttttactttcgtctattacattaatatctgtattttcaatattttcttcatcttgttgttcataaataattatttcatcttctgtggtagcttctattacattctcaaaattaacactgtcatctattaaacaccttaaatataaatatccatgctcattaggcttgtactctatttttatatcttcaatatttagcagtctgtatggcgatttaattctcagattatgaactgctcccaccctattttctgcccctttctttatatgatttttcttttatctaatcttaattactcttcttgtccattacttataaatgttatctttcctccatatttgcacacaagaaatgaatctgtagttaaagcatcttctccttttacaagagtatcttcttttgtcttcagccattcttttaatattgtaacctgacacttctttccatttactgtccttccatcttctgttataagataaatatcatcacttgatggacagtctcctgtacatattccaaaatatgatatattcttatttacaacattatcctttttgttcatcattggcttttcatttgcatatgaaccatgactattaggcaggtttatttttcttggatgagttcctttgtcacacaccacctttgcacctcgaacaatataataattttcctctgacatatgagaaccatctccttttttatatcaataaatactaaaattctatttaatcaatttctaatctctccaaagagattcccttaaattttcttctaagcaggctttcagcaacatcaagacttacaactataagtggcttctcactttcttttattctgaatattttctgcccactaattttacttttatctaaaactattttctcaacaactgttttattcatgttgagtttacttctatcacttaaggcctcaatttcttcaataataggcagataataattttcttgtctatcatgtctcctatctataagcggtaaaatcttaaatataatttctgggtcatactttgaaattattttctgcattctttcacaaaccataaatatctgcgtatcaataatatctgtaaacacacaataatcatctgcttcaacctgtaatattactgcatcatcaattttgtctgcattaaatatatttatgttatctacatttatatatttgaacaaactttttatccttggagtatttctgtatctttcatctttcttcaataaaaaatagtccataacaagtacttctccttaaaatattgttttatactgatgcatcatatattatctctgcttcatccatatattctcccgccattatttttatatcttcacattttttcatttcactatatgattttgcctgtataaattgatttattctatctttgagaaattctataacaagcataagatatttatcagcttcatctaaaattatttcttcaatatccatgtcatttaaatcacttccatacttttttcgttctttcttaagctcatccataaattgaaataaagatttatatacaaaatcaaaattcatgttaatataacattcacttttatcaagaaaccagttttcatcataggcatcaattctaaactctcctcttccctcacaaaaacttgtccttaaaaatgaaaaatatatatattttatatttccttttaaattagaattctgaagacttatgcacttgtcacataatctttcaaaagtttccattaactctttgtctatttcgcttttcttatttctatacacttcatctatttcaatgaagtctctaacccagttggattcaagatattcttccttgaactcttttaatatgtcttccttatccctctttattatcattactatatactcactttctattcaatctttaccttgccaccagtcatttttacatcatccttaattgcaagattagcagaattttgtgtaagatctactccttcatcgcctttgattgatactttagcctttccttttatttctatatcatcttgtgcatctaaaattatctttttatcactttttatctctattccaccatcatcagtcattctcattaaaagattatttcctccaattatttcaacagctcctggtttcatgacaagctgttttccatacttagttcctatattcttaactgatggatcacttctcttttttgaattgcttgattttaaattaacagaacttattgcataggcattcttttcttcattatctggaaaatacagtcttattgcatctccaacttcaggcatacagtaccatccagtaccatcttctgacgaatatactgtagagtatggaaaccattttgctgtatctttattctgacttgaatctatatccagcttaattttcacaacatcattttttgtatccaaaatatttcctttaagtgataatccaattaatttatcattatatcttttttgaattttcattcctttttcatctcttaaaacatacttatttataaattcactatcacaaatttcaattatggctttatatacatataaatttttcccattaaaattgacagcctcacataaattaagcattttattggttgttatttcataacttattaaattcatatcatttaaagtttcaataccattttcatatttttctttatactcatgaatactttttttaatagaataattaaattcatctaatgaataagaaattccatcttttctcatccctataatatatttagttccatcaagctgacattctggaatgagccctgcattaaaatgggaagcaagtctttttattagttcccaatcagtttctttatattgaactataagtttatcaattttcttatcatcagttatgttatccattgctaatacatttccattttcattatttaaaatatttattacatccatataggtgtaattttcatcttggaatgttctgaccatcttctttatgtccattaaataagttctgcttaaagcctctatctcaagtattcttacattgttttgagtatctatacttatatctgtaactataccttgaaataagttctttatattattttcattatcattaactgatatattaataaaactcttatcattagcttcttctacatatttgtcttcattttcttcacttataattcctcttattttaagctttgcatgttcatttatttctcgtactatttttagttctattattttttcaaaatcataccctgaaacagtgatatctttatattcatacacatattgttcgctcataatacccacacctccattgaatccatatatttattattcctcttttattactttaagcgtacaaatcatcttgtaggctatatctctccattctttataaacttcatatttacagctaaaagttcccattaatgtttttcccataaattctgcaaagaacattaagttatataaatctgcatctatagctgaacttttaaattcataaaatccaatgttttttgaattcacttcaattacaccgtcttcataaaatacattagcaggatttgtctttcttattatcattttcattccatttttaagttcctcaactttatcctcacttaatggactatcaataacatttagtgttatacatatgcttccatcatcattacactttataatttctggtctgctttctgatggatatttaaactttctatcttccatgctcatatctacaaaatcttttggtataaatatttttagctcattattgaagaattccatattttcaaattcataatatctgttacctatttttataggacctgctgtaatatcttctctttcttctctctttttagcctcatttataaattctattatcttttcatctactttcttatccaaattattcaactcccttatttatattttattacatttttatctttttttgtatataaaatctttgaatcatacaattataattatttaaggaaatatctttataatagagttctcttttcctataccatttataggtataaatcagcttgctaaaaattattctatctgatagctaaaagagttaatactttttaaacttaaagtattaactctttgtgttatatatatttactttcatgcagtataaactcttctaattattaatttagtttcatgctattaattaatatatatatctaatctaattctattcaaaataaattggttcccgacattcacctacaacacaatcaagcatttcttcgatattttcaccatctttacataaaaaaccatcagtatatctataaaatgttccactttccgtcataagcataagcaaattccccctatttgctattcctattggatagacaacatcatcgatatcatattcatcaaaaatatctctaaaatactcactatctaaattgttgccaatcgctttaattgcattaaattcaatcacctcatcaatgccaatagcttgcatttttctctgaaattttatttctaacataccatattgttgcaaaaaagctcgtatcttttgaggtatatcaatacttttctctttaaatattttttctattgaatcaatattaacatttcttccatttgtccaaccagcttgcatcaatctatccactgtgatattttccatgaaacctcactccttaattttatttattgggcatactaaagcctttaaatgtcactttacaatttgcacacggttctgcataagctccattatatcaaaaagaaatatctcctgtattcatatctactgccacaattatttttgcaggtttatatgctcctccgcctgattttgttataccaccattctttataaagttaattattcaattattattgtttaatccctcttacttaggaacaatattctcgtatagatagatgtttacttacaaccccttgaggcatcttttgacctcgtaactgagactgttacctcattgctgcaagatattgcgtataagctggatgttgatttaaatatttcaattcaccgtatatataaccaagatgaaactgacgttatcattgtaaagtctattaaatttactaattcacatagcggagctaataaacttcttgaacaaataactaaaagtataggaactttggaataaaaaatatgtataaaatatatctaataacagtggaaagaacctttttgacgcttacgattactacctagaatcgttgtaatgtaccattgaattcaaatcctttactacttagaaatcaatgcattaatgtctccaacatagttttctattgttttaggaatcttaccatcttccattagacttatcttgaaatcctcaattattttacacctacactttatcttcttgaatattttacatagaaaaacagccaatgcttctttccttagaaacattgactcttatcattgttataatatatatttactttttcttttagttacatctaactgaattattaatattatgctttaacttgctttatctattttattgatattactacattaatatctttttacccattatgaattgagttactatttaattttgcatctagttttatattagttgcttatttagtttttctgctttatgcaactctcctagtaatggattattatagtcattatagctatccatatatgctctcactccaccaattatattgattttatttatatctttattattttttagaatatctactgcattcatatatcttatatatatcagtttcattacaccacttttaatttcatcaacatattccatttcaagcttcttaatcacaatttctatttgttctaataacgctctttttatatccacttaattgtcctcctatctacttggtacttctcttatttcctttatccattctgatgaccatccttgtggtaataaaatttggtcaccatcaccttcaagtaatgctccagttttagtgtattgtttctcaactctaccaatatttattgttgtacctttaggtacttctataactgcttcatattgtcttgaatttttccatcctggaactaatgcagtattaatctttgcattaattctgtttcctgctggtgtagtagttacaaaagaaccatcaacttttgctccaccaccataagttctatagaaagtaatattctgctctgttacaacagtcctataatttgcatcagtaaatgactcacctatccattctggtaaatctaccttatcaattacttttaccctatcatcaattattgttgaatattttccatagtgagtagctttactcctccccttagtaccacttataatcttttctaactcttcatctaaaattgatgaacttttattagtaactttaatagcatttttatttgcaatttcacattcattttctgccattggtaatgatactgttgctgctgtcactcctgcaaaaatcattcctatattaagtaattccatttcttgttgatgattatcttgccatcttgccatgctagccagacacttatatactggtgttgatacccaaatatctgcaactttcccccaaaatccatctcctgattctccaacatggactctataaggatctgtatcaattggtttaacatttttactagcttttgttatatatgtttcatcttttttataacctgcaacatcagtttgagtattcatcaatgatttgttattactatcccttaaatctacattacttgtaccacttgcattatttcctacaccagctaaacattccccaattttacccatagcaccttgtactgcaccaacaactgccgcaagtgcaaccttaactgctgattccattgctgcttttgcttttttagcttctgctgctcctttttgtggatcatcatcaaaagctccattactggctttatcacttccattttccattacaattccagcattattataaaaatcattttctaatgatataaagcttgattcaccttttttagcttcaagtttactctttgcttttattgtaatatctccagcatatatcccaacataacctgcacttatgtttagtgaacttgaactacttaagtttattccacttccatcattgaaattagcacttaatcctggtcttgaaaaatttattgcacttggaagcatatcaagattatttccgctttctgttgaaaaatatctgttgtttacatctgaaaaactctcacaactacttccattctttcttatacaaccgatgacaataggatcttcacttctctcacttgaaaagtataaattcgcatttgttcctactataggcattgaatacataaggttacctgtcggtggtgcatagcggtaccatgctgctttatctttattctgagtctcatctatatcaagatgaagctttaccttctctcctgacacttccaatacttcaccttcaagggatataccttttatcttatcattataaagcttttcctgccatattcctctttctctgcacagtttataggtataaatcagctctcctcgtacatattctgcttcatacgaatttatgtagaattttttctgtttaaatactacctgcgctcctaattccattaattttcttgttcttattttataataaaagaaatctgtatcgtgaaaattgggactgtgaactaatgattccctatacttttttatatcttttaaggcttcataatcaatattatcttctattttatattctttgccccatggtcttccaaaataaaatacattatttgtatttattatatcacaatttatctctaaaccaatctggcttgctactctttttaagaattcataatctgtttctttatactgaaacagtggtctgcctatactcattggtttgtccattcgttgtgtgaatgaatatattttataatcaagaagtatcgtttttattaaatcatcataactcatttctgcatcttgaaatgatctacttttttcttttatgtctagctcaaagctacttgtatatgcttctatctccatataatatattccattgatattctctgttcttatgttttgtatcgtcccattaaatataatggatttttctttatcttctgtttcttcataaatacttatcttatcatcagtggaagcttcaattgcatacttgaaatttatactatcatctaataaagcttttaaatacagtctcccatgctcattaggattattagaaattttaatatcttctatttcaagtatttcataaggactttctacctttaacttatgaaatgcttccattctactacatccctccccatttctattggatttctaatcttcttgtccacttgttaaaaaagttattattcctccacagttagtaaacataattgaatctgttgtaagtgctggctttccatctacaagataatcttctttggttacctgccattctccaccaagctctaatttgcatttctttccattacttattaaatttcctttatcatctattacgtcaattctttcttcttcttttccatgcaatggacatactccaaaataacttatattttcttctgtcttatcatcagaatttaatattggttttgttgttccacacttttcttcattaacataacttccatgacttacaggaagatttatttttctcttattgcttccacaattacatttcatttcagcacctcgtacaatatactcacttgccaccctctcactcctttgctactttatttcaagtctttcaattgatattccttttaacttccgtctcagaaggctctctgctacatcaagtcttataactattactctctcagaactttcttttactttaaatatcttcttgtcttttattttatctttatccaaaattattttttctaatcctgatttattccagttaaactttgaatcgttatgtaaagtttcaacttcctcaaaaataggtatataataaatcttttgtttctggttattcctatcaataagcgcagttcttttaaaaattatattgcgattatatttttccattatccttttagtaatttcagaaactaaaaaagtttggacatctagaatatcaagatatacagtatctttggatgattttataaaaaatgaaatattatcttctattcgatccgcttttaaaggcgttatattctgagtatctataatttgaaaaaaattagtaatcctcggaacgtcagtatatcttctgtcctgtttcaataaaaaatactccatatctgcctcctattttctttatataatttactgagtgttaatcttgctaccactcatatcaatattatctgttattgttatacttgcacctgactgcataagcttaactttatcttttccctttattgtaacttctccaccatctatacttatgcttggagcagacattgaaatactgctgtcactacttattgaaatccctccgccatcatttaatgtcatagtgttattacttgaaattatattgattgcaccaggactcattactatttcttttccatacttggttccaagactttttacagatggatcgcttcttttttctgcattgctacattccaaatttactgaacttattgcatatccatttttttcatcagaatctggaaaatacaatctaattgcatctccttcctctggcatacagtaccatcctgtaccatctggagatgaaaatatagttgaatatggaacccactctgaattgctgtcagcagtatttgaatacccatcaatttttaatgatatttttacaacatcacttttacatgaaagtatttttccttctaaagatactcctgaaatcttattattataatattttcttactttaattgctttttcatcccttaatgtataagtatttagaagcactccatctattatctccatttcacatctgtatacatttaaataacgatctttaaaattaactgtgttgtataaatccataattatatttgtagtgaattcataaattataaagtttactgaattttctgctattccctgtgcactttttattttgtattcctgtattccttttgtaacagaataattaaattcatcaagactataaagtgaacttgcttcacctcgtcccatagaatacttaattccatcaagcctgcactctggaattacccctgcattaaaatgtgatgcaagtctttttaaaaattcccaatcggtttcattatactgtacaatcattttgttaatttttcttccagcggatatataatcaatcattattagacttgaatatgaactatttatagtattaaaaatgtccctatactgtatattatctccttgaaagctcctacttctcttttcaatatccattttacatgtattatccagtgcttcaatttctaaggtttttacattgtctacgctttttatagatattgtacttatcatcccataaaataaatctttaatctcacctttatcatcttttacagatatcttaataactgcattttcatttgcccattcaacacattgatctgatgattcatactcatctgaaacaataccacttaaataaagtttagagtgttcattaatttctcttattatcttaagcttaagaatcttctcaaagttatagggctctatcaaaatatccccctgcgtataaacatatcctgaagtcatctatttcatctccttcttcatactaattttcatcttctttttttactcttatagtattaatcatctgaaatacaatatcgtccttccactgcttatgattactatatccacagctaaatgtccccatcaatgttttttctttaaattctagtaagaatacaaaattatacaatgaatcatctaatgctggacttttaaaatcgtaataacctatttttttagaatctatttcaactatattctgatcaaatataatgtttgcagggttcagccttttgtttatcaaaatcatcatatcaagcaaattctctacatagtcgtcattaagaggactgtcaatcacattaaatgtaataacaatccctccagtactgttgcattttattatttccggtctattttctgatggatatttaaactttctagcttcaaaaggcatatcaaaaaatgtatttggaatacacatttttaattgaccatcaaagaactcagtttcttcaaattcatagaagcagtcattaattcttacaggacctgcacatatatcttttcttaattctttatcttccattgcatttatatagtccaaaatcttttcatccactttcttttccaaaactttcactttctttcttatatatactattttttcacattattaatcaataaaaatcttcttatatcgtcctttgcttcgtgttccctgtgagccttgtccatttgatacactttctagactctgaacaagataattataaagttgttcattggtatattcaccatcagtaatatttaatttactttttatataacttactattatatctttttcaatagtatctctactctgcacgcacaagcatgcaaaattaatatcaaaactttcagtaagatcatattttaacatttctcttccaaaagttcttaatatatatggtgataaactagattctccaattgccgcaaaaggtgcattaattatatttacagtatcaaattcagttgaaaaatctataaaacttacatattctcgtctaagccttgcaccttctctcaatttaaacctgcaaagctccatttcgccatctttaattgttatattttcagtcataaatatttccgcttctattcttacgtaatccccctcatcatgttctggaaggaacttaactttaaggcttgttaagacattgttatttgcatattttataggataatctttttttaaaatataaatattttttccaaactttatgattccttccttaacgacaatgaaattatccattacttcaatatcgcaccctgcaataataccatctgagcattttccatattttattttcattatttcccttggatagtctcgtaaagattccaacattccgctttttaatattcttccttcattaaactttggataattaccaataaacaaaattctgctacctccaaatatctaaatatattaaattattatttcaatccatcaaagaaattcttttcccactcatcattttcaaaatagaagaacttctctttcccaacatataattcttcatcctgccttaagatagctaaaacataaaatccccatagttcttcttctacccatgcaaaaaatttcacttcattattttcaatattatctgtttcatgctggtttatgttaggatataaatttccaattgtctttgcatctgtcttttcaagttcttcacgtctaaagttgtatgcatattcatatttgatagcattatcaagagattttaagtataactttaaaataattttgtccgcaaatcttgaaattgtacctttttttatttcttttcccttaatcaatactttttcctctcctgtatgagtaaatgcggtaacaatatatggaagtgtaggagtattgctttgtatatttatatctgcatatccaaagtttttgtcatataaatatcttaacgctcccttaatacatgcaagtttaagctcgtattcttcttcagatgccctcttactcctgtttacttctattatttttccaggaataaattcctttaatgcatctctaaatatctcaaccttacatgactgaccagtaagctttattaatgaatagtcgtacaattcatcattttcataaagcttgtttaaaaattttcttattatattataaacatcaccttttataagtgttgtaacttcatatatattaagtaaaattgaaggagcctccttaacaatctttaaatttccattgttcatatatgaaagtttccatttatcaaacaatatagtatcatcttgtgcttcctttggtactgatgatgtaagtgttatatttagcaaatcgggattactgaaaaatttcttttttactctttcagcaagatcaaaaagaaaatagtaattacttcttactttacagtaatcttctttacttcttgtctcatatacttgaaattttgtaggtattatttcctctgctttttcatattctttgtttaaactactatatagttcagaaataccatacttgtctatacttctaaaaatatccttattaaattcatcaactatagctttctttattgtcatatctctttttgaaagtgcatcagccataagaatttttataaactgcataattctaaatgtaagattatttcctccaaaatccgtatcaccattttcatatgatgtttcaatgttaagttcataggatatcctattattttttatgttgaaactacatcctgaaagatcagtggttccacctccgcagtctataataagagctttataccactctccctgtatatatttatttttttcaataagttctgatactgtgttatataaaacagctacactttcttcaagtatattttcgctttctaccacataatcacttagaatttccttaaataatgtgtgaaacttgaatctttgctttgatggacatgatatatatatcttcttaaatttgcatttaaacctttggtctgcaagagatataatgtggagaaggtacgcttttattatgtcctttcttttaataaatgttgaagtttcatttgaatcaataaccttttcttccttttcaaaatcactaacccatctttttatgtcataaaaaattgtaagaccatcatctaaatatcttttctgagatattttcatagcatcatatccaaaactatattttatatttccatcttttatttgttcaattgctacaatgcttggtattagaggtgttattttaagaatatcctgtgtagtgtccataattttaataagtttaattctttcttctactgtttcggaattgaaaatttctttatctatataaatccctgccgtagtattggatgttccaaagtctatagcaagaggtgttactgtctcatttaattgctttatctcaaattgaagaataggaagactctttattgtcattaccttttcactcaatgttgattcccctgtatatattttaaataataattcagaatctttttctgaaaataatagcaagctgtagtgtctactttctgattcaaaagcagcaacactttttccttttgtaagataataagtgaaaccattttctatttttatcttttttatattgaatactgtgcataccctataactatcatctaccaataatacgttaccttcacataattcttctgtactttttaaaacataatcatcatatatatcaagatcaatttcctcataaatcgtgagttttcctggataatctatagttttgtttttagcaatatgcttttcactcttttttataaacttctcgattctttctaatccatcttcattaaaaaaattgattaaaagataatccttttcacctctgtatttcataatcagccttataagttcttccttatctaaaggatttactatactcttgactaatttttctctatcacatatttcccttaattgaaacgtagtcatgagtcttaaatctttttccttatatgctcctttatgttcctcatttatattatgcagtttgtacgaatataaccccatattttcctccttcaagcacttactctactacaacaatttcatttatcatcattgtatcttctattcctataattccaaaatgtatgtcccagaataatttaactgaaacatttataggaagaaaagtatttattacagtacttattctacttatattttcttttgtcttctcaacaccaagataaatatataatgtcttgtttgtgttcttattcatgtaaacaatactactattaaatatatttttaattattttggtaaatagaaataatgaacttcctgctttcgacaatgttaatattccatttaatattgtgtctaactctcttttttcaaattcttttatattttccgcaagttcatgtccatatactctattttctatatctctaaataaaaataacttaataaattcttctttaacaatacctgattttaaatcgagttctccaagaaaatgaagaagtatatctaaaagtacatctcttatttctttatcttcctgaagatttatatcaaatagttccctaaatattttaaaatatctatagcacggattaacttctattggaatatctttgtttaagaatgatgtgttaagacatgaaaatgatgtttccatataaggactacatatatctgcatttttaaattttatatcggattttcttattccctgttcttcggcttttattaaaatatcccatatataattcatatcaatctaccttcacattcatattcaggataaataaactgcacttctgatataataaaacttagaatatcataatttaaataattatttttctcttgtgcttcaaatgataaaatcaataccttttttacattactgtccctaatttcatcaacaataaaatcattgacttcatatgtctcttttaatgttctatccattatatttatcagctttgtatccttaaattttaagaaacgagatacttcatatgaatctacaacacgtgccaaatcagtctttgtttttattttttgagaaatgccttgaaacattctattagaaaagcttatcttcaccttatttgacataatttcataatcatattgttttttctgcatcttctgtgaagatattatttcaagtacattccacatatcagatttttccgtatctgatgatactattattgctccttctttaaacataacataatttatactctcttcatcaacttcaaccaaatatccattacctttagctacttgaatattatgttcaaaatttattttatctacacatggtacaggaaagcttgtagatttcatagcttcttcctttacattccacataggaaccatatcatatcttatatatttactgtattcaccaaaatcaatatcaattttttctattttttcttctgaattcagttcttcctttgttcctacaagtattacatttgcaaacttatgtatatatggattatttatagttgaccatggtatattattatttataaatattctatataatctttttattttatttatataatctaaatttttcttaataataaatctagcttcatacttctttttattcgttattattacaccattaattgataaatcactctctaaaaacttcttaaatgtcaaataatcacattccataaaaacattaaaaagagaaaaacttcgcttttcttctaatgaatttaaaatatcctttatttcatacactggttcttttaaatcttgtgggatcattgtaaaaagaaactcatctgtcagatcaattttgtttcttttcataacagttgcaaatactttatatttctcactttcatattgaacctcatcaaacacctttttttcaagtaacgaaaatttcttttcactttcttcttttaaatttacaaagaccccattcagaatgctttttaaaagcactctgtctttaagatcatcaatttgatttaatttttcataaatttcctcatccgtcataatcattccccttactatttacccattactagatgatgtagtattcaatgtcgatattttatcactcatattttttgattcatctgtaaacccaagagaatcatataaatctttagcaacgctatacaaaactttagcagaattaacatctccacttgccagtcgtgtactagcttcttctacatatttatcagcttcagatttcttgtctgctgtttcattaatcttctcatccataagtacaatctttttctgaagttcttctagaatactataatcaccagaatccttataagcttgtattgctagagtataatacattcttgcacttatataatctcctgcaacatagcttgtatctccttgttttctaaattcagcagccttttgaagaaggtcatctgctttttgctcttctttttcctttttttcagcatccttttcttcttgttcttttgctgcttttttatcgtcttcatctttttgagtatttttagctttttgttcagatatctgctgcaacttgtccatagcctcttttctctcatctttcatatatgcatctactgaaagtttctttgcttccatatatgatgattccgctgaatccaaatcaccatccgacatctgcttgtcaccaagagttaatagatccgctacatttacccctttttttgccatttcaatcttattatcaatataatttcttgcacttattgttatgtcatcgcatgaatcaagtgctattttatattgatcaagtgcttcctcaaattttccatcatttaataatttatctgctgacattacattatcagtaaacttttcatccttatcaaatgtattcatatcttttttcaacttatatttttttgcaatatcaagggcattcttataatcttcatttgccttttcaaaattctgattatttatgtatgtttctgcactaaccttgtactgattcatttggtcaattgcatctaatttcttatgtcttttgaacataaatattcctgtaaatattgctattacgattattattggaatcccaatacatatagctcgttttatttttttctttttatccggatcaagataacattttttagcaaacgttactgcaagtgtgtagttatctaaatgtttaggttgtcttgaaagtattatgtcttcaacattgtcaacaacttccttgggttcctttgcaccatctaaacagtcttcaatttcttttgcatcacagttttcccatattccctttgttgcaagcgcaaagacatccccatcttttaacttgatttttcttgaaattttaggataaggaaaatcattctgtccaagaaaacttgtaagattgtttctttccctgtgacttgccatcttatcaagtggcacatcccctttttcatatagttcctgggttacagaataatcttcgctttctttatttaaataaccatctttaaagtaataaaaccttgtattacctataactgcataccgaatttttttgtagttagttacaactactgtcatcgaagccttaagtcttacaaactttccatttgaaagtacttcttcattaactccttttaaatattgtgcaagtatgaatctattcattgtaggtttatttgtaaactctcttataaattcagttacagctattttagcagtttctatttccttatctttatcaattccatcagctattacataacatgcataattatctaattcaacaaaagcaaaataatctttgttttgtaaatggcttccttcttcagaaacaaaattcgttaaaaattccgagttaatttttctcatatttcatcacctagctctttttatttagaagaacaatatttaataagtacgatacttccatttttcctctggcttgtgttttctattatttcatcacaagcttcttctatattgcttttccctttctttagaattttctcaagatcaatccatcttatattttcatatattcctcttgtcataataacaactatgtcatttttataaagagttattggaacattacaaaattcaatatggtcaaatggctcttttccgaaataatataatacctttttattatttattgtacacactgcatcttctttacttatatgaccttgatagtattctttttttgctatttcatccattgtatgcccttcgctaattcttacaagttcactctttctaaataccgcaagcattacatctcctactaatccatagtacagtttatttttattaattattgcggctgtaacacttgcaccacccttaccttcttctattctagttaatacttcatggttggttttattaaatgattttttaataaaatagtggtatctttcatttatctcttcatttttaaacattctacctatagtatttacacatatattactagccgcttttcctgcttcattaaatccaaatccatcagaaacaattgctaatgtttcattttcttttgttacaattttcacattatcttcttgaatttcttcttgacctataataattctttcagttatctgtaatgtttttttatttaaaaaatatttaataactgtttttaaaataaatagaagcagtataactataactgcacagactattatattaagctttaattcaaaattactatactgcataatttaagctcctattcattatcctgccattcaaaatgctcaccacaaaatggaacaaatataaatttactctttccaagctcaattacattataagaagaaagttctactggcatataaactggttctccatttagatatgctattcctgaagagtctcctggaagaagtacattatttttctttttaggatcataaactacaattgcgtgatttctattagctatactgttatctccaattatctgaatgtccatatcatcagctcgtccaataaaattctttccactttttattttgtaatcttttcctactcttgtcccttctatacatacaagccagccacatactggttctacttcttgatataaaagattcttttctatttcttcaatttcttctggttctatctttctcttttcttcaagcttttttgtatctatattacaatatggacatatacttccataccttctttcactaaacatatgaccatttggacatcttataagtcccataattatcactccattcataaaatatataatacgattattttaataatagttttatttttgcaatatataaaatatcaccacatttaatttcgcaaggtgtatcattaactaatctatatatgatatcatcatctcttttttttatcctaactccatattctgatgataaatcctctacgaaccactttcctgctgcgtaattgagtactgcatgtttatcatcaactagatttgaatatattgaggaatttaaatctatattaactttttcatcttttgtattctttccaattaataaagatgttttatcttctatattccataaactaacaatatcattatcttcattaacaagttctactgtctttatcctactaaaatcccgaggcttatttttagcttgaaattttatatatatattaattaaacatattgttccaagtactattacaactccaataatcaatgctcttgcatatgtatattctattgtataatatgcaataatacacaataaagtcataatcactgctatgagtacatttatcatctgcatgcttatgtataatttcttttttatactgttattttcatacaaggatactccctcccctatttctttttcatcttaaaaaagctttcaaacatattacttgtatctattggattatcttgcttttttaatttatctttattaatattatttgaagtcggatcaaagccaaaaaaatttgcaaaatattggtttaaatcttccatgctttctttcttacttctagtcttttcactaaaatcattatcagttttattatttttactgttttcatttttcttcttatgagcatttttaaaatttgttttcttctcatcataacttttttttgaatcttcattgcttaatacttcataagcttcatttacttcttgaaatttttttatggcattttcatcattgccatttctatctggatgatattttttagccagacttctaaaagctttctttatctcatctttactagatgtttctgatactcctaatattttataataatctttcactattcacccctaaatatctattgtttattcaatagataacctctgccctttcgcttaaactattttattttataagaaaagattttccccttgaaatattcaagaaaaaaatcatttttctgtactgaattaacaaatgttatatagcacaaaaatttattcttattataaataagctcgtgcacatctaacttaatagaaattatagcttgtcctcaattatgataataattatataaattgagaacaagccaaatgaaaatatgcctaatttagactaatttcattttttatatgtgtttcaatgttaattaagcgctatatccgccttctattgtaaccatatttaatttatctttcttttgtcttaccactaattcaaatgttccaataccttctgtatcaccatagtgttctctatagtcaactacaaatgcattaggatacgtaatttttcttattacttgatcagctgaaattacatctacagttacttttctgtaacaatctgctttttctgctggtactaatgaccaagttcccatttttcttgtagagtcaaaaggatctccatctacagcagttaatatttttcctgtaataaccattgtagttcctacatcttttgaacgtgcattagtatcttttggagtatctgttgtaaattttactgtttcaacactttctatactaaggtctattgtttcagcgccttcaatctttactttaaatcccatatctttctttcctttctttatacactttttaactatcagctaaacttttaaaactattcagcaaatccaccttcaaatttaacagctttagttttatccttcttttgcttagctaaaatatagaatgtaccaacaccttcttcgtctccatagctttccttatagtcaactacataagcattaggtaaagtaatctgtcttaccacctgtgaagcagaaatcacatcaacctttatatttctataacagtctgctttttctgctggtactaatgaccattgtgctagcttgatagtattatcagctgcttctccatctactggtgttaatattttcccagtaattgctagtgttgttcctaaatctgttgaacgtgcattcgaatcatctggtgtatcagtcttaaattctactgataagatactctcaatgtttaaatcaatactttctgcaccttcaatttttactttaaatcccacgtctcgtgtcctccctttttatttaaaaatttataattaaaatagatatttttgtatctataaaaattaacctaattaataatatataaattcatttcataacgaaattactaatagcaattgatatgttaatatttcaactactcttttaaatttatatataaatatcttctataataaatgtactgtaatttaattaacttgcatcactacgagtaatctcaacttcaagatttttaacattcccattaaatacgagatctatattacatgtaccattcttatcatcaataacaaaattaatgtcatctccatcttgaattattgcatttgtatattccttatgggctgaccactgactctttacactagttggattattactaaagaatcttataatattgtcttctttaaagtcattagaataaaatcttaatattctttctatataagttgttactaatgttttatataatgattcaaaatcattttctactgcttgcatacttcttgctttataaacagttatttgatttatctcttcaccatttagctgagcattttctgatgagaaaataaacccaaaattctttctatttattgaattcttaatatcattagtaaatcctgatatttcttttgctaatgttgttttaacttttagaggattatcttttgattcaatatcaaatcttaccccaggatattcactaaatgtatttccacagaattcctttaagtattcagggcattgatatgcagcaacaattcctgctgctatataagaagctccaatatacactccttcaatccacaatttaagaatatcttctttttctcttgatagttcagcagaaccactttctgaaagtatcatcttcttatccaaaatcacaccagatttttctttaggtattactgtgaaattaggtaaacatggaatagcgaattcactatatgatttacgcaataaagatgaacatttatctacaaatttatcaattccagctgttgcaatattattaaatgttgtctcttcctgtgattcaaaattaaagaaaatttgcatacgatatttttgaacgcattctaaaagtattgtaagttcttccattgtattgcaatctgttttttctacttgtttattagccttaaatctttctcttctaactttactttttgattgagattcaagttcaattgagggtacaataccaaaccaaattgtatttgaaaaatcatttttgtcatttactgaacttaagtaagtatttaatcttggtaaattcaatgaatttactaatctactaagctttgtattagtaactaacaaagtaggtttcatccctttattttttgcttgatattgatcaaagaacatctttacacctaatagtttttcaattaaaggtttaactgtctttatgaaatcatcttttgcacttttataaaactctaaataagtgttataattgccaacttccttatcaatatctattgtactttccatagttgatgttaaaggacagaaagttctaacaacaaggctcttaacataatccgatttaacgtcattaacatcatcataatcatcttcaaatgcttcaataagtccagcatttgcattatcatctattgctatcagtgctgtttcttctttcttaggagcttcaagaacttttagttctccattctctcctaagcttaaaactccagcttgaaacgggtcatttccacttgcactatcatctgctcctaaaagaagtcttgtttttatatcttctattgcaagtggaagcattgccattatattattatagttttggcttgcctcttcaaacatatcattaagcttgtcccctaagtctaatttaagaggatcttcatcatctaaggaatcatatttaccatatgtatactgaatttcctttcttgtttgtttaatatcttccattacttttttaggagatatcatatctaataaattctcaaatttaaaatcaacatttgctattccctgtgctctttttgtatctattaatgtaaatagcattttcaagaaatcatttgattgatttattggaatttctgttataagctcatcagataacgtttctggtttatttaatgtgtacataactttttggttattggcattgtaaaacgaatatactgtaggtgcaaatttatctaaaaattcatcaaaactgcttaccaaaagactttcattaatttcttttattttatcgtcgtttaaactatttaaaccttttgtatctccaaccaatgttaataaatctaatctttctggatttatttcctcaaaaagcatagttcggtttgtttgttgtataacatccatttttcttcccctctcatacgaattatttatcaattaaattccttaataggaatttaaaccgtatttatccattttaatggatatatttacattatattgttatttttttgttttttcaatagttatatttgtttttttcacatattaattaatatttatttcctatatttacttttttatattattttatctattatttagttaattcaataaagtaattaataactaaaaatacaataataaaaagctgctttaaaacttatttgtcttaaaacagctttctattatatttttattacgatagtactttcttagcaatttccactgattctctagcatcttttgcatagaaatcagcacctattgcatctgcatattctggtgtaagtacagctccacctacaaaaacctttccctcatatccatcttctttcaaggctttaattgtctcttccatgcttctaagggtagttgtcataagagcacttaatcctattaatttcacattgtgtttttttgcttcacttacaacagtttcaattggaacatcctttcctaaatcaatcatttcatatccataattttcaagtataaccttaactatattcttacctatatcatgaatatcacctttgactgttgcaacaattatttttccttttgatattgtctcttgattatttttagaaatttcagcttttaatactgcaaaggaatttttcacggtttctgctgcttgtattagctgaggaaggaataacactcccttttcatatttatcaccaacttcatctagagctggtattaaatattcattaactatagttagaggttcatattttttcagcaaattagttgttgcagacttagcctcttcttttaatccttttattacaatactttttaagttactttcaccattttctgattgtgattttattatatttgttttatctgcattttttatctctacattgctttctattgtaacattagcataattttttatataatgctcagaacccttatcataattataaagaacattgtaggaatctataacccttaccatcccactttcattagggttcattataggaagatcaaggccatttgcaagtgctaatgctaaaaatgtttcatttataagttttctgtttggaagtccaaatgatatattagaaacacctagtagagtcttaactcctaatttttcttttaccattcttactgcttttaaagtttcttgaacttcttcctgttgagctgaaactgtaagtacaagacagtctataaaaacattttctttatttattccatattgagccgctttatcaactattttttttgctatctcaaatctttcctctgcctttttaggtattccactttcacttaatgttaaaccaacaacattagctccatactttttaaccattggaagtatattttccaatactttatcttcaccatttactgaatttaatataggcttaccattataatatcttaagcctttttctattgcatttttatcagaagaatctatctgaagtggaatatcaagtattccttgaatttccttaaccaccttctgcatcatctctggttcatttatttctgggagacctacattaacatcaagtatatgagctcctgcttctgtctgtgctactgctgtatttaatatataatctaaatcatcattaataagtgcctgtttaaataatttttttcctgtaggattaattctttctccaacaattcttataccatcaattttaacaacttttgatggtgtacatactgctggataataatttttttctctttttagaatacttttaccatcagttctttttaccagctctcttatataatcaggtgtcgtaccacaacatcctccgattatacttacaccactatctataaaactgcataatgtttctgcaaattcttccttagtaacatcgtactttgtttcattattaactgataaagtcggaagacctgcatttggctgaaccattacaggtatattcgataatctgcatatttcctctacaactggtttaagttgcttaggtcctaatgaacagttcacacccaatgcatcaacaccaagtccttcaagaactaataccatagcctctggaaggcatcctgtaaatgttcttccattttcctcaaatgtcattgtacatagtattggaagactgctgttttcttttgctgcaagtacagctgccttaagttcatacaaatctgtcattgtttcaaaaagaataacatctgctcctgattttgtaccttgaattatctgacgtttaaatatatcataagcttcatcaaaacttaatgttcccattggctcaagaagttcacctattggtcctatatcaagggctatgtatacttctttttcacctcttgactttttagctatattaatagctgcatctacagcttcttcaacttctagattgcaaagtttaagctttctttcattagcaccaaaagtattggttgttattacattagctccactttctatatactctctatgtatttcttcaattatatctggtgattttatatttaatatttctggattttcaccaatttttaatccttttttctgaagcattgtccccattgctccatcaaatatcaatatcttttcttttattaattctttaagccccacaagtttctccttctcttctgaaactgcaattcttgtaattactgcagttttcacaactttttttatttattttagcatctaaacttactattcctattattgccgtaacagatttccttggaaataaaagattattttctgataccattaatccaattttcttctgcgcatctaaaacacgtaaaaaattattctgaatatcaagtggaagatccccatatcctggactatacctaaaggttatcttcatacctttttcttcagcttcttttcttatcttttcctctacaatatcacaaacctcttcaacagcggtagttgcacatgcatcaattataagtgctttcgtaagattaattttttcatataaacgtgttttcttttctatttcgtttcctagtgttactgccataagaacacattcattcgaagcacttaaatgttttttaatatcatttccttgcaatattaaattcgttccagatacctcaattcctttttctgaattggatatacttttatattcatataatactctaggtgttattatatttttaacttcttctctactagtattaatcatatgatccattttttcatctatttcctgacctttataccccaagtatctaagaacttcttctttgttaatctttaattcaaatgcactcatcttatcaccaacttctttagttaataattacatataatttaacactttctaaattcttttttctcattgcttattcctccatacttattctcttaaaatctaattatattacaataaataaattagtttatataacaaaaacgcctaaaggtattccttaggcgtgaagctttctaaaattaccttatctaccagtcataaaaactgcaggatttggcacctcatattatctaataaatattggttgccgggcttcacagggccagtccctccaccactcttgataagtattctaattgtatttattgcatttattatatatctttaccttaattttgtaaagaaaaatattaaaattttatctttttattaaaagtaaaattattgaaagcacgctgaaagataaacttatcagcattatgtagttaactatctgttttggagaaaatcccttttcttcaagtctaaaatgaatctgacttctatctgcttgataaaccggctttccttctgaaaatctttttaatataacaaataaattatcaaatataggtactgcaagtgctaatataggaatgaacaaacttaatacagttgcttgcttaaatgctccatctaaagctgtcacacttaaaataaagcctaagaaattagctcctgaatctcccataaaaactttagcaggatacttattataatataaaaagccaattatacttcctgatagtattatagataccatagcagatggatcctgctgacctagtataagtgctgctacaaagaaagtcattgctgaaataagcgataagcctcctgcaagaccatcttttccatccgaccaattaataaccgtagtaacaccaaaaatccatgttattgtaagaataaactgaattgttccactaagcagaataaattgagacgtaaatggattggtaaatcctttaaaaaatattcctgctttaaataccaatacagctgctaataattgaattataagtctaggaaaaataggaaattcttttccctttgttttataataatcatccacaagcccaatgataactattaatgttgctcctataaatatgactatctgctgtttcatgtcatctctaacaaataaaaaatacgaaacaaaaaatcctatatataatgcaatccctccacataaaggtgttggagctttatgctgttttctcttattaggcttatctgtaaattctaatttatgagacagtttcataagaaatggcatggtaatcattgaaaatactaatgcaattaccattgctaatatataattcatcttctctactccttagttaaaatcatcataattttataacattttgagttttctacccatttgattatactattaataatatagtatatcaattacaaaattattaaatccatatacttatctaataaattttcaactaaaatattaatttccaattgactatatactacaataaagagcactacaaaactgcagtgctcttattataataagatagtgcttatgaattataaaaatataattacctatcttcaatatttaaatctagcctctttgttcaatcatgctcttaactttcattaatctagttgtagcagatctttcattttcgtctagtctcattctaatgtactttatagtctcttgaagttgaggtattgtcatatattcaagagcattaactcttcttctagtgctttcaatttcgtcagccataagttgacatgacttttctacttctgcaagctctagtaattgtggaagaattccataaagttttgaaagtgtatcgtcaagttctgaagatgtatttgcaaatccataaggatatatacttccttcatctccttcaagttgtctcttgaagttcattacaggaacagatacactcattacattcttttctccaacttcaactgaaatcttttctttgggatatataatagcttcttctaagaattcagaactcattacggcacttgccataacgaaatcttttaaagatccttgaagattatcttcaacttcttttcttagtttattattatatttaacaaggttaatgaattgtctcattaattcatcttgtttatcctttaaaagtttatgacttctagaagatgttgcaagtcttttcttaagcttagagagttccattctagtaggattgacgttcaacttagccatagactattcttcctctcttggcagatatttttcaaggtattcatctctgattctcttaagttcagttcttggaatcatctttaataatttccatcctaaatcaagagtttcttcgatacttctgtttgtactgaaaccttgtgaaacgtattctgcttcaaaagcttctgcaaatttagcaagtttcttatcagtttcagataaagctgattctcctaagatagctgataattcttttgcttgcttaccttgtgaatatgctgcaaataattggttcatagtatctgcatggtcttctctagtctttcctttacctatacctttatctttaagtcttgaaagtgatggtaaaacatcgataggtggcattaaacctttcttgtataattctcttgaaaggataatttgaccttctgtaatatatccagttaagtctggaattggatgagttttatcatcttcaggcattgtaagtataggaatttgagtgatagaaccttctttacctcttaatcttcctgctctttcgtataatgtagaaaggtcagtatataagtaacctgggtatcctcttcttcctggaacttcttttctagctgctgaaatttctcttaatgcttcagcatagttagtaatatctgtcagtataacaagaacttgcattcccttttcgtatgctaagtattcagcacaagttaatgccattcttggagtagctattctttcgatagctgggtcagatgctaagttcatgaatagaactgatctatcaatggcacctgttgatttaaattcttcaacgaagaattgagcttcttcgaatgtgatacctatagctgcaaatacaatggcaaacttagaatcagaatttaaaacttttgcttgtcttgcgatttgtgcagcaagctcttggtgaggaagtcctgatgctgagaaaacaggaagcttttgtcctctaactagagtgttaagtccatctatagcagatattcctgtttgaataaattctgatgggaaatctctagccatagggtttatagcttcaccgttaatatcaactcttttttcaggaatgatgtctgggccattatcgttagatctacccataccatcgaatactcttcctaacatatcttcagatacaccaagttcaagtggtctacctaagaatttagctttagtaccctttaagtttattcctgaagatccttcgaatatctgaaccattgctttagatccatttatttcaagaaccttacctcttcttttttcaccagtatgaagttcaatttcaactagttcatcgtacttaacgccttcaacaccttcaacaaccatcaaagggccaacaacttctgtaactgttctatactctttaagcatttgctacccctcctttgcttattaggttatccattgcttcttttaagtctacagagatttgatccatcttatctagttcatcctcatgtatgtacttacttcttgcaattctatcttttaagtcttccatagccattatatcgcttaagtaaactccagcttctaatgctctttcagcttcttttctatatcctaatataaggtttaacatcttatattgtttctttaatgatgtataagtatcaatttcgtggaaaccattttgttgtaaatagtcttctcttattgacttagcaacatctaattttaatctatctttttcagataatgcatcaataccaacaagtcttacgatttcttgtaattgtgcttcatcttgaaggatagtcatagcttctaatcttaaagctccccagttatcagcaacatttgaattcatccacttatcaattgtatcagcgtataatgaatatgatgttaaccagttaatagtagggaaatgtctttgatatgcaagttgtgcatcaagaccccagaatactttaactattcttaatgttgattgtgatactggttcagatatatctcctcctggaggtgatacggcaccgattgctgtgatagaacctattcttccaccgttacctaaacattcaaccttaccagctctttcgtagtagtcagcaagtcttgaaccaaggtatgctgggtaaccttcgtcaccaggcatttcttcaagtctaccagacatttctcttaatgcttctgcccatcttgaagtagagtcagccattattgatactgagtaacccatatctctgaagtattcagcgattgtgatacctgtatatattgaagcttctctggcagcaactggcatgtttgaagtattagctataagaactgttctcttcattagagattcaccagtcttagggtcaataagttctgggaactcattaacaacgtctgtcatttcgttaccacgttctccgcaaccaacgtaaacaactatttcagcgtctccccatttagctatctgatgctgagtaactgttttaccagctccgaatggacctgggatagcagctgctccacctttagctactgggaagaaagtatctataactctttgtcctgtaagcattggctcaactggattaatcttagaattataaggtctaccttttcttactggccatttttgcattaattgaacttctctgtcaccttttgcagtttcaacaacagcaattgtttcagttacagtaaagctaccagctttaatgtcttttatttttccttcaacaccaactggtatcattattctttgttcaactactggagtttcttgaactgttccaataacatctccagctttaacttcgtctccaactttagcagttgctacaaagtcccatttcttttctctgtttaatgatggaacagaaacacctcttgttaagaagcttgactgtgcagcctccataaatgcatctagtggtctttgtattccatcaaacattgattctataagtcctggtcctaattcaacgcttagtggttctccagttgtagtaactggatctccaggtcctattcctgaagtttcttcgtaaacctggatagaagccttatcgcctctcatttcgatgatttcaccgataagtcccttttctccaaccttacatacgtcatatatgttagcttcatccataccttcagcaactactaaaggtcctgaaactttaattatctttccggtcttcaaattactaacctacctttctataaaatattcatgccgacagctttttctacgttatcgctgattctctgcatacctatattaagcgatccttgattgcctgggattaatataatagctggaagtactgctttattatatctttcaatagtttcttcaatatgctgtgcaacttgctcagttacgaagataactgcgtagtcatttctagctaatgtatcgatagtcttttttgcttcatcatgctcaacaactggaaatacatctattccaagtgctttgaatgctaaaacagaatctttatctccaactacacctattttcttaaacataaatatcacgcagcctttctcttactacttccgcagaaatattattgagtttgccaaccattatgattctaataatcttgatttctgtttctttagcataaatataagctagtaatggttcaacaccaaatggtattatttttgcatctttcatcatatccataacatagttatcgcctaacttttctaataaacttacagaaccagtcttcgtataatactctataccagctctaataaattcagcataattagtatacgtaagctttgttgatatgttttcagctgcatcattaagcatacctaataacttatctttatctatagaacctccttcaataataacagaagcaaagaattctctacctttgttttgctttttaactcttaaaagagtttttaaatttgtagaatctattaaagcatctacatatttattaacaaagttatcattaatctcttttttgatttctactaatgatttaaacataaatttatctaatataatatcaatcatttgtggatcattagtattttcaaaagatatttgtacttcttctacagcttctctcattaaatgaggtaaatctgaaagattgtcattttctataatgttctttaattcattacaatctattgttccaactggaattaaaagatatgataagtcctttttaagaaacattccttttaaaattacttttatattttgataatcatatttaatactcattaaatcaactagagattttacagggctaatttcatacattacggtaaataatctttttaattctccacctaatattacttcatagtcctctgctctcttaacatttgtcataacattggcatactctgtttcctgaagaatctttaaagtttcttcagcagaatgtgaatctatcattctgtctatttttgctttatcaaggagttttgtctcgtatactctaagtctaggtataacttgactaaattgcatctcatccattagttaacctccttaactaaacaacactcttgctacttctagacttaaatcatcctttattgaactaaccaaagcttcaaaagtattatttatttctatgccatctttttctaatatgaatccacctctaaaatcacgagtgttttcatctatttttatcacagcttttttatcaagagctttattgatttcagcaacaaaggcatcatcaataactttctttccttctgcatttaatataaggttttgttcaccttcgatttcagtatttaaaatcacttctttaacaaagccttttaaatcatcacctgagcagtttgaaagttctttaacacttgtttcaaaaacttcactaattactttttgttttgcttctaatttttcatttctagcgtgtaattgtgctccagaaattattctttcttttctagatgcagcttctatttcagccttttctagcatagttttttcaactgagctagcttcttgttgcttcttgctaagaattttatttttttcattctctgcatcgcttaagatgactgcctttttagcttctgcatcttgtaagattttagaagttaaattatttaaattagacattacctcacatcctcatcttaatactactaagcttttttatactatgcgatagttcctgcagcattaactaataagaatgatacaacgaatcctaataatgcataagtttcaaccatggcagctaataccatacctttagttgtgtgttctgggtttttagctaatatttgaataccagcagctgaagctttaccttgagctattcctgaatataaaccacagatagcgattggtaaacaagcaaataataagtataaaccttgagctaatgaagtatctccacttaatttaaagaatgctaataaaccaataacgaatccataaagaccttgtgtacctggtaataattcaagaactaatgctttaccgaacttttctggttgttctgctaataaacctgctgcgctttgaccaacgataccaacacctttagctgatcctatacctgacatacctactgcaattgcaactcctagtgctccgaacaccattcctccaaaattttctacgaaatagttaatccaactcatttccatttttaaattcctcctactctcttgttaaattaatatattcattttgtgtttcaaatggcttaaaggcttttcctccaccatcatagaactttccgaaatattcaacataagttaatcttaatgtgtgaacatatccacttaatagtgatagtaataagtttactgtttggaatattataaatattaatggacctactaagaaagctccaattggacctggtaccatgttcataatcatgttaacagcacctgcaatagatcctcctgataatcctatagccataagtcttgtataagaaactaaatctcctacatatcctgtaatattgtataattcatataaaccttgacctatcttaccacctgcactcttcatcattctaccttgagtaagaacaatagctaatgctcctataatagatcctgctataccaacagttttaagtactggtatttcaaggaacattccgcctgccattaatccaagtgaaattaatgtaagagcccatgatccagcatccattaatgcatctaatggtctaccaagtttacataatacatatgctttcattcctaatccgaagaatatttgaatagcaccaaatactactgataatgctagtatagacataacatctgtattagtatctaaaagtcttggtaattgaagtttaaataaatctccaaaaaatgctccgtaaattgctccaaatgcaattgtaggataacttaagtaatggaagaacttaaccattttcttcattccatcatcaaagttaaagaacttaagtgcaagtattgttccaattaacataagaagtccataacccatatctgctaccatcattccgaagaatattaagtagaatggtgccactactggtgtagggtcaacttcattgtactttggtagtgcatacattgatgttacatcttcaaatgctgcatttaagtcattattttctaatgctattggtacatcatcaatttcttcttcttttacatcttcaaagtttaggtaataatctgctcctaaaacttcgtcagctattttagtaaacttttcattgtgcttaactggtacccaaccttgaattaatgaaacgctctcagtttttaagaacttatttgtaacatgttttcttccaactaggttgttatagtactcataagctaactgtaatttttttaattcatcatcatatccagctaattcttcttttatgatgaatttatctgattcaattaaagaaattctttcatttgaatcatgaattagctttagaggagtatcttcttcctcagttttaaaaggagtaaatccaaaccctcttagtatttcagctgcattttcagcattatctttattgcataacgcaaagaaatatgtatcttgattattcttagatacgatttcaagataacaatcatttaagtcgctatttaaagcttcttcatattgatttgcaacacttcctaagaaatatacagtttcctcaagttcttttaatgaacctaaaggcgcatcgaagttctcatatggttgtaaactttgtacgataccttgtaacttcgtcttttcattgtctaacttagttaattcatcatcttttgacttaaccttgtcgtagatagcttcccatccgcttgagctaactctttcttcaagttcacttaaacttaaagaaagcttttcgctacgtaaagcttgaagcatagattgtttaggcacatagtcttgtaaaaactgtagggcaaatttaacctttgataattgctcttcccactttgctatatcagaatcaactacatctttagttaaatcctgaagaagttcattatcttctaatagattttcatcttgaagatctatgaattctgcacttgaaaaaccttgaagtttttcaagtaatgcttccttttttgattcaaaggctaacaaagtgaacttattcattttaactattgccatgaactttcactatcctctcaaccactaattttacagcattaagttttttgtcttcagatacatttgatatatcttcagcttcttttctgccttgtgctaatataggttctgcttctttatcccccatattaaccgcgtcgtttataagcttatcagccttttcttttgctttagctaaaacatcattatattgcttttctgcttcaactatagctttttgaactaattcttttgcttcagcatttgcatttttaacaatatccttagccttggcttcagtttgtttgatttcttcaattgcttctaatgccaaaatatcaccacctttaatgccttcaatgtaaatgtaaaaaagaaaataatatatattaatactttatatagtattaattactttgtacttgttttattatacacgcagtatgtatatttttcaacaattttaacccaaaaagaatacaagccttatatttgtattgtttaaatttaatagttttattgatttcactatagtttaagactatgttaattttttttaaacttgtctatacatattaatatttatgtataaaccaaagttatcaaataaataatagcattctttttctattatctgcccactcttgacatactcttccaaatcaatgcagaatttttctaaatgatattctttaaaggaatacttttcacgaagagacgattttatctctttttcttcctctttagatatattactccttaaaaagtcaggaagccctcttttcttattatataacaaataattaaatttaactatttcattaataaatttattatcttcttttaaaatttcatagttaaaatctaaaaataccttataatattctatatttcctatatttttattaaaatatcccttattttcgaaaaatactcctaatttataatagaattcaaatggactatggaatttgttttcaaagtattttattatgtaattaaatttcccagaattataatatttatcaaccatttcttctactttttttaacttaagcatttcttcataactcaccatatctgtttttagtatttcatatggtgggtatggtgaatattccattccatatctattagcttcttctctcatagacgatccttttagtaattttaagaatcctaattgtatttcttctggtcttatactatatacatcattaaatgattttttaaaagatatataatcttctcctggaagacctgcaattaaatctaaatgttgctttatattttttatagccataagttcttctactttttcttttatatgactgaaattaacaaatctatttatatttctaagaacttcatcatttgtagtctgaactccaacctcaaattgaaatcttccttctggtgcttttgaaagaatttctatttcttcatcttttaatatgtctgcggatatttcaaaatgaaattgtgtctctgtatctgaatttattaaaaactcccatattgccatagcaaatttatgattacaattgaatgtacgatcaacaaactttacaagcctcactcttttatcgataaaatatttaagttctttacgcactctatcaatatttaaaaatctcacaccatgacttgttgaagaaagacagtacttacaattaaaaggacatcctcttgatgcctcataatacactatcttattactaagatcctcatcagtttcatacggaaaaataatctcatccatatccataagaggccttttttcatttgaatatacagtttcattatttttatagtgtaaacctcgtacctcttgcaattccattttccctagtttatacaatataaaatccctatatgttttttctccttctccttctataacatattctccaacattttcttttaaaaatgttctagaatcaaaagaaacttcaggtcccccatataaaatttctatattggaatcaactctttttattaaattagaaattcttgagaccatctcaacattccatatatatgttgaaaaagcaactacatctggcttttctcttatgatctcttcaagaattctttcttctctatcgttaattgtaaattcttttatttcaccttcgtagtctaaatcttttgcaaaacttctcaagtatcgtactgccagattactgtgtatatactttgagttaatcgctgtaagtaacaccttcattttcatttttctcctcttctttaacatttgtctctaattttttccctcttaagaaaaaaatatcttcccatgctttagtttcttctatattgaagtatttttcaaggattttttttgtttcttctatatttgatgatgtaattacatttaaatttttaaaattgaattcttttatattactttttggaagtattacttttatcttattattaaaaacttttcctctttctttattaatatcccatattaatatttccccgccaagctttatatatttataaacttccttaataattttttctttttctattgatgtccataccttatttaattcgaagaaaaaagtacatgcatcatattctctgttttttaattgaattttactttcagaattcacataatcaaggctcatttcttcctgagcttctttggttaaattataaataattccaagattcttttctccaacgtctaacacatcaccacttatgttaaccttctctaagtttataataattgtttttcccattttcatcaccctttatttcaattttttaatagcatatatcacaaattaattttaccatttatttacatcgtttaaaatgtctttttatattttgtctttatttcaatcaaagaaaactctccaaggaaactatgttatagactatacattaaaaagctaactataaaaaatataacttctctaaagaataaaaaaatctgccaaaataacaacatggcagattttaataaatcatcatagtatttaattaattattttttgagttatacttatacataaatataaaaacaagtattcctagcaataccattataaatataagtacacttctaggtaaattaaatatattatttccatcatttgaacttaatttatatatgcatcctattccactatcaagaatatacactgaattatcttttatttttatttcttttacaatactatcatcttttaactttaagagtctattaactacagaatctttagtaattgatgagatcatattttttccttcatcataatagactccagtatccttttcgaaaattgcaccttcagtatctatagaaagatactttattgagcctaattcatcaaattgaaaaagtggtccttgaactattttgttaggatgattttcaattatctttgttataggcttgtcaactttgaaacgtggtgaatcaattggatctcctccactaaagtctggccacccataccatttgttcttttcaattttatataaataatcaaaatctctctttaccggtctgtcactactatcctccatgccaccaattatacatataagattattatcactatctaaagaccatccagtaatatttcttataccacatgcaaaaagagaaaccttattagtctctgggtctatttcaattatagaactgtttgcaatctttttacattctattttctgacccttaagactagagtttccataagccataaatgctcctgttttcttttctccataattatttcctgtcaatgttatgtttataggactagtgtcatatggtatttcatttatatcaaaagttccatcattatctgcaaccccagagttagttgcacttcctatagctaatagcaatttagaatccttaataagtaattttctatcaagatactttcctttaaacgggataccttctaaaacaactttactttcatttttagaaatatcatatctatatatcttatcattggaaatataatatattactcctttataaaacaatatattttctatatttaaagaatcatcttgaaatagtatatcttctgttccttctcctctcataatttttatagagtccttataagcaacatatgtattgccatcttcatccttatcaaaatcagatgcctgcttacagttcttattatctatactccatgttacattatttcttaatatactaactttatatttacctgatatctcaaccaaaataaatgctgtaactacaattactattgaaattattacaaatttcaaaaatcgcttcacaatatatcaccccatctcaaaacctcacatatattattaaacataatgtgtaaaatcaattcctattagattatattttgatatatgtaaaataagaccttattatatattgaaatttattttacattacaatatttagaatttttctaacttccaaatcataatattaatcaaaggagtgagtaactttggataaagataatttttttaaaaattcatttttgttaacatcgtctaatatagctacaggtatattaggatttattttttccatttatctttctaagatattgggtcctgaaggcatgggactatataatcttgttatgcctatttacaatttatttatatgtcttatgtcagctggtattgttgcttcaatttcaaaaatttcagctgtttattctcaaagaggagaacataataatataacaaaaactatacgagttgttaccatatttaatgtagtatgggcactatttataggcattatcgtattttcatctgcaccttttatcggcaaatatggagtaaatgacacaagaacgataagtgccataagagtaatatgtcccgccatgatatgtattgctatttctaatatatttaaggggtatttttatggtacttctaaaattacagtgccagctattatagatatatttgaaaaagccatgagaattgtgactgtgagcttgcttatctttttgactcaggcacatactttagagggcatggttacgctagctacagttgcattatgcataggagaattccaaagccttttctttttgtatatatactataaatattcaataaaaaaaatgccggtttcctttgaaagacctgaaagcagctctcagcttttatttgatgttatatgtatttcaatcccattatgcatgaatggttttctcactaatattcttggcaccctggcaactcttgtagttcctagaagacttatttcagctggatttgattactctgaagctttaagtatgataggaaaatataatggaatggcaatatgtataataactatacccatgatcgttgtttcaaccatcaacactctgcttataccagatttatcacaaactcttaatcagggaaaggaatatgaagcatcacttagaataagaaaagtaattaaactagcatttttactaggtcttgcaacagcaataatctgtaatgtagttcctgttaatcttggagaaatgttttttggacgcgatgacttaggaagttatataagattttcatctttttctgcacctataatctttacatcacttactatgttcggaattcttaatggtttaaacagacaaggaattatactgagaaattcattaattgaagctgtaactgagttaatctgcttatatatatttacctctatacattctataaacatatttggctatagcattacaatgtgtatagcatgtagtattagttttttactaaatatacatgaagtaaagaaacatattgatattaatataaacccatataatgtaataatttatcttttgcttggtttattagtctttattattgtttcaattttttcaaagcatttttcagcttattttccaattgcaaataattttgcagtaatgggaataacatttttaattttcgcttatcttggtggttttggcgaaacagaataacaataagataaggatgtatcaattataagatacatccttatcttatatttttatattataagttttcaccatttgaagctattacttctttataccagtaataactatcttttttataacgattcatagatgagccttcttcttcttctctatcaacatatacaaatccatatcttttttgatatccatttaaccagcttaataaatctgtaaaagaccaagtacagtatgcaattatctcacaaccttcctgtatagctatctttaactcttctatatgagctttcaaaaattctattctataagggtcatgaattgagttatcttcttcttttttatcaaaagcacctaatccattttcagatataattacaggaagattatacctacttgtaatttctcttaatccatatcttaatcccataggatcaatagtccaatcccaatctgttgtttttaaatatggatttgatggatttttgaataatccaggctgacctgtaacttgccccgaccctttaactccagttgtattaaatgttccataaggagttactccatctataggattatattcacaaacactagtttgataataatttacccccataaaatcaatctttgaagcagcttcttttaatatttcttcatcaccatcttcaaatacaggtgccatatctttatttttcaaatatatgaaagttgatttaggatatcttccataggcatacatatccatccaccagaaattcttcatgtcatcaaagtccatttttgacattgcattcattggatcgcagtttattgaataactaggactatatgcaaaacttgcccctatctttccattaggtactattttcttaaattccaaaacagtttttgcatgagccataaatgcatgatgattaacttgataatatgttttcacatcatcaaacttacctggtggatgcattgctgttagccatcctaaggttgtaaatatattttgttcatttaatgtaatccaatattttactttcttgccgaaacgattaaataaaatcactgcatattttacaaaatcatcaactatatttctactttcaaatccaccatattgctcaattaagctttgtggaagatcccaatggaatattgtaaccataggctctatattgtattttaaacattcatcaataagatcttcataaaatttcagacctttttcatttacttctccattaccttctggaataattcttgcccacgaaattgaaaaacgatatgttttaagtcccatatccgccattaatttaacatcttctttaaatctatggtaatggtctactgctacatcacctgtagtatgtttaaatgttttgccttcaattctaacaaaattatcccaattagttagtcctttaccatcctctaaataagcaccctctacctgataagctgctgatgcacttccccataaaaaatcttttggcatcttaaaattttccatttttactttcacatcctaacatttaaattactgtcattatattttcatttttaataatttttcgttcattttccaaaattatatccatataattatcactatttgttattataattggagttataacatcatagccttcatttttaattgcctctatatcaaattctaaaattacttcatttgctttaatagtatctccttgtttctttttaggagtaaagtactttccacctaactcaacagtgtcaataccaacatgaattaatacttctacaccatcttcactttttaaccccatagcatgatgagtattaaaaaatgcctctatagttccatcaaacggtgctactaattgtccttttgatggtattatggcagctccctttcccattactccacttgcaaatgttgcatcatttacttttgataactctactaattcaccttctaatgggctactaattttaattcctgtatttaaaggttcagatatttttatatttaaatcttcatcttcatcatcttcttcaattggatcttcaaaaccaattaaatatgttgcaataaacgaacctattattgttactaataatgtaatcaatgcatatataatactcttaggatttcctttttcaatatattgaggtaaagttactattgctggagtagctatcccataacattttaaattaaagaaacctccaacaagaccacccagtcctgctccaatacaagcacctatcataggtcttttaagtcttaatgttgtaccgtataaagctggttctgttattcctgcaactaatgccgaaaaggctgaagaacctgaagtttgttttatatctttatttttcgattttatagaaactgctaaagcagctgctccttgagccatatttgaacaaaattctgctatgcatataaacccttcaaatccagtagtagcgatcattcctaattttatcggtgtaaaagtatgatgcattccagtcataactataaatggaaatactgctgctactaaacctactgaaataaatcctaatttatcatgtataaaataaactattgatgataatacattaccaaatattgtacctaaaggacctattgctaccattacaattggtgctgtaatcaatactactaacattggttttaaaaagttctttgttatattaggagttattttatcaacaaatacttctatataagatagcgcccatactgataatattattggtataactgaatagctatacgaagcatatgttactggaataaatcccaaaaacgctactgttgttcctgcttcttttgcatcatttaaaagtgaaataaaattaggatgcaaaataatcaatgctatactaactgcataataagaattcgtattgaatttttttgctgctgacattgctattaatacaggcataaagaaaaatgctccatcaccaatagcagctaataatttataagtttcactactttcacttaaaatacctatcataggtaatactgttagtaaaaccttaatcattgcagcgcctataatagctggtattactggcgacataattcctgatatagtatctaaaatactagaaactataccctgattttccttttgcttttcattcttaggtgtagaatcactttggaaatcacctagctgacagatttctttataaactgctccaacttcatttccaatgattatttggtactggccaccttttttcataatgcccataacaccttttgtcttcttaacaagttcatcatcaacaattgattcatcttttaatttgaatctcaatcttgtcatacaatgaacaagtccctgtacgttattttttcctccgactctttctagaatcttctctgctacttttttgtaatccatttttatattcctccattcatatttaaataaaaaatgaagttttgcctacatatataaattataaatataacctatagcgtagttacaatcttactatataataagctggtggattttccagcattactaactctaattaaacagttgattttgttactattctttctatatgaattattaaataaagttgttcttcatctgataatgtatattggtatttatgttctatgaaatcttttatcttatttgtacacatataacttttttcatatttaacttttaatatattaaacaaatctgtttcattatcttcataggcagatttattgaatactctctgagcaaagaacttcaaatgagtcacaaatctataatatgatactgtctcctcatcgaattcaactttaaaatgatattttattatatttaatatttcatgcattattttagttatattcactatattactcatatcgttattaagttctgcatttactatatgatgtgctatataccctgcctcatcatcattaaattcaactccaaactcttctttaattatctcaagagcttttttagcagtatcgtattcttgtgaaaataatctctttatatctaaaatcaagggattatttatttgaattccattattatatctttcaattgctccgtgtatgtgttctgtaagacttacatatataacatcatctaattttcgattgtatgtattttcaaatatagatacaatctttgtagttattcctatatattcttctggtatttctgaaacagtagttattaatttctcattaagattcttatctttatttgagaatattttatatttaaaattacttaaatcaacatcttgatttccctttttaccaaaagcaatacctcttcccattacaattatttcttctccatctttatctaaagaaataaacgcattattgtttaaaaccttttcaatatgcatatcatcaccacctgttaaatctaaaaaaaggcaaaaccacaccaatattagtgggttttgcctgcataatcagttacaatcctatttgtatattatcatgataacgttattttgtaaatagttttaatttatcttattatcataaattaaccatacaatcgatatattaactattttatagaatttttatctcattctctttcgcataaaacgtggaagaattctgtatatccttcctgatatactatccatatcttctttgtttaatccaccaaggattatcattaagtataaatacacaaatcctccaatagatattattattattgtaattaatccgcttaatattttccccccactagtaatcgataaaattatacttgcaggctgtttaagcacgaataatactccagccatagctaatgaagatataaatggcttaatcatatgtttaaaaaacggaattctcattcttaaggtcttatttaatgccatctgatttaatatcataggaataagaaaccaaaggaaattacctccaactactcccaaaatattaatacttggtattcctacaagaacaaaattagcaattatctttgcaactattcctaaagagaatgtaaataacacaaaataaagcttattcatactctgaagtattgttgtctgtatctgaactatagcttgaatcacaagtacaattgatcctatcatcataagctcatacccctgactcgttccataaagaagttcaaaaacttcacttgcaagacatgaaagtcctattgctgctggaatagtaactataaatgttactctaaaagcaaagcctgttctctttcttacatcctttttattctttaatgccatagctgcagcaactgctggtagaactgttgtccctaatgcagtaacaataattaatggcactgataacaatgttttatatcttcccaaaacaccataaagttcctgtgctttttgaagtgtaaatcctgcatgagctagtctgctatttacatttaccatatcaacaagacttccgaaattctgaagaccggctgttaaagttattggaagtccatatttgattaattttcttacaattactttgcttcgtaccctttttttatctccttgagcttcaatagcttcttcctcaaagttcttcttatcatatacatataccatataaagacatgcaacaagtgcccctattgaagtacctattgttccaccggcgctaccatatgcaatacttattttaacaagtaaaaaggcacatgttaaacttactaatatatttattacctgctcaacaacctgtgaaatagctattgcattcatgctacttttaccttggaaatatcctctatatgaagataatattgatgtaataaatatacttggtgcaagaagaagtattccatatgatgcttctggattccctataagatttcctatagggaatgcacacatcattagtattattgatattatacctccaactagagctaataatgttcttgatatttttaatgttcttacagcatcttcatgtttttctagtgctgtgagttctgccacgacttttgcgattgctggctgggttccaagattagttatagcatatgcaaataaaaatacttcataacaattctgatatattccatatccacttaatcctaatattctctgaagaagaggaatatagaaaactgatattattttacttacgattccggctattgaaagaattaaaaagcctctattggctgatttctcttccataattacctcctatctaaatgaaactttaaatgcatcttgttttatttttttgaataatggaggtaatgctactgctatcgtcttgttgtctaaatactcaagcttaccttttatctttctaaagtttaatttgtacgcatataaatattgataatttaaaccatatttgctctcaaagaatgaatttaattttttatctccatatttgttgtctccaattataggatttccaacatgagcaaggtgcgctcttatttgatgacttcttccagtaattaaattaatttcaacgaaagaatatgcaccattagtttctactacatttacatccattgcaattttttttgaatttttaacttccttatcatatactgttgatgtattagtttcaggatttttaactatatatccctcgtatagtccactctttacttttccttttgctaatgtataataatatttttttacttcatcttctcttatggcttcattaatacatttcaagccttcaaaagtctttccatacataataataccagatgtgtttctgtctaatctattacaagctgcaggtgtaaatgtaatttcattttctggcaaataatctcctttatcatttaaatatgaaagtacgtagtcagtcaacgtaggttccttattatcacttgtatcagaatgtacaagtattccaggccatttctcaacaataaccatattttcatcttcaaaacatattttcatacgtttaggatctacttttataaatttttgtgttttatcttcttttttgctttgtatgtacttaatttctactatgtcgccttcttcaagaaaatatttttcgttctgtttctttccattaactctaatatctttttttcttaaagctttaaatattgcacttaaaggtacatcctttaataattttcttaaaaacttgtcaagtctttgtcctgcttcatttgaccctatttctattttcaaatacaatcactcctaccaaattagttgaaaattgaaagtgtatgatataaatcaattttcaaccttcaacttttcttttgtctatcctcttagcattatgtagtctttttataacattgtcaattataattatttagtcaaataattatatgctgcagtagcttgaattgctacgcctattggaagacagtcttcatcaatattaaataagttactatgagctggttctgttgtctgcttttctttgtttccagatcctaagaaatagaaagctgcatctctttccattgcaaaatatgcaaagctttcaactcccattttaggtgctttctgctctaaaacattttcttttcctaaaactatttctgcactttcttttaataaatcaacacagttatcttcattataaagacatggatagctttcatctactttaacttctgcatttgctcttgacatagaagctataccttctgctatttcagtaagtctctcaatagcaaatgctctatcttctttagtcatggttcttatcataccgctaattgttgcttcacctggtattatattctgagctgtcccagcatgaattgtacctactgttactactgctggattaactggcgctatttctctgcttactatagtctgaagagctattacaatatgacttgcaataactactgggtcaactgtagtatgtggtgatgctccatgaccaccttgacctgttatcttaatagtgtaaggattggatgctgcattaactacacctttttttatttttattgttccacattctgtttcttcatctacatgaagacctaaaacacaatcaactttcggattatctaaaacaccttcatttatcatatgtggtgctccacctgtagtttcttctgctggttcaaataataattttattgttcctgaaaattcatctttatgatcatttaacagttttgcagctcccattaatattgttgtatgggcatcgtgaccacaagcatgcatctttccttgaacttttgatttaaattcgcatgacttcatatcttgaattggaagagcatcaatatcccctcttaatgctatagtcttattattaccttcttttgttccttttataattccacaaactccagtttttgctacttctatatatggaatattattttttgttaaaaattctttaattactcctgaagttcttacttcttcaaatcctgtttcaggatgttcatgtaaatctcttcttatatttatcaactgatcttttatatcttctgcttctcttttaaaatctaccacaacaaactcctccatacttatatttctaatactttttattattctgtccaaaacacttctacaacatctccatcttttaattttgctgtatattgtgcatttactccatttaatgtaatattaatatttcctttaggtactgttagatcaaaatctatataatcaaatatatctactattacatattcattttttcctatcattgttttctgttcaccattaatcattacatttatactatcaaattcttctttatatactgaaatcttatcattattatctttatgattatcctctaaatcacatttttcaattgtaatttcttctgagtcagctgctataagcttagatatgtcttccttactgttttcattttgtgtttcttctaaattttcatcttcactaatttctaaatatcttgtaagcctttcaccttcacatacttcataagaatcgtctaatatattttctccactcataagttttatattttcttttattatatacttttttaaatctgaaattgtattaggaataaatacccttacttcatctccattttttattatatattctaaatcttcaattttatcatttacaagaataacaggttctaaatttactatttcatcatcgatgaaaatacaaacagaatcaatatttcttatattatcccttaatttaggctccgcatttttaccattttgtgcataaacaagctctatattgtcattactttttacttcagtttcaagggttgcttcttctgaattaattgttatctttgcattagctccatattcaccaaatacaatcctcttacatccattataagtaaatcttacactctttccatttttacttataagaagtgatgggtttattcctgcctgaagcaatacatccattgtattgtgcttatgggagttaaataaacttataggttctccatttaaattaacatcaataaaatcatttccaagacttcttatggcagccaacgctattcctaaaacagtcactcctgctgaacctagttcattatcagatacacattctataacagcacttctatcttttattgctattctttgagatggaagatttagcttttctgctattgattgcactattccaggagtatgagcccctcctccaacaagaaaaactgcacttggagatttatcaccatttaactctaatatcttttttgatatttcatctgctgttttatttacaatattatctatgagttttaaaatagcttctgatgatataacattttccattcctaaaatatcaacatacgttatttccgaattaacgcctaattctctctttattctttctgctgtattaaagtctactagatactcttgaactattgcttctgttatttcatctcccgccataggaaccattccataagcagaaatagcttctttagaacttattgctatatccgatgttcctgcaccaatatcaactaatgctatatttaataatcttaaatttttaggtacagctgcttccattgccgcaataggctctaacgtaagattaacaacatttaaattaactttattcattactgaatatagagaatcaacaactgatctaggcaaaaatgttgcaataacctctgcacctattttttctcctttatgtcccataagatttgaaataacaaatccatttaaataaaaacttttaacagaatatccaacacaatataattttccttctgttgtagaatttatttcttcttcagcattctttacagcacttaattctaaacttcttatgatttctttatcgatttcattttctccatctatttctagttcagcttttgaatttacagttcttaaaaatcttccagccgctgcaattgatacctcttttaactgaatcccaacttcttcttcgatagcattcttaactttttgaactacagatgccacaagagatatatcatgtatctgtccatcaaccattgctctttcttcatgctccatatatttttcacatacaacatgaaattttttatcttttattataccaacagttccaataatagatctcgtacctatatctaacgaaaaaattatatctttttgattaaatccttttaattccattattacacaacctttattgctaatttccatagtaaatctaatttaaattatatagtattagacaacttcatacaatattaaactattttgaatagaaatagacagaactctcaaaaataattgcatatgaactattttcatttaaatttatcataatataaaattaaactgctttaaatgattttatttaaaatcatttaaagcagttataaatttaattattattgtatccaagctccgcttgcatctaatgtataaccgtcaattactgtattgtatgccatagctccattattatataaataataccattttccattagtatcttttaaccatccagtgtgcattgcacctgatatatttaaataataccattgttctttatctttaatccatcctgtttgcataacaccttcagaatttaaatagtaccatgtattgttatccattagccagccattagcttttgttccatcaactttagtataagaccatgttccgtctgaattcttattccagcctgctacagtttgtacttcatctttagattctgtatcttctactgattcttcagttttttcttcttctacagctttttgtggtgcaacaactgaatatacttcattgtctgtgttccaaattatcatactattttcagcaaatacagataagttgtccatagttctatctactgtatattttgtttctaactttccattttctagcttttgaactttccccttattaagaacccataaatttccttgaacatctatatcataatcttgcatatcctcattttgaacatcatcaaaatcttcatcaagttcaagtactcttttatctaaagattttccttcaacactatccttatcttttattttcttcataatatatctatcgactgtaacagaatcatcttctgttttaattatatatagactattaccacttactctagctgttaatttatttgctctataatcttcaattgtttctagtgcatttaaatcatatgtttcgtagctagtaacactttttggtatatatgctccatcttctttatcaccttgttccatacttacctttaatgcatatgtagttaatggattcattcctgctttcaatttatcagtatccattatagcaataaccttatatatattttcagcatctattaataaagtttcttcttttacaatacttaaatttttattttctttaacatcttcataagtatcaagatttattttgtttccatccttatcataataaacaacatttaaagtttcagatgcatcaacatatttacctgaatcacttaaatacacagtgtatttttctgttgcatcatctaaatcatcactatttgcaacaacatattcgtaccaaacaccgctaaatatatcttctgcaatctttccaacttgaattaaatatggtgtatcttcatatctatcagctttttttataactgatgatctaaatttattttccatcatagatactctagtttcttcatcatcttcttcagcttgtccagttactagattaaataaaatttcatcatccttaaagttgatatagttcattccatatttgcttcccatagtttcagcatcttctatttcaacatcttcttttccattaaagaagtacattgctgaatcttgttcttcacctttataaccatcaaatacatatactccgtctttaaaagcctttgcatcataaatagttccttctaaggcttgaagctttattgctgcattagcagttgttgttgggactacgctacttataactgcagctcccattaaaagtgacattaatttattgaatttcataataaataccttcctcttttgcgctttaaaatcatgttgatattgtagcacatgaaaatgcttatagaaatagatattattttttttataattctatcaaaattaatgttgattaagataatattttttgtactcttagtacaaaaaatattattttaataattgtattcgttatcatttgtattcatatactcactattataatttttttgaatatttaatttagttttatactcaaagtataattcaaaattaaatattcaaaatttccttttaattacattgattatcattcaaaagtaaaagacatttctccatcgccaattaaaatagaagtatgaacttttaatggtttttctaaaaatatttctgtctttaagctcttttcattcaattgaatatagtattttatatcattattttcaataatgacaatattcatacacttatctggtgtaaggagggtaaacgtcatcttatttccaatactcttttgaaaatgatatattccttctttataaacatcagcatggggctgatatttataatgtggagtagcataggccttaacattaaaaattgttataataattattaaaaccattaatgttttttttaatttcatcttttgtatcaccacctcattatatagtattaggatttcttctaaaattattaatgcatcttctattacataaaaatagttccattcacctatcaatctttaattaaatacatgaatgaaactaatacaattttttattctctcttaaccagttttacctacaaggttgttatcaacaagaacttttaagctaaagctcctatcaatattatcactaaatttaatcttagctttatcaccatcaagttcaagtatttttccttttccataagccttatgaattatttcacttcctactttatatccatatgtatctggtggaagcttgttaaaaccaccttctactataaatcttgatatatccttgaactgcccttttctatttcttggagaaaataaatatagattatctatagcacgtgttatgcctacataaaaaagtcttctctcctcttcaagattctcctctttacttgattgatgtggcattgtatcttcacatgcatttattatatagacatttttaaactccataccctttaccccatgaatagtgcttaaaatcaccccttctctatctttctttttcttgctttcatcaatactttgtttaacttcttctatatgggctaaaaattcaaaaatagttttatatccttctgcagataacttaaattcttctattatatcctcaaaatcttcaaaactttgatttatctttttagcatattcacgtatatgatctatatatcctaaatccattattatatatgatatggccgatgataatgatattttatttaaataatgaacatctttttttaattcatctaatttcttcttttggaaaggtggtgtatcatctttatttatcaatatatcaaataatgcttcttcctttggatatgttcttacatatccaagattagctttacttacatatctaaaaggtttatttataattctaaaaaagctttctttgtcaaaatcatttactgaaagttttaaatatgaaattatatctttacatataaaatgttcaaagaaattgtactctctatctatcaaagtgaatggaatccttctttttgtaaatacatctataatactcattgattcaatatttgttctgtataatattgcattatcttcataattaatgtttaattttttattttcctcaattatgtcagcaagagcttcaccttgaattttttcattatacgaattgaaccactttataattccatcgttatctttgttccacttaatctctttattatttctttctttattatactttattacttgtttagacttctccactatattttttttacttctataatttattgataaataatgttttttcccattttcaaatatcttatcaaaactaaccatgtattcaggttttgaccctctaaatgaatatatacactgatcctcatcccctactgcaaataaagaattttcactctcatcattaatcatctttaaaaaatctatctgcatttcatcacaatcttgaaattcatctacaagtatgtatttgaataatctcctataaccttcaagaagatttttatcattttgaagcatttctaaagtttttatggctaaatcatcaaaatcccacttattattttcttctttatattgttcatacgtattatatgcttcttcaaaaatttcttttgaaattgaaggtttaaattcatttagcaactgccttgatgttttgaatatagatatattatttattgtctcctttattttgtcatcattaacttcatcaaaatacttatttaatatgctgctcactattttatgcgctacaccgccatcaattatatctatttctcttccacttctcaaaagcatcttataaaataacccatgaaatgtcccaaaaaaaggtgacgtatttgtgttataagcactttcatatctctttttcatatttactgctgctgctttagtaaatgttattattattatattgctatttgaaacatgcaatttattaacaagatgattaactctatttattattactgtcgtctttcccgaacctggtgcagctacaactagcacatttttatgatttgtttcaactgcatccttctgatatttatctaaattataccccactattcttatacattcctttctttcattataaattaaattgccttcttacttctattaccctaaattatgtccatatttttaatttatataaatgattatcttcataccaaaatataataaaaattattattttaattgttattgagaacatatgtggtaatactaaatatattgattatattaacttgtgaattttttatccattttaatttagctttacaaattttatacaattctaaagtaaaatcctgatttatattatacactacaaaatatcaagtatattgtaatgtaagaattatagttgtacaataagcttatgtattttattttttcaaggtttttcttgttaaaataatattttttatgtattaattaaaggagattgttatgaataataaatctaaattcaatgtaagagatgagagaaatcttacaatgcttgttgacttttatgaattaactatgggaaatggttatttcaataaaggtctcaaagataaaatcgcttattttgatatgttctttagaagagttcctgatggaggcggttattgtataatggctggtgttgaacagcttattgagtatttaaataatcttgaattcacagatgaagatattaattatttaaaaaataagaacatgttttccgatgaatttcttgaatatttaagagactttgatttctgctgtgatgtatgggctgtaccagaaggaaatcctgtatttccaagcgaaccactcgtaacagtaagaggacctgtaattcaagctcaattccttgagactatgatactattaacagttaatcaccaaactttaatcgctacaaaagcaaatagaatatgtagagctgctgagggacgtccagtaatggaatttggttcacgaagagctcaaggttatgatggagctatttatggcgcaagagctgcaataataggtggctgtagttctactgcatgtactttatcagatagaatgtttaacattcctgctgttggaacaatggcacatagctgggtacaattatatgatactgaatatgatgcctttaaagcatgggctgaaatatatccagatgactgtgtattgttaattgatacttataatgtaataaaatctggtattcctaatgctataaaaacttttaatgaaattttaaaacctctaggaaaaagaccaaaaggagtccgtatagattctggtgatataacttatcttactaagaaatgtagatctatgcttgataaagcaggttatgaagactgtaatatagtaatttcaaattccctagatgagcacataataaaagatgttttagaccaaggtgcatgcatagattcttttggtgttggtgaaagactaattacagcaaaatcagaacctgtttttggaggagtttataaacttgttgcattagaaaatgacaatgagataattcctaaaattaaaataagtgaaaatgacgaaaaaataacaaaccctggcttcaaaaaaataataagactattcgataaaaatactcacaaagcattagctgatttaattgcactaagagatgaaaagataaacgagtctgagcctatagtattatttaatcctgttcatacatggaaaagaaaaaaattcagtaattactatacaaaagagcttcaggttcctatctttgaaaaaggaaaatgtgtctatgaatcacctagtgtaatgagtattaaagaatttgcacaagtagaaactgataaactttggcaggaagtattaagatttgaaaatcctcatacttattatgtagatttatctcaaaatctatggtctttaaaacaatctttacttcataagtttactgattcttatgatgcttaataaaaaaatggatttgaaattgatcaaatccattttttaaatattaactaatttatcatcatcatatgatgataaatttaaaaagctataatcctctttaataatgtctttaaaacttattcctgttgatgaatcacatgcatgaaaaatacattgatcttcttcattcatctcctcatgctcacttataaacataggacactctttataacaatcaactttattttttttgtctgaccaaaatggacacttactcataataaccccaccctttactcatgtcttaaactattttccccataatttatgaatacattatattacataacataataaaagtaaagtttttacatttattatgttagataatataaactatttttttattttaactaaaaaaagcagttcaaaatgaactgctctttcagatctattaaacttgtccgttattttttactgatgaaatattaataatctcattttggaatgccttaagcaatgctttttctaacactttttctttatcaaaattatcaatatcactacaaactgcaaaaactttattcttctgcccattacaatttttgtatgttaatgtgacattgggcttatcatactccacttctaatatcttaactccccaagatatttgtgcaaaatctccatcaactgttaatttagttaattcctttaacttttcgttatccttacttggatcattaacaattatcaattcatctccaactttatatttagccataaaatacgcctccttagtaccatcaaatattgcattttaatataggctattattaaaagtatacaataaaacttctattattaaatgtttgttaatttattaacatttaatctacttatattctagcagactttagttgaatatacaatatttttttgtcttttttgtaaataatataccagttttaaatttttatataattttagatattttttctatataaaattatataatttagttacaaagtaattatttataactattgtcaacggataatcattatgatttgcattgaccaaatatatttttctatgttataatttgtatatacaattaaataagtgaggtaagttaatatggatcaaattgctgctatatttaaggaaaaaaaattaaaactaacccctcaaagacttgcagtatataattatcttatgaatacaacttctcatccatctgctgatgctatttatacagacatacatgtacaataccctaccatgagtctagcgacagtgtataaggcattaaaaacattggttgatgtaggattggttcaagaaataaacgttggtgaaggcaattttaggtatgatggaaactcttgttcacatcctcatgtgcaatgtctaaaatgcggtaaagttgatgattttcacgggtttaatttagataatttaaattctttagcacaagagaatactgactataaaattatatctaacaaagtatacttttatggttattgcaaaaactgccagtagtcttacagactaaaattttaattattattaaagttttagtctttttaattttaattattatgtatcacaagaatttctttctcatataattaatggaggtgatacataatgaaaattttattaataaagaaaaagcttataatcgatatgatttttataatttctatttttattataggaagtgctactttctatttccaatcatcaaaactcaaggccctgcaagctatttatcctgtaaatctatcaaaagacactgaatatgatttaacaggggatggttctaaagattcctttcagttaataagcaatgaaaataaagtggattttaacattaaaacatcaaatacagatttttatctctcaaaagaagttgatgataaaatattattcacaaaaaatatacactggtcacctaaaatatttatgcatgatctatctagaaataatattccagaactaattttgatgggttccaaaaacaataaaaatacttattatgtttttggatggaataataataaattcaacttaataacatctggtaatagcaatattttaggaatacttgactgcaaaaatacaaaaacaccacaatgtttttctctttcatcttcatcaggtgcaaaatcaattaatagtttcatggttattaacaatagcttctttaatacaacaacatcaaatacgaatcttccatctttagatactactttaagttttataaatttaattgaacttccctacaatcttgatgaactacctgacatatttacaactgatataaacaaggatgaattatcaatattttgggctttagataaagataattattcttatgcttttcaaaatgcttttttctacgattatgagtggaatgattctggagaacctatagccttaaaatggaggttatcttttgaaaagaacaaattaaatggtcaggatggagataaagaggaattatgtattcttcttgatgttataaaagatcattcacaatataagatcactacaatacaaaaatccaaataaataaaggccgcaaattgcggcctaaaagggggatggggggttacttaataaaatatcagtattttattaagtttgtaggagaatgctttctccactacatttatagtattgacaactataagatttatatacatatttttttactatttttatctatttaaataatcccttcttatatccatctattatcctatcaacaaatggtattttactctgatgtacgaaacttcttaatgatattaaaaattctaaattctcatctcttgttttattctgtgtttgtgtgtgtgttactgcctcattctgtttcatttgttcttgttgagtcatctttgtattattcctcttatctcttacttcatcatgcttttgtgtatttgcctcatttttatttaagttgctggctgacatattttgcatatctgtagctacatttgaattattgttatttctatttaaattattatttccattagtaaaattattatctaaatttaatcctgccatttgagctaatggacctaaattgtttaaattaaaaccgtttgtattcattgacgctaacatattgctcatatttctcatatcaaagtttccgccaagcaaacctaaaagctgcattggatcgattccaaatggattattgtttgaattcatcatattattattattaatattatcattcattgaaggttcttgttcccttctcctatgcttagccatgagtttccctcccaatattattacctattaccactatatgtataaagtatttaaattgtttatgtttttacacatttttttggagggtataaaaccctccatccactattttagcaacagcagctatttcctgagccgttagaagctccagtaaaacatccaccaaatagtataaatagtaagataatcaaatatgatgaaccacagtttaataatccagatccacatgcgattaataagaatataataggtgctacagcggaaccactacatcctcctaataatccagatccattattatttgtacagcagcatgaagtttcacagcagcatggtgtacaacagcaagcttcctgtttcctttcacagcagcatttcttttcacaaccacatttattcttctttttagacatatttatctctccttcctaaaaattcagaattctaacaaccacaattactattagcaccgtatccagctaaagcaccgtaaggacttgcacatccaccattattattgttgcaaaggaataagattactagtaagaatagatatgctgtgcagtttccaaacattccaccaaataatccgccttgatttccacaactattattacaacaagaattacatccacagttattgttacaacaagaattacatccgcagcttccattattagatccacctaagaatccacttccaccacatccgcaatagaataatattaataaaatccaaatccaactaccaaatccacaacctaatccgccacctaatgggcctgctcccatcattggtccaacgttctggcctccacaataacagttatctgctgatactgaatcactagaactatcgtcgcatgaatttaaaccgttaaggatatcattcatctccatatttattcctccttggaaatatttttttctttttcatactatatactattcccctcattactttttgacacattttttatacaaactttttataaaataatataaaaagttatttggtaaatacgagctttctcatttagtaggttataaactaatgtttgataaatataattttctacatataaaaaggcaatgaaaagatgttttcatcttttcattgccttatatatcttttaatctatatctgttgcaaattctaaaaataaattatctattaaagtttcaatccctcttttatttaaagatgagaaaaagtagaatttatcttcttcttttaactttaaagtttcttttataattttttcattctttttaaattccgaattctttaacttatcacttttagttgcaacaacaacaacatcatatccaaaatgcttagcccattcatacattagtatatcatcaccagttggtttatgtcttgaatctactaataaaactattctttttagctgttctctttctgttaaatacatttcaatagttttaccccagctgtctttttcagacttagaaaccttagcatatccatacccaggtaaatcaaccaaataaaaatcattatttattaagaagaaattaactaatctagttttccctggagttccacttaccttagctaacttttttctatttgttaatgaatttataattgagcttttacctacattagatctcccaacaaaagctacttcatttctattatctaaaggatattgttctctctttactgctgatataataaattctgattgtttaattctcattagtatcctctccaattaacgcattcttcaatacctcattcacttcttttgcagaaataatattcaaactacttcttattgaatttggtatcttatctatatctttctcattttcttttggaattattatagtatctactcctgctctgaatgctgctaatgatttttcttttaatccgcctatgggaagtactcttcctgttaatgtaacttctcctgtcatcgcaacattatgcttaactttctttcctgataatgctgatacaagtgctgttaccatagttacacctgcagaaggaccatccttaggaactgcaccttctggagcatgtatatgaatatctttttctttataaaatgattcatcaattccaaatctactagcatttgctcttacataactataagctgttttagctgattcctgcattacatctccaagcttaccagttaactgtaatttaccacttccagtcattgcagttgcttctattggcaatgtatctccgccatacgcagtccatgccataccatttactacaccgactttatcaaatttatctacttcatctatattaaatattctcttaccaaggagttcttctattgacgacgtctttacaacataatctttctttccttccttgatcatatctgcaagaacttttcttacaagtgatgtaagttttctctcaagtccacgcacacctgattcccttgtgtaaccttcaactaccactcttatagactcatcttctattttaatattatccataggtatgtctaaatcattaaaaatcttaggtattaaatgttctttagcaatattaaatttttcttcataagtataacctgaaacttctataacttccattctatctaacaatggtcttggtatagtttctagtgtattggcagtagcgataaacattactttagataaatttaatggaagctctaaatagctatctctaaaatccttattttgctcattatccaatatttctaataaggcatctgatggatcacctttataagtagaacttattttatcaatttcatcaaatagtataagaggattcatagttttagcatcttttaaagcataagtaattctacctggaattgctcctacataagttcttctatgacctcttatttctgattcatctttcataccgcctaatgaaattcttgtatactttctattcatagcgttagctatagatcttgctatagatgtcttaccaactcctggaggtcctactaaacataaaataggtcctttttgtgatttactaacctgttttactgctaaatattctattattctatctttaacatcatctaagccataatgttctttatttaaaatatctctagcttttactatatctatactttcttttgaatattttccccaaggaatatctaaagcccagtctaaatatgtttttataacattagcttctgctgatgatgaactcatattctttaatcttccaagttcatagctgagcttttcctttatttcttttgcaatttttgatttttcaattttttcttcatacttggcaatttcatttttttcttcatcatcttcaccaagttcttcttgaatagctttcaactgttctcttaggtaatattctttttgttcttttgaaaccttactttttacctttgatgcaatatctttttgtatttttgctactgaaacttctctttttattttttccaaaataagttcagctcttgctattacatcaaggcattctaaaacttcctgctttgcctcttcttctgtaattgcatatgaagctaccatatctaaatattcaattggactttctaatggctctattgattttgcaacttcactataaccatcatcagttaattttaataacttcataaattctctgtctataagcttaatatacgcttctaactcagcacttttagatttttttgaacgtatcttttcaactgaagcttttatatattcatcatcttctatatattcaactatttttgctctttctaaaccttcaacaagaactctaatagtattttcagacattttaagaatttgttttattttgcatattacaccaatagagtatacttcctctctcgttggctcttcaactaataaatccttttgtcccacaagaaaaatctcttggttatctaacatagcttgttcaatagctgcagtagacttctttctaccaacatcaaaatgtactactactttaggaaaaacagtcaatcctcttaatggaattagcggaattgtatataactttttcataatactatttcccccccacatgaattatattgtattatttattttgacttaactagtatacacataatctaatattttttcaattatcctttaaaaactattaaatagaaaaggtgtgaattttaagaaccttatcttaactattcacgccctttatattatattaaactaattattatatttttacaaattaattttttagaagttgagggctttactatgtttcaataacattatttccttttgctgataatatctctgtattatttactacaacatcttcattttctaatgctacatttattacttctttaaaattagttacaggtaatatttcaattccttcaatttcttctaatgatttatcataattttcttgtggtattataaccttcttagcacctgacttaactgctgctgaaatttttgctttaactcctcctattggcttaacaagacctaaaatacttatttctccagtcattgcaacaaatctacttactttcttttttgttattgcactataaatagctgttgctatacttataccagcagatggaccatcaacaggcattcctcctggtatatttacatgaatatcatatttatctgtatttaaatcaaagagattgtcaagtaccgtaagtacattttctactgaagcatatgcagtacttttcatttttattttcttattattagttgtaatttcctcttcttccactattccagttactttaacttcacctcttctgttatatacttttttacaacttacctctaaaggcataagcatacctatattagcaccataaactgctaatccatttactactcctatctttgattcatgtggtataatattgcttattatctttgtatactgaccattttctagaacccacttaatatcatcaatacttattgcatatctttcttcatttattgctatgccagatgcaagctgtattaaattaataacttctcttccatttgtacaataattacttacttcatctaaagcattttcttctatttgaagtcctactttttcaacagagtttttagcaattgtttttatctcatctggtaaaagtgctctaaaaaatatttcgacacatcttgatcttattgctggcattatttcactaggtgatcttgtagttgcacctattaatctaaaatctgctggaaggccattctcaaatacctctttaacatatttaggcatattaggatcttcagaactataataagaactatcaaaaaatacctttctatcttctaaaacttttaataatttgtttaattctataggatgaagctcacctatctcatctaaaaacaaaattccaccatgtgctttagtaacagctccaggcttaggttgtggtattccagctattccaaaattacctgcaccttgataaatcggatcatgaaccgaacctattaagggatcggcgatccccctctcatcaaatcgtaatgtagttgcatctagttctacaaacttagcattttctttgaaaggtgatgacatagctcttttagcttcctctaaaactaatcttgctgcagcagtctttccaactcctggtggtccataaattattacatgttgtggattaggtccgcataatgcagccttaagagcttttatccctttttcctgccctacaacctcttcgaatgttgacggtctgcttttctctgttaacggaactgacaaggatatttgtctcaatttattaagatgagacatttccttggtattttctttatcaataactatactcctgcttttcgggtttttatttacagaagttgacaacacatataccatcataactaatacaactatttgtaaaatcattaatatactgttcatataactgaatatatttctttcgtataatgaaatatatcttcctccttccactagttctattactattatttgctctactttacaaatatattcctaacttccatataaaattaaagtattgtgaaaaaatgcataaataaaagccctgttctgatattaaatatcagaacagggttaaactaaaaatttatgctgattctatatcctttttagttcttgcttttattaaagcaggtcttgtttttccatcttcaagacgttcaactataggatcctttttatttttaattgtttcttctgtaattattaccttagttattctattatcacaaggtatttcatacattatttcattcattatatcttctataatagctctaagacctctagcacctgtctgtctgcttatagcttcagctgcaattgcagttaaggcaccatcttcaaagtctaatttaacatcatctaattcaaatagcttcttgtattgcttaacaagggcattcttaggttttgttaaaatttctattaaagcttctttatttaatgattctaatgtaacaagtataggaagtcttcctacaaattctggaatcaaaccaaactttaataaatcagctggcattatttctttaaataattgacctacatctttttcatgtttagattggatatcagctccaaatcccatagaactttttcttgttcttccttcaattatcttatctacaccatcaaaagctccaccacaaataaataatatatttgatgtatttatttggataaattcttgatgtggatgctttcttccaccttgtggtggtacagatgctacagttccttctaagatttttaatagcgcctgttgcacaccttcaccagatacatctctagtaattgatggattttcagactttcttgcaatcttatcaatttcatcaatgtagattatacctctttcagctttttctacatcataatctgcattttgaattaactttaataatatattttcaacatcttcaccaacgtaaccagcttcagttaatgttgtagcatctgctatagcaaatggaacatttaagaatttagctaatgtttgagctaataatgttttacctgaaccagttggtccaagtaataatatattacttttagataattcaacatctatatcgtctttattagtatttattctcttgtagtgattatatactgcaacagctaaagactttttagctctatcctgacctactacataagaatctaaatattcttttatttcatttggctttggaacactctttggatcaaaatcaacagattcttggaattcgtctgcaattatttcagaacataaatcaatacattcatcacatatataaactccaggacctgcaataagtctcttaacttgttcttgagtttttccgcagaatgaacactttaactgttttttatcatcatatttagccatacattcacctcgcttaaaaagtatctaaataactttttatttctattcagatttttctttgttctttggttttttaacaattatttcgtcaactaaaccatattctttagcgtcttcagcactcataaagttatctctttcagtatctctttgaataacttctaaaggttttcctgtattttcgcttaaagtcttattaagaacttctttaacttttaacattctattagcgtgtatttcaatatcagttacctgaccttggaatccaccaagtggttgatgtatcattatttctgcatttggaagagcatatctttttccttttgcaccacaagaaagtaaaaacgctcccattgaagcagccattccaacacaaattgttgatacatctgcatttatcaattgcattgtatcataaattgccataccagcagttacagaaccacctgggctgtttatatatagagaaatatctttatctggatcttcactatctaaaaataacagttgagctacgattaactgagcactggcatcgttaacttctccgcttaacataattattctttcttttaataatcttgaaaatatgtcgtaagaacgttctcctctacttgtttgttcaacgaccattggtactaaactcatttgaatcctcccttttcaccgttataatataaatctacttatataattatatattctttttataattttgttaattattatttgaaataattgccagaaaaattaatttttctggcaattactattcaataacttatttaatattataactcaaataaaattatttgcaattttcttttataaatttaagagtattttcaattactatatctttttctatcataggcttttgagttttagctaatattttagccatcttttctggatcttttggtccatagatttttcctaattctaaagctctttcgtttatttcttcatcagtagctttaacttcttctgctttagcaacagcttcaagaactaaatcagctttaacttttctttcagcattttctttcatgaagtctctcatcttttcagttgtgttaccagtgaattgcatgtattgatctaagcttaaaccttgatattttaatcttccttcaagatctttcatcatagcatcgatttctttgtttaccattacttctggaacatccatctttgcattttcaattactgcagttattactgcttcttcgaattctctttcagctttttcatcattgttcttttctaaagttttctttaagttttcttttaattctgcaaatgaatcaaccgctgcaacttcttttgcaaattcatcatctaattctggtaattctttaactttgatttctttaatttccacttcgaatttagcagcttttccatttaactcttctttaccatagctttctgggaaagtaacattaatatctttcttatctccaactgctaatcctattaattgatcttcaaagttatctatgaaagtacctgatccgatttctaatggataatcatgaccttctccaccttcaaaagcagtttcacctatgtatcctttaaagtcgataacagcgatgtctcctttttctacagttccttcagttttaacttccattctagcgttcttttcttgcatatctttgatttgcttttctatttcagcttcatcaacttcatatacaggcttctttatatctaaacctttgtaatctcctaattcaacttcaggatatactgtaacagtagcagtataaactaagtcttttccttcacctaattcaacaacatcaacttgtggataatcaacaggtcttatgttttcagcatttaaagcttcaccgtatgattcatctatagcaaagttaacagcatcatcatagaatacttctactccatagaactttttaaccatgttcattggaactttaccttttctgaatcctggtatattgtatcttcctttgtttttgttatatgctttagtaattgcagcatcaaatttatctgcttcaacccttatttctaacttaacaacgtttgtttctattttttccactttagctttcattttattctttcctcctaaaatagtatacatctaatttaactaggttattataccataaacctctaaattatatcaaatatttatttttattgaacataactaccatcttgcgctataaaatactctctattatctacagttatttttaatcctttatcttctctagaacccataactatcttagctgctgctaaatcccaatatatcttgtctgttccagtttgtaaatcagtcatccatagatattgctttacagccgctgttccaaagtatggtctatttgttacaaatactatactttgatcactaacaaatttaggattactattccataaataatcaggttttgattgaagtgtattatctttagtaaatacacttccatttgtagatacatatttatcttttgatacaattttatttgtaccatctatattatacagtgtaatctgagtattaacatcacatattataagttgctttttcgatggacttatgtcgaaacttactccattatctaaatttcttacttctgtaaataccttttccccattttcttctatatagacagctttcgcagtgtttccactactttgaagtatatctacatactcctcaactggtttcttttcttcaactacttcttctttctcatcagcttttttctcatcagcttctttgatctcattgtttttagctgtatcccccgttgatgtagtatcactatcaatccatgcttgtatattagcttttattttgctgaaattaacaggattgtatacaaatttaagtatagtagcacatgctaatacgactattattaacgaaaaaattatgatatttcttcttctttttttcatttttcgttcatattctctgctgaagatacttggctttcccaaggataacccctccacatctaattataatttcattgatttagtaaacaaacttaattatatattattattattattaaatccacatattttaaatattacttttcacattttttacttttacatccagaacaattacctttgctcttgcaagcacatccaccactgcagcctccacacttaagcattcctgcatccctaagttcatccaaagtcggactacacacattttcacaatactcttcataatctatagtatttttaagtaactcttccttttttaattctatcatctattacctccttatatcatttgataaattttgtacaagtttactttataaatcatttaattttataataatacttcattgtattttaatacattctctatataacttcagaaattttttaagtttttatacatttaattgtcgcaatgtaaaaaattattgttttttaatttgtttattgtataataaagttataaatagaagttatttagcccatacactttatggcaccaccataaagtttaataaaccccacaatgttcatttattccctttcttaaatgaacattagaaaatccaataaaatattggattttctttttttaattattaaaaccaaaaatctttttgcaatgattatcacagcaaaaagatttttttacaataaaatataaagttataacttctacattaattcctttattacatttacaacttcacgtgctatatattcagcatcttctaaagctaatgtgctgtagactggaagtgttatttcattttcatacatagcatatgcatttggataatctttaatatcataacctaaatttttatacaatgtaagcattggaagtggcttataatgtacatttgttgctattcctttttctgccaaaatctgaattgctttatttctcttttcttcattaaatccttttactctataaagatataaatgatatgaagtttctgttccattgtcatctttagtaaatggtattattgaaaaatcttcttttcctaatatatcactataaactttaaaaatatctcttcttctatctaacatcttattatatctcttaagctgaacatttccaatggcggcacttatatctgtcatattgcatttaagaccatcatttattatatcgtattcccatgctccagctttcattttgcttaatgcatcttttgattgaccatgcattgctgtaaatcttaaatactttaatagatcttcatttcctttataattattatccttaaaagtaagcgctccaccttctgctgtagttaaatttttaactgcatggaatgaaaacgaatggaaatcacattgtgaaccaactggctttcctttgtattttgcaccaaatgaatgtgctgaatcacaaagtatcataatatcttctcttccaagatccttcaatacttttttaagtccatcatagtcaaaaggaactcctgcgatatcaactggcattataactcttgttttttctgttatcttttctgccactttatctatgtccatttcaaatgtatctttttttacatctacatatataggttttattcctctatgaacggcaacacttgatgttgctgtatatgtgtaaggagttgttattatttcatctccttcttttatatcaaaaaattttaatactaattccattgcagctgtggcactatttaatgcaagtgctttctctacgttacagtattcctctattccttcttcaaactttgcaagctgtggtcctgatgttatccatccacttcttaaaacttcacatacagcctgtatttcttcttctgttatatctggtggtgaaaaaggtatcttcttcattgtctgttcatcctttctttcctgagctttatatagaatgtatcaattccataattaatattaattcaattatttttgagcttttcctatattatacccttaagatttattgatgtacataagaaatcttccatataaaaagaaaatggaatgagctaaaatctgctcattccatttataaattcatgaattattaattaaacatttgttatcggctttctttcacctttaaaattatttattttttctcttctatttccaagttcttctgaaatttcatctactgatattcccatttgtgccattaaaacaagtacatgataagctaagtcacatatttcattaatttgttccttcttatcatcttctttacagcttattattacttctgtacattcctctccaacttttttcaaaattttatctacacctttttcaaataaatacgatgtataggaaccttcagatacattgttttttctttctaatataacattatataaatcatttatattttctttcactaatttcgccccctattatattttattccaattttacaaatccctataaaagcatgttctgtttcccgtatgacaagctgcacccttttgctctaccaatactaaaatagtatcattatcacagtctacctttatttccttaacatattgaaaatgtcctgaagtagctcctttattccataattcattcctgcttctactgtagaaccatgttgtatcaccctctagtgttttcctcaaactttcttcattcatatatgcaagcataagtacttcttttgttttaaagtcttgaacaattgtaggtactaatccatttccctttttaaaatcaatttgttgagctcttctacaaatatccatatgtaccccctttttgctaattcaattcttatagtcttacagcaatttctttgtcatttaaatattgcttaacttcatccaccgtcaactctccataatgaaaaagtgatgctgctaaagctgcatctgcagtattatctttaaatacatcatagaaatcttccaaacatccacaacctccggatgctataacaggcacattagttatgttacttactgcccttgtaagttctaaatcaaaacctcttttagttccatcagcatccatggatgttaacaatatttctccagcacctaataatgtcgcttcttcaatccactttaataaatctattccagtatctattcttccgccattaataactacattccatccagtttcgtcaggtctttttttcgcatctgctgctaatactatacactgatttccaaaataaaatgcaccttcttttattaaatttttatctcttactgctgccgaattcaaactaaccttatctgctcctgctctcaaaatagcttttatatcatcaatactttttagtcctcctccaaccgtaaatggtataaatattttttcagctacactctcaactactttttccattatccctcttttttcatgagttgctgttatatctaaaaataccaattcatctgcaccctgtttattataatactctgcaagtgctaccggatctcctacatctacaagaccttcaaagttaattcctttaacaactcttccttctttaacatcaaggcacggaataattctctttgtatgcataaaatgcttccccctttcataagcataatgcttatatctctggcttttattaatttcttactgcttttatagcttcttctaatgataatgtttctgcataaattgcttttcctgttattgccccataaagtcctatttcatttaaatcttttatattttctatatctcttattccacctgatgcagttatatctatatttactgtttctttaatcttttttagcatatctaaattaggaccttgaagagtcccatcttttgaaatatctgttactattatattttttacacccaatgactccattttttgtgcaaattcaatataatcaagattgcttccctctagccatcctcttccataaactttaccatctttacaatcgataccaactgctattttttcaccgtattcagaaattgccctttttaatagattttcatcttccatggctatagtacctagtataacccgtgaaactccattttctaaaaggtactttatagtttcaaatgatcttattcctccacctaactctacaggaatatctaacatattagctatttttataaccaattcatgattatcattgctcccactttttgcaccatcaagatcaactaaatgaatatattccgctcccattttctcaaatgattttgcagtttcaaatatgtcttctgccactatttcctttttatcataatcaccttgataaagccttactggctttccatcaattatatcaatagctggtaaaattatcatttaatcaactccccaaaattttttaatatatctaatccaactgttccactcttttcaggatggaattgagctcctataatattatttcttcttacaattccaggtattttattctcaccatattcactataagcaactaaatcttcatcattatacgattgtgcaaaatatgagtgaacatagtaaacatatttaccttcatctatatttctaaaaagaatatcttttctattatattttaaattattccatcctatatgaggtatctttacgtttttttctctatcatctttcatcttaacaatattaccttttataagaccaagtcctgttctttctaacccttcatatcctttttcaaataaaagctgcattccaagacaaatccctagaagatattttcctttttcagtctcttcttttatcaccttatcaagcccaagcttttcaatggtatccatagcatctggaaaagctccaactcctgggagtatcaatgcatcagcttttcttatttcatcataatcatcagaaattttattttctattccgagataattcaaagcatttctgacactttttaaattccccatcccataatctattataacaatcattaaaacgcccccaaatatcaatcaactttaaattgttccttttgttgaaggaataccattttcatcactaattttttttgcatcttttagcgctcgtccaaaagctttaaaaagtgcttcaattttatggtgatcattttcaccatataatacttttaaatgcagtgttattcctgcattaaaagcaaatgccctaaaaaattcaactaccatttcagtagccatttctcccaccatttctcttttgaaatcacattcaaaaacaacaaatggtctattgcttatatcaagagaaaccatagctagcgtttcatccataggaacataaaaagttccatatctattaatccctcttttgtcaccaatagctttcttaaaggcttcccctaatgttattcctatatcttcaattgtatggtgatcacatacatcaagatcaccttttgccaagacctttaaatcgattttgctatgaaaagcaaacaacgtcatcatatgatcaaaaaatccaactccagttcttatttcactagctccttgaccatctagattgatttcaagctcaatattggtttcattagtttttctttttaaagttgcaagtctatcactcattttatataaatcctttcgtcaattaatatacaaaaatttcttttatagcttctataacttttctattttctctaggtgaaccaactgttattctaaaactatcatcattaaaacttcttatatatattctgtgggtttcaagtccctttattaatgcttctttatgctttgttcttccaaatataaaatttccctttgatttaaaaaattctattttcatagctgcatttttttcaatctcttttaatctttcatataacagttcacgttctcttattattatttttgtattattaattattttttcaggatatttcaaagctatttctgcaatcttttgagaatacgaacttattgtataaggtactttataattcaacaattcttcaatattttctttactacttatcaaaaacccaaccctaagtgcagctaaaccccaagcctttgatagggtccttgtaataaaaagattgctataattgttaatatacggaatcatagattctccattaaattcataataagcttcatcaataacaactgtagaattttcaaattcttctagtatctttacaatatcttttggagaaatatttattcctgtaggattattaggatttgaaaatatgatcatatcaacattatttgattttcctaactcaataaatctatcaacatcaaatttcatttctgttcctatatcatattttataagttcccctttaaatctctccacaaaaaaatcatacattacaaaatcaggtccaaaagataaaaccttcccttgtgtaccaataacttttcctataattaattcaagtacttcatcagatccattacccacaattatattttccgaattaacttttgcatatttaccatataatttctttatatctcccatttcattggatggatatctatataggtcaatacctgtcaaactagattttatcttcataatcacattatcatctacattcataaagatttcattagcatctaatttaattttgaattcctcagcggaatcaatgtatcgattataaacgcccatctttcaatctcactttaatagaatttgcatgagctgttaatccttctttatcagccatagtaataatcttttccccgtttttcataattgcttcttttgaataatagatgaatgatgatttttttataaaactgtctactgataatgctgagaaaaatctagctgtaccacttgtaggaagtacatgattagttcctccaaaataatctcctataggttctggacaatatcttcctaaaaagactgaacctgcatttctaacaagtcctaaatactgcattggttcatcaaccataatctccaaatgctctggtgcaatggaattagatatatctatacattcttcaatattgctacatattattgcttttccaaaatcatttaatgatgttcttattatttcttctctttctaatgtttttgcttgcttatctaattctaactcaactttttcatataaatcctttgaagttgttacaagtattgccgatgcaagcttatcatgttctgcctgagacattaaatcagcagccacataagatggatctgacttttcatctgctataacaagaatttcacttggtcctgctatcatatctatatctacttgtccaaatactaattttttggcagttgctacaaatatatttcctggtccaactattttatctacctttttaatagtttctgttccatatgcaagtgcaccaactgcctgtgctccaccaactttataaatcttatcaattccagctattttagctgctactcctatatatggatttataccaccatttttgtctggaggagtaaccataacaatttcatcaacccctgcaactttagctggaattacattcattaaaaccgatgaaggatatgctgctgttcccccgggaacataaacacctactctttcaagaggcagtactctttgccccaaataaacaccactatcttcagtcattagaaaaccatttgatttctgtttttcatgatatgcttcaatattactcttagcttcttttaatgcttctataaaattttcctcaaccttatcaaaacatgcttctatttcatctttcgatacttctaaatctttcaactctactttatcaaactccttggtaaaatcaaataaagccttgtccccagatttttttactttttctaaaatattctttacattaagaagtatatcctgttctgtttcttcacatctctctttaagttcattaattaatttctgcttattgctttcactaatctccattaacttcaacatttaataatagcccccttattttcagttgatcgtgtatagttgaaaatttgtagttatcaaataatctatttcatattcagccccacatgatcaaatagataatttgtcaaataattttattttttattatcaattaattaaaatatcttacttattattatcaacattctgcgttttttgtcaattattaatatttcctttaatgccctcaataaattctccaatttccttttgtttcattttaaaacttgctttattaactataagtcttgcacttatatcacatattctatcaagaacaacaagtccattttcctttaatgttgttccagtttccattatatctacaattccatcacataagccaagtattggtgctaattcaactgatccttcaattttaattacttcaacatccatgtttttcttcttaaaatattccttagctactttgggatacttactacctatttttatatgtccaacttttttgaagatattattttctggtaatgaagccactataaatccacattttccaaatcccaaatcgagaacttcataacatttatgttcgctttctaatatggtatccttccccactactccaatatctgcaacaccatgttctacataagttatggaatctgctgcctttaccaaaaaatatttaatttcttggttcttatccttaaatacaagctttcttcccttatttttcaattctgatggatcatatcctgatttttctagaagttttaccgcttcttcttctaatctgccctttgtcaatgcaatacttatgctcattctatttcccccaatttatcaaattactaacttaatattctaacttatagtaataccttaatttcatttacactgtcatcaggtatcaattctactatttttccttcttgtctaagttgttcactttttcttatagcttcaattctatattttgatgaataataaattttacagcttttatcaatagtatttattttttcacttgttttaacattctcaataacagaattaatatctaaagaaaatcctattgctggaatatattcttctccaattgtaataagattatcatatcttccacctctaagtactgtatttccaacaccttctccgtatcccctaaatattattccagtataataatttagtcttggaaccattcctaagtcaaatgttactttattaccataccctagaatatcaagctctgaatataaattttcaagatactctaaattagcctttaattcttcattgaaagctaatacttttgcttcctccaagattgatctatctccaaaaagccatggaagtttattaaaaaactctttatattcatctttaatatcaatttcatctaaatagtcttcaagatttttcaaatttttatcttctatatattgagcaattatttctttactttctttacttatattaagagttttaaatacaccttcaaaaaaacctatattgcctatttcaagtttaaagtcacttaatccaagtttttctaatgcttctaatgcaagaacaagtacttctaaatctgactttttatcctcaagtcctataagttctactccacaatctgtatattcatttctttttcctccaagacttgcatgaactctaaatacatttgagttgtacctaagcttaattggcagagattcatctttaaattttgtttcaacaacccttgctattgggattgtcatatctggtctaagtaccaaaattctacccctattatcaaagaacttatacatatcttcttcttttaatgtttgagaatcatgattaaaagtttcataaaattctactgttggagttatgatttctttatatccccatttataaaaaatatcatctatatctctttctattgctcttttcacaatacattcatctaatattaaatcccttgttccttctggaagaatattttttttcttcatatttaacccccacttattttactacttaatcattttatcattttatcaatttaacgtgctaaactgtttaagttaatattactctctttccatgtttttgtcaataaatcattcaatatttcccaattattttattccttccctttaataaaatgttataatatatctgttgtaattctcagtagacaaattgtaatttacttaatgagaaattatcttgcctctgtggcttataattgaaacttacaagataaggaggggatttttataattgcatatgaaaattctgaaaaacatataaacaaatttgatatacacaaccaaacatccgaatcagttactcttggaattttgttatcaatcgtaggaggcttcctagattcatatacatttttatgtagaggtggtgttttcgccaatgcccagactggtaaccttgttcttgttgccattgctgttaccaaaagaaatattcttgaaaccttaactgctttattgccaattttagcatttgtagcaggtgttctcatatgtgaatggagaaaaaaacatcattttgtttttccaggaattcattctaaaagagcaattttaatattagaagtaatagttttattggtagtaggactgattccaactacagcaccaaatttaatagttacagttgctatatcttttgtttcttctcttcagatagcatcttttagaaaactatccggaactccatatagcactgcaatgtgtacaggaaatttaagatcagcatgtgaagctttttatactggtatttcaagtaataattcagatgaacttacgaaatctttacgttatggtaccattataattacatttataataggtgctcttctcggagccattttaacatcatatttcgattataaatcaatatggttttgtgtattcatgctaatagtatctatatttctattcaccataaatgaatataaattcaaaaaatctcaaagctaatgtgactcttcacacagctttgagatttctatttttagaatgtaactatttccatattgtttatagcattttcaattaattcttctacatttaagctttcttcttgtttctttataggttcaagcttaggatttgtttttggatgctttggtacaaaaattgtacaacaatcttcataaggaagaatcgaagtttcatatgtgcctatttttctcgctatttccattatatctgttttatctgtagcaataagtggtctaaaagcaggtctatcagcacaatcatcactaactattaaaccatccatagtctgactagctacctggcctatactctcacctgtacatactgaatctatattatatttctccgcaagtttacatgctactctcatcataaatcttctcatgattattgttagttcatcttccctacatttatctattatttccatttgtatatcagtaaagggtactatatataaatttattttttctgtatattgtgatagtatccttgcaagttcttttaccttgtcttttgctctttcagaggtataaggatgactatgataataaacacaatttaattccacacctcttttagccataagatatcctgcaactggagaatctattccacctgataacataagcattgtacttccattcatgccatatggaagccctgcaacacctttagtaatatcattatttgaccatacatatgcaaaattattacgtatttctatatttatttgaatttctggttttttaacatctactgtaagttcatcattcatattggtaagaatatgaccaccaacacatcttgatacttccatagaattcagttcaaattttttattagctctattcgtaactattttaaatgtttttccttcacattctttaattttatttagtgcaacttcttgtatttgatcaatatcaaccgctacttctttaactttacaaacttccaatattccaaatactttgcttattttttttatgctttcttcaatctggtcagttttaataaagtatcttccactatcatgtataaattcaacttttattccttcaagcttttttccaatattatctctgagcttcttttcaaatttccctctattaagtcctttcaaaaatatttctggtgcatattttactaaaataagatctttcattatttttttatcctccttaagaacctaagtcccttttctaaagtttctacagtgtaatcaacttcttctaattcattatcatcgctaaatgaaaatctgattccacctccaatttcatcattagtaagccctagcgctttcagtacataacttccaccaatcctagccctttcttttgaagagcatgctgacccagtagatacataaactttattttcctctaaaaagtgaagtaaaacttcaccccttacacctctaaatgaaacatttaagatataaggcgaaaaactgtcctcatcataactatttattcttatattatctattttttttagtttatcaataaatcttctttttattgataaaactttttcataattatccttcatattttcacacacaatttttgctgctactgtcatacccattattccagatatattttgagttcctgcccttatacctgattcctgagaaccaccctcaattaacggagatattacagcttgtttttttatatatgtaaaaccacatccctttggtccatgaaatttatgagcacttaccgttaaaaaatcaatctgcatcttttcaacatctattggtaatttcccataactctgtactgcatcaatatgaatctttgctcttgaactagccttctttacaattctgcttatctcttctatattctgaataataccaatttcattattaacatgcattattgacaccaatacagtatcttttgttatagaatttttcaaatcttctaagtctacttttcctttatcatcaatctttaatactgttactttcacaccatttttttctaaattttttatggtatttaatatagaagcatgctcaaaaggagttgtaataagatgatttccgctttttaacacaccctttaaaatcagattgttaccttcacttcctccaccattgaaataaatttcattttcagaacaattaatagtttttgctaaaatatctctacattctttcaattttttttcactctttagtccaagattatgaagggatgacggatttccataaaattctttaagaccatagcaaacttcattaattacatcatcataagtttttgttgttgaactattatcaaaatatacttccattaaaattctctcctatcatatattctatattttgcacaatttatagaatatatttgcttcgtttcaataaatattataaatatattttttcacttaattttttttatattacaatttataatatatagttttcttataagtttagtatgttttcttttttattataacaaaaaaaggctctatgtatagccttttcttttaaataataatcaaaaaattattttttaacactctaaatttattcataatattttataagagcttgcgtgccaaaatttccacagtcattcacttcaagagtttcatacatttccaatactttattaagaaccttaagttctgaattaaactccacacattcttctactgcaattttcatatcttttataaaatgttttatataaaatcctggtgcaaaatcttcattaatcattttaggtcccatattgctcatctgccaacttcctgcagcaccttcactaatactgtttaacattgtgtttacatcaagtcctgcttttttcgcatatgttatagcttcacatactccagacactgcaccagcaatagcaatttgattcgccatttttgtatgttgcccattccctgcctttccttcatatatgatattagttcccatgcattctaatacgtccttacattcttcaaatgcatttttatctccacctaccataattgataaggttccatttttagctccaatatcaccaccagatacaggtgcatctaaagctttaatatctctagacttagcttcatcatatattctaattgataatttaggacttgtagttgtcatatcaataactgtgcttccttctttagcattagctaatattccactttcaccaaagtatacttcttctacatctttaggatatcctacaattgtaataataatatctttatctttagcacatgactttatatcatcacaccatattgcaccatcttcaattacatccataattttagatttagttcttgtgtatacaaaaacttcatgtcctgctcttattaaattttttaccattgattttcccataacaccaacgccaataaatcctatttttttcattattactccccccactttatacacatttttcttgattatcgataattaaataactataatcaatatcaattattactatatttcttgaatccgcatcatttttcaaatctattattttactacttctgtctgcaatttttattattggtcttaatggactatccttattaaccccaataactcttgcacatctcttatcactaagttttacataagaacctactggatagggctctatttttctcaaaaacgcctttacaatgttataatcaaaactacttcctactcccgccataatatattctatagcttctaatggttttataggatttctatacggcctatttcctgttaatgcatcatatacatcagcaacagcaattatcctgccaaataaaggtatctcttctttttttaatgcatgtggatatcctgttccattgtatttttcatgatgacttattattcccatatatatatcatcacttacacacttatgatccataacaaaatttccacccaactgagcatgtgttttcacaatttcaaattcttccttggtaagctttgaaggtttgttaattatttcaataggtatctctatttttccaatgtcatgaagaagtgcacatacccctaacttgcaaagctccatttttgtcaaacttaatgccgtaccaatagctattgaaataactgttacgctgactgaatgtaaatatgtatttaaatcatacgtctgtaaatccgatatgcttactgaaatttgtttatcactataaatattgtcaaccaacttttctgaaatactttcaatctgttttaatgtattttcattaagtatggtatgagtattttcacataaattaaaaatttcctttactgcacgaactgattcttttcttaacttttcatcaagtatcggatttgttctaccatcatcaatataaactccagatatattaaaatttgataattttaatatattatcctttgttaagatagcaccttcttttaataaaaaagcctttgatttttctgtatcttttaaagatatatcattagcaaccttcattccttcttgtaatttataatatggtacaaatatcacaatttctcacctccagtattctttttatatcaataattaaggttaataatatgaatattattaaccttaattaaatcaaacgtgatttaaactaattatttcctcttatgtaaattatgataaatagcactttatagactattttgtaaatattataactctttattctacatttttaaagtattttttcaaaaaattattgaaataatgcataattttattgtttttacatagtattggtaaatttattatatcaatttaatttttattataatattctttccatttcatcgactttttttcttaacatttcaatttcttctttatacttattttctttttcaatccattctttatttaaattattaataagcgaagccatttcatccgcacttccaacaattctgttaaataataacaaattagattgaagtatttctggtatttcatcatgagaatatctaagccgatggtctatttctccatatccttcttcaaatattgttctaacctgtatttctgcaatcactttttgatttgtaggataaaattctacgagataatgaactgatctatatcctgaagctctagatcttacttctatatctaattcttcaaaatctttagtattatcaccttctcttatattagcagttatttctataactttccaggtgcttattataaattcatgaatttctctccattgctctttaaaaatgtgaattactcttattcctattaaatcattaatttcattcttataattatctacagaaaactgaaattcatcaccatatttattttttcgatcttcggtctttcttattattttttcaataagtctttctggatccttaattcttgactttactgaatgaaccatactttgagatctcaaaatatttgctataaagctagcttgattttcatatgaatttttataatttatataatcgctatatatctcctgcaaattctcaaaattaattttatatttcatcatttgtttttctaaataaggatacttttttaaaagtttatccttttctaatatttttctcattgtatcctccaaaatttattagttatatttaaaattcttaatactataattcataaatataattatacataaaatcattgtgatattctattctgcaatgttttttattcgtatatctacatctgataaaatctcaaatattatattattattagcatttaatataacatcatcaagctgatgttgaagtactttaatttcatctaataattcttgtatttctttattcttatatttaatgttaatttccttgtccatcaactcatcttcaagttctagtacttttttctccaaactaaataaatgtttatacatctctattaaatccaatttagacatatcaaatgctatttcttctgtaaacatcttttcatgtattatatccattatcttctcattcattctgtcactatatctatattcttttctataatttttttctctgtcatagttataacctatacaatcatttataatcttggcaatactcaatgcacaattatattcttcatcttgattatttacaataataaatttgtttatcaaatcactacatttgttatctaacttctctataattttatctctatccatatataaatttaaaattttctgtttctttctaactgttttaagttcattacctgattcaactacaactccagattttttaccaccattatttaataaatagtcataatatttttttatcagattattaaatgctttatcaagtatgtctatgttattattatttaaatttattttacttgctaaaatactaaatttagactcctttaacacgttgtatatctctttttttaatatacatcctcgtttaaaattattgttattatcataaattgacatgtctaaatcattatcataaataattctttttaatgaggattgactactgttttctcctatacaatatttttcttcaaatattattcctaccatataaaaattattttttccatctataaacccattctcatcaacaaacatcaaatattttttaaccatataacctctcccctatttaaaatattttaattaatatattaaaattatttatgaaaataatttcattaacgcttaatcatgataacgttatcaagaactgcaaagtttttatcttaaatagtattctataaaactatacactttccttccaaattatgtaattttttaagaatttaataattattctccatttatattatgttatgttaataaatttagaacaaaaaatccgaaatagcctaattaatatggctatttcggattttctaatttttattccattcctataatattataaaatccctacattatatatagggattttctgtactttaattatatctattattcatattatattatgatttttttgtttaatagaattttaagtacgtttttagtacgaataattttatttatatgaaaaaatatactatataccaaatctaatcattagtccttgtacaaaactaattataaaagttaatacaataggtaaaccagttagtaatgatattattgctatttttttgcttaacttcttttgaattaacataacaattcctaatataaaactaatccatgataatacatatccacaaattaaaacaattatatatgtatattcactcataaatgaatattttgaattaggattactaaaatcaattgggaaaataatataatgaaatgttgcctcaattaaacaaattaatgttaatacgataattacaaacgaaattttctctaatactgttttatttttaaagttcaaattttatcacctccatgattgcactctatttatatttacaacaaaaattattcagtaaactataaattactataagctccatctttatttacaatattttatataccaaatctaatcactataatttttgctgctccaattatacaaggtaatgccaatggagtacaaattattagtgatataattgaaaattttttattcgagtttttttgaaacaatgtaacaattcctaatatgaaattaatacatgccaaaaatccaaaacatattacaaaaaaatttgaatatggtcttaagtattccaagtattgatatacaattaaaattctcgaattaggattgtcaaatgggtaaagaaaatctaaacacattgacactattatattggctaatataaataatgaaatataaaaagtgacttttcccaatgttgtattacttttaaaattcaaagttacccccccttatttttacattctagtccatattataccatattgtatataaaacaaaaaagaagccagtaagctagaaattaatctaacctactggcttatttaagttaaagctatattcgtgcaatctagccttacatattatatcataattaaatttttttaaataacattattatggtgtaactgaatagtcaccttctgtatacatcttaaattcactccaccttctagttattagtccttgatacttaacaccattaatatctgtaatgcatactctccagttatcccatgtattagctttatttcctaatactatatctgatataccaaactttttaaaattggtaaatcccatgttataaatagcatcagcgcatgcatcaaattgattttgagataatgaaatattattctcatttagccaatttacaagtgtctgacatccattctgcatttcttcttttagccattcaaaagcttgattttcagtacaagtttctatccctttggcttttaattttttccctacacttccagcagtacttgtaccatatccaatagtagcagtaccatctccataataccaatatgaataaaatccctcaaatttctttgtattattaataagtagatgtgatactgtatctccgtcttttacccaagctccatgagtattaaaactataatacttaccatctataagaattctacagttagaatacatatatcctttatctatatctaagtaataccataatccatcagcatcctggaaccatcctataagcatagcgccatctggacctaatctgtaccatttattattatcaagaatccatttgttagataccatatagcaattatcatcaaagtaataccacttaccatctttctcatatttgaaccaacaattttgatatgcataccctttagaatcaaatctgaaccaattaccatttaactgcttccaatctgattgataatatgttaaaccatcaggactataccaccagcctttagaatctttattccacccaacagtatattttttctttaatggtctattaacatttttctcatcttctaatacccatagttccttaataatagagctatttatatctaaataatattttcctttatctccattataatctccccagctatttattaatattaatgtatcttctttatatccaatgcataacagagcatggccccctctttttttcccattaggttcttcagggataattccaccattaatattagcttcatagaaattttcatatactcttactgttattaaaactggcttttgatatttaaataggtactctttaatattttcgatgtctagtcttatatatgctaatgacttatgatcatctgcttcatctaacagcttatcttttccatacttctctaatgtagttactatacttggatattcctcattaacaggaaaagatttttttgtacaatctccatactttactatatttttaaaagcttctctagtaatcattccagtaccttgaaagtcatcttcctgcctattagcataaataaatccaacactatacatattatctgtattagttccatctatatatgatttcatacagcttagtgcatgagcaacacaacttccaacagttccttgatttaaaattggatagtcataatctaatataaattcttttggaatatcaatattgtctgaactacatgaaaccatgctataatcataatctcttaaatctactggtgaatcaattgctcctaatataaatttatcttccataaataaatcctccttaaattaaaatagacagccataaggctgctatgattattcttctttatttaattgcttagttgtctggttaactcctacagcaactccccaacataaaatgccttgaagtactgcattaacaatagctttgtacattaccatgtattctgtattaattaaatttaataaaactgaaaaggtaatgctgaatatcataagtgatatagtaatatacttatccttaacaccttctaatttctttaagaatattcctaaagtataagttgctacaattaatattaataagttttctgggataaattgaataagatttgttaattccatttttaattccttctttctatttttctaatgagtctattctgtgatgtgccgattttacactctgcttaacttctattaagtcttttgcgagttcattaatttgcctatctcttgatttattatctaatcttatatcgtctacacctttgctgatataatctagctttgcttttgtttctgcatcttctcttgtctctgctctaatatcgttgcttttatttctttgaaatgataaataagttatagtgacacctaaaattgtgcaaattaatgcaacgcttattgtctccatctgacacctcttttctttaatatttccaaacgtttggaactttcataaataaaaaaagacctataaaaagtctcagaatttactttatggttattaaatttaaatacatttaataatttgttattattaattctttatatttccctcttcccttagtttcttttgaaaccgaataattaacttgtacctcttttatgttaaagtctttataccattctcttatgttctcatgatcgtttattgttaataaaaatttccccttgatatttgaaagtttatctcttaacattaaatgttcgtgttctccaaatgtatttccatacccagttgtttctaaatagggaggatcacaaaagaaaaaactatattcacgatcatatttatctatgattttttcaaaagataaattttcaacataagtgtttcttaatctctcttttaaatctccaagtacatttttataaaaaatttgtggtgatggttttgtattcgtaccatatccatatactccaccacgccctgcaaagctttgtgttattaaatatagaaatcttacagctctatgaatttctgttaagtattcaattgtgcaatgtttatactcttcaaaaatatctctaccagaaaattcatattctaattgtctttctatttccggagaatgatattttatcattttaaataagttaataagttccttatctatatcatttataacttcaactttgcttttttccttgccaaaatatacccatcctgctccaaaaaataattcaatataacaagtatgttctggtatcatttcaattattgtttttcttaatttacttttgcctcccatacgacaaataggtggttttaacataatatcacgtccttactctataatgctttaaagttaattattatatattaattaagtctgctaggtaattttagttcatcatccccatttttaatatttattcttttacatatattgaaggtgatatcttttatttgcttcaattcaatttctgtaattaatccatctgcttcaatatttgtattaatttctatttgaacattacaatcctccccttcttgattaagatagacttcaaatacttttttattaaacatactatttgtctcctctcttattttaagcaaaaataaaaacacctactggtgcttaaactttgctcttattactttttatttgattacactctactctgttgtaactgtttcttctgtagtagtttctttatacttttcttctgcaagctgcattaattttgtatattcttcttgagtaagaacgttaaatgcaaagaatacatttagcttctgttctacttcttcctttgttgaataatatttgttgttaattaagttttctaaaattttagtcattttacatcttcctctctattttaataaattattgtaagttacatcaactacggtagcctgtgtttttaacaattcatgctttgtattttctaattctttattcttagattctaattctctcttaagttgctctttttcttctgtagttgcttgtctatctgctaaaatgaaactattagtgcttaaatcaactcctataacttctttagtatctgcaactaatgaagttaaacaagcatattcttcttgcaccccattttgggtaaatagtaagtctccactctttttattgtatactgctaaaattttattcataattatcctccttattgtgttattcacttatgaaataattaaaatctccataactataaacaggtaatcttaacagagaactacttattgataaatctggattattttcacttggtatttttataaagtattctttttgggtggaggatggtctttgcaaatagtatataccatctctaagtatcccgatactcattaaaaatggagtgcttgtggtaatattcaacacatatattgtaccatttttaggtataaatcctaaattttcaatagttaaggtatatgcactaatagaagttccttcggaatttatccaagttttttttgaatttgggactgtgaatgtacctactctgtaatttatacctcccatactctgtatagtagcattaccggttctaagtactccatctttccagtacttatatccatttaatactttagtatcatctgctgtagctccaccagtttgacttgctaaactattagctataatttgtccaccagcataataaccttcctgtaaattaacaactcctccacaatttaaattagatgtcggtgcacctcgattaaccatagcaccatctacacgtccattatcaccttctccataataaccagctaataagtatttagggattaagtttccaccaccccctttaccctgtaatataaaatccgagccattatgacagagattataaggaatattagctttcatatttgtaactacatttccattactgtccttaatggctactgctccagaattatttaaatttaaactacaattaccattacttgctgttccaacaaatagcgtacatcttgtaccctttcctactgcttttattcttgcactagctcctatataagcatttgctcctgttgcttctactattggataactatcattctctaaattgtttatttgcttagtaatttcatttacttttgtctgtaattccagtacatctttcctttttgcataaattattgttggatctatttttaatgttatagctgacgtatttactacagctaatgtcattttcatagttatttcttttccgcttccctcatctaatgtaggcttatatgattctgcacaattacatattcctatcatgtctccatcagaatcgaaaactgccatttctcttatagtaaatcctccatcggttggagctattaccgtatatatattaatccaattaggattaccagcatcaatttctacatctacaacattacctctccatacttctttttttacatctgtctgactagaatcaggattataaaatgcaccatttccatcacctagcttcaataaagtaagatccaattttttgccgctataaatactatttgctattttagcctgaccaatatcagttactaccgtataatatttactgccctttaattcagccattaattattcctcccttggataaatttctattatttcgctacttatacttctagcattaatttcaatatcaaactttgcatttatttcagtaatattccatggcaaaaccgatatttcttctgatattaaagtagatgctccaatatatatatcccctttactagctataaataaattaatataatctatccatgatcttttatttttataaacatcaattaagatatcaagtttttttagttcttcaggagatgccccaacttctgttatatcaacatcaagtccaaaaaaataaggcttcccaccatattcaaaccattcttttagctttgttttaccaaagactgttgtacatgcctcttctactgcttttggagtcccttttatcatgtgtaaatatatcgacttcttaacaagttctcttttttgatctaaagataaactatagtcataaaaatcaacatgaaattgccatgcgagagaatcaatagcttcttcctctagttcatctattcgcccataaataaatacaagccttgtgctatcacttaatttttgaaatactggattaagtgctttacacaaagcttgtacaaaattatctttttgcatatatgaagtttgcaaacttaataaatctattttatttaagtccattacaattttcctccatatgtaacattaatattttttacctttgctaattgaatttcttcaatgttatcatagcctggactatttataatcaattttcttactccagataaagttctattatccgcttcataagttgctgaatttaatatctgaaactttagctcttcaacatttatagatctacctatgtcctcttgttgccagttaataaatgtccttattgctccactttcgtaatcaaagttttcaccttcaatagctttacgccattttccttcataagttggaaagtttttatctaagtaatatgttaaatcaatatcatattcaactatttctggagttcctgtttcaaccttatctgtaagtgggcgtctatctctaggagagcactcatcatatactttttttagtatttcatctgaagggctttctccattatcaacaactactaatattcttactgttccaggtgatggagatactacttttactgctgatatagagttgtctgctgaatatgcgtagtattcatatgctccttccggaccagcacaactcttactttccatttctaacctagctctttctctatatgatttatcatcttcaatatcagatccttccttggatatttcagtattataaatttctgaaacatatgcaataggatcaataatatgatttatctttccagctaatattccattatatttttccccagtagatgttgaaacaagttttacatcaacttccttttggcctgctttaactatataattttcttttatttcaaatattcttattccatctgatgttattttagttccagatggaataagaatatcttttttctgaacctctgataatactgctttaccagaacacgatgctttagttggttttaatctcttagtatcaaaataactgttagctatagcatcagttttttcttctctcgaattctcaagaaagttttggtttgctgtatcatttatatcattttttaatgccattattataggcatcaaggattttataaatagctttttttcatcaccttcatgaagtttttctccaagatcagattcaatattgcgtactatttcttcatatacagtttctgcattaatattaacaaaattaatgtacaatttctatcaccacctttattactggaattttattattgttatcatcaatttcatatacaatgttaacttcttttactttaactcttgtttcataagtatttactaaatcatatgtttcctctattattttatttttcaccttttcaagtggtttatctaagttatccggatttctgcccataagcctatcataaggcacttcgtctttaaaggtatttaatatagtatttacattttgaattattctttcatcaccttttgcattccaatttaaataacttttatttgagtaaacttcatattccataataattatcctccaaaaatttggctttctaaagctgaaacttttgcttcatcgtcactagacatagtattatccgaagagcttgatgaggatttcttttttttagatgagctcgaacttttcttagttttagatgatgtaccttcttctttttttgcaccatatcgtacgtgttccctaaatgtcaatttaagtttgcatttaatcattttcccagagttaattattaatgaatctgaaatatcacctttttctaaaatatatttattatcagatactggagtattgcctataaaaagcatatgtggcgttttggaataacatatttctttccactcctttaattcagtttcaacatcaacacttgatgattgtcttaaatctattgtaaagctaggtttttctaaatctaatcccttaatgtagtttgaaggtctgtcattttctacttcctgctcttcaacacttattccaaagctatttgaataatcatcaaatgtgtatattttattgctatttacttcaaaagttttttcagcaaaccctcctaaactcattaaatttcacttccctttgctattattattcctgaatttataccatcataaaggcatacaatcacacttgatcctatttttaaatctaatgtagcagtacagtttgtattattgcaactttctgtacactttactttaaactcacttatagctaaccacccagatacagtattatttaaatctgggaatgtcactctagcactagattctttcaattctgatatgtacccttttctaaacatcaatacccctccagtacttttctgacttttaacttagtttttccacttgaagcagaatataaattttctattatatatttaccactaaatagtgccaaatcttgaattttaatattattccctgcagctatattattatttttctcaatatagaaatatcctgtagtttcttttttgttataggatctcaaaatatttttagaaaatctatttgcttcttcgatattatatacaactatatcatttactttcaaaacttctagtgtattatcataaatatagcttccctttataaattcttttgaaaacgaacttatttcacaccctccaaatactttatttgaagtacattcaaattcatatttatctttaaaatcagcaggagtaacagttaaaactgtatcctgcttttctaggaattcttcacttactattactgctttcccatctgttattttaagattatatccttcaagtttgcatctataattcaagaattcaatattattttcttctaattgatcaactcgtgtatacaaataatcatttaatccataagtttctaaatctaattcacaatctttaagcagatcttttgctaaatctaaaaatcttacattttcccatacttttgatttctttgttttaaattttttctttattgatagtgcttttattgaataatatccattagaacaagagtaaccatcaacaaacatttttccgcttgagaatggatactctatcatttcaataatgtcattcttcttaaaatcccatgtcctacactcatgttttatatctgaaaatataaccgatacactatcgcatttcccccccatattatcatcaattttataatctactacaactacatctagttttactccttgatagtataaatccatattaccacctaccttttccatggaggcaacgttgatttatcacttacttttaattttggtattattaattcaacgccagcttcgaaaattatagttcttatatgagtaggattaagctgcattataaatgtgctataattctcttcaccataaaaatctaatgcaattctatcaaatgtatcaccatttatggttatatatctataacattctctaggcaaactcaactctctccctttcatctaatattttatttaccatatccttaaattcttcatattgttgttttaatatattaactgtttccgatgatgcttctccatttattactggtgaaaatacaaatgtaggtgcattaccattattaccactattgttaggatttactattgaagctgtcttttctaacagtgaaatacttctaggattgtttcgtttaagtggtattactgcttctggacccgcttctcctgcaatacttacaccatttgtaattccaccttttgcaagcattggaagttgtggaatactaaggccaaaatgttgccctcccacaagtggtacccagtcaggaatatctaaacttaatgaattaattccccctatagcagtgttaattaaactaattactgcattgagtggtgcttttgctatagctccaatacttccaaatattccagtaaaaatttgaattatattttgccatgctcctgaccaatttcctgcaaatacatttgatataaaatctattactccattaaaagctagttttatattttcccatacagtaccaacagtataaaaaaatccatttagaatattacctaaaatcccaaatgaattagtccagtctgttgtcatagctgtagtaatccataaatcaaatgcctgtattccagattgaatactctgccacattcctataaagaaatttctaaaaccttcacagttattccatagtagaacaaatattgctataatagctgctatacctaatactatccaagttattggacacgctaaaaaagcactattcaatgcccattgtgctgcagtctgaatacctgttgctgttgtagatattcctcttgctgctgcatcttttacataaatagcacagttttttacagcttgtaatccctctttgattttcaaagcattaagaactctatgtgcagtactttgaactccagtagcaacagctgatgcttttctaaccactgcatcttttgcatataatgcagttaaatatatagtatcagctttatctttaagttttgctaaccttaatgcagccataccgccctttaaaatgcaaatcgaattatacacggatcgtattgcttgtactccagatgatactccactaattactttccatcctacaaaggcctttgcaatataatcaattattgttcttatttgtggtccattgttttgaacatattgaaatccactttgtattttgggaattgcattatcaactccatcgcatactttttgagtaaatgatgtgaatttttctgccataacatcaaatgatccattatcttgcatctgcaacaaataatctgttactgatgcaaatttctctttaattttataaaatgcggaatctttaacaatatcacctgtatcagaaatacctgctattttagctaatccattttttatgataccgcttgttgtagacattaagcctttgaatgttttagcttgtatttccatagcgccattatatcgttctttcataagagaaaacattgcggcgttaaaagctctttgatttgtaatttggcctttattattaacgagttcaatacctgctaaatctttagctccttgtgctattatcatatctttagtaattccaaagtctttaagtcgttcaagttctcctgtctgtgcatctgcaacagcttcaactgcttggtctatagattttccccaagctccagccatatcccctgcaagtggcaatactttttgagcctctagaccataactctgaagttttacagtagcatcaactatttctccagtttcaaaaggagttttattagcatattgtgtagcccatgaaaaaatttcacctgcttttttttggtctttcataacaatatttaatgtatttctatattgttccatgcttgatgcttgttcaagcatggaacttcctatttttttaactcccatagtaagagcacttgcagcaagtacagttttcaccttattacttactgagtccaattgatttctagcataccctgaaacagctgctgttcttgaattaattttattaatagagcttatagttccacttgcatatttgttaactgctgaaaaagttctctgtagtgtaggatttatctggccaccaattaccacattggtaagtaaattttttgccaaaacttcatcactcctttttactcatagcttttttatactcttgatttcttctttcactttcatcaacaagtgaatcataataatcaaataaatcaattagagtcattgagtaacaggcttttcttgaattagatgtttccaatgttatctgagcaactatttcttttaattgctttcttcttggtttccatccgagtcttgtataaaaaaagctcgagctatatttgcagcctccgtataatccttaagttttaatctatttacatctgaaaaatctaaatctgatgcttttgcaaacattctgcctccaattatagggtctaattcataagatgcacttatcatatagccacttcgtgttgcttctttaaagacttcttctatatccattcctgttaatttgtcaaaatcatatttaatttcattggtttcttttccatcaattgaaataggtctttttaattttaaagttccagttcctataatttctatattattttccataattattacctccaaataaataaaccaggaatagtttcctagtttttataattaattttataaatattgtgatatatcactatacatgtttttgccattaatagaatatatcccattaagtttatctatatttaagatttcttttccatcgcatattctcttatatgcaataacttcaaatgacagacttccatcctgtgaagcacctgattcaattttaccttcatcagcttttttatttgcaacagttaaaaatgctttatttgctattatcctagctttccctgtagatgtatcatatgcatctgttacccatctatactcaagctgactagcagctgataatgttgcaaatttatcatccgatactctcattgaaatttctgtttccattgaacttatctgtccataacttggaagatcaagctctcccattattcctgaaccttttattgtatctgttattttttcaacagatggcagagtaacatctgttgagtttccaattttctctgctgaaccactatctcttacatatacagagaaatcaatagttttatttttaatttccttagctgctgtactcatttattcatcctcctctgtatataaattttcaatacccttagatgtagatttaactctctgagtaattgatttagctggtggagtatttgtcactaatgtatcaaaagtgaagtctccctgtatcatatctgatcttgcattattcttattgttaaaactaatttcaccataaagaagttgtcccgctgtaacatatgaatttaatatagtctgttctgatacaattaatgcatctacatcatttcgtgtcattggtttatctattaaatctatattcctataattaaagtcattaagcaaaaatttattcatcattatgttgacatcaaatatttcatcaacagcagtagtagaaccataatcataattagccatatgtggcccccataaaacatatttcccaccactatagatagctgttgtaattcctttttcattaagttcattagctttttcttggccaaacctaatttgtttaccattagcaataagagaatctatatctatagctttattagatgaactttcataaggaattccatcattttcagcatcagtttgtagttttcgtactattgcaactatagatccccataattctttattgccagttttaaatttcggccaacatgttttttcacacgtagaattatatttattagcatctttccatttaagtgctttttccctggaatctgcctcattcgaattaatatctgtataacaaatagcttcccatctatcacttattctagatgttgatttaactaaagcttgctctatttcctttatgtgtgaatatcctggtgctgctaatatttcaggaattatattcaattcttcataaacatcttgtatcgcttgtattcctgtccttgtctcagtttcttcttcatatgatccaataacattctcaggttttattttagatgtctcaaccttcttatatgatattgaaatagattccccaagaccatcttctaattccgatacttctaattgtcctgattcattatattttaattcataatctgtgcccaatattttatctgtaataataatggaatctactattacattatctacaatagttccaactccatttattatttctaatgtagaagtagtattgtctgcattagttatagtgtctagcacaataactactattggtccaatgggtttaatattatttgaaaaatgagcaaatattactgctgataatgtaaattcatcaaaattatcggtttctctataacctagtttcgtctgagcctgttcagagtttctaataagtaatggcttatttataactctattttctttttttactctgtgtattggagcagttcctatataaataggcactgttttacttgtagatattgattcatcacttgcaactaacgaaccatataatccatgtttatatgccattttaacaccgccttataaaaaattattatttatatttatttctattggagctcttgatatgctaaaagtcatttcagaactccaatagggataattttgttctgatattttccattttataggtttatcaacagaatttatttcttctgaaataggactattatttaattcatttcttgtaattcctataagatttaataaatctttatatccattagtattaggacttagtttcccatttaattccgttgttcctggatcatatgttgtaaatgtaattctaattcttcttgttacctcatcagaattatcttcaccttcatctatcataactacaattgatggaatatcaaatccgtaactttctaagaaattcttaggtggaacccatcctatataaactgctggatttactaaatcataactttgttctacaatattattctcaggtggtttttctagcttaattttatttgcaacattatttataagaaacttactcaaactttttaaaatctctatatctgtcatattacctcctgctagttaatttatttaatctaaattctatttcatgatttattctatttttaagttgctcattagcctgttctaatatattttcacttaattctgaatttgaaaccatttgaggaacagataatgtttttaatacttttataggatactgtttacttgtttctcttcttacgatgtgcaaattaccaccaatagcagtaacaaacgcccttggatgagtatttatcttcttataccctgatttcttaacttttacttttagattgcttccttttgtccaccctgattttaaatttgctggaaaatgactaagtgttattggtctgcctatacttgttattgttgctgacaagttgtttgttgtagatttcttaaccttaagagtttgagctacttcccctgactttattgaatattctcctgaaacttctttcttaatattcttatttacaaaagtaatagttctattcagagctgcattagtagcctttgggatttccttaggaaattcactcagtttgcttaatgattttcttaactctgaatcatctatttttatatttacagccattaattcatagctccctgcagtataatttcatacactcccgaatcatacttaacatcaaatacgctatacaggcatccatcaaaattctgcatttccccactcttcggcttcttaaatacatctgattcttttatgaaatatagaaggtctgcctgaagtattccatcatattcttttcttattctttccttaagtgtttcattatcaattacaacagtcctaggcattccatcaatactatgtgtatctccaaattcatctaaattgaaaaatacatctaaatcttcatttatctgttctttaaaacttagcatattgaagttcctccataaatcttttattttttttgaatttattttttagtacctgctgtacatcaccataacttttcttaaatttattatctattttcaaaactgcaccacattcaatcaatttttcagcatctgttaaagtaatatcagtgattgtatcaccaatgctatacaattttccattatgagatacattgatgatacatttaacactcatctgatattgctaaactactttcgatataaaccatgcatctacttcaacaggacatgctaatggtctagacattaattgaatgtattttgcagcaggtttcttttgaatccatgaatcagggcatcttgtcccttctatgcttacaaattctttgctagcattatcaattattgcatttacaccatatcccataaatccttgcatctgtgagctaaaaattccacagtaatcagctggtattaatgattttacttgtggattttttggatcagtaaaattatctaaataccattcattatattgataaatacttaatcctaatttaggaatagtaccaatataagttgctccatttggaagctgtctaggttctatagttgcaagattcatatgttctgtatcaagtatcttttgaacgcttgcattatttacaaattcacttgctgcattttgtcctaatatacatatatctggatttacaaaacctgtcttctgtacctgcttagccatttcttcaatttgacttataggttttgcttttgcatctgaccataaatcagttccagacttaacatctttatttgtaaatttaaaatctatttcataatttacacctttaccaatcacaggtattttacctgtaaataaagtctgagcacacatccattcttctcttcttgttatcatttcatctatctgtaaaaaatctcttgctattttttgtgcagcacgttcttctggagatattgagttatatggaagttctccagcagttctttttaatatatcgcctgctgtagttactctgtcagctgtaacaagtgctggtttaaactgctttgttacatatccttgattttctgttgttgtttgagctattttgtcatgtacaaatggagcgagttctctatttccttttgtaaaatcgacatcaatatactctgtatttgaagtttctactcttccaaagaaagtatcttttaaaaatgtttttacttggggatttctttctataacagaaagcattgttcttggatcaaataaatttaatggcatttacattcatctcctcttgattttattctaaaaatattcctaattttcttgctaatatagccaatgcatttacatcttcttcatttgcaagtacatcttttactgatgatttataaaattctcctgatagataaactggaatctgagttttacttatgttttcctcactaacttctgatgccacagctgaaaatccatataattctccattttctgattttatagtaaattccttgctagtagaattataataaaccggctgcatttcttttatactttctgctgctttaagatccacctctgatacctttacaggaatattagctccacttcttattttttctggtataaatacctcttcattaaatccattcattatcgaattcctctctttcccaacgctctgtctaaaatagattctgtttcatcaatatcatatccatctttagcaatatttctttcatgagttgatgttggttttacatcatcagcaccagaatttctaatatcatcatccctgttatttaaataatcctgaccttgctgtttttgagcatttaatataagcactgcacattggcctgcatctataatttcttcgtatttggctttatttttaatctcatttgctcctggaagtccatctatagccttaattctttctctttcttgaacttgtgctgcatttactacttctttatagacatcaggatatttatcctttaattcatgtgcatttttaatcacatcatcatctcctcttttattatttaatttattaaaaaaatagctttggttattcaaatttgaattaccgctattattccttaaactatttttagatattttatcttttatcttttctttaaaatcatctggcatattacttaaatcagtgccaactttattaattattaacatattcttatcaataactggattatattcatcatcatcaaacataactttatcaataaatccattttcaacagcttcttcagcggtcatccagttatcaccattaagaaaagtttcaagctcatcttttgttttacttgttttatattgataagcattcattattatatcttttaccttatcaagcattattttatattcatctaaatctgatgaattaaaataaccacataaaccagctagtggtggatgtgtcataaatacagcacatggagatatctcagattctcctgccattgcaattatcgttgcagcgctcatgcacattccatctatttttacttttatattagctttcatatctctaagtattgtataaatagctgttgctgcaaatacatctccaccattgctattaattcttactgtaatattatctttatccttatatgaatctaattccttaataaaatcattagatgcaacttgacctgatgaatcccaccaagaaagactgcttactatctcaccatatattgtgagttcaacttcttcatcttcaacataattaaaatcccaaaacttcttgtctgatactgataacattccttttgaaatagaagaatcattaactattagtaatttttgattgttcagcttctctaacaatatttctaacctcctctattaatgtaacttcttgttttctttgttttatattttgataataatcacctcctgtaagttccattgtttcttttgctgctgtagaaaaaccattatcaattcttttaattgctgcatctacttctttattaggatcaagttgaccagcactaggccctgaccactctgcattacagtaagctttcctaattaatggattattgaaaaatcctggagcatatatccttccttttgctactgcttcatgcatccattcaacaaatataggttgacaaaaatcattagccatccatgttcttctcattctaaacattttccatgcttcaagaagagccgcacgacttgctgagtatgatgctgtaaattctttagtaagtaattcctttggtatttcaagcgctgctcctatctgccttgttattgcatttacaaatccatcaaaagcagtgtttggtctaccagggttaatttcttttgcggtttctccctcacctaactgaacaacagctccattacctaattcataagttgtatcatcatcagaatcaatttcatcttcaaaatttatattagaaccaaatacatttccatcatcagtgtttttactttcaatgaatacagtaaacattccactaacaactgctgccataagttcagcttctgtatatctacttaattgtttaagagcttcaattacaggcgctagaattggaactccccttctttgtcctattctctcactctccatgagatgtaatatattaggtcttccagttttacttccataagcttttactttaatccatttaggagctttatcccatgttgttgctaatggatgccttgaacatatatgatagtatgttatttcaccattttcatttgtttcaacaccctcttgaagtgtctctgaattagaaacatagttcttattacaaactctgtcagcttcaattaatagtattctaatatcgtatatctcattgattctttttatagtgggtaacattacaaatgcatcaccattcataatccagcttaaaaacgccacctgttgaagttcataaaaatcatttattctttctacatcacaattcttactctcagcccataagctaaattcacgttcaatttgtgtttcaagatttcttgtttcttctggtgtaagtcctaaaaattctccatcaatctgtgattttaaccttaatcctgcccctataacatttgttcttgttgttttaagtgcagatgttgcaataggagcacccataaataaatctcttgatctttgcctaagagttttaatattatctgaaatatcttctttaggtgatccacctctactcagccatcctagtaatgattttttgcttctacttgctccatagtttgaatatccagtattgataaaatcaagtttctttctcgcaaattctcttcttaaggctttttcagggttgaatgatgctattgctctatctataacattcatgttattcctcctataaatctctaggaactattctaaatactctatttcttcctcttcttttttctatgttatttgcttttgctaattcacttttccaataatcaatttgtgcttttatacttgataaattagctcttgtcagtgttcttccagctattgaataactttgaccattacaaactgctaattctgctttaagccatgcatctaaatgctctctacaagtctctatattaaataccatatcgtttcctccttttaataaagaaggtgttcctcatgaacaccttataaaccttttgaacttttatttttcttttttctgttattcctatttatctgcataaaaatatttccattcatattccttttagccatctcttcaacattaggatttaatatttcatatgctgcatttgcatagtttcttaagtcaaatgcttcatttcgtattccactagatttctttacccattcataagtacgctttcctttctttatttttaatactcttttttctgatgttaatgctttaaagtatttttcatcatatcccttatcttcttctattggaaaatggcaatatccagggccaatctctttaatattcaatcttgaaagtatattttctttaccattatcaactccaagtatgaataacatgcactttataagattatttcgtgacattttatgaataaatggtattccatagccacccatacccttaattgcatatattcttctttgttcacgtactttacagaatttatatacttcttctgtattatgtccacctgaatctatacatgtagctgaaattacaagcccctctccttctggataccagaatgttttggataaatataaatctaattgagtccatactatacttttgcttggatctccataaataactttatattcaatcccccatgtttccctattcagtccccatccaacaacttcaatttctaatctatcatcctgaacatcaactcctgctgttaataatattacttgtggtggtacttctgcagtatagaactctcttctgttgattaattcatccttctctgctccttcaccttcattatcttcccatacttcaccaagcgaagtgttaacccatgttttcaatgtttctgcaccattcttcttagcatttttaaaatcttcaataatatcttcccatctttcccatggtgaagccaatgcatttaaatgaaatccccgtttttttattctttctggatgttctgcaatccattttcctttattagctttccattcaaattcattaaacctctcaccacagaattcacattcatgagtaacatcttcaaatttaatatttccccatcttagtggctgaaatttaccacatataggacaaggtaagcaccattcttcctttgtactttcatcaaactccatctcaattcttgaaatacctttttctgtaggagttgatacaaagaattttttcttgttccagaaagtttttgttcttttttcagccaaagataaaggatcaccttcaatacctgcactttgtgggaatctatcaacctcatcagctaatagaatccttataggtcttgaagataatcctgttggtgaattggcaccagtcaaagcaacataccctcctggaaatcctttttctaaaagagtattatcagaatctcttgattttgcatcttttactttttctttcaatgtcggtgtatctcttatcattggcgcaagtctttttctagaataagatgttgccaaatccaatgtcggcatcagtaacattattggtgatggatcataatcaataaaatatccaatgatattattaataagttctgttttccctacttgggcactactcatgacaacaatagtttcagtttctttgtttgataatgaatccataatttccctttggtattctgctcttgaagttttccattggccaggttcagcagaactttcaggtgacaactttctatagttatctgcccagcttgaaactgtaagcaatggtggtggttctaggatagatgctaattttttaaataaatcaatagttcttttatgaatctgtagtttctttcgactcattttgtacctcatcatctaaaacatcaacatattcattactatagaaatcattaggattatacttgctcatttcatttaacgcatctaatacttcattctgcaaaatttcttgaatatcagctattgtactaagagttattaatcttggtgctgctcttgatgggagtgcaagtattttggctttgaaattagaaagcatatcgttcatcactctttcaacatcttcactataatgcatagtaccacgcattgctgcaagttcaagttcaatcttctctctttttcttctttccagtaatgcatgttcttcatcataatcaattttacctgcttcagttttattttctttaagatctgccgatgcttttatgtaagttatataactttttatattgtcctgtaatgaatatttaccacgtgcaatcttttggataacaccttcattttcaagctgtcttattcttcgtgtagtcaatccaaacaaattagataatactgtactcgatactgttaccttctcaacattatctattttcttaacatcattgctcaaaatacatcctcctctcttaattcggtaacggaaacacctttaaaaatttttttgtaactagaaaagttttgggcatcgctagaccctcggggcattttattctctgaaagaacctatactattatataaaaataaacaacaaagaactaaaagataactaatcttttagttctttgttcctaaatattaaaattgttttcttcagataataactcttttagcgcttgcaattctaacttattcatatgaatttcacttcgctcatctttaaacttttttttactatcctttatggcaattttgttattatgtaaataatatagtcctacaatacacataaatatgacaataagcataatacaaaaactataccattgacctacatttacaaacttatctattgcaaaaagtattgttatagttcctaatatcatactaacaatactaaaactcttgtcctctactattatagtcctattattttctatgtcttcagtagcaagttttaataaattatatattcttattcttttttctttactatcatttctatacttatctttaaaaaacaaatagtctttcaaatcctgatccaccattttttcacctctttcccataataatattattcaacacaattaactatattcctacttctatagttaattaatgttacatatcttataattctgtaacatactttcaaaaaaataatttccaatatatatactaaaaatcttccactttaattttacatgccttttttatgtaacatttatagacaaataaaaaagcgcttccgcttttatcgtctaagatagcttacttcttctactatcttgtctttcctatcttggttaactcctatatatctaagtgttgtcgataaatccgaatggtttaatatctcttttatcgttattccatcatgagttctttgatataattgatacccaaacgtttttctaagagtatggcatccaatagattcaagtccaaacttctcagctgcatcagttaatattctatatgcttgttgtcttgatattggtctatttttcccttttttgcttaaaaaaatatattcataatcaagcttatctttcataaaactttcaagaatatattttaaatctttaggtattttcattcgcttttcttttccagttttttcttcacgtatataaaaatattctttagtttttccgctactatctctaagatcccttattctgaattttaatatatcggaaatcctcagaccagtataaattccaaacataaatagaacatagtttctttcactatgtatctttaaataatcagcaatatcataaatatcttccatttttcttataggttcaacggtattcatcgtctcacctgccttatctttccgttaacttttttataagattcatgattcatacattgccttaaatcattaagcttatcttcaatatgaattcttttatatccacaatgagaacatgataaatagttcccatttcttactgtatcatcaacttcatctgtcaacaaaatcgttgtctttttacacttaatacaaaaataagtagtatatatttctttcatgttcccaccttctttcaaaaaataagagctgttatccaaacagctcatctctcttataattacttttcattattctcttattaattaactttttgctatgttcattaactaaccttctaggagtatcaaacgaaatcaccggtgcaacatctttgttaataacaatattcccctctgcatcagttttataaacagatctattcttattaataaaaacattatcactcatacagcttttagattcatatcttgttattctatcgatttcttttcttcttattttttctgcttcatgtgaatttctaaattctcttaaatttctatagatatgttttcttattgtatctggtttagcatttaagatgcttgcaattctaatataattttcccctttgagatatagttcttttaccatttgattatccaacataagatacacctccaatactaaaaaagaatatagttattccataccataaaatgggacattttcttgttggttttatattatcacaaatttcaagacatttgtgagacatttttaggacattattaagacacttttaagacatataaaaaataaagagttcattttttgcaccctcatattattatttttttagcagctttatttaaaattctatcaacttgtcttatacttctatctattgttttagaaactctttttttatcaattccatctataaaaactaatttcacaactttatattcattttcaggtaatagcttaagcttattgtcaattctcttattttcattttctagtttatttatatttaaaattaacatttgtattgaaacatcattttcctttactccatttaatcttaaattttcaatttcaatctttaaattttcaattttgcatttattttctctataaagattaaatatatttttcatttctgccatgtttatcacctatccttcaatatgttataatatagatagataattagagaactaaccttccaaatctgattctctaatttatgtatgaggtgttcatcacgaacaccttttttattaagttaagcttgtgtagcataccacttgtccaaaatttcttcacttgaaaaataattacttggctgccatattgatattactggattgaagaattttaatttaatttcttcttctttatgttctgatctataactatatccactatttttacttgttataatcgttctaccagttagtaaatcactatatactttatcaaaggtatattctttagtcttatttatttcaatatccattacatattccttcccaccaattttaaattattatgaattaaatttgttctaatagctctgagctttcataaatatttcctacaacttctatttcagtaagtggaagtttctctattcctggagcaaataaacttaaacaagtatcacacatttcactttcatggactatcaaatcgcaatcatcatattcaatagcagaaacatattcttttaattcttctcctcttatttcagtacattttacaatgtctccaacataaatttcttttccatttacatctttcaaccccgtatattgcatcaaatcaatcatttcaaaagtatcacttaatgaattgtcaccttcatttaagctaatacaattttctctaaaatcaattttttctacaggtaacatttgattacttgcattatcccaacctctaaatttaattattggtaaatccaatttcatatttatcctccttcgcacaataaaagtattgcgaactaaaatctgtaatttacaaccccttgcttagttactacatctgcattaactaagtcaatttgaaaagatttttgactacatgttgtagttataatattaattttatcttttacattttcttctttaacaaacatgtacccttcaaaaaatgcctgctcaacataacaattgcttatcttaggaataacttttatatgttcctcttttattttgtataatttactatttcctcttgccatgttcttacatcctttctacgcaaaatctgcaacttgtttaaataaaagtattgtgtaataaaaaatatcacactactcaaattagaaaatgaatagtgtgatatttttatattatatattgtttcttatttcagcatatttttttaatattccaatatattttattgaataattaattccccagtaaattaacataaaaaataataaaccaaactttaaattatacttatccccggcataaactactattgatacaagtattgcattaactaagcttaaacttagctgtattttaaaaaatctatcatcaattataataaaattcttatcctttattgtgtaaattacttttctttttaaataataaataatattatagatagtaaataatattggtataataataccacatataacaaacaacatacacattctcccattaatatattttctataattgtaacataataggtaaaatataacactattcaattttcaaagatcacttttcttagttacttcgcattatctacatattctgaaccattaaagttcttctaaaccgtaataacatacatcaacttcatcgtttggatacttcataactaatgtcatatttacatttttctttaattcatccaaacttctattttcaaatgttatactctcattagtatatttaaattgaactctagccatataaaatgcatacctactcttataatttttaaattcatcattatacttaatttttatacaactacaacatggctcttctcctgatttaatcttatgatttacacatgtataacaatgttttctaaaacctatattcgaatttttacttatatatcccatactctcacctcaatctgcatattctgtattattaataagcaatattcacagctactgtctcaccagtttctaattttgtattttttccaacatgttttactggataagttactactcttttggtcctgataggttttttaaaaactttaacttctaaatcttcatcatatttttttaattcttcaattaattctttaactttcataacaacgtctccaatctgcatattccgaatcacatcaaatatctatctaaagcaaataatgttgtttcttcactatctattgatttgttaaagcgatccctattatattcatgcatagattcaggaattttataatatctatttatattgttataagcttcttctctttctaattctcttggattcttatctttttcacttccttctatataagcaacattatcctcataaaactcctttgcttcttcttcagtgcctgcacctattaatgcataataagcataatcctcattattaaattcataaaacttcattactgctctacctcactatcattaatttttttctctgctttctagcatataaatcaacatagtatttactcattttgaaatcatcacattcaaatctaactatattctgacttaacttaggatcatccattccataaaaataacattcatcacaattccaacatggctcttccaatgttcttgcttcttctacagttgtatgagaaacatgaagttcacaatttttcatacatttactgcataaacatttaccacatatagttgcatcatatggtggaattatctttcgttcatcttccttcttttcttctataaaaaagcttatctgttgtgaatcctgactattcatcttcttctgtattatctaaatactcattaagagtaattggagttaacatttcaggatcacattgcatctgatatgctgtaatttttctaaatccatcatgcatatctttataatctgctccaggtactttatatgatttaacatcattagctttaacacatatataagcttcacagttatttccgttttcatcaaatgctagtcctaacttttcactaactttaaaacaaaatctcaaactcttactcattactgctcctcctcatttttatataatgggtgattttttgcataatgtactttcttacctcgttctcttaaataattcactatattcttataagcataagcatatccaaatgaatcacaagcatataagccatctgttctattgctgttttcacattctggacatacagtcccatttgctattgttgtttctgcaaaaaatattaatccacatcttggacaacaatattctctttcaatattcatttcctacaccctttctgacatttgtgcatttctcaaaagtgttcttcacaaacacccttttacttatctgctattacattctcataaatcaataaatctaactcctgacttacttcaattgtcctttcatcagcaattccaaacactgatatgtatctatataacttttctctcatatcttctaatcccacttacttctctcctccaattaatttaaatattcaatattgtcaataaacagttttgctgcttcaactgacactgctgccactcctgctattattggtataacatcatcttttatgcttacaccatttaatgctgcttttaatgcaatctcttgtttcttttcattgctaatttttttaaatctatttaaaataaacttttcattcattaatatccctccaataattaggggatttctccccctttgactattatttatttaactgcagttttaacattagcttgtaatccctaactattagccctgcaagattaactatttaagtatttctaaatgttttgcttcaaaatatcctcgtatttcttttaaaactactacacgctttctatctactacataaggactcgctttaactgtaaatactctatctttattctttacagcagctttacaattaactatttttaccttatctcctactcttggtaatctgttgtttgccataaactatcactccctaattaattatttctttaagcgttttaaagaatttttctctttctgattcatcaagctcttcagcatattcttgaaaaacttcttccagtgttttatcaggtttattaaaatatatattaactatgttagttgcctgcttttctgtatttttcatattttcttcatcctcctactaatcttcccaccccaacaactgtttttctaaagagtcataatcatattgccttggctcaaagttattaaatccaattgcatttttcttattcatatttgaactttgatttttaactgagttattataattcttcacgttagcaacattatctctgacaacattttcttgattgtaatttccttctagcacttttaagaaattattaggtgctataaaccaatcaaaagttatcacccaacctcgcttattttgaccttttaggaattggctctttgcaatgtttgctatggcttttaatatattatcttgaccatattgtttaactcttgcattaaatagcttgtatctattcgttccatgatttattgctacaactttttgtaatcccaaagagttccattcatctattactatttgttgcattttagtgctactaactatatctttagatatagtatctagtgtattattaagtattgtattgttaagtttagtattattaatacaagtattaataatacttgtattacttactgcgaacttttcttcaccagggggtacgaagttttgttcaccaggggtggtgcaattttgttcgctaggtggtgtattttctttcactacctcattagatgtattatcccattggtttattccaaagaatttttcattattgactcttaaaattctctgctctatttcctttgtaccttctttatatttaaagctagatgtaatgtatccatttgctattaaattcttaattataagctgaattcttctttctccaacacctaaaaattccataaagtgcttattcttcgcaaaacatccatttgcattatccaaacttttaatttccactagcagaaccttttcttgcagagtcaatttttcattcagccaaatttccttaggaatccaaacaccttgaaacattctttcctggttcgccttcttttccatttgtaacacctacccacttaaattttattattaaacgaaatataaacatcatctgtaatcttatatccatgttttggcattattttcttgccatcttcaatctcaatttcatctacttgttcaaaaattttaggaataatattcataaaaccgactctacagataccagataatttaatggataatttcgaatctattatcttaacttctgatgtataaaaagtacctttaatataatcattagatataataaatttaggatttaaagcaaatttatctaatgctttctttatatcatctaataacttatcttcacttcctatagtttcatttttatctgtttctttattttcaggatacatttctttaagcagctttttatcatttttatttataactggctgcttaattccattgattaatgtttctatttcttctttagattctttatgatctaggtctttaatttcatcatgaataatattttgttcttcaactgataaactacttaatgtatgagcttgagtaattgtcaattcttctttatcaagcttttctttaagaggtttgattaagcccttatctatcttttgatatcttccaacttgtgttcctgaaagcttcatatcctgtcctattaagtccctaatcttaccctttggtaattcttcaccattagctttcttttgcttataaatatctttaagccttttaataccttccatcttttcactaggtaataattctctttgttcaacatttgcctgtatgagcattatttctgcatccaaatcagtaatttttctaacttgacaaggtatttttttatattctagacttttaagtgccctatatcttctttcccctgaaataatttcataagtttcattatctttttttctaacaactaagttatgcataagtccaaattctttaatagagtctgcaagttcttctatttctcttattccataaaagttattttcagaaggaactagaagatcaatatctagctcctgtaaaaattcatcatttgtgttattgatattattaactctgtttgctataccctttaaataagacgacattgcatttcctccacaaattttatatagtccttagatgcattagcatttttattcatgtaaataactggcttagattcaaatgtgcttttaataacatctacgttatctctaattgtctgtttaaacattaagtctcccagctcttctttaagctctcctttgatttctttattaatccttgtagctttatccattgttattaaaatccctaaaacattcagatttgaattgaattcttccttaacttcttgtatgctgctcataagatactcaaatccatctaaggaaaacttgtctattttaagtggcacaataacgtaatcacttgcaactaatgcatttatagataacattcccaaacttggtgggcagtctattaaaacataatcaaaagtgttagtatttttactttgaagccatttctttatgcgtgtttcccttgctcttttcatatctgaaattatttcagattcactcattatcaaactgatattggcaggtataagccatacattatcaaacacagttccttgtacagcaacatcttcaccattaagaatttcatatgttccttttaaattaggattatacatgtggagatactttgttgcattactctgcgggtccatatctataattaatacttttttaccttctctccctaattgtgcagcaacattaacacagctagttgtcttagcaactccaccttttatatttaaaaaacttattattttcattctttacatctcctttaatatgtcttataatggagatacggacggcaatccgtatctttaaattagagttttacgtttattgaacctttactaaaaggttctttttatttgctagaattatcttcgcaaattctttcttcaaatcttttgccttgcatgatattacaaatcccatatactcaccttctttcgcatacaagcattatttaataccattgcatacctcctagtaataatatttttcactaaagaactttgttggcacctgaccggctattgttatgtaacctttatctttaagttccttattgagcaattgaattattttataagcttttgattggcttacccctgtgagtttcataatatcctcaacctttaagtacgtcttttttgttgccatgcatattccctcctatttcttagaaaatttcaaagtcattattgcttcaacaacttcatcaagttctttcatgatcttttcaaattcttcaacctcatcatcattaactttattatcagatgcgattttaaataattttttacaaaacccatcatagtctgatatttctgtatctaatgttaatacagcttctgaaaagtttttaatcttcaaattaggtaataatctatcacctaatttagatttagttttaagatgttgataagctaaaaattgagcatcataaatttctatcatctttatcactactttgtctgatggaactcttctgtcatattcataagatcttaaagcatcaactgatatgtcaatcagttctgatgccttttcttgagtaagtcctgaactttctcgtactatctgatatatatttttctgttcactcatttttcttctccttttgcttttttactatgctaaatgataaaataatcctgaaaggaggatgattttatgtctaatatttatgattcatttgaattccaaagaaaacttttggctaatcaatctaaaatatttgaatctattcaacctatagtcaacattaatcaaaacttaattgcaaatattcaaccatatataaatattcaagaaatggttaatgctactcttcaacctgcattggaaatcatcaacaaaaatattacaaaatttaattatgatatttttactaaacaacttgaattatttaatagcatcaatctaaattactctgatcaaatacaaaatgctcttagttctctaaattctttgaaaaattcatctgttaactttgaaagtataagtttaaaaaattcaataaatgatttttctgaatatatcgtagaacatccatttgaaattaatactgaatctaatttaacaatagatactgatacaatttctgaaatcgaacaaacttttgctgatattcctacatatatggaaactcagttagaaagtacaaataaaactgattggattcctatattaagttttataattgcactgttagcactactactgcaaattaaagattcattcaaacctaatgattcagaagaacaaattattaaattacttaatgacattaatacatcaatttctcaaatcaatgatagttccaattaattatttaaactcttgagttctaatttctaattgctcaataagtaatttttctttcaaaatcacttgagcatgattatattgattgtatatggttactactactgatattgaaattaaaattaataatatcaattcgaattttttgaataattttagttcgtttttaacaacttttttaattaactgctcttgaactgctacttcaagagtagtttcttttttttcttgcattcctctaacctcaatttccatatttttttatatttaatgtacaatctatcagtatatttatactaattaagtactattaatccatttatactaattattaaatatattaaaattttttatataagcattaagaaacattatgtgtctatatttagtaaaaaaataagatcatctaacgtaatattgtaaagcttagctagactaatagctagttctagagatggattcctatttcccctctcaatagcacctaacatctgaggtgttattgataaagtattggcaatttcttttctttttctatctcctcttaatgctattaatttatttctcaaattatcaaatcctttcctaagaaacgttttgtttctctatatttttattatattgaaacaaaatgtttctgtcaatacttttcagaaactttctgtttcaaatgtagaaaatgaaacaaaaagtttctataattaatgtaggtgatgaagtatgataaaatctttaaaattcaaagaaagattagtaaatctaagaaaagaaaagggtcttacgcaatatgatttagcacaactacttggtttctcacgtggtcaaataggcaactatgaacaaggttccagagaacccgatcaagaaaccttattaaaaatagcaaatttttttaatgtgtcttcagattatttattgggtatctcagatataaaaaatcatactgatgattccaatataactattgctcttcatagcgatactgattatgatgaccttcctgaagaagctagaaaagaaattaataactttattgaatttgttaaacaaaaatataaaaaataaggtgttcctcacgaacacctatatttttaaatatatactgtaataaatttcattaatttataatttttataataatataatacataaacaaggagacttatatgggatttagatttagaaaatcaaaaaactttgggccttttagaattaatgtttcgaaatctggaattggttggagtgtaggaacaaaaggactacgttatacaaaaagagctgatggaaaaagacaaactactctcagcgttcctggtactggaattagctatgttgatgttcatggtaataacaagaaaaaaagtgaaccttcatatccaacttcaaataatagctacataccaaataacaacaataataagccaccattctataagcaaaaatggtttatgtggcttatgctattattcatacccccagtaggaattgtattaatgtggctttatagcgaatataaaaaggttcctaaagttgtattatcactatttttcggaatagttgcaattgcagcgtatactggccaatcaacaacacatcctgtaactacatcaaataatgatactgttgttacacaagaacaaaccttatctcaaaataacaaagaaaatgatcctattgatgaatctataatatctgaagaaccaaaacttaccggctggcaaaatataaataacataacttattactatgataatgatggaaatccaaaagctgggtggattgaagataataacaaatattattactgtgataataatggcgtaatgaaaacagggtggattcaggataacaatgaatattactattgttcttctgatggatcaatgcaaaaaggttgggttcaagataatggcaattggtattacctaaatgataatggaactatggccaaaaatataactaaagatggctataccatcaattcatctggaattgctacaaaggaagttgtacaagctagtcaaaataatacacaatcaaattcaaatactacttataataattcaagtcaagcttcaaattctattggaaatactgtttatattgctagtagtggtaaaggtaaaaaatatcatagtaatcctaactgcagtaaaatgaatggtacaatttcattaacagcagatgaagcaaaatcaaggggatatactccgtgttctaaatgttattaatagatatattaaattacaaattgtgctaattagcacatccaaaattcacgaaagagaggctttataaatgaaaaattctaaaataacttcaataatactaatttcactattaagttttacattaatatcttgtggatctaataatgaaaataaaaatactcaaactactgaatcacaaaatctagaagatactacaaacattgaaccagaagaaaattctgagtttaaagaaattatttctttaaaagatatttctaagaaaagtgtttcagaagtaaataatctattgggagttcctgaaaaaacagaagaatcttctaactatataacaaattattatatgaatggagttgttgaagtagcatttaaaaatgatgtcgctgctagaataacagttactcctgattctagtatttcattcttcaatgattctaaaaaacaagtaaaaacattaaaatcacttggaataaatgaagatgaagtcaaacatgtaccttcagcagataatctttatgtaaatacgtggagtaatatatgtgatgtatatgaaatatccgtctttaacaatcaagcaaaaaatgatggtaatgacactataaattacttctatataattactgataaagattttaaataaatatgatgaattagaaataaggtgttcatcacgaacacctatatttttaactatgtactgcaataatttattgtaacatgtataaaagtacactttagatactttaaagtaagaaacaatttcagaaaaaattatttattattaagatagacaatttttaagaaattgttatttacctataacacccattttaattatatagagggggaatattgtttgttagaaccaaaagatacattttcaaccttatacgatcattataaagatacaattacttatataaaaaaagatatagataaaagagataaaattacaagatatttatttttagtattaatactatattctcttacagaatttaaacaaatagattcaagttctgtatttaatgatttatgcaaaaagtatttagggatatcattaaatataaactacgttcttataacaacaataattctattttgtatatttacttgcacaataaaatattttcaaatgtgcatgaatattgaaaaacaatatagttatattcataaaattgaatccgaccttaatcatatatgtggtcaaaatttaatatcaagagaaggctattcttatttagaagattatccattattctctgcatttcttcatagaatttatatgtttttcctaccattagcgttggttatattaatgtttgtaaaatcatattacatatttatacttttaataagctcaatcaatatttcatcagggaaaaatttcacttgtatattattagaacattcaataattatatcatttataaatttaataatatcactttctaccattttaaccactgtattgtatttactatttatttatagagataaagagtggattaagaatataaataataaattcaagaaaatatttgttctattacatttatataaagaagattaaaaatataaagttaactattatatttaaggaggaattttaatggctaagaaaaaagtttgtattagctttgactatgatcatgacaaccgttatagaaatcttttaaaggcctgggatgccaatgaaaattttgagttttctcttaatgatagaactccaaatgaaatagatagtgaaaactatagtgtagttaaaagtgtattaactaaaaaaataaaatctgctacttacctattggtaataataggtaaacatgcaaatgaaaagcatccacgttcttcagaaattggagatataaattggatgaattgggaaataaataaggctaaagatgagaatgtaaaactagttgctgtaaaaatcgatagttcttacacttcaccattagcaatttacgattcaggtgctaaatgggcaatgagctttactcaagattcaataataaaagctttaaatgcagctgcaagtaaataaaatataaatataaattatagaacaaatatttatattttgaaaggagatatacatatgtctaaaaatcagggttctaaatcacaaggtatacctacaacttatagtagacctgaaattcgcaatactccaggcagtagacaaccaggtacaagctctggcagttcacttacaagtataaagccaccgagaaagtaaaagtcaagaggataatttaattatcctcttgacttttaaaatatgataataatttattattatcatatatctttattaatataccagtattaaaatcataatattctctttttattatatcaactaacttcttatcatcatctagtctataatcattcgataaatattctttaaattcttttgttccaattaatgaaatatctctatttttttgatttggtggtgaatatcctgccaaaagtccttgagtaatagttttaccatccttttcaattgaaataaacatatcatttactggttcatcatcattttcaaaaattttttcccattcactaggatatttactttctgttggcatattgtatttttccttaaatctatttattattttcaaaagtaatggttctactaattttattttaataaaaaatacagctaaacatgtaaatgttgtaagaaacatataacctgctaaaaatgaaaaattattcatcatctttaaaagtgtgttaattgaataaatcttctccttagatattaaattcattaataatacattcattattaaaataattgcacttatcggaatagccataattgttttttcatattcagatgtatcttcaaatgattttggattaagacgtttatctattttggttacgattatgccaggaacagaaaatataatagctactattattgcatccataaagttcacctctttagtgataagtatatcatgcaattggaatattttccatgaatattcatttaagtcctactatgtttatacaataaaaatatttactaatatcttttatttttcacaccaccttgaacatatgttcgtattatattataataataccataaattacatggtggtgatatactaatgaacatatttttcaaaatattaaacttaatttcttttgaaggaattatccttgaagaatttgattcaattaaaattttatcagatggcatatattttaaaattccgaattgtcctcccactataggtataagctcatcaataatcaatgatagtaaaaagtatctatcgacattaggtgaagaactaggacatcattttactacggattctaatttaatgctcaaatcaaaaaaatactcagataaaatcctcaaagataaaaatgaatttaaagctaagacatgggcatcaaattttttaatcacagataaagaatttgtacaagctcttaacagctgcatagtatctaaatatgaaatggcagagtattttaatgtaactgaagaaataattaattataaaatatcatctattatttctgatgaagataaatatatgaatataagaaaaaatttcatgctcaaagaaattcaatataattcatgcaatatatagtacttaatgtactattacttatataaaacaattatcttttatcaatttacatattacattaaaacattaaacttaacattgtatatattactaaattctaattttaaggagataaaaatgccaacatataagaataaagaaaaaaatacattttactgttctttctactatacagactggactggtaaaaaatgcagaaaaaagaaagaaggattcaaaagagaaagagatgcaaaacagtttgaaatagattttctaaataaaatcaaaaataattgtgatatgccttttaatacattagtgaatttatatttagaagatatttcaacaaaagtaagatctacaacatttgcaaataaaaaacaccttatagaattaaaaataattccgtactttgaaaatttaattattacagagataacacctaatcatgttagagagtggcaaaacactcttaaaaagaacgactactctcaaacatacttgaaatcaataaataatcaattaagtgcaatatttaattttgcaattagatattatggactacatagcaatcctgctcttagagctggaagtatgggtaaaaaaaatgctgactcaatggacttttggacattggatgaattcaaaaggtttctaaaatataatgataagataatatctaaaatagcatttaagatattattttggactggcatgagacgtggagaactactagctctgacatataatgatattgatacagtaaataaaaccattaatattaataagacttatactaaactaaatggaaaagatgtagtaaaccctcctaaaactccaaagagtaaacgagttatatctataccagatcatctggccaatgaaattgaaacttttaaagatgctctttatgattacaatgaaaatgatagagtatttgattttggattaccatatttattacgtgaaatgaaacggatatgcaaagaaagcggtgttaaaaaaataagaatacatgatcttcgccattcacatgcatccttattaatagaacttggtttttctcccatactaatctctgaaaggttaggtcatgagaagatacaaactacattggatatatattcacatctgtatcctaacaaagatagtttagtctctaaaaagcttaatgatttatattagtacgttttaagtacgatttacaatttcaaaactttctaaagccttgatataagacaaatagcgaggtttccctcgctattccattccaatgaattcaactttttcaatatttttcaagttgcttaatccatctgtcaatgttttgatatctccatctacacaagataaatcaatagttatgcttaaattagcatatccattaagaggaataccttgatttattgttaagatgtcaccaccttgctccgcgatgtaattacttataattgataggactcctttttcattctttaaaatgatattgtaagtaacttttcttccttcagatgtttctgaaaaatcaaatacatggtccttatatttgtaatatacacttctgcttattccagcaatcttcactgcctctgtaatttctttaatctttccatcttttaatagttttttagcaaaaagaactttttcataaacatcaggtaaaaccctcttatctataaccaagtaatttccactcatcagtaatcaccctttataatggttgccccttcactatctaaagataattccaatatatcccattgtaaattttcttcgtttaaaaacttttcaagcttattgctaaagcgctcatccttttcgtcgataataaccatgattgtaggccctgctccactaaggtaacaacctagtgctcccaattcatagctcttattatacaccttttcaaaaccaggaatcaacttacttctgtaattttgatgaaaggcatctttacatgcatactttattaactcataattaccacttgtgaaacttgctaccataagtgctgcccttgaaacattatagaccccatctttcaaagtaattgactttggtaacacacttcgcgccttttcagtagataatctgaagttaggtactactgcaataaacttcagcccaccttttatatttaccttatcatagaaggttttattttcttcatgtattgcaacaaccatgccaccaagaagggctggtgcaacattatctggatggccttctatttctactgccatatccaataattcatcttcagaaaatttttttcctaatatttcattagctccaactagtcccccaactatacatgtggagctacttcctagacctcttgatattggtacatcttgcttaatttcgcttatttctaatcctttaaatttatagcccgctttatcaaaacaatatttcattgctttataaataatgttttcttcattacaaaattcttctggtattccgttaaactttaaaccactttctatttccttaaattcaaattcattatataatgttagccctaaccctaatgaatcgaatcctggtcccatatttgccgatgtagctggtactctaaccttaatcataatgcttaaaacccctatgcattaagataagccaataacgcatctctcatctggcttttatcccaaacttcattatgtagtacttctgaattttctaagtttgctaaattcttaggaatttcattttctgtcgcttctgataatttcttaagtacttcaaaatcattaattccatctacatctacattaagtgcattacaaatacttcttgggaatttaaatggacttgctgttgagacaactaaagctggtttatggtctttagtttcttttttatatttttctttaactacatatgcaactgctgtatgtgtatccataacataattctctttttcataaacttctcttattgcatcatacacttcttctgttgttgcataattaccataaaagatttttataaattcctttattttatcatttacttcatacacaccatttgtatttaactgtttcattaaatttgctacaacttcacagtctcttccacatgcttcatatagcaatctttcaagatttgatgatacaagtatatccattgaaggagattctgttaaaactaactctctcttcttatcataaactccagtttcgaagaaatcagtcaacactttattttcgtttgatgcacatataaacttatctattggtaatcccatttgtttagcataatatcctgctagaatatttccaaagttccctgttggaacaacaacattaattggatcatctaatttaattaccccttgatttactaaattaaaatatccataaaaataatacactatctgtggtacaagtcttcctatattgattgaattagcagatgataatatatagcccttgtccactaatccactcctgaattcattatccccaaatatttctttaactccagtttgagcatcatcgaaatttcctttaattccaatgaccttaacattgtttccttcttgacttaccatttgtctttcctgaattggacttacaccattctttggataataaacaacaactttaaaaccttctacttttgcaaacccctcaagtgctgccttcccagtatctccagaagttgcagttaaaattgttatatcttctttaacattacaaatcttctttgctcttttcattatttgaggcaaaaataatagcgctgcatccttaaatgcacaagttggcccatgatataattctaagaaatttttttctacttttacttcaaatcttccattatatgcatcattaatcgcccccattaattctgcatcatcaatatcagtaaagtactcattaattactttaaatgctaaatcttcatattgtatctttgtatttttctttagttcatcataaacctttggaaaatcatctggcacgtataaaccaccatcttttgaaattccatttattattgctttggctgaagctatttccttttctaagcccctagtacttctaaacttcatttaactcacctcaaaaaatgtattagatatggatttatatattattgtaaatgtcgacaaattaaagtatatataaacatattctacctataatctatattatcatgtatcctattcatacacaagtgtttttctataaaatacattatattttttcattttattaatattttgtaatatttttatattatataaatctattaaaactacatgtatatatttataggcataagctgaattgcacattcattaactcttaagtctggacattcaggtacaaaaaaatcattttcttcaagacactctaacaatggctttgctttttcaaaaaacttttcataaaagttttcttgaccagtttttcttaacagacttatagaatcctcttcttgtgtacatgtttttataacttttccaataactttacagtgacaatttatcttatcaaaaacattacactggctgttcataaaattatctttatttatagttaagatagcttttccattaccaacattcattattaagtcttgggtattattacatgtcaaaagactatttagatgagttagcatcttttgaaacattgtaaaattcatttttgtttcttttcccttaagaagagtatttagataatcggcaccaaatatatctataagatttatcaaacaatcaatatagcataatatacttgaattggttattgtaccttcaacttctataaggtctcctgtaaaaatattatcattttctatgtcagtaacatctttatgaagaagctcttttttttgattaagatgatccataagacttccattcaaaacaaaggttgtatatgttgtctgaatctttctttcttctcttatacattgccttgcatcgatatccttatcaagatggtggtgttcaaaattattacatgcatcaagcttgttttcatccctaaacccttctttttcacttttacttatgcttccctggctggagttctcgagtctatctccttctttcatcccagcctgtagtgttttatcaaaagcctgcgttagtgtaattgtctctatgtatcctgttaataccaaggatgatagattcttgactagattttcatccaaataaacaagtatatcaaaaggattactcattacttctcctttcacacaattaattgcacaatattttatactcattattattaatattcttacttctaagataatatttatataaccacttatgaaatattatcttgtataaaaacttcataatggcttttctcagaaaattacaattttattaaaattcatatcttcttaaaatatagtgttataatattatctattaaaaatatagaaaggatttaactgattactaattatactattaagatggtaatctgcgcattatatagaattatgaaaaaattttttaaaagactttttttactattattagcttcaataatatgtattactgtaatttttcataaaagaatttatttattatatggaattgcttctaaatatatatcattagaaaaagaaattgataatatgaatgatgcttttagtatcgagccaattgaaaatatagattacaaagatattacatataaaaacacaaatggtgtttcattaactcttgatatatattcaccattaaaaaatatatacaaaaaatcaccagtaatactttatgttcatggtggaagctgggtatatggagataaatctcttccaactgcacttacacctgttttagatacttttagagagcaaggatatacaataataagcacttcatatgaacttatgagaaacaaagaaaatttttcaaaacaagtttctgatataaaagatactataagatggatttataaaaatgcatctcaatataattttgatacagacgaaataggacttttaggaatatcttcaggcgctcatctatcactaatggcagcctatagtgattcagagaattttgttgattctcaagaattaaaggattatccaagtaaagttaaatatctaatagattttgctgggccaactgatttaagcatattaaatactacaaacttgaattttgatttatctaaaatattttcttcaataactaataaagatgaagtaatacaagaatttaatcctataaattatgttagttcaaatgttccagaaacattaataattcatagtaaatctgatagccttgttccatttgaaagctccgaaaaactagctgaaaaatgtgatgaggtaaaagcaaaatcaaaattaattgctctcaatagcagttctcatgatttatctgaaatatcatccgatgatattattaatatttcaaaaggactattattctttgtaatttccaattcaccgctttaatatatttataaatacgcctaagagtaaattttatataaaaatactgcatcagaccaatgataattgatctgatgcagtattttaatactcatatttttttatattttcacatattactatgttcaattttttatcttctaaaacctttttatatgaacataaaaattcatttaattcattgtctgttaaatcaatattcttatcacttattagtattacttcttcaccttcaagaagaactttaagattatttttttcattattaataaagtactctgacattgcttttgatgtcattctactcttatacttttcttgaaaactgagggccttcttcatatctccataatttaaacctgctccactaaagtcaaatccagacattttaaactgttcttcaagcattgaagggtcaaaaccatatctctctaaaaactttttttgaatattcataagtttatcttgagaaatgttgttttcttccatataactcattatatttttagaaaaatcagccatatttaatttaccttcagccatcttataatacatagaatatatgtattcctcgaacttatccacatccttatccttaactttattcttaatttcattaaagtctataattctgtctgacataacatcaatcctctcctttgtactattatataataacttatactaataaatcttcatttgttaattattttaccaaatttctttataactattattactcaaaaaatgcaattataaatattcacagtataaactattgtttacaaagctaaactatatatttatctgtaatctttaaattcagtccacgcttcttcatataattttaacttatctcctaagtaatcgtaactttcacatttttccaacaactcttctggcatatatgcattagggttatcctttacagcttcatcttgctcatccctagcttcactctgtggtgtagtatatcctatttcatcagcagttctaaaagctggatccttttcacataagaaatttataaacttttcagcattttctttatttttagttccctttggtatacataatgaatcaatccagaagttagcaccttctttaggtacaacgaattttatattatcatgctctgcttcaagatttagtccttcacctgaccaaagaatagatatagcagcttctccacttgccattttatctgtattatcatctgatcctatagctaataagtttccatttttcttaagctctataagtttatcttttgcttcattgatttctttttgatcagtagtatttaaagaataaccaagcatttttaatgttgccccaagagaatcacgaactccatctaaaagtactacatttttttgatattcagtatcccataatgcagtccaactatctattggtttacttacataatcagtattataacatattcctatagttcctgacatatatggaacgctatattcattatttggatcaaatgtctttcctaaatgatccgatgatattttagacatattcgtaacattatcaaaatcaattttttctaatctatcttctgcaatcattctttgtacaagataatctatggatacaattacatcatactgtgatgctcctgatgttattttattatacatctcttctggtgcatcataaacttcttgattgacgtgaattccatatttttcttcaaattcatctaaaatcccttcaccaatgttttcgccataatttataaagttaattgtttgcttctcttcttttctgcagccaaaaaacatacttcccatcattacagtacacaatagtaatgttcctactcttaattttttacttataatttttttcattatctttctccttagtcattgatatatatatatatatatatcataatctcattttataaatattttttagttctaagtatgactatttctttaaaatgagatttatttttcatcatatattttattaattcaattcatgataatacatcactttttctaaagaatatataatatctataatctttagaaattctcatctataattacatttacatcttattactaatattatatcctatacttcaatttatcaaaatagaaacatgtattagtatatattaattgataaatatattcaattaatatatgtccttatgggtattattcatatctttattctataattttaaccttatgctaaaatattataaggctatatcaaaacaattcaatttcgatatagccttatagtatttactttatgcctttataattatttaacccatgctccatctttattaagaacatatccatcaactatcgtattagataacatggcacctgactgatttaaataataccatgttccatcagcatcttttatccaaccagtttgcattgctccactattgttcaaatagtaccatgttccatttgtatcccttaaccaacctatactcattgcaccattttctttcaaataataccacttgccatcagaatcctttagccatcctatttgcattgctccatttgcttgtaagtgataccatgttccatctttatcttttaaccaaccagtcttcattttaccatcattttctaaatagtaccattttccatttacctgctgccaatcagttttagcaataccattttcatcacctagataccatttattatcaataaactgccatccagtcataacctttccatttgcatcaacaagttttattgatgatgttccatcttcattagtaataacttctgtaataactgaattagaattactatctcctgacaaatcattttctgatgatgaattatttgatgatgaatgacttcctgatgatttaaacgttatttttgatttagtatagtcatgggatatttctttttcttcaccattattgtctacatattttaccactaatttaatgtatttattataatcacttcttgctattttataattcttatcagtacctataagaactgaattagtatcattaacttcatctttatcattatccatctgataccaatagtacttaagatttaaactagtagttatttcatttccttctttatcttccactttcacaataggagttaatgtataccctactttttgtattccagatatatttacagatacatttccaatctccgtttcactttctgatgtattaatagctttgatatcatcaaaatacattgttgaatctacattccaacttccttcattatcctctggtactattgtattacaatatattgccatacttgttatattgcttggatctaatttcccaccttttttacctataaaatcactgaattgaagttttaaaagttgtggttcagttgtttttgtaaattcaggaagcctaatttcaaaatcttcaccatttgatgttaactgaataactaacttttgccctttcccatctggcttagcccaaatttgaagtgcatcgcagccagtccagtctgcttcaagggattttattattcctgcatatccctcacttgttttttcagtagaaattttataactaaatgctactccataatcacctgtatatttatttttatctgacaacttaggatttacactacaccctggccccttatttgtagaccatgcaccagataacagactgctatcacccatatagctttcaaagtcatcaacaactcttggttgcttttctgcttctttaatattaaacactgcatttatatagtttaaaactgtgttatctgattttaattcaattgtacctgatacttgaccaagttcatttaatatatcttctgtaatatctccactgaatataccattattatctgtagcttcaattgttttaataacttgtccatctttattcttgatgtcaaatgtaacttttccttctgtatttctaacagctgcttttatagttactggctctaatattctgtcatttgaaattggagtcattatatatccataagcatatttatcactaatttgtgtatctactgatgcataatcatctattctgtcagcaaatactgtatttttatcattataataatcaataaattcattaatcatttcatggccttttttatcattagccataaatggtgcaaaaaagttatctgtattattaaagtttgcccacaccatataatatggcatatctgattttgaaattatatccgaaacatccttaaaccaagtcttatttggatttcctgtttcaggcattccaccaccattaattcttataccagtttctgatactgctgataattttccttttgagtctgctattccttgaactaaattgatagtttcctttaaactttccatccaaggatcttttgatgcctctgccattggatcatcatgatacatatcaaaagctaaaatatctatatattcatcccctgggtaacgtgataaatattctttatcattttcaaaaggtccatttggagaatatacatataagaagttatgaatatttttagtatttcttaaatagtccactgtatatgcaaataaattcttgtaagattgtgcatcacaaaatgctcctccccaccaaaaccaacttccattattttcatgaaacggtctgaataacactggtacattttctttttgcaattcatctgcatactctgctattaaatctaaataacctgtataaacttcatttaaatctccacctggcattatccttgatacaatatttccacttgttttatttggagaataccctgaataatcatattttccatctactaattccttattttttacaatctcaaaattaggcatatgagaagataatgtaattattgcaccttcttttgctgcttgagcatctatttgagctgctttcttaggaagggttaatccttctttcttttcttcatccgtaagttctaattcatcccctgtaaatgaaagtgtatccattcctataattccagctattgaacctgttacatcttttgtatctgagttcgtaccttgtttatataaagccttgtgatgtgtatcattttgatgtccatatatgactttgtctgtcttcccaagagcctttaaataagcatataagtctgctgttgcttgagttgcttcattatctactaatttaacttctgaaggcatctctaaagaatccacttctactagtccttgttttacaggttctactgtcttttctacatatggatcttcttgtgctgcctgacttaatttaatattatctatataaatgcttcccttataatctgtattacttccaaccaaacctaatattattgaatcagcttcaatatctgcattattaaattcaacaactgcttgtgccttttttagtccattacctaaatcttcagcatttgataaatctatagcaacatctttattaggtccatctgtaataaataattttgccttaaacgtaccggttgtcatacagtttggatcgtatataaaatcatatgttaatacattatatccattaagtttaagtttttcaccctcaaatttcttctctattttaaattcactccaagagtccccaacatttttactataatcaacatctaatctcaacccttgtttttcttcatcaaagttaacaacattatcttgtggtccattataagaatatgcgcctccaaaattccatccttcattggaattgtcaaaactccatgtaactgattctacagcagagccggtagaagtttgtgtttctatttcaaaattgctcttttctaattcatcgcctttctgctcttcactaactattgcattttcttcataagatattttctcattattctctgttaggtcttcacctgtctctttatcattaattcctagtgattcatcttttacatctaattctgatagctgtacattattttcaactgcttttacaattcttccttgatttaagctacccacagtagtcatagccattgctgctgctgttaactttaatattttcttcttgttcattattttacccccattattttaatttttctataatcatattattactataacgagcatcatgtaaacgttgtgtgagtattgcaataatttttgtttataattattaatatatgcttatcttaaaaatcaacttaataattaccacttctaagctaaaaaataaaagaacctataatatatagactatcttttacaagtatctattttataggttcaactttattaaatattctatttttttatttagataactgttgattaaataatttaattatagtcaactttttcaaattaattatattaaatacttaatttgattcactaactgcaaattcttcaaagctctttaagaatttctctacgtggcattcttcatgtttaacacttaagaaaactgcttcaaattgagatggtgcaatatttattccattctttatcatatgttcaaaatacctattgaatctctctacattacatgtcttaacatcatcataacatcttacttcttcaagatctgtaaagaatacagtaaacataccacctactctgtttataatgacaggaatattatatttatctgaaatttctttaattccattttcaagcataattcctatcttttcaatatgatcataccattctaaattattcttaagctttgtcaacgttgcaagacccgctgccataactattggatttcctgacattgtacctgcttgatatactcctcctaatggagataagttttccattatttctcttcgtcctgcatatgcgccacatggaagtcctccccccataatctttgcatatgtaactaaatcaggctctattccaaataagctttgcgctcctttaaaagcaactctgaatccattcataacttcatcaaatattaaaagagagccatatttatcacaaagttccctaagagttttcataaaatcttcttccgcttttattacacccatatttccagctacaggttctataataacccctgcaatttcatgtccatacttttcaaaaagatcagtaatctgctttttatcattatatattcctattaatgtattttctatggctccttcaggaactccaagggaacctggtattccatttgtcattactcctgatcctgcttcaattaaaaatccatcaaaatgcccatgatagcatcctgcaaactttactatcttatttctttttgtatatcctctagcaagttttattgcactcattgtagcttctgtacctgagttaaccattcttaccatttcaacattatctaaattttcacacataaactttccaagatctaattcaagttttgttggcgctccaaacgctaaagccttactacttgtttcttgaattgcttttactacatcttcatcacaatgtccaagaattaatggcccccaagccaaaacaaaatctatatattcttttccatcttcatcttgaatcattacgccattaccagactttattataggaggattcatactcattcctttaaaacatctaactggactgtttactcccccaggcatatatttctgcgactcagtaaaaatttgatcatttttagtcatttttatttcctcctaattatgtaaatatatatattaaaattaatactttaatatttattattaatagttcaactataaaattttgactttcactatttcatgaaatacattataatccataaagttttcttattatgcttatacatttaattataatagcagaaattgcctgaatattcatctacgtaagaattcagacaacctcattgtttattctatatttattttttattcaatatttttgcagcttcaagtgcatgataagttattattatatctgcaccagctctcttaattgaagttaatatttccatcgtaactctttcttcatcaatcattcctgcttttgcggctgccttaaccattgaatattctccacttacattgtatgctgcaagaggcatatcaaaattatccctgcattctcttattacatcaagataagaaagtgctggtttaaccattattatatcgcatccttcttcaatatccatctttgtttctcttaaagcttccattctattagctggatccatctgataagtctttctgtctccaaactgtggagctgaatctgctgcttctctaaatggtccataaaatgctgaacagtattttgctgaatagctcattatacttacttttctaaatccattttcatctaatgcttttctcatggaacctattcttccatccatcatatcagaaggcgcaaccatatctgcaccagcttttgcatgagatactgctattttatcaagatattctaaagtctcatcattatctacatcatttccatgaattattccacagtgaccatgagacgtatattcacacatacacacatctgttattaccaataaatctttatttaattcctttatctttctaacagcctgttgtacaattccatcatcattatatgcttcacttccacatgcatccttatgttcaggaattccaaaaagcaatatacctgctatattcgcttcttcaatagattttataacttcaggtaatctatctattgaataatgataatttcctggcatagaagatatttcatttttaatgtttttcccttcaacaacaaatataggataaataaagtcctttgagttcagtgttgtttctctaaccatatctcgtatcgaactacttgctcttaatcttcttcctctttttaacatactatccctccagcttatttagttaacaattaacagttaacagttatcaattaacgattatgtttatttaattatttggttcatttaaaaatgacactatttcttttaagaaaccctcttctgaatgttcactacatacatctgcagctattccaaattctacaagtggtttatttgtcttttctccaattgctataatatgcttttccttaaccgcatctagtccaaccatgtcaatcatattatatacagttgatggacttgtaaagaatactacatctacttcgtcaaataccctcttatttcttaatattccttttactgtattgtatataaacactctttcaacatctgctccagctttctttaaactttctgctatgttttcttttgcaatagatgaacaaggtataagaattttatcatgttcattaatatgtggctttaaaacttcaactaatccttcaccaataaattcacgtgctttttcgaaacaaacaatgcctctatcttctaatgctttccatgtagctttaccaattgctgaaattttagcatttaatcttcttatatcatatccctttttaattaaataatcaaaaaagatatttacactatttacagatgtaaatactatatgatcatatttttctaatttatccatgtattcattaagattttctggcgaaggctctatctcaatagcacttatagaagtcacttcagcacccatatctctcaatttttctcttaacttaaccccttgcttttgagatcttgttacacatatattagttccaaaaagaggtttattttcataccaagctaaatcatcatgtaaatttacaacttctccaacaacaataatacatggtgattgaagtcctgcttttcttactttttctgatatatcattcaaagttccaataacctttttttgtttactgcatgttcctctcatgacaactccgcatggcgtctctggatcttttccattttcaacaagctgactaactatattttctaagttgctcaatcccatcataaaaactaaagtgccttcttcaatagctaaagccttaaaattaacattaagatttttagccgacatcccagtaataatatgaaaactttgcgctattcccctatgagttataggtattcctgcataatttagcactgctataggtgatgtaacacctggaataacttcaaaatctatattttcattcttaagtgcaagaacttcttctcctcctcttccaaaaacataaggatctccaccttttactcttccaactatatggccttctttagccaatttcacaatcatttcgtttatttcttcctgtgtcttataatgtgatcctggttcttttccacaatagtaaactatacaatcatcattcaaataatttaaaacattatttgaaactaatctatcatacaaaacagctgtacactttttcaaacattttactgctttaactgttaataattcttcatcaccaggtcctgttccaattatataaactttactcataataatatttctcctattaattcataattgcttaatattttatttttcatttaatattttttctgcaagcattctgcctacttcaagataattagatttttttccagtaatatcttttcgtactattactccatttaaatcatatattcctatcatatataattcatcaccagtcacttcgctataagctccaataaggctatgacaatctccttttaattccctcataaaacttctttcggcttccacagtaattctggcttcaccattatccagcattttaaagtatttagaattttcactgttttttacacactctatacctattgctccttgagatactgctggaagaaattccttaggatcaaaatattcggttattatgttgtctagctttaatctatgaattccagctgcagcaagtattattccatcaagattttcactttccatttttgcaagtcttgtttgaacatttcctctaataggcactacttcaatatcacttcttaataactttagctgtgctgctcttcttatgctacttgttccaattttagctccatatcttaatttactaaatgatatattatcttttgaaattaatacatctcttatatcttctctttctattattgctgttatttcaaattcactgcttaattcatagggtacatctttcatactatgaacagctgcatctgctttttcttctaatagtgcacattctatatcctttacaaaaagtcctttaccgcctatcttatttaacgacacatccagctttctatcaccttctgtaactataaggagcttctcactctctttattaatcttgttttttaaactgtccataactatttctgtctgaacttgtgctaatctactttttctcgttgcaagtattaatttatccattaaaactctcctccacgtttaaattaaaataacttatttataacttcttctggaaatctactctttatactattaagttcttcacctttatcaaaatcatttttaaattcatctgtaaaaataaaatttataatctcacttttatattctggaatacttttagctttatttcttacttttgtagtaaaatctatataatcatcataatctcttagtactttgcttattttatcagctgcccatactgctccttttggattacctccttttgtatttaaagcaaaactaatagtttttgtacttctttctgctggaacaacggccataccttctttaaaatctgttgaatctatatatatcttataatttttatcacaatattcttttataagttcttttattttattatcctctaaggcaattattataatgtgcttatctctcaaaaattcataatcaaattctctattgattaatttaaggttatcactattatttgaaagttctaaaatatcctttgaaaaatcttttgataaaacttcaacataacaattattttttacaaaatgattgatttttattgcaccagcttttccacctccaataacccctattcggagtttttttgaaaaaagtgaaataaatgaatattctacttcatcctgaatatcttctctattatctctatacattcttcaccacgtccctttagtgtttcttcttttaaaattttaatagccctattaatataaaaatctgaagcactttttataagcgtatttgctagttcaatatcacttttatctttacatttatttttaaatgtaatacttctcatactataaacttcattgccaacttcttttattttttttatttccggggcaatacttctaatcttttgccattcattaaattcattaagatacttctttaatatgtatttgttttctaccattctttgtactcttaactttttattttcatcattgagcgcacttactttatcaatattatatacttctactctgctcatattttctacttcattatcaatatctcttggaacagcaagatcataaatatatagtttttctccacattcatttatatcattttttgataacacaatgtgaggtgcagatgtacacgatattatactttgaacttcatctatgtatctatttttctcatcaaatgtaattactcgcactctttcatcttctatttcatatttaatattagtatttctaacaaccaaatatataatgtctgttttatgagatagtaaatacttcataacaagatgtccaacttccccatatcccataagcataaatctagagcaccctttttttatactttcatttacagcaattgatgctgatgaaactggaatatcataaagttttgcttcatttctaaatttttttccacatgttatagcctcctgaaacaatctgtgtaattctaaatttactgaatttaattcaagtgcaacttcatatgcatttttaacttgcccaagtatctgatcctcacctataattttcgaatgaaatccacagcatacctcaaataaatgtctgcatgaatcctctcctctagtaataaaaacatactctctaaacgaataatcccaatcaaaaatctcaaaaatctcttttaatagttcttctttcttaaaaaaatcattaaaataaatttctgttctgttacaagttgctaaaatcacaacttctttaaatatttctaaaagcttattagtatatgtttcaattcttttaggctttaatgtaagtctttctctgatttctaaaggcgtatttcttttaattcctattaaccctatcaccttgtcacctctgtcatataatttaatctaaataattagcaaacattattatactacataatcatatctgcatagtgattagtttagcagataataattattaagtacacgtaaatttcttgaaatattttatataataacttatttctcaattatttattatatcctaattaacatataaaaatataacaataattatttaaatcgaacataatctacatggacttatgatttaatacaaatctttaattaaaaaatgtacaattcacttttattataggtgaattgtacactttttctatctatttaaaacttcttctataaacttatcttttcctatcctatccataacagtagatattctttcaccttttataccaacttccctatagtaatccatgatcttattaaccataggtattatttcttcttctttaaatatttttcccaatgaatcaccgattcttattcctcttccaaatcttccaccaacaaaaatttctgcacctttttctttaggtaatgctgcttttaaattacaagcacgtacacatccaccacagttaacacataaatccttattatgaactatctttccatctacaacttcaagagccttttgtctgcatgatttaacacaaagtccacatccaacacatttatcaacatcaaattcaggaactgttcttcccattattccaatatcatttatgttagcttttgcacagttatttgcacaccctacaatccctattttacacttatgaggtgtatctgtaccaaaatagctatcctctaactgcctgcagatttcttgagtatctatgttcccatgcaaacatactgttcctttacaagaaactaaaggtcttattttttgtccagttccaccatgtcttaatccaagggcttttatttcttcaattaatttttccacgtcgctatccttaatccatggaatttcaacttgaagtcttgtagtttcaccaacataaccacgtccatatttttctgcaagattagctatgtctcttagctcctgtactgtaaaatttcctgctctactaagtagtcttactgcaaaatgttccttatcattttgtaataaaaaacctaaggcttttagttctttttgtctttttgcattaactgccatattacatatccccacacacacattttatgtaatttacttttcactaatattcttttatgtatattttatccattaaatcagatataatccaatactttttgatatatattaatcataagtatatacctatatgtaataatcaatatattatatttatagttaataaacgaaatataaaaatactatagactataaaataaatttaaaaagaatagtaaacaaagcaagtcccaaaatattatacattgtaaatactcttaaatatcttgttctgctttcattattactagtacaataaagcttatatgatattacacttgccatagatgctatcaacgttcccattccccctatatttactccaagaattaaatcattaaaattctctgtaaatccagatagaagcatagctgcaggtacattacttataaattgacttattattattcctgcatagtatgtatttgattctccactaagaattgttttcataaaattttgtatttgtatggaattagatatattccctacaaatatgaaaaaacctataaaagttataagtagtgaataatcaacttcaaaaaatagctttctatccataaagaatataaataggagcgttaataaaaatgataatttataatctattacatgaaatactgaaaataatattataactaaaagtatagaataagttattaatttttttctatctcctataataaccttatctattgaaatatttattactttatttttacttttaaatataagcataataagaaataatatagacattagtgcaattggtactgttatctgaaaaaatcttattggagatatattgtaatatgtatatgtaaataaattttgaggatttcccataggtgtaagactacttcctaaatttgctgctaaagtttgaaaaacaacaatctttaaaacatcaatatctaacttacttcctataatcatagtaataggtacaaatgtaataagagcaacatcattggtaactaacattgatgcaaaaaaagttataaataccaacgctactgataaatgcttatatgtactacatttttttacaactgctactgctatataatctaaaaatttaagtttcttaaatgcacttactattatcatcaaattgaataataatataagtgtcttaaaatctatatactccatcttaggtgtatatataaatgaagttgtaattgctaaaaacaatgctattattaaaacactttctttttttatatattcaacaactttcaaattctttactaaaaccataatattatcatacctactttatataattttttaatgtcttttctaacattatcaaatcttcttcttttttaaatgaatcaaaaggtattgctattccaatatcccctttagcagcaatacataaacattcattcaatttaattacatcaataattgaatgagtctttattatagacttttcttttccccttaaaacctttattgctttcccatcaaatttcactttaatattagaatcaatcacatttccctttttctttaaattctttctaattgttcttgcaacatgtttattagcatacttttcaaagaaaaatagactaagtacagcaaacaaaaagaatattcctgcaaaaattagtcctattggcaacttaccttgctctttcatattaaatcctgcaaaaatgtatattagtccagctactaaaaatatcagaaacatgaaattagattttttctttaatgtttttttatatgattctgaacttgttgccctatacatagagaaatcacatatctgcttttctgtatttttatattttacttcaatcataattatctccttttctatgtttattactttgacaacacctattatatataaattacttaaatttagctagattctattacttattatgttgtgtattactgatatttttcttaatattattaagaattccttaacctcttttatgatttttttaatatgtctgacataaacctgacacatacaaatcttataataaaacttgtaaagtagttaaaaattattatttacccctttattaaatagtaatagccattttccttatggttaaatggtaactcggctgtgaattcccctaaattcacagccgtttttatatgccaaaaagtttttatttttacgaatttttatttatatgtatttttttatactatttggaaaaactatatataagaattactaattataaataaggaaggataaatttatgagagtgccaaaacatattggaataatccctgatggaaatcgtcgttgggctttatccaatgatatgacaaaagatatggggtacagctatggtatcgatcctggattacaggtgtttaaattatgtcaaaaagaaaaagttgaagaagtaacattttacggttttactgtagataatacaaaaaggccttctgatcaaaaagaagcttttactaaagcctgtattgaatcagttgaacttttaaccaaagaaaattgtgaaatattagttttaggaaatacaaattcatcttgcttccctaaagaattattacaatatactgaaagaaaagtatttggtagtggtggaataaaagtaaactttttaattaactatggatgggaatgggatttaaatcttcttaaaaatcctgctctttctaaaagtggtataattccatatttacattctaaagacatttcaagaattgatttaataataagatggggtggacgtagaagattaagtggttttcttccagctcaatctgtttattctgatttttatattattaataactactggccttcatttaaagaagaggatttttatggtgctttatcgtggtatgataaacaagatgttacccttggtggataagaatcttaaatttatgatataattactttaagtttaatacttgagggagtaattatatgtataaaataatatttctctatttaatagtaattaatatctgtggatttctaataatgtttattgataaaagccgtgctgttcacaaagaatggagaatccctgagaaaacattaatgtttgtatcattaatcggaggatctattggaatgtttgccggaatgcatattttcagacataaaacaaaacatataaaattcacattaggagttccctttatatttattattgaattaataacagctgtatacttaattaaataaagtatacagctgttatgtattttataaagtattaagatcatatggagtattctgataaacacaataattaagccagtttccaaaaactatatttgcgcttcctctccatgtttggcttggcttttcatttggatcattatttttaaaataattttttggcattgctatattatcgcctttttctaagtctcttaaatattcatctttaagagtgtttctatcatattcaagatgcccagttatataaacttttcttctatcttgtgttgctactatgaaaacccctgcttcttctgattctgataatatttcaagatcttccacttttactatatcctctcttttaacctctgtatgtcttgaatgtggtgcattaaatacatcacttaatcctcttgtaagatctgctttttcatcattaacccaatgtgaaaataccccaaacatcttttgatctaaatcatacttaggtactgaatgatgataatataaacctgcttgagccccccagcatatatgaagtgtagaaaatacatttgtattactccattccataatattagtcaattcattccagtaagtcacatcttcaaattccatttgttctactggtgcacctgttataataagaccatcaaacctctcatgttttatttcatcgaaataactataaaatttctctaaatgttctaaaggcgtgttatgagatgtgtaactctttgtctgaatcaatcttatctcaacctgaagaggtgtatttgacagataacgtaaaatctgattttctgttactatctttttaggcattaaattaagaattgctatcttaagtggccttatatcctgcgtgtttgctctttcattattcattacgaatatattatcatcacttaaaactttaaatgctggtaattccctaggaatttttattggcattcctaactcccctttcattattgtgcttattgctttttgatatattatttatcattatatatcaaaatttgtatatatatcaacttaatgtttaatcacaatcctttagtatttaaatttatatgtgctataaatttaaatactaaaggattcaatatattcctaccttttattttttatcaaataattttttatactctataataatattttaatattattattaatatttatttaataatttattttattttttatatttttttaatcattttttaatttcacttaaatagtaactaatatgaataaatcactatattttctatttatgttatactactttatatacatacataaagggggcacacattatggtattacatcaaaatataataacagcttatgtgggtacgtataccaatagtaaaagtaaagggatatatcgcataaactttaacaaaaactcaaaagaaatagagagagtggatcttgcttatgaagtagaaaatccaacttatctcgcacttgataccgaaagacacatactttattctacttgtaaaataaataataaagcgggggtaatatcatttaagtactggcaggaacaagataagctaaatctaataaattataatctttctgaagaaaaacaaccctgtcatataagtacaaataatgataatcaagtagtaatttcatcaaattatcatgaaaataagatgatagtttacaatactttagaaggtatcatactaaattacccatctataggaaagcatatacaatctgattctgatgataaattaattgaaaatcctcattttcactgctctatgtttacttttgataaaaaatatataatctctacccaattaggtattgataaattagctgtttatgagttaatcaatggtacactatcagaaaaatcagaattaagctatcatttccccaagggaacaggtccaagacatattacttatgttaattcaaaatacatctatgttttaagtgaattaacatccgagatttttgtacttagatacaaaccatctaataataataatatctttgaaaacattcaagtaataagtactatgccattaaactatgatggtaacaaaagtggagctgcaataagaattcatccaaataaaaaattcctttatacatctgatagaggaaataattctataagcttattttcaattaattctacagatggaaaactaaaattgttagaaactgtatcatgtcaaggtgattctccaagagattttcaaatagatccaactggtagttatctttttgtcgcaaatgaaaaatcaaataatatatctgtattttctattggtccatcaactggaagcctgacatttatgaattctcatgaaatttattcaccaacatgcattgagttcatttaacagattacaataaataaaagcattagattgactatttccaagtcaatctaatgcttttttatattattaataattttatcattgaaaacctttttactttttgacatacctattgatgtttactataatagaaaaaataatttatttaggaatacaatgatatatgatgataagtataaaatgagctcataaaacatagcatataacattattttatggactaactgtctgttaaagtattctatagttataggaggattttatcatgacaaaacaaactttcattgaacaaattaaagcatctaccaaatcaataaaatgtgacttggtgattaaaaatataaatatagttgatgtatttaataaaaatacctttattgattctataggtataaaaaatgggtatatagttggtattggagactatgaaggaacagagacttttgatggaacgaataaatatatatgtcctggtcttatggatgctcattgccacattgaatcaagcttaacctctccagctgaatattataaagccgctcttttaaatggcattacttctgttattgcagatccacacgaaatcgctaatgtacttggtcttgatggtattaaattcatgcttgactcttctgaaaatatcccatttgatatgtattttatgcttccttcatgtgttccaggaacagaattcgaaaattctggagctgtattaaatgcaaaagatctagaatctctatataaaaacgaaagaatactaggacttgcagaagttatgaattatccaggagtaattaactgtaatgaagatattattaataaactttatgatgccattaataataataaactaattgatggacatggagctggtcttacacctatgatggtaaattcttatagatgtgcaaatatatctacagatcatgagtgcatttctaaagaagaagccctagaaaaaatccgaagaggtatgcatgtgttaataagagaaggcactgtagcgaagaatcttaaagaattacttcctgctgttaatgaaagtaacagttcacgcttctcattatgcaccgatgataaacatattgatgatttaatggaaaatggttcgatcaacacttccattattgaagctataaactttggtttaaagcctgaaacagccatatcaatggcatcaatcaacacttcttccttatacaatataaaaaataaaggtgctattgcccctggatacattgcagactttattatattggatgatttaacttcatttaaaataaatagagtttataaaaaaggtctgctcgtagtagataaaaataaactactaactaatatgccaataaaaaatacccttaaaaatcttacattaacaaattcaataaacattcctattttatctaaagacagttttaaagtttcacttactagcaatcctacaaaaaaaataaatataattgaaattataccaaacaagcttgaaacaaaacatttacagtacaatcaaattgatttatataatcagaatataaacacttctggtactttcaattttgaatcctacttaaaaaatgatcttgtgaaaatagcagtaattgaaagacataaagcaacgggaaatataggtcttggaatattaaaaggacttggtctaaaatgtggagcaattgctacaactatcgcccatgattctcataatcttatagtagctggtactaatgataatgatatgttgtttgctgtgcaagaactaaaaaaaattggcggtggaataattgtagtacaaaatggaaaaattctttcttctataaaacttgaaattgctggattaatgacatcaagatcttatagtgaaatagattttgagctagaaagtcttcacaatagtataaaaatagtagcacccaacattaactttaacccatttttaacactttcatttctctcacttccagttattccttcaataaaaataactgataaaggtttatttgatgtaataaattttaagtttataaaaataatagaataaaacaatagatgagttattggatataaaagtccaataactcatctattattccacatcatacactatctctgtaataactatagacaactcctctaataacgaaatcttattaccaatcctactctcccttggtccactaattattcttaatattggtctaagaggaaaattaggaatagtttcttcaactcttgctatttcttctgtacttaaccttactacagttccttttggaaaaggtattattattctacagaatacacttatcaaattataatcaaacatcgttcctgcatttgacattaaatattctaaaacatcacttggaaacattgcccttttgccaggaagatctgtagataaattgtcatatgcatctgcaatactcacaattttacttaaatcaattatgttttcatcagtaagtctatctggaaatccaagtccatctggacgttcatgatgctgcaaaacaataagtttgctcaaactattaatattatatgtacttgataaatatttatatccaagtcttggatgatgatttagaatttcaatttcactttctgtaaattgtgtttccttttccatcaatcttttaggaataagtgactttcctatatcatgtataagtgctcctatacataatgcttctaattttttctttgaaaacttcatagcaattcctatagttaacgaaataactgcaacattaacacaatgagaatacatataattattcatgcttctaatatcaactaatgctaaaactaaatctttatgacttaatatatcctctattatattttctgccatctttcctatattataaaaatagctttgttcctgccatgtatagtcttgttcactatttctaaatgcatttccattattaagtcttcctatatttgaaaatgcttcttttatagttattatagctttctgccgtatttctggctttatgatatcttcaatttcctcgttgctatatttatcaactatgtatatagatagaatgtttatttcttttatttttgttatagtattttctcttaaaactactcctgctcttaaaagaagccttccatctatgtcatatatagtttttcctaatacagtattaggtcgtactttttcaatcggaaccagcctcatagctgctattcccccctaaaatgatacaattataaatttccccaaatgtctaaataattatatgtacaccgtttatctcaaaatgcctacattacttatcaacgcataaatctacaacttattttttatacgtgtattttacatttttaaattagctcatatataatctttagatatgttccaaaattcaggaataatataattatttgtaattttagttaaaccatagattataattttacatcattaaaattatattttctttaatttaccgaaatttatttctagtataattcctactaaactcttacttgtttatttctttagatcctgcttttgttcttatcttttaatcattttttcatttgaaacatttggatttattttttgaagcaaaagttttaaagcttttgctcttctaattattatattcgtatacttgtagtaaatttgaatagattaaataaatcttttttacttttaagaaaaattattatggaatataaaaaataaataatggatatctctatattgaagtatcaacatccattatttactaaatacaaactattttattccttgtaatgcagcaatatttaacaaactccaaggcttgttaaaatgtggctgaaaaaagaaatctgtcatagaaagttcttcaattgtcattttattttgtataacaacagataaagtgttcataaattgtgttaaatcaatttttgaaattatctgccctccaagtattcttctagaatccttatcaaatactatttttaatgttgcaggttcataagtcggcataaattctggcctataattatctgttatcaatactgaatcaatattgtaatttgtagtcaatcttgcgctttcctctgtaagacctgtagatgctatacactgttcatatatctttattcctgatgtcccctgagtccccatatattttatctttggttcttctatattaagagcaattaatgtacccattcttactgcattagttgccagtggtatatatctaatatcttctgctggattataaataacactacaacaatcaccagctgcaaatacattctctttacttgttctcatatactcatctattaaaatagctccattatctaatgtttcaagctttccttttacgagagtattgttaggtacaaaacctatacataagataacaagatcacattcatattcatttttatcagttactacatgtgataccattccattacctttaaatttctttaccttctctccaagtacaagattaattccatgattttcaaactcattttctgctatatctgtaaactctttatctagatattttgccataattctttctgcagtatctattaatgttacttctttacctttcatttgaaaagcttcaactaattcaacacctatataaccgccacctataacaattacttttttagaattgttacttttctctattatttcttttgcatgatcataatttttacataataaaatatttccaagatctccaccttcaaatttaggtacaacaggccatgatccacaagttaatattaatttgtcataattatcttcaaactcttcactactaccgacaatttttacttttatttttttctcatcaaaatttatatctgtcacttcatggttcatatttgttttgacacccatactagctaaattttctggcgaattataaaataatttttctggctgtgtaactacaccaccaacacttaacgctattccacatgaaaggaaagaaatattatcatttttctcatatacaacaacttcataatctgaatgtaattcctttaacttaacaattgctgctgttcctgcatgagtacatcctattacaactactttcattaatatattcctcctatttttaaaataaaaagtatatctatattatgttgattataggttatttgtatactatacaacttagttataacataaatagtattaatattttatataattaggatacttaaacttattttttgatcaaaataaataagcatccattttcatggatgctttattataatatactgttctagtttaaaataaacttttcaaccacatgcacaataccatcttcatcattagaaagagtaatataattagctgcttttttcacatcatcagttgcattttccatagcaactcctaatcctgcatactcaaccatagataaatcatttccagcatctccacatgctataatttcatcttgcttaattcccaaatattctcctaatctttttaggcccttacccttatctacttctttatttgtaaattctaaaaagaaaggtgcacttttaaacacactgtatttttcatataaatcttttggaagtttctttatagcttcatctaatttttcctgtggatcaatcatcataacttttacgatatcttcatcatcttcaatttcattaaagtcttttattgttgctttaatcccatttatatcacattcatgttgagtatactgactcattttaggagttattagtccttcctttactgaaaaggcatgtatattaatatcaagttctttagcagtcttaaatatttctttaagatcagatccctttaataagctacttgttataatttcctctgttttactattaataacgataccaccattgaagcttaatacataatcatcgcctttaaaaaggtctaattcttctaaatatcttgtaattccagttagtggtctacctgacgctaaaacaacttttactccttttctttctgcttcttttaatactgatttagttttttcagatattttcttttcagatgtaagtaatgttccatccatatctagtgcaattaatttgtacatttttctcctccatacgccaaatacttatttatatttaaaatttatatttcatttttactatttaagtataccatgaatcacattttcttaatataactacttaaacaaaaaatatattacagtagcttacatgatatttacgatttgtgtaactaattgtagtttttattcatattatgattatgtatataggaaatgtgaggtaagatttatgcttgagtcattattgcttgtatcatctttatgtatagattcattcgttgccagtatagcttatggaacttcaaaaataaaaattccacctaaatctgttataataataaatttagtatgtacttcgactttggcgtgttcattatttatcggttctctttttaaaagctttcttcctggaaatcttccagctgttttaggctttattattttgatgtctcttggaatttatagacttttcgaatatttgtttaaggcatatatttctaaaaaaacaaaatgtgattatcctttaacctttaaattatttgattttaaattcgttcttcaagtatatgctgatgaaacaaaagccgattttgataaatctaaatctcttaattctaaagaatcattttatttagctttagctctatccttagatagtcttgctgttggttttggttctagtttatgcaacataaattatgttcaaaccttggtattatgttttttaataggagtttcagcagtttcaatcggtgtatttttaggtcaaaaattctctgaaaaacttcatttggaattatcatggctttcaggtgtattgcttataatactagctattgttagagtattgaaataaatacagaatccatgtatctcattttacttaaccaatatttttattaactaatatatatctttaaattttatacttgattaggcaaaatagctggtatcaatttagttgataccagctatttttaaaaattatattctaaatctatctgcttgtttatcaagttcattcatatccttttcaagaaattcataaaagctttcttctgtgaatttaaatgaaaaatctgtagattctactgtttttaaatattttataataatatcctctagatctttattatcaacattaaaaactatttgtagcatatcacatatagttcctttattaaacttttcttttcttctctctgcttctttttttatcaaagaaagtttatctcctccaattaaactatactgctcactcaatgtcatatatccatttccaagcatattcatatattcatcaataagtgattcctttgtatttggtacaatttttccgcttgccatcatatcttttattatttcataagctttatcttcagatacaccaaatgcagctcttaatatgtctgtatttctgaaaaactttttattttcaacattgtattttgctcttttctctatatatttaaataattcttgattatcataagccattctaaaatcccccgttagttattattcaaatttaaaaatctttcatattgtttatcgagttcttctaaatctgactgaagaaatttattatacatttcttcatctaattttatactaaatcctggagagcttgcaaaagatataaatttcaatataagttcatttaaatcactatcacttacattgtatacttctctaagcacgtcaaaaaagcttccaccctcataagattttattcttttttcagcagtagaaactactattgagtatctatcgccaccaaatatatctacctgctccttaattgatccatatccttttttcaacatatcaatatattcatcaataatatcatattttgaatttcctatattctttcgagacattatatttttaaaaacttcataagccttatcttctgtaagaagaaatgcatcttctaaaacatctgtcattctaaaaaatgtttttcccctaacattagcatttgcatgatcttgaatatattgaagcattctttcttcagtatctgtcaacataacaattcaagctctccttccttattaatactgtaaatatagctgcatacaaaattattctatatttagaattttatttattttatccatatcaatattttcttcaaatattttagcaagcctgtcatattctttttctttatattcatttactctttcaataagtttttcttctgatatagaaatatcattgctagttttaagacctgttacaaaggaatttataaaatcctctgaatcaaatattccatgaagatatgttccagctatggttctttcttcattacatactcctattactacaccatcagtatccttaataaatggaaccgctttttttcctattttacttattccattatgaatttcatagccacttacaatatgtccttttatagattttatatctcttaaatcacataatatatcagcatgtgtttgctttgttattttagcctcattaaatcttgtttttatatccaagaaaccaaaaccttcttcttggcttatatcaccttcaacaccaagtttatcaagaacaacagaaccaagcatctgatatccgccacagattccaagtataggtactcccttttcctttacttctttaatcttattaaatagcttattttcttttattgctcttaaatcatcaatagtattcttagttccaggaattattattatatctggattttttaattcttctggttcccttacatatctcacattaactccacatattctatctagcatagtaaaatcagtaaaattagacatatgcgaaagtctaattactgctatatccaattttccttcttgctcttcatttttaattttttctgttacactatcttcatcttcaatatcaaacttttcataaggcattacccctagtacaggaatctttattatttcttctagttgtttttttccttcttcaaacatttttttattgcctctgaatttattaataattacaccctttactctgtctcgatccttttcctgcaataattgaagtgtacctactactgatgcaaatactcctcctctatcaatgtctgctactaaaataacaggagagtctgaaatattagccattgccatgttagatatatctgtattttgtaaattaatttctgcacaacttcctgaaccttctaaaactattacatcataatctttttcaagtttttcataagaagctttaacacgtgcttttaattttttatttaactccttatacttataaggttcaatattgcaataaacttttccctctactattacctgcgtacatcctccacccggtttcaataaaactggattcattaacacatctggttcaattttgcatgcctctgcttgaacaacctgcgctctccccatttccagtccctcttttgtcacataagaatttagagaaatattaagtgctttaaaaggagctacattaagacccttatttttcaaagttctgcataatgccgctgctaaagtgctctttccaacagaagatgctgtacctaaaaacatgatgcttttctttttcataatataccccttccactagttcaattaattagtgtttaaatttaaaatttcttcacaagtgtaaattacataattcttattgtcttttatagatttattattgaatttaatgcgtttattatcttgatattttcttcatgaccttttacagcaattctaaaatacctctcatctaaaccacgataattactgcagcttcgtataagtatgtttctttttagtaactcttttttcatatccatagatttatttattttgaaaaatatgaaattgacactaggctcatatactttcaaataattaactttctttagttcattatacaagtaaattcgttctttttccataaaatcaattgtttcagcaatatatttttcatcttttaagcatgcccttgctgaaatgtcagctaaaatatttatattccatgcaggaaacatttttgcgattttttcacaaagctttttattactacttagtccataccctattctcaagccaggtaatgcaaaaaactttgtaagtgattttattacgattaaattcttatattcttctatgcaaggaataattgaaaaatcatcatcaataaaatccagaaaagattcatccacaacaacaaatgtatttgtaagttttgaatggtttaatatctttattagaagttccttagagactattgaacctgttggattattaggattacatataaaaatcatattaatatcatcatttatttcttttaaaatactgtctgttaatgcaaaatcatcatcttccttcaaattatatataacgatttcttttgaaatggataataccgcttcttcatactcagaaaatgttggtgcaagaatcattgtcttatctggattaatagctcttacaacactatatataacttccgctgctccatttcctaaaatcaaattatccctagaaataatatcagctctatctaattttttattttcatactcactaacagcttcttttaattcataataagaaagatcaggatatttctctatctcttccaaattttttttaatagaatcttttacacttttaggcatgcctaatggatttatattagcagaaaaatcaattattcgtttccaatccatattataatttcttcccatttctttaacatttccaccatgtccaaagttagccaaactaatctcctccaatttttccttaaatataatttctgacctatcaagtttcactttataggtcaaaaatatgtatttctatattctgtatattataaatttaataattaccattaatataaaccccataactgctgataaatataaaatttctgctgtcttttttacatcattaatttctatttcctttattttatcaccaataacaggcttctctacaattttcccaaaataatagtttgctcctccaagctgtatatcaagtgctcctgccatagcagcctcaggatgtgcactattggggcttgtatgattatatctatctcttttatatatcttcaaactatttttataatccctcttaagaaaaaacgatgatattattatcaatattccagtaacccttgctggtatatagttaaacaagtcatcaagttttgctggaaaatatccaaattcaatatatttatcattcttatatccaaacatggaatccatggtgtttacagccttgtatgccattgatcctgcagctccaaaaattcctgcaaataatattggagcaataactccatcgctcatattttcagcgatagtttcaataacagctcttgttattccctttgaatcaaggctttctgtatcccttccaacaatgtatgaaagctgttttcttgacttctcaatattaccttcatttaaatattttataactttatatccttctacaaccaatcccttagctgatatacaaaaataaataattattccctgaacaattacgcctaaatatttatttattttcatacatacaaaaataattccatatgtaattgcaaatgttaaaataattgtaattatccacacaatcaatccagcaatctttaaagaattttttaaaagttttctaaaaatagtttctaatttagaagctaacaatccaattcctcttactggatgaaatggattgttaggatctccaattaataaatccaaaataaatcctattgttaattccatttagatataaaagcatatgaatttctatactttacttaataaaaacttatatactcttttcctttctttttattttaataaaggtctaatttattatcaaatttaaaaattatagtctttctttcaaactttaataagttaacatataaatttctaaagcaatccaatatatttttctgcaatataatctaccaatgttttaggctcattgaattgaatattataagtaaatttaggcttttctattactattaactttatatttaaattttttacagccttaaatttctcaagacatccaccctctacaccactatctttcgttaataaaccttttatatcaaattgttttataaatcccatttccaattcacatgatatgggtccctgcattgctactatatcttttacctttatcccactctcaagtaaccttgaaagcacttgtactgatggaagtattctatgaataattctatgttcaaattcaatatctacaaatctggctgcattatttccacctgtagtattcaagatattcccatcaagaagtttaaaatattctattgcttcatcgtaatcttttacccttacaatattatctgactctatagcttccaatacacctaatctttcatatcttatgtatgcaatatgaagtttttctgcacattcaattgcattttgtgtaacttcctgtgcatatggatgtgagccatcaacaagtacttttatattattatctttaatccatgtcaaaagttcatttttatttaaaggctttgtatttaaattccttatcttataattctgaagtaattctcctccatagcttgtggctgtactaactgcgatattatcagtatgtttatttattaatgataatatctttttgccttcagatgttcctagtataaatcctatcatttcctatctccaattaaatcgttactatatagacatttaaattatcttttgattttatctctctttttatcattatatcctcttggtgttataaagcttccatttttataaaaacttttggtatttcctattattacaatagacatcatatcaactatttcatcattgaattctcctattgttgtcattgtaacttcttgtccttctctaagagcatgttttactactgcaattggagttgtatcttccctaaactcttttattatatcaatacattcctttaaataatgtggtcttcctttacttttaggattatataacgaaattataaaatcactttctgctgctgctttaactctattttttatttcttcatagggagtcattaaatcacttaaacttatattacagttatcatgcattagtggtgctcctaaaactgatcctgctgaacttgatgctgttattcctgggattatttcaacttcttcttcacctttcatttctaaaataagacctgccattccatatattccagaatcaccagtacttattaacgctacatttttatcttttgataaatttaatgcttccttacatcttgcttcttctcccatcattcctgttgaatatacttctttatcaacaataagctcttttatcatatcaatatacttattataaccaacaataatatcactgtcctctattgctctataagctcgtaatgtcatattatcaatacttcccggtccaattcctatcactcttaattttcccataactaatccacctttctgttatttcttatcattagctttttaatattcctattgcaagtgtcataccttcatgcttaattttacttattactatctcagcaccgctcaaatcaacacacggctcacacactgaatatacacctaaagttttaaatacaaattcactcttttcatatttatcttccacaagctttatttcttcccttttataagttataaatggacactcaaaattttctgctaatttaattattccatcttcatcttgtttcaaatccactgatacaatcttattcactgctctaaaatcataattatattttcttaagctatccaaaacaaattctttaattttttcatatggagtatttcttcgacatccaatcccaagcactatatctctttttataagctttaaaactttattaaaatccaatcctgtatcttcataattaattttgtttgttatccatatagaattttcttctagctcgctaagttttctatatccctttgttatgtcaataataccatattcatcctttatcccaacttcttttccatctacaagaagcgctgctatacattttgcctttttaaggtcatctataatcaggttatgattttttgcaattatatcaggtgctttaatattcattgtatctgttgctgtagttattactggatgacagtttagtattctgcttacctctaatgtaagttcattacttcctccaagatgtccacttaaaagacttattgcatattttgatgataaatcaacaacaacaactcctggatctacatcttttgatacaataaaagatgatactgcccttactgcaatcccagttgatgatataaaaataatactatccgaaattttaaatgtttcttctgtaatatcctttagtttaaaatcttcataaaatctataaatagtacaatttgtagataaagatacttcagaatccttgattttatcgtactccttatcttctatttttccctttatataaagatttgcatttaaacttttttgaagtttaaatgcaatatcactgccttttggagatggacagattatacttatcattatttcttatcctctgcatctctaaacatatgagaaaaacttttatcgtatagtaagctcttttcaaagtcactatcaataaaatctccaactaatatttgagcacatttagttatattattttccttaactttttgtgcaatgtcatctaaatgacctattataattctttcatcatcccatgttgctcgttcaactactgctattgcaacattctttttatatccctttttaagtttttctacaactttatcgatcattgaaacagacaagaaaattgccatagatgcacctattgatgctaatttttctaaatcttctgtttctggtacgggagtccttccttctactcttgttaaaataacagtctgagtaacacctggaagagtaaactctctatttattgctgctgctgcaccagtaaatgaactaacaccaggaataacttcatattgtattcctactctatcaagttcaaccatttgttcccttatagctccataaatgctaggatctccagtatgtaatctaacaacagtctttcccatctgctcttccatagtcatgacttccataacatcttcaagagtcattcctgctgaattatatatcttggcatctggtctgcaatattcaagatgttccttggaaactaatgaacctgcatatattacaacttctgctctttctaataaatctcttcctcttacagtaattaaatctactgctcctggacctgctcctataaaataaatcattttttaacaccctttcttttcagtttacagttatcagttaacaattgtcagttacatttaatattcttacagaatctctgtttttagtaacactctaatataaaaaaatcataaaagtatttcagccttaaactgttaactgttacttattaactactaactaattcctgcttgctattattaatgacatgtaatctcttactttaagtatttcctctctatctgttaatacaagctgaccttctcttcctactctgcttgcataaacataatcgaaacctttttcttcaagtatatctaaaacttcttcttcttttttataaactttcattacaacaataaatttttcatcagttatttcttttactttgcttgctggcataactacaagattttcatttcctactacaagagttctatctacaagacttgctgccgcacaaaatgaagttattcctggaattgtttttacctcaaaaccatcgtctctaagatgattaagcatatggctataagtactatagacatatggatctcctattgttaaaaaagcaacatttttaccttccttaagctttgattctataaactcataggcttctaaagcttttataatcctgtcttttttccccatcggaaagtgctttattacaatttccgtatcaggctttatatattctcttgctgtttcaagtgcaatactatctccaccttcttctgcactaggtgcaactataacatcacatttctcaattgtttttactgccttaactgttaatagttccttatctccaggtcctacccctattccgtataatgttgccataatttattttctctcctctatttctaacttatacaattatttaacattttaaacattgaattatatatataggattcaatgcaatcatcatcaatgtatttcctctgtttttgctcacattaattagtgatatatcaattctataattcaattctttaagaatttcaattgacttgtatgcattatcaagtgttatgaaattcataacgattgttccatcatcttttaataatttatcacacttgcttattatttctttaagcttgcctgaacttccacctataaatattgaatcgaactttaaatttttattatcaaattcagaaagggcagtatctgcatcattttttataagttctacattactgcatttaaacttatcaatattactcttagttacgttgtaagcctcttcttctttttctattgaatatactaccccagaaggacatattattgcactttgaactgtaatacttccagtaccgcttcctacatctaaaactattgaattactatttaaattcattttacttattgaaagcatacgtatttcttctttagtcattggacattttccacgtatgaattcttcatctttaataaatttcaaacttttcctcctaaaaacattaaaatctttttatttcttaggcatataacatataaaaggacatatcaaatccaaatatgcctgcgggctgactcgttatttttttgataatgtcttatgtactacaaatacatttaaatcactaaaatttttatctgtaaattccaatggctctcccatatttattacttcatcatcataagataaattttcaccaatgaccacactgcattctatcttttcttcataaagagtcttacataatacacttggagtattatctttatctgtaagccatatacttacttcatgctcatttaccttagtaagaaattcatcctttctcccatgaagactgccaagatatgcattgttccaaggaagcttaaccttagatgttaaatattgaaatgaacttatacctggtataatttcaagttcttcttttgacttaacttttatataatttgttataccataaaaagttggatctcccgatgctataactgcaatttttttgatactattttctgaatcattatcatttggatattcttcataaattttattattacatatatacttatcaagatcggataatttattcatatatactttttctgtgggtataaattctaatgaatcaattgctcttttaaagcctattataagatcacattgttccattactttaactgcctttggtaatatataatctggatgtcctggtcctattcctactatatatatcattcttaatcctccctggaatcccataaaagtactggttcagatgcaccataatacataactgcatcaatagacatctcttcatacacatactgattcattttatcaattatttttttacctatattttcataaagtctttcatatccatcaccaagatatttcactgcaccttcacatgttttttgttctaaaattttatttatgagagaaagatcatatcctaaaagcgcaagttctaatgcgaatacttcaagacgtacaccattaattctactatgtgtattaaaacatccataagcaattttactcatcttacctatatgtccaataagaattacatgcttaatcttacatgaaacacaacactctagggcaaatcctatataattagaacatatcactatttcatcttcattaaatccaagttttttgcaatatttctcacctaaatttccaaaagttaaaacaagtcttttattgcttaaggacctttgatttatttcaagctttattgatgctttaagtgcatcttctgacataggataaactatacctgttgtccctaaaaccgaaatgcctccttctattccaagtcttggattaaatgtttttttagctatttcttcaccttgtggtattgaaataataacttcaactctttcaccatttggaagtacacttaatacctcttctcttatcattttccttggcacagggtttattgcacattctcctttaggtacaaataatccatcttttgttacagttccaacaccttttccaccttttaaatatatactttcaccattttcaatatcatcataatcaaaaagagtgtgaactataccttcattttcatctattcttctaacctttgctttaatctcaattccatttgttatatcaggatcatcaccactaaatttaattatactgcattctacccactcatcacctctattaatatgtgatactggcattcttatctttattccttttggagatgttatctctatgtcatttaaaacttcatcaatattaaataaaatcatcgtagctgcttttgctgcacctgcactgcatgaacctgttgtataaccacatctcagtttttttccatcactatctacatacatttcaaacatacgtctctccttatacttatataaatgacatagatattctgcactatgaactttgcaattataatctagaaatcacataatgatttcaacatcaattgacaatttgccactggaagcatacacaagaatcattatatgtcaatttaaatatacattagtatataataaaaaaataccgcaaattcatttctgaataatacggtacactcaaatataagtatttgctataatacagattttaattcttttcttttattttcctgcattaaatttttcacaggaataaccgcctcttttaagagtttctattgttccactatctaataatggtggcagtttagaatagataacatttaatccatcttttaatttttcttttaaacttagcatcctgtattccatcattacacttcccttaatgaaatttagatttttatctcttattactaagtatattcattaaatgttaaatctgtattattttaatgttaatttataccatattatatattttatctttttactaccatatacattaaagcatttacaatagctgctgcaacagtactgccaccttttcttcctttaactcttatgtatggtatattcagttcatccatattttctttactttcagcagctccaacaaatccaactggtactgctactattaatttagggttagctcttccttcttttataagttcctttaatctaaataatgcagtaggagcatttccaaatacaaaaatatcaacattatcttcacatgctttttctactgcagccatacttcttgttatatttttagtttttgcttcttcatgaacttgtggctcatttacataacatataactttactatttgttttagataaagctattttattaattccattaagagccatattagtgtctgtatatattgtagcaccatttataaataaatttttagctgtttctattgcgttctcacttatttcaactaaatccttatattcaaaatctgctgttgtatgtattgtcctctttactataagaagttcttcatcagaaaaagaatgttctcccatttcttctccaattatttcaaagctcttttcttctattcccatgggattttttaaataactcattttttcacatctttcctatattaattataattcttatataatattatatcctattacagatttaagaaaatcaatatttccaaggaaattaatatgagcatatcctgctactgtattttttttagcatatccacaattccatgatatcaattcattgttatattgtttcttctcaactgtataaactgtcttttcattgctttctacacatgatttatgaaattcatgtgcatttatttctatttcatgtccaaatactttttcatctacttttactctacagtatccaaaacgttgaagcctttttttcataaaactctttccttgaaaaaaaccaatcatcgcatctccttcaatttcttctgtgagatacataaatcctccacattctgcataacatctaagcccattatttaaagctgtatttatgctgcttctcatggtttcattacttgtgagctctttcctaaaaacttctggatacccccctcctaaatatagaaaatctaaattttctggaatactcttatctttcattggactaaaataaattatttctccaatttgttcaaggagctctatattatctttataataaaagctaaatgctttatcctttgctatacctattcttaaatttttatcctttaagtttaattgagaatatgtattattatcattattgcatttaaattctttcatagaatttatgatttcatctacatttacatattgctctaccatttttccacataactctattttatcatttaaatttaatacttccatactttgaacaaggcctaagtgtctactgcttagacttatttcatcattcttaggaatatagccaaaaacctttatatcacaatttttctcaattgaatattttaataaattataatatttttcacttactgaattaagaacaattcctgcaatattagcatttttataatcctttaaaccttttatcacagcacatatagttgaactctgaccttttggagaaagtacaagtataataggcatgtcacttaaaatttttgaaatatcatatgttgaagcttcctctcctgcccctattccatcatacaatcccattacgccttcaattatacctacatcaccgcatccttttttataactatagattacaccttcttttcccatgagatgaacatccaaatttcttgattctatgttggtaacttccttgtgaaatgcagggtcgatataatctggtcctactttatatccctgaacactgagctctctatttttaagtgctttcataagtccaagagtaaatgtagtttttcctcctccactagcgtcagaacctataattattgacttcattaaaacaccaccaattattttaattaaaagttgagagataatctctcaactaaattaacaatctatttattttttctcaattttttcgtctttcctaaatttgaatatctatcttcaatcgtatcataaattctatttatatataattcatcaaatttatcaacctcgcccaatccatgtaaatgaagacttacttctattccttctctttgtaatatactttttaaagaatcatcctcatctgatgccatatcatttttagcatgatctcctgcaacaagtaataaaggcactaatttagttttctttattgatttttttttcattcgtctcagcgcactctctatgcttgggtatccttctactgtagcaacaaacacattttcatatccttcatcttctaacacagtctgaagcatcccatatactgcattagatgcatgagctgttccgtgaccaaataaaactacactttcttcattttcgattatttcctttatactttctataaataaagtataatcttgtggaacttcttctattccttgataaaaaaatataggacgccctacttttatagttttaaaatcttgattatgtctttcggctattccctttatgtaatcaaattcttctcctggaattatatgaagtggctgaattataacttcttcgtatccttgtaatttaagcttctctaaagcctcttctggttttaaaatgtttaatccatctctttctttaagctttttaattatcatatgagctgtaaatgctctaaacacatcatattctttaaattcattctttatttttatttcaattttttcaattgaatttttcagtgcatctacatgacttgttccaaaactcacaactaatatcgcttttttcattattattcctcaactttcactcataaaaaaatccttttaccatctgataaaaggaagccataacaaactagagaataaaagatatagcaaattcaaaattcatttaattacttatacattaattattcttcatactctgccatctgccttcccaccgaaggtaatagtcaaaattttataggcaggtctcctgactttggtatcaacctgaacactcacccttcccagaattaaattccagtggttatttgagacagtactccattacagtagcgggggctgtagcagactttaactgctttcccttttaatttaattagacttatactaaccaaaacctataatcatatttattattgttactaaattatagactactatttgattttattcaataaaaaaagatttatatagaacaaatttctacataaatcttttttatttaaaatacttttctttttttaattataaacaacaactatatcatcttctaatattactgtacttcctctaggaattatattttcagtacctctttttataagagtaatcagaatatcatctggaagatttatatcttctatggctttattgcaccatttattatacttttctatttttatttctcttaattttatatcatcttgacagtcatattccggtatactcaatattatactgtcattcccttttattaccgtatttcctctcggaactatattttccccatttctctttataataagagctagagaatcccctggaatattagcctcttctatagttttgttttcccacatatgtccttttggtacaaataccctcattaaagtaattgatgatttttcctgataatcattaaaggtcttccttacatcactttcttcatctatcatatctaatttttttgaaaccagtggtaaaagtgatccttgaataccaactgataacaaagaaatcacaaaaacaatatgatataagtcactttgaatctgtactccatcagctattgccattattgcaaaaactatagatgctgctcctcttaatccagcccaagatactagaagacactgtttaatagatgatttaaatggtaacagtattgaaaatacagctataggtcttgctataaacgttaaaaaaagacctatgagtaatgatggcataataactgccggcattttgtgtggaaatgctagtagtccaagaaggaagaaaattaatatttgagcaagaccggttaccccgtcaaaaaaatgaactaagattattttattatttatcctgctatttccaagaataataccagtaatatacacacttagatatccatttcccccaaagtaatcactaagggaatatgaaattaaaattaaagccgttataaatattgtttctagtccatcagttgcaatttttaactttcttaaaataaaaactccgataattgctgtcccgacaccaattattgcaccaaaagtcacttgtgaaaatagcatggaaattactcctgaaatactactttgaccatttataaaacttaaaattatcattgtcatcataaaagctatagggtcattgcttccactttcaagctcaatcatagatgctgttccatcttttaaacttagattctttgaccttaaaattgaaaataccgatgcagcatctgttgaacttataactgcaccaattaacatactgtctaacaaagctaactgtaaaatgtaatgacaaaaagcacttacacaacaagctgtaataacaacacctactgttgaaagtaaaatagattttactgcaacaggttttgcaatatcccacttggttccaaaacctccataaaacattataaatatcaatgcaatattacaaacttcgttggttatctgataattattaaattgtatcttaaataatccatcacttccaaacatcattccaagtgccataaaaaggaataatgctggtataccaaacttattagaaaatctatttgctattacacacgataacaaaatacatgcacataaaagaatcatatatctgcccccttaaattaaaaatctattaattatataaaatacttttattcttataaaagccccctaagtttaataacttaggattgctaaaataaacatatattagctcctatttcacttgctatttatataaaatttcaaaataaatgcaaaatcgttaacatacttattaaaaatatcctatatattatatatattcttccttttttcattaaataattcattaattacacaaagtttaatataactttctttgtattataatttaaaaaggatactatataagattatagtaccctttctcactcatatagagtttacatttcctttactatatcagaaacccactcacaaagattagctgatgctttatttgctacatctacaacatttgcatgagaatgcttacacttttgaattccagttgccatgttcgtaatacatgctattccaagaactttcattcctaaataatttccaattatagtttcaggtactgtagacatccctattgcgtctgcccccattttaccatatgcccttatttcagctgctgtttcataataaggacctgtaaagtgtgcataaacaccttctttatattttaatccttttttatctgctacattcttagctaaatccattaaattctttttatatggttctgacatatctgggaatcttggtccaaatctctcatcattagaacctattaatggattatttgcagtaagattgataaaatcattaattatcattaaatctccaggctcaaattcagtatttatcccaccacatgcatttgtaataattactttttctattcctagcatcttcattacaaagatagggtatgttacttccttcatagtgtatccttcataataatggaatcttccttgcatagcaagaactgttttattacctatagttccaagaagaagacttcctttatgaccttctacacttacaactgggaagtttggtatttcgctatatggaatttcttctttattttcaaatttatctacaagtgctcctaaaccacttccaagtacgattcctatttcaggttctctcgtaaacttactttttaaatatttaactgattcttgaactttttcatataaattttccatgatatcatcctctcttcatatgtggaattatttttctttataaatattatatcaaatttattattttctttctttaatttttttattaatctttatataaatagccacaaataggttaatctatcctaaattcattagcttcttctaaaagttttcctattaattcttctaattttttagatatagtgtctattctcatgcttgattctttaaattcacttgcagtagctgaaacttcttctgtacttgcagccaattcttctgatattgcagtaacatttgctattgaatctataacatcatttttctttaatttattctcatcagacaatgattgtatttcaactatctttggtataatatccttaatagaatccgacatgtttttaaatgaatttattgtttgatataatttttctttttgttcttctatttcaagattcatatctttgcttgaatctataataattctactttcatttaaaatttcgtcaacaactctacttatttcatgcaatgattcagttgtctgttctgataattttcgtatttcttctgacaccacactaaaccctcgtcctgcttctccagctcttgccgattcaatagctgcatttagtgcaagtagattagtttgctctgcaatagaacttatagtttgcgtgataagacttattgctgagattttttcattcatagttacaatttcatcattaaaaccttcaaatcttttattaaatgaattcagtgcataatttaattgatccatatcattgtgactttcatttagtccactttctaattgtgatgatactgtatttactgaatttatatttttattcataatttctatattatcacctagctcgccaattttgttatgaatcattaaaatttctgatgcttgatttgtatttccttgagctgattcatccattgcaattgaaagtccattagctccattatcaatttctcttgatgtttctctcagtacatcagactgatcatttattatataaacatcattttttatttttttaatcattgctcccattgatgatgatgttttctttattgaattacctatgtcaaaaacttcatcttcaactttaaaaacataatcacttaattctatattaaaatctccatgggcaagtaaatctatagcttgttttacatttataagtcttttccctagagcttctcctattaacactaagcagaataatactacgctcagtccaactatccctattacgatacttgcaattgttattgttcttatatctttataaaaatctctattgtctacttctaaaattaaactccaaccatttgtattatttacagatgtatatgtaataacctcattagtcgaactatcacttccattttcaccgcttatggctttttcatatatcttctttttattatctgtatatttatcagattcaattgtatcaattatgtttacaccattactaacatcatttaaatcctctgatccaattattattccatcgctatttattaaatatgaatttcctgttccattatatttgacttcatttgtaagctgagataaatagctacattcaacagtacaagtaatatatcctgtaatttcatttccatttttaataggaacacctacaaatacaatctgttcttttgtatcagaagtaaaaacaggatcactcaaataatttttaccttcttttaaaatttttaagtatggttcctgacttgagtctgcttcaaaaccatctgtactccttaaatatccatttctatctatgtatccgatagaccttaagttgaatttttcaacatatttttgtaaacttgcttttttatcttcaaatggtatagtttcatctgcaattaattgattgtttgcaatagattcagctattataaatttttcttgtattctatctcctatatcaagttgtgatttgcccattaaattctctatacttgctaagctaacatgaagcaacgtccccttggatatagatattgtaatcaaaaatacaattatgaagatagctgcaaatacaaatccactttttttaataagttctctttttatggtcttccgattactattacccctcattataatattcctccctagacatttttgtttatttgtctattatttgttcctttttaaacaattactagataatattagcacaaaattcaaactttttaaatatttcctattattttttatatttttatgtattaattttaacaatttttatatattaaatttctagtgtcatatgttgtttattatttaaaatatatatttagttcaaataactacaaaaagttctagttttattttagacaattctaaaaaaaccagaactaattttgcttatgcttatatattcttattgatttattaggcagccttcattaaactcattaagatcaccattaaaatccccaatataatcactaatatgtttttctgttgaatactgatgtccgactaaatttgtaaacttattatccccaacactgctccaaggttttccattatagttagcctcccataaaggcatttcatatatttcagaatcagcattatttaaatatttatcaataaaacttgtatagctataaatccccaactttagaggtgataatttgttaaaagcaaccttaaatctctttatgtaatcttcaagtccatcaaaataaacttctgtatccaacataggtatgagatcccaattatatttagatatagtattataaaaattttctgcttgttcttctgggctgcttgtattcaccaaataatgatatactccaattttcattccaagatctttacactgattataatatgtatccatatatgaatccctaaatgttgctccctctgttgcttttaaataaacatatttaccacctgcttgtgttacagaagataaatctaaattaccatcattattagaaatattaattccttttactctgctatttatatatgaagcctgtacatttctatctatagttatcatattaaaagcactgaaactaacaataagacttattacaataaaaatagttatgtagtacttcttgcttgcattcaataaactaaaccaaagcaaatcccatccccccttaatttttaatactataatatcataactgcatgtcaaccataagacaatctcttataatatttaaatcatatttttataaataatataaaagtagtttaattctaaattaatgcccatctgtctatttgacaaatgggcattataatactattgtaatttatctaaaattgatttacctattgtgttttcaggcatattcaaattaaaattatctgctattgtagcaccaattgtagcaaaagtatcacaagtgtctaatactccgtttccttccattaatggtgagtatgctataaatggtacatactcacgagtatgatcacttcctatatatgtaggatcatttccatggtctgcagttattattaataaatcatcttccttaagtttatctaaaactttacctagattaatatcaaacttttctaattcttctgcatatccctttggatttcttctatgtccccataatgcatcaaaatcaactaagtttacaaaacataatcctttaaaatcattatccataatttctaaagtttgttccattccatgaactgaactctttgatttatgagattctgttataccctcaccgtcaaatatatcacttatttttcctactgatataacatcataactgctatcttttaaaacattaagtacagttgttccatatggctttaaagcatagtcatgtctattacttgtacgagtgaacccatgttctttatccccaaggtaaggtcttgcaattactcttccaactttccattcgtcttttaatgttatttctcttgctatttcacaacatctataaagttcatctaatccaaatgtttcttcatgtccacaaatttgtaatactgaatcagctgatgtataaactatcatatcacctgttttcatctgatgttcagcaagttcatctagtatttcagttccacttgcacttttatttcctacaattttatgtcctgttctcttttctaattcatctaataattccttaggaaatcctgtatcagtaaatgtttggaatggctttgtaatatgaagtcccatcatttcccaatgacctgtcattgtatcttttccaacacttgcttctgccatcttcattgcatatcctaatgctttgtcagctttttcaacatgctttattggatgtaaatttgatatacctaatctttgaagattcggtatattaaatctttcaactgattctgcaatatgtcccagtgtatcaacatttacatctccatattcttttgcatcatccatttgacctatccctaatgaatctataactattgtaaaaattctattatattttttcataattgttttcctccttgctagaataattagtaatattactctataaattaattttatatgaaatgttcaagaatataaagtactattttatacatgtctttttgttgtattctttattgatttctaaataataaaaattagaacgcaatgcatttatttgtacatcacgccctaatcgccataaatttctatattaatgtaactaatccaactattattgcacttaaaagacttactgaaaatccagcaagcattgatttaaatgcaagtttagaaagaatatttcttttttcaggacataatgctgatattcctgaaatacatataccaatacttgatatattagcaaatccagcaagagacacagataaaatcaatcctgttctatagctcaattctgaaattatttgacctaatgattgaaatgcaacaaattcatttaatacaagcttgcttccaagaagatttcctgctataaatacttcgcttccatctaatcccattagatatccaaatggtgcaaatatatatgagaatattttttcaagatttaatccaaagaatcctaaaattaaatttactatagcaactaaccctaatatagctataagagatgctccaattgctaaagcagtctgtaatccactcatagcaccttctgcaatagctgatagtatattttcattatcacctttattgtcaattttcaactcttcaacatcaaaagtttcttcagtttcaggcattaatacttttgataatgctatgcttcccataggaacaagagcacttgcaataagtaaatactccattggaattccaagggctgtatatccaccaattatagtcgctgacatacttcccattccagaaaccaatacaacaacaatttcactctttgtcattttacccaaatatttacttactaatattggactttcagtttgtcccaaaaacatattagcaactgccacaaagctttcaacatgacttgtacctaaaacttttccaacagcttttccaataacttttactataaaacctactacacctaaataatacaacgctccaactaatgcagatacgaatattatgtttccaagagtctgaattccaaatatattacctgttgccgaactcgaatcagcaaggcttccaaatacaaatgctataccatcttttccacaatttaaaacacttgtaaccacatcagatatcttttgtactacatatcttcctaaaggaaatttaagtaacaccactgcaattaataattgaattcccaatgcttttataactgtcttataagggatattctttctatctgatgataataaatacataaatccaaatacaacagctattccaagtaaactcataattactttcatctttttctctcctaaataataattttcttttgttaagaccttcaacaaaacccgtacaattataacatttgtattttaaattgtatagttgttttcttatttgtgatatatttttttacttttaattgatactataaaaatattttatagtaaaattcaaaaaaatttgttatatttaatagtatataaagtaaactttatataaattaaatcttattatttagtaacgttattttagtaaagttactaattttttgtacattcactaaaagatacctaaacggaataaaacaaatctgatatacaattaaaaattatgtatattaaattataattatgtaaatcatttataatatatatactcaattcatgatttgtatgaattaaataatatttatacaagttaaaaatacttgctatgtgaaaaggtgatattattatggataaagttaatttagaaaataatcaaaaacaactacgttacgttgccgtatatgataaattatttaaaatgattaatgagggaatttttaaagatggtgcacgtcttcctagtgaacctgaccttgcaaaatctttaggagtgagcagaactactctaagacaagctcttgcccttttacaagatgatggtcttataaaaaatatacaaggaaaaggaaatttcatacaaaagtctacatctgacaaaagttcaggtttagaaataatagataatcctatttataaatgcattaatgaaactatagataatgtagaaatagattttcatatcgaacttccaaatgactatatgcttcagatactacaaaaaaagacagctgtatgtgttgttgttgatagatggtataaatcaaatgatattgtagttgcttatagttttacattaattccaatagaaacaatttctgaaaataatattgatttaaacagtaaagaagaacttttaaagttcttagaaaatgatatatattcaagatcatcgaaatccacaattgaaataaaacactctgcatcgggaagctttactgcaaaaaaatactcattatattctaatggtcaatgtcacttaatacaagaaagcttatacacaagtacagataataatccagctgtctataacaagcattatcttccattagatataagttcaattaaaataaactcatttaaataaaaacttttgattctatcatacaaatatatatatcaatcaaattagtcttggattacatttaagcaatctaagactaatttatttacattataatttacaaacaacaaagaaaaggttatatcagaatgatttaattatcattctgacataacctttttatctatatagatttatttattcataccttcataatcttttaaaaacttttcaatacctgcatctgttaaaggatgatttatcatctgaacaattactttatatggtattgttgctatatcagatcctgcttttgcacattgtaatacgtgaattgggtttctaacacttgctgagattatttcagtatcaatatcatgaattgcaaatatttctgcaatatcttctattaatttgattccttcacttccgatatcatctaatcttcctaagaaaggacttacgtaagttgcacctgctctagatgctaataaagcttgaagtgctgaaaatattaaagttacatttgttttaattccttctttgctaagaatacttactgcttttaagccttcttcacacattggaatctttactaccatatttttattaatttttgctatttctcttgcttctttaagcattccttcacaattcatagaaataacttcaccacttataggaccatcaacaatagatgttatttcttttataacttcattaaagtcacgtccttctttagctataagtgatggatttgttgttactccacatattacacctaaatcatttgctttttttatttcttctatattcgctgtatcaacaaaaattttcataccataatactcctttattctaactcattatatctgcataaattatttttctatttatctttaatttatagacttactatagcatcaagtgcaatttccatcatatttttaaatgttgtttgtctttcctctgcacttgtaacttcacctgtaataaaatgatcacttacagtcataattgctaatgcttttacatgatgttttgccgctacagtataaagtccagctgcttccatttcaacacctaagcatccaaaagctgcccatttcttccagtcttcattatcatctccataaaatatatctgaactatatacagttccaactttaggttcaatacctttttcaactgcagtatcataagctttctttaataattcaaaattagctgttggtgcataagttcttccttggaatcttgttaaattaagatttgaatctgtacatgctgacattgccataacaacatctcttactttaacatcttcatggtatccaccacatgttcctattcttataaggttcttaacaccatattcattaattaattcacttgcataaatagacattgaaggaattcccattcctgtcccttgaactgaaattcttttacctttgtatgttcctgtaaagccaaacatacctcttacttcattataacaaactacatcttctaaaaaagtatctgctataaatttagctctaagtggatctcctggtaataatacgctttctgctatttcgccttgttttgcatttatatgtatgctcattttttattcctccattattttcatatttatatacacctaaattattaggattttaattatacattcactaaaatttcacataaatcaaatcttatttttgcttaaaccatttcttttacttttaaaactatctcatcagatgttaatttgtattttttcattaattcatcaggagttcctgactcaccaaatgaatcttgtattccaaccatttttactttagtaggacattcactacatacaacagctgaaaccatagctccaagtccaccaattattgaatgttcttctgctgtaactattccctttgtttcttttgcagctttaattattatttctctatctattggttttattgtagacatatttataactcttgctttaataccttctgtttcaagttgttttgatgcttcaatagctttttgcaccatcattcctgttgcaattattgttacatcattaccttctctaagttcaacacctttaccaatttcaaacttataatcttcattgaatatatcttcagtattacatcttccaaatcttaaatatacaggtcctttaaattcagcagctgctttagttgctgctcttgcttctctatcatctgctggcactattactgtcatattaggaagtgaacacataagtgctatatcttcaactgactgatgtgatccaccatcttcacctacagttattccagcatgagttgctgctattttaacatttacttttggataacagatagaatttcttattatttcaaatgctcttccacttgcaaatactgcaaaagtgcttgcaaaaggaactaacccaacatttgccataccagctgccatacccattaaattctgttccgcaattccagcattgaaaaatctatctttaaattctgttttaaatccatttgttttagtcgattttgaaagatcggcatctaaaactactaccttttcattttcatgaccaagttcaactaatgctattccatatgattctcttgttgcttttcccatttcaaacttctcctttatattatgcaagaatttcttttattgctttatttttttcttcttcattaggggctgcaccgtgccatccagcttcattttccataaaacttacaccttttcccttaacagtctttgcaataataacagttggtttatcactacacttatctgcttctgaaaatgctttatcaattgaatcaaaatcatttccatcatcacataaaacaacgttccatccaaagcttctaaacttgtcatctaaaggattaacattcattacttcttcattcttaccatcaatttgtaatccattattatcaataactgcaactagattatttagcttatagtgacctgctgccatagctgcttcccatactaatccttcttgaagctctccatctcctaatattgtatatactttagaatttttatttaatgctttaagaccaagagccattcctacagcatttgatattccctgtcctaaagaacctgttgaaacatcaactccattaatgtgtttagcatctggatgaccttgtaataaaccacctatttttcttaaacttttaagttcactttttgagaaatatcctttttcagctaatacagcatatagggctggagctgcatgacccttactcaaaacaaatctatctctattttcatctttagatttttcaacacttacattcattttttcataatatagataagtcagaatttcagaacatgatagagatccacctggatgccctgactttgcttcatatatcatttcaataatatcttttttaacttctttacatatttgatttaaattatctttattcatttttccaccaacctatcttttttgtgtatattaaattattttaatttaatttttctaaaactgattttccaattgtatcttctggcattttaacatcaaaattatctgctattgttgcaccaattgtagcaaacgtatcacatgtttctaaaatcccatttccattcattgatggtgaatatgctataaatggcacatgttcacgagtatgatcacttcctgtatatgttggatcatttccatgatctgctgttattattaataaatcatcttctttaagtttatctagtacatttcctaaattcacatcaaatttttctaattcttctgcatatcctttaggatttcttctatgtccccacaatgcatcaaaatcaactaaatttacaaaacataaacctttaaaatctttatccataatctctaaagtctgttccattccatgaactgaactctttgatttatgagattctgttataccctcaccatcaaatatatcacttatttttcctactgatataacatcatatcctttatcattaagcgcatttagagctgtttcaccatatggttttaatgcataatcatgtctattacttgtacgtgtaaaaccatgttccttatcccctaaatatggtcttgcaattactcttccaactttccattcatctttaagagtaagttctcttgctatttcacagcatctgtacaattcttctaatccaaatgtttcttcatgtccacagatttgtaatactgaatcagctgatgtataaactatcatatcacctgttttcatctgatgttcagcaagttcatctagtatttcagttccacttgcacttttatttcctacaattttatgtcctgttctcttttctaattcatctaacaattctttaggaaatcctgtatcagtaaatgtctggaatggctttgttatatgaagccccatcatttcccaatgtcctgtcattgtatcttttccaacacttgcttctctcattttcatcgcatatccaagtggtttttcaatactttttacatgctttataggatgtaaatttgctaatcctaacttttgaagattaggaatattaaaactttctactgaatctgcaatatgtcctaatgtatctacattaacatcaccatatttttctgaatcattcatctgtccaattccaagtgaatctattactattgtaaaaattctattatattttttcataactacaatcatccttccctctctttaggtcattaaggccataaatcttataattatatccagattcattttatgaattaatattttaaccataaaatgaatcccttatgtatacttactttgtaagcatatacttatgctaaatctgaacttgtaaaagacataggcataagttcttctattgtacatatcttttcagttttcttatttgataaaactataggtgtatctttatttaaaagttcaactaatacctgtctgcatgctccacatggtgcagcaagcgtatttccttcacatactattgctattgctaaaacatcatcttttctatatccatttgaataagtttgaaaaattgcatttctttcagcacaattagttaatccataagatgcattttcaatatttgcaccaataaaatatttattatctttagttaaaacacaggaaccaactctataattagaatatggtgcatatgcattttccattgctttaaatgctctttctaaaagttctttataattttccataataatctcccctttaactaattctaataatacttataattattaatacaacatctctatattaaagtaatgtaataatccctactatcattccacttaacacacttactgcaaatcctcctaacatagatttaaaagcaagttttgctagtatatttctcttttcaggacataatgctgcaatccctgaaatacatacaccaatactagaaacatttgcaaatcctgcaagtgaaattgataaaattaatcctgttctttcacttaatgaatttataatttctcccaaagattggaatgctacaaattcatttaatactaatttacttcctaaaagttgaccagctgttaacacttcacttccttcaagacccataagaaatcctaatggtgcaaaaacataagagaaaatttgttcaaggcttaaaccaaagtatccaagaaacatatttactattgcaactaatcctaatatagctataagtgaagctccaattgcaagtgctgtattcataccattaattgcaccttctgaaatagctgataatatatttgcattatcccctttattatctattgataaattatctaaattttcacctttttcaacttctggcgttaaaatttttgcaattgccatacttcccataggtactaatgcacttgctataagtaaattttccataggtattccaagagctgtgtatccaccaattatagtcgctgacatacttcccattcctgaaactaatacaacaacgatttcactcttagtcattttccctaaatatttacttactaaaattggactttctgtctgacctaaaaacatgtttgctactgcaacaaaactttcaacttgacttgttccaagtacttttcctacagctttacctattatttttactataaatcctataactccaagataatataatgctccaaccaatgctgaaacgaaaattatatttccaagtgtttgtataccaaatacaaatcctgttggtgctcctccatctgcaagacttccaaacacaaatagcagtccttctcttccacagtttaaaactccagttacaacatcagatatcttttgtacaattaatcttcctagtggaaatttaacaagtaaaaatgcaattacaaattgaattcccaaagcttttataactgttttatacggaatctcttttctattggaagataataaatacataaatcctaatactacaataataccaaaaatgcttataaatattttcataacataactctccactctgtaaatctaattaacatttatcttctgcttaatttaactgcagaattgtatattatttatttttttgattttcacttcattttgtcctataatatgtttatatgatttttattttgtactgaaataaactttcattaattaatgttttagaaaatccgctaaattttctaaaacattttttattatttagatgccttttttttatctaacttaatcatatttcttattccttcaactgcaaccttaattgattcttctgaatcatgacattgtggattatctaaccctgctttttcacattcttgatttgcaataactaagaaacatgctcctgtacgaactcttaaataacttcctacaataaataatgctgcactttccatttctgatgctaaacatccacatcttagccatgcattccacttattttctagttcataactaaccggtttagtttctggtgaatgttgcccataaaatgagtctttagattgaacaactcctgtatggtatgttttatttaatgttttagatgcatctacaagtgcatttacaacatcaaaatttgctactgctgggaattcaattggtgcatactctttacttgtaccttccattcttatagaaccagttgctactacaatgtctccacccttaacatcaagttccattccaccacatgtaccaactcttataaatgtatctgctccacatttaactaattcttctaaagctattgctgctgatggtccaccaattcctgttgatgtaacactaactttttctccatctaaataacctgtataagtaacatactctctgttatctgcaacaagtactggattttcaaaatattttgcaattttttcacatctcttaggatcaccaggaagtattacatattttccaacttcaccttcacctacagcaatatgatattgttttcctgaaccttctgaataattcatcacaattcctccactacttaaatatatttttacaattttacacaatctttaaacttgtattttaacttgtctacttgtcttgcaaattcatgataacatttacacacatattttgtcaatgctttttataattattattctatacattaattgtatttattcgtaatatcagtatttttaatgttaaaatattatttgcttattataaaataccagtcataaactctatacttttaatatctttgatatataaaataaaaagactttgccactaaatctaatgacaaagccatgattactctataaaatataaaactgtcttttaatctatttatcttttcctgtctgttttataagctgattagtatatactgtagctcctgtaaccaatactccttgaattactgcattagcatttactccgataattcccatacttcctgcaataccaaaaacaagtagtattaaaggtatatatttatcacttattttatcagtattctttataatcattccaattatataaagaacaggtattaagataagtgcattctgtgtgatatattgtgatacatccataattatcaccacactttcttttgtatatttattacagtttcctgtgctatattatatgaataatactatacttgtgttaacttattatttattctttatatttaaataatattaataaaatgctataattatatatatatgttaactattatgaaaggggtatttatatgactattatagacattcttcttgaacatattcatgataaaaatccatatgaaagacaagctttagaaattatacgtgattcgtatataagttctgtaaatgataattatacattaattgtggatccaaatggagaattgcttgttagaataccaagcatggaaaaacgtgatgaatttgtatacaataaacttactgaatacagttatccactgataatgtgtatgaacatagacgaaataaataacactgaatattattcatacataaaagctaaattcttggaatgttataaggacaagcttcatgtttttttcaaggatgttattacagtaaacaaattaaaagatgatatagtaaaaacaaaaaagaaaattgaatatatcacatactttacaattattggtgtaattttaagtggactatctttatgtatttttaatgttgaaaatacaactaaatatatacttgccataggaattattttactttttggatgtgcactatatcttcaattaacaaaagaaaatacaataaaaaaattaatagatggatatatctcaacaatttacacagactggtataatactgttttaagaaaacattatacttttttatgcaattttatggggtaatgtttttttatattattaatacttaaattttattatttgaatttattttaatatttttcaaaattaaagtctgtttatcaaaatttcatataattttgataaacagacttattttttaactatatatagacttttaaaaacaccataaatacacttctattttgtttataaacatcacttaactatagatttaaaacctttaatattctcttctatatttcctttaaaaattccagaaccagaaactaaaacattggcacctgcattaattactgactctgcattgctaagcttaatcccaccatctacttcaatatcaatatttaaatttcgttcatcaagcttttttcttagtctagatatcttattagtcattgtttctatatattcttgacctccaaaacccggatttacagtcattaaaagaatcatatccaaatcttccaatatatactctaaaacatctatattagttccaggatttatggctacacaggctcttttcccacattcttttatcttctgaatggttctatgaatatgagtactcgcctctgcatgtactgttataatatctgctcctgaaagcgcagcttcttctatatatttgtctggattctgaaccattaaatgaacatcaaatatcattttagtatattttcttatactttttattacagggaatcccaatgatatgcttggaacatataatccatccataacatcaatatgaacataatctgcgcctgccctatcaataatttctagttcagaacctaatttcgaaaaatctgctgataatattgaaggggctatttttataatattacttgtttttgaattacttatattcatattatttaccaaatgcgtttctatagtcttctttgaatttttcaattcccttatctgtcaatggatgttttatcatttgaactatcacattgtatggaattgtagctatattagatccagcctttgcacaatccaatacatgaattgggtttcttacacttgctgatattatttcagcatcaatatcatgaattgcaaatatttctgcaatatcttctattaatttaattccttcacttccaatatcatctaaccttcctaagaaaggactcacataacttgcaccagcccttgctgcaagaagcgcttgtactgctgaaaatattaaagtcacatttgttttgattccctccttacttaatactttaacagcctttaatccttcttcacacattggaatcttaactaccatattttcatgaattttcgctatttcacgcgcttctttaatcatcccttcacattccattgagataacttcaccacttataggaccatctactatacttgttatttcctttataacctcattaaagttttttccctctcttgcaataagagatggatttgttgttactccacatataacgcctaaatcattagcttttcttatttcatcaacattagctgtatctacaaatattttcattatataactctcctattcatatctcgtgtacctacttgtacacttttttatttaataatttctttaatactttctgatattgcatcacttgtaagcttaaatttctccataagctcatcaggtgttcctgattctccaaatttatcttcaattccaatcatctttactttacatggatatttatcacatacaacagaagataccatagatccaagtccacctataatagaatgttcttctgctgttacaatacctttagtttcctttgctgcttttataataatctctttatctataggttttattgttgatatgtttataacgcgtacatgtattccttctgattcaaggtattttgctgcttcaattgctttttgaaccatcattccagtagcaattattgctgcatcatcaccttttttaatttcagttccctttccaatttcaaatttatagctatcatcaaaaatatcttctgtattgcatcttccaaatctcaaataaacaggtccttccatcatagcagctgccttagtagcttccattgcttccctatgatctgctggtactataactgtcatattaggtagtgaacacatcagtgcaatatcttcaatagattgatgagatcctccatcttctcctacagttatccctgcgtgagtcgcagcaattttaacattagcttttggataacatattgaattacgtattatttcaaatgctcttccagtagcaaatactgcaaaagtacttgcaaaaggaactagaccaatattagacattccagctgccatccccattaaattctgttctgcaattccagcattgaagaatctatctggaaattcttttttaaatccatttgtctttgtagactttgaaagatctgcatctaacactacaatatttttattttcataaccaatttgaatcaatgcttcaccatatgactccctagttgactttcccatgataaaaccctccttaaaattatgctaaaatctcttctatagctctatttttttcttcttcatttggtgcagctccatgccattcaactttattttccataaaactcacacctttccctttaatagttttggctattataacaatgggcttatctatgcatttttctgcttctaaaaatgccttattgatactttcaaaatcatttccatcattacaagagattacattccacccaaagctttcaaattttttgtctattgggttaatagtaattacttcttcattttttccatctatctgcaatccattattgtctataatggcaattagattattaagtttgtaatgtcctgctgccatagcagcctcccatacaagaccttcttgaagctcaccatctccaagtagaacatacacttttgattttttttctaacattttaagtcctaatgacattccaactgcattagaaattccctgtcctaaagatcctgtagatacatctataccattaatatgtttagaatctggatgaccttgtaataagccaccaatttttctcaaactcataagttgctctttattaaagtaacctttctcagctagcacagaataaagtgctggcgctgcatgtcctttacttaaaacaaatctatcacggcagtcatcttttgatttttcaggacttacattcatcttttcataatatagatatgttagtatttctgaacaagataatgatcctcctggatgtccagactttgcttcatagatcatttctataatattttttttaacttgctttattactaaatctaatttgcctttatccataaatcactcaacctttcataacatacatgttgatgttaatttcttttagtatctagataattaaacagctttcatattttcacataaagcttttctaaatttatcatcaataaaatatttagtttctttaattacatctttccaatcatcattgcctgtataccaaaattctactgtaaattttcttacaccaagatcccatgacttttttataatttcttcaaaattaacatgtccttttccaaaagtaacttctctaaattttcccggaacagtttcctttaaatgaacagcagctatatggccttttccagattcaaaatcttcactaggcgtaagtccatattccaaagccgcattagtcacatttccacaatcaggatatatctgaagatatggagagtttatttctttgacaaacgtcatcgcctttccaacagtattcatgaattctgtttccattgtttcaaatgcaagaataacacctttactagctgccatttcaactgccttttttaaattttccttaaagtgttttcttgtaacttcatttccttcttcataataaacatcatatcctgcaagctgtattatctttattccaaggtcatctgcaagctcaattgcgttttccattatttccatgcctttatttcgtatcttttcatcaaggcttccaagaggatattttctatgtccactcaaacacattgtccttatttcaacaccatatttaaacattaactcaacaagtgcttttctatcacctttagacatatatatccttgataatttttcttttgtttcatctatacttatttctatattgtcaaatccacattctcttgcacaactaaatttttcttcccatgtaagataattaggcatagatttttcatataatcctaaagtatattctttcataccgaacacctctattaataaaattctaagtaattatttattaaaatatctaaataactttttatagtctaaaattatttttttattgcccataataagcattgggtccatgttttctagtaaaatgtttttctataagctcttgtggcattttaactgtttcactcttacttaataattctgtattaagagccatcattgctacttcttcaagtacaactgcattatgaacggcttccatagcatctttcccccatgcaaacggtccatggttttttactaacaccgctggcacatagttaggatttaaatgtttaaatctctcaactataacttcgccggtattatattcataatttgaactaatttcctctgccgtcatatcacgtgtacatggtatctcattataaaaatagtcagcttgagttgttccatagggaataatatcctttcccgattgtgcaaagatagttgcatatctagaatgtgtatgaactactgcgcctatatcacaaaaatccttatatagcttaatatgtgttggtgtatctgatgatggtttatatcttccctcaactatgtttccatttaaatcaactacaaccatatcatcaggtttcatgatgtcatattcgacacctgatggtttaattacaactagtccactttctttatctattgctgaaacatttccccatgtaaatgttacgagattatatttaggcaaaagcatattagcctcatatactttttcttttaattgttctaacatatatgacactcctatcattgatttttattatcatttaattctttatatttttttatctatggacattatttataatttctataatatccatagataaatgttaatattttagtactctattcctttcttactgtatacactgctgctttattatctgtatgattagcagatacaattaaatcacaatcatccaaattaataacatgaatattagcaggacctacacctttttcaattattgtttccttacattttccatctatatattgaatcataaataactcagcttctttacgtcttactccacctacaaaaaccggttcaccacaaagcttagtacctacaagggtgtgtgcaaaatctatttcatatggatatgagtaaatttcactatattttccttcagttaacttataaattttcattgaatccccatgaaaaggttctattgtcatcatttcatcaattccatcattatctatgtcgcaccaagcaatttctccaacactcttctcaagaatgcaatttatctgccactgttcattcttcataggaacaacttcaaatactccttgatcacatccaaaagttccatgtattttaccatctaccatatgactgctatacccatgattcctaaacaatcctgttttaagaacttcaagttctattccctctgttaatacatctggtagttttccataataaatagtacctggtctgctccagtcttccttattatctttaagatctgctattgttgcaccaataaaatatatttctccttcaacatcccataaatcaaaacgatgtagataaggaagcttcaatatagtttcagtaacccactcaccatctactaagtgtccccatacaaggcgtgcactgcttggactttctttaagataaaaatcacgtactgccaaaaattcatttgctctatttggaattggaataattgacatacatccgcctccatcttcccatactgtctgacgatgattaaaattctttccactatatgaatagcatggatatcctttttcttcagatgctataagcaagttaagattgccatctatttcaattgagcttgatgcatatgcacgatacatttcatctaagttctttttttcaatcttcatagtctacacctccattttttatattgcaaaatactattttttatttacaaccttttccattactttttcttcaatttccttttctgataacacattttttaatccgataactattgttcctgaatcttccgctcttttaaaattagactttaaaacctctgaacagaatacaacatcaaaacttgaagcctgactctttgcttctccaacactactatgttgaattgttacatctattcctaattttttaaatacttttgttatcttcattttaattatttgacttgatcccattccacttccacatgctgctattacttttaacataattaatcacccttttttcaattattttatactgattgactcatttcttccaaatattcttcataatcttctgctattttaaagtaaccttttttattcttaagatattgaatttgcggtattgctaataatgcaattattactattccaaatccaacatattggaaatttttcattaatactccgataacaggccaaactgtatcaaagtcaaagtttccatgccaacctccgaattgtgctaatccaaagtaccatgctgcaaaagcaccacctaatacttgaattattccagaaacgaaaggtataatcattgcagcttttaatccaccttttctattagcaaatactgcaaatgttgcattatcaaaaaatactggtacgaaacctgttattattaatactgggctcttgaatacaattaatccaataatagaaatgaattgtcctaatgctccaaataagaaacctattgttactgcatttgcatgaccaaaaccatatgttgcagcacaatctactgctggcatagatccaggtaaaattttatttgatataccttggaatgattcagtaagttcagatacgaacattttaacaccaagttgtaatatacttaaatacactgcaaaatttaaagatttttccattatatagaatataaagtttttatttgctgcaaatcctgtgtctatttgatgcattaaatctggtccgagtatacctataattgttccaaagaaaaacatcattaatatacctgttgcaacaacattatcattaaatattgataaaaatcctggaaattctaaatgttcaattgatttttctttgttaccaattttacctgcaattttatcagttaaccaaataccaaacatttgttgatgccctactgcaaatcctccaccttctgtcaaatcctgagttgcttcaactgtaagattagatgatactgcccaataagttccaagtaatattccaagcattataacagcttttgtatcaactaaattaggaaaacagaacaatacaatccataacgctgtagatgattgttgtaccattatgtgtccagtaataaatacagttctaatctttgttgtctttctaaacaatactaaaacaatattaaatataaatgctattagaagaactatcatcataagtgaaaatgatcttcctacattttcaactgcttgttgagctgctgtttgtccaaaatagggatcaataactgccgctgctaaattaaaacgatcttttaatccagctaatattggtctaaaatttccaactaatccactagctgctacattaagaatgaggtaaccaacagttgctttgataaagcctgctattgcttcatatatgggacgtttcaataataaataacctataagtacaataaatcctataaaaaacgctggattagtcaatatgtttacctgaaaaaatttccagatgtttaataatatctccatatttattcctcctaaaatttaattacccttaagctggtaaaaaataatctttatatatgttttctaaatcctctttacactctgaacatatcaattcttctactacttcattattttccactaattcaactagtttagaaagattctccaaatgaatattgttgtctgttgaagcaagaacaaaaaatagtcttgcatcttgatcatggtcatcactaaaacaaactggctttttacttctcataaagcaaactgctgtttcatttactcctacagcaccttcctgtgcatgtggtatacatatatccggcgctattactatatatggtccatatttattaacattgctgattattgaatcaatgtatgcttcttcaatagccttatctttaattaatggcatacatgctgcttttattgcatcctcccatttttcaaaaccatcatgaaaggaaaatctgttcttttcaattaattcctttaacatttctgtttcccccttttatattggaactgctattttgcttttatagcagttccataacaattacctacatatgttcttaataagataaatttaaaaccacttttaaaaaactatgctttttaagcaattttataaaaatgatgtatatggcatgttaatatctgttgtaaaacaatcatcaaatccccttggataatgatattctctctttttactatcatcagggaatgtgaatttacctcctacttgccatataaatggattaaattcatactgtaatctatcttttctcatatcaaataactctaaaatttcttttgtatctgcttggaaatttgaccatatatcatgatggaatggaataacaactttagttttcaatgcttcagccattcttaaaatatcaactgatgtcattttatcagtaattcctcttggattttcaccataagatcctaatgcaacatcaattttgtattcgtttccatgtttggcataaaaatttgaatagtgtgaatcaccactatgatataaatttccacctggtgtctttatcaaataattaacagccttaatatccatatctactggcatctttcctctgatatctccctttggaggttcagttattaatgctgttctgtcaaatgattctaatgcaactattgtgatatccttaatctgcactgtatctcctggttttacaacaatacatctttcactaggcactccccatcctatccatttatctacacatgcttgtggtcctacaaacggaacatctttgctacaatttttaagaactgccgccgcaacgtttacatcaatgtgatcattatgatcatgtgttgcaagaactgcatctatattttttattccaaatggatctaacacaaatggtgctactcttaaattaggttgaagtttttttccaccacacattctagccatttgatgttgtggatttatataaggattagcttttgtttttttaccacttccacaccaaaagtcaatacttatattagttccaccttctgatttaagccatattccagtacatccaagccaccacattgcaaatgttccttttttaacttcttccatttcgatttcttcatttaaccaagttccccattctggaaaagtatttaatatccatgattctcttgtaatttcttctacttgtgtcattttaaattcccccattccaattctcatttttaatttttctcttaaatagtatttatttcctatccatgacttaataatacaccaaacattcatatagttcaatacttttttaactttttttatatttatttgatttttttgttcgacaatgctataattttctatattaaatgaactttttgaatgttttatactttacgttcaattattaattcattttgttcataaaaaaactatattttattaaatagatatatttatgagttcatttgttgttcaataaatacaatatatatagtatagttatgttatcaagactttaataaattaagattgacttaacatgaattcatatatgtaaatttatataacggaggaatatataatgaaaattaatactagcataatttctaaaagacgagagtacattttaaaatatttaaaagaatatccagatataagtacagctgaactagctgaaaaattaaatgtatcttctcttacattgcgaagagattttcaagctttagaaaatgatggacttgttgttagatattatggtggtgctaaacttattgaagatagtccactattaaatgatattaattttgaaaacaacaattcacttaacaatgaaaataagcataaaatagcaaaatatgctgcagatttaattgaagacggagataccatttttataaactcaagcacaacagctcttcttatacttgaatatttagaagataaaagagtaactgttataactaataacggtaaagcattattttctaatataggtccaaatgttgatctaatattaactggtggtcaagtatatgaaagaaaacaatcattagttggtgaatttgctactactattttttcatcagtaattgcagataagtgttttattggtgtcaatggtgtatccgtagattttggaataagtacatctgtatttcaagaaacattagtcaataaagctatgataaatcattgtaaaggtccagtttttgtacttgcatccagttcaaaaatagggcttaaaaataaatttttaagtggaagtatagatgatatttcgcacttaattacagactcaggaataaatgaaacttctatcaaaaatttagaaaaatgcggtatagaaattataaaagtttaactttaatgatttttatacataaaattgtataatacaaaagcgctattgttttaatagcgctttttaaattcaaaaaatttcttattaattctatcttttagcctataccaccataaaatattcccaatgcaattattattattgtggcaggaacaaatacataccttccaaatttaatgaaccattttcctattgtacgttttgatccttgatttattccagataatatcttttcttcgtctatcatgtagtaaaaaacgaatgctgttataactgcaccaagtggtgatagtactattgtaacaaaatcagtaaatttattaaataaaccttcatttatacttaatggtacagctaatataaatccaattatagctacaattatagttgtcttttttctatcccagtttgttatagtaagtatcgattctaccggtccctcaagtaacgatatagacgatgaaatagatgcaaatattatgctcaagaaaaatgctgcacataataaattaccaaatggcatcgtctggaatatacttgggactgttataaataataacgatggtcctccagtaggacttaatcctaatgcaaaaactgctggcataatcataaatgcagctaatattgccgaaattgtatcaaaaattgctgtacttactgcacattcagtcatatcaaattcttttcctgcataacttccatagataaccattccacatcctgttattgaaactgtaaagaatgcctgtcccatagccattgcccatgtttttggtattagtaaatgtgcccaatccggctttaataaataccttataccagctgctgaacctggaagtgttaatgatttaatcattaatagaataaatataataaataataatggaattattatcttattaatcttttctattccctttgaaacacctgcactaactattgctaatgttattacaacagcaagaagatgccacccaattgaatttgaactaaaagcaaatccgccaaaatattcactagtatttatattgtttatttgccctgtaaggcttatgtaaaaatattttaatacccatcctattacaatggtataaaacataaatatccccattaatcccaatgtgggaattatagataaaatctttcctccagatttcttattttcttcaaatacctttcttatagcacctaaagatccttgtttatacattctaccaaaactcatttctgctataagccctataattccaagaacaatgataaataagaaatatggtattaaaaatgctgctcctccattttctccaagcttgtacggaaacatccacacatttccaagcccaattgccgcaccaatacatgacagcacaaaaccaattctgctagaaaaaccttctctcttagccatttttcttcctcctaatcttcgtaaccttccaatacatcatattacaattaatcataaatttacttagactatacctactactattcctcaaaaaatttcttaacaattctactagtccacttttgtaatttaaaaaattatatatttcacagcaaaatattatctaatattttgttttttatatatttttttgattaattattaatatgaattattcatataataatacaaattagctattatttcaacaaaaatttctttttttacatcataaatttatttttaatctttaaatattatattttatgtttaaatattctattttaaattcatttacaaatagtaggtgttcatggtactctaataaaaacacatatataaaggagaaaaaacatgtcagcatatttaattacatatttcataagcgatacatgtggttgtggttgcggtcacagtcacgatgataataatactcaccctcacactcatgaggaatcaagcgaagataaaattatttctaaaataaaatcattaggttcatggggacacgttatgcctgaagcatatgttgttaaatgttctatgtcatctgatgatatactaaaagagttaaaagcagtagctaactctggtgatctattatttgtaacagaagtaaacgctgaaacagcctcatgttcaaatgaagctgttatcaattggattgcagaagtttaataatatcataggcaattaaattcaacaaaagtgaaaaggatagaaagccattaaaaaatgagttttctatcctttttgcgttactaattcttttaattttcttaaatccttgaatcaaaagtttttattttaaataaaacttaacaaaatctattgtgaatagttaggacataaaaatatgagtaatcggcatgatacatattcctaaaaatattgaacatagtgataaagtattatatccatactctcttgatgatggtataagttcttcaaaagaaatatataacataattcccattacaaatgcaaaaatcaatcctaataaaaattcacttataaaaggttttaatattaaataagcaagaactgctcctactggttctgatagacctgaatacatggtatatttcaatgccttcattctacttcctgtagaataatatataggcattgcaactgctatcccctctggaatattatgcatggcaatagcaactgatattgaaattccaagggctgcatcttgatacccagacataaatgtagcaattccctctgggaaattatgtagtgttattgctatcatggcaacaagtcctactctaaatagttttgcattgtttgaattatctgaagaaagtaaatgactttcatgtggtataaatttatcaataagcatagcaaatataacccctgaaagcatatacatcattgtaagcaacactccataaaagtttccgtaatacttaactaacgtactttctgcaaacggaaaaagatctgtaaaagagatgcatatcattactcccccagaaaatcccagtgcaaaagtaattgtcttcttgcttgttcttttagatataaaaactatgcaggctcctaaaactgtagaaattcctgcaaaaaatgaaagtaccagtgcaaactgagcactctgttccataaaaccaactccctgctctgtatataattttatcaagttaatatttcaactgttttagtagttaacttaaactaatcattaaactatattatgtatattctgaaatatactttaaaattacataaaaataatatccatcaaaattcaaacaaaagttcaaattttaatggatataccacaaaatattaaaaaggagtcgtaattttatgtgacttatctcacaagaggagcgatgagtattttttataatacacctctttaaaattactaactatataatagtttaccaaatttttcattaaaatcaatagtattttttaaatattttgaaaattatgatatattatatagatttatttttcaattttctattttttatatttaatgtaattattgacataatagtataataagagtataattcttattgttgtatggcccattggtcaagaggtcaagacgtcaccctctcacggtgaaatcatgggttcgattcccgtatgggtcactatttattattaagaatgactgtatcactaagtttattaactttttgatgcagtcatttttgtttatttgttacttaatttgttactttcagaattttatcagttaatcttagtaataaaatattatctaaattttgtatataattatttaaatttatctatcaagagaatccaatattaagatacttcatttttcatataactatactttatcatctttaacaacttattctataagattccatacctctttttctattccataaattatatgtcctatttttaatatgatttcatctatttttctaccaacaatttttacacttataaacataatttctgctatttgtttttttgttttattttcaaaatacttatatgctattaatttttgatcttctaattgcaaagcattaagtgctcttattaatgaattaatttcataatgttctaataaagttaatttatttttttgtgatttttcttttaaatttggagcattttttaataattctttagttctgtttattatttcttttttatataaaaacataattcctccttaaataatgccttgaaaatacttattagcaaaatcaatcttcttttctattgatttataattatgtctaattgactcataatattttttgtattcaactcttgaccacttactttgccttatctttcttagtgctctattttctatctgatgaacccttgaagaggtaatattgaatattccagatatgtatgtaagggtacattctttgcaatcccaaccataatgtaactttaatatttctctttccttaagcgttgtattttcattcataaccctttctaaatcttctctaagcttttttagatatattttttcttccacattttcaaaatcataatcaataaattcaataatatcttgaagctctgaattattttcttctgatacaggaatattcagacttgtttcatcatttgtgtttttttgtattataaatccatgtatcctttgatatatccaataagtcgcatatgttataaatgatgcatgataatccatgttaggattgtatttttctgatgctataattaaacctatatatccttcctggattaaatcatcaaaatcaatagaattagttttaccaacaaaaaacttattagctattttaaatactctacctttattattttcaattaaaatttctaacgcttgtttatctcctttttgatataataaaactaattcttcattactcatatgttcacctctatatattaaatttcaaagagaaacattatactaaatatttctctttatcggctttctcaccattttcttttacttgcaaaagccatctcttgacttactgttggtgcaactaacctgccaacctttctcccatctaaagcaactgtaatatttaaagcttctcttaatgatgctatttcatttctcatcgaatccattatagataacactccatctaaattacttgaagatcctattcctctatttgttataaatcccatatcgtaattaccagcatttacatttggtattgctgcatctgctattgcatttgcttgcttagatatactgtttactgtatctccaatacctaatccaaatccttcaccagtataaactcctaatgccctcataaccctacttggtgaatgtatatccattttttcttttacgccatcaataaagctatcgcaaagtccgcctatccatcctttcattccattccatgcatcacttattccttgtttaattccagcaactatattttttcctatatccatcattttgctaggtagatctgtgaaagtatcaactatgccattaaaaacatctgtcattccagttttagcttctgtcaacatattcccaccccaagttgtcatgtttgttacacaattagttaaccatgtccatatttgtcctgggagttgtgtgaaataagttactatattagttatccaagcacttacattagtacttatccaacttgccacgttacttccccatgtccctaaattagtaacaacatttacaagccaagtccaaatctttcctggcaactctgaaaaccatgttgatatattttcaatccatactggaacattagttgttaaataatttattgtatctgttccccattttataatagatcctaaagcttcacctaacccataggcaattttattaggtaattctgcaaaccatgcatacattgattctaaccaaactggtacactttcagtaaaaaatgttactatgttattccatcctgtttggaaaaaagtaattacactttgtataaatccatctataaaagttttaaatccatcacaattgctatatagcaaagcgaatgctccaacgaatggattaactattaaaagtaataattgcgcccagttattagttaaaaaatcaataaaaccttgaaatgcttgtggaattgtaactgtaaaaaacgtaactattccatttaaagcattgcttattgttgcttttattccttcccatatttcggctgctttaacttttatagtatcccaatttgtatatagtaatacaccagcagctacaagtgcagttattgcagctactacccctaaaactggtaatgctattgctccaatacttactgtcattgttcccgccaatgatgctaatgtcattaccaatggagctattcctgtgagtatccccattaatattcctaacgatgatattattgcagttatagtggctgctaatactggattattcgatacccattcagcaaattttcctattacatttgaaataacttcaaggagtggtgataatgctaattttaaatcagccaaagcttgttgaaattgcaccattgggtcagagtctaaattttcaatggcatcatttaggttattttgattttctttagcagatgataaattatcattcattccaagaattgtatctgttattttactgccattttcttcccacaaagtaccccaaacagtagttcccaactgattttgtaacgttttatcatcaacattagcaatagcttcggcaatatcattcatagcctgtttaccttcttcaccacctgtagcaactgcctgtccccaagcctgtaattgttctcctgatatgcctatctttgaaaacatttcttctgttgctttatcaactccttgaccaaattcagataaaactattcttccttctttaagtccatcaagtaaaacatcaatattccatgtaccagtttctacccctgctgccattataccttgaacttcttctgcactatatccagctctagctaattggcttccatactctgttattatgtctaactggtctggcggaaatcctatttttaaaagactatatgtcatagccaatgcgtcttcattacttattcccaaactttttgaaagttcgtttgtttcttgtattaattctgtaaaatctacatctccataagatgccactattgcagcagcaccttgaactactgttgaattactttcatcacttgcatctttatttaatgcccattgcctacgaactccttcaagtgctgcttctgcatctactccataactagttatattattaatagcttcttttatagacttttgagatccttcatctaactccatagatatcgataatttagtatttaaactagatgtgtcaaaagcatcttctattacctcagatataccaacaccagttgcagctccgattactaattgacttaatccacttcttagttctccaactttatcttctgtttcctctgtagattccccaagctctttcatatctttttttaatgtatcaacttgatttccatcatctatcttagctaatgactgcttaagtttatcaatagatccttctgtatattctatttctctcctaaaagctctatattgatcttctccaatatctccatttttaaattgttgttctacttgactttgtgcattttttaatccttgcaatttttcagaagttacttctatctgctctgataaaagtttttgtttttgtgctaaagcttcagtattaccaggatcaaattttaaaagtctatcaacatcttttaattctttttgtatatctatactttgttttgtaacatcacttaaagcattttttagacctgtggtttctccatcaagttctattgttataccttttattctatctgccatactttcacctcaattgcttaatatattttttactgtcaatttatttatcccatgaatcccccccttttttatttttttcgctctattggaaagagttccactcctcggtctcctaatatctattaaaatttattttaaggtgggggggatactttattttttgttttcaaagtattcttcagctaacattactaaccgcttacctatatatccatcaacattaaaaaaatattgagcttgcttctcttcttctgtcattggatatttattaaataatttttcttttaactctagcattactgtaccactgcctacctttacaggttcgcttgcataatcatgttccataaccttacacctcttacacttgctttattaatcttacaaatgatttgttattatgtggtttaccatcataccttccaactactctaaatattgtttggtcttctaagaacctttgatgttctgacatatttattcttatgccacttctctctgacaatatatattcctttagatctcctagtattatttcattgtcttcaactgctgctgaatatttaactctaataccattgatgtttggataaggtaatacattagttgttataggtaatatatcttggtagtatgtttgacgtttcattactgctaccacttcacctatgtcttcctttttccctttatctataagacctatgcttgacaatatcttaggtgcagtaaactctatagtaactacattgtcttctggtaagtttttcaatattcctacaggttcatatattaatggtccatctccagtagtatctccaacaccatttaatattccattatctattgcatatcccatagccttagccagcaactcttctatatacattgctgtttctattacactatcttctaatactccattacttactggaagatatccaccaacttttatatcttccatttccaataaatcaatacttgaatttaattcttcaagtgatgcttttacatcattccactttgcaattgcttcaccaacacttacacatactcttccatctactcctataggtacaacttgcacttcatcataaaatcctgaatacagtcccattaaatccttaattctatctcttacaacctcaggcatatttaatacattaccaattatatgaccttctcttaatgatatctgcatttcatcataaaactttgctatttgttcatttcttaataattcctttaattgacttcttctttgcatcctattcattatcttgattctccttttaattttctgcttatttctcttttttttatttcaatcctaattttattatctaattcctcttctgatggtttatttctctgattttttcctttatcatccatagccatgattatttcccctttctgattttttctatatttctcttgatatcatttttacttttttcaaataatttagtgtttttcgtccttttctccaacgaattaattgccataagttttctctgctccttaacaatttgctccatctctgattctgctctcatatttctctctgcttttatcatctttttgtctcctctcttttttatgtaattccttattcttgattctagctttttccttatacttaaaatcccttattccaacaaaaataaattttccagacattacacattactctccttctccttttccttaaacttcttttcccaatatctctcttgagctgccttaactttatccctattccttttcctccattctttcatgtaagcatttctttggtctttagctctttgattcaaagcaattctcctttactactgttttaataaaacaaaaaccacgggaatatataactaagtcaataccattaacttagttgtatattcccgtggctataatttctattgccttacatcacttctgatgtggtacttaatttttatttttatctttatatttactataacatgaatattatactatatccatatattaattaatattttctaatcattatatctatagtattatctagtatattcctatctgaaactttatataattttactacaaatttctagttaatatctatgtatactctataatattgtccttttttatatggttcacttattttttttatatttgttccctccgatataatctttaatatctttattttttcctcttcacttttatatttaatttgtattttaatcataataattcccaccttttttaattggtgtccaatttggacactacttctaaaacccaatcactttaatatttgttttaatttatgaattctctatctttttccttataaaatcaattcccttttgaaataccattgtttttatatttatcttagtttctccactagataccgtgtatttttgttctaataccctgaaataacccaaatctacatactgctgataaggaatattatttctatctaaaactttttcatttcttaacaatgaaaaaattttatttcttcccatacctttaattccaagaacttttgcaacatgtcccatttctatgctatcttttgaacctgcaacacaatcataaaattgtgcttttggttctagtaattttatttttctttcagcctcaaaacgtgcttttctttcttcttttaattttgtagctgctgcaattagtaaatctggattgtccaataattcatctgtagcatacataccattttttctaatactgggtaatacatccctagtaatccactttttaaatttcttagcattaggtaacttacttcctagaactgcattatataaaccactttcattaataagaatagatttcatgttcataccctccaatttatcggatatgaattcatcctcatctaacctttttgttaacgcatttgtttcactatatccaagtttttctgctatgtctttcgctacaaaataggattcaccattaatcgttacagctctaacctctccaaactcatcactgctaaaaatacgtaaatcattcatggttaagcctcctcaaaataaccttatattaattacagtttttttcttgtttcattgcttgaattattccattaaagtccttttcaagcatattcactccatatttttctctatactcaaccataatttttataagaggttttcttaaaatatatctttttttaaactctttttctcgtttaacatcttctaaatttataatcatttctattctcccttcaaatctgcaagcacttggctttttcataaattaatttttgaattcacctctaacattaaatatttcatatatggatatccattatattgacttatcccattcactatagaatttttatcaatataatatccttttttaggttttggttgatcgtaatatctgtttgctcttactatttctgttgtaggttctggtattattaaatttctactagaattccactttttgctttgtagttctttacttttgcttgtttgctttatcaaatatgatgcaagatctccataatttccactctcatctagtagaaatacttttattcttcctttagtccaacacttacgtaatatttttaatggaatttcatttattactaaatgatgatgttttgctcccttttgtcctatctccattacatgaatatatttaagctctattcctaattttttatattcttttctaagctgctttaaaaattcatctatatcttttctcatttcttctctggcgtttggtctattatttaatgtataatctaaaattaaatgatagtctcctggtttatagtttgcatttattctccatcttagttttttctctgcatttcttatatttattttttcctgttcctcacttgtaattgagattctattccctcttaccattccctttgttttatatttagttgtataatatttttcaacttctattgtttttcccgctactatagtcttttttatatatggcatatatataacctctcttttttctcttctgctaattttaaatattattatttagttctaaagttaatatatttatcaagtcttaaaagctctatttcattgacttttagccatatatttgctatactatatttgcatttttttgtgaaatatatgacttgaccatactgtttactccaataaacaatatggtcatttttaatttaaatttcatataaaattacccacttaactggatttataaaatgctctaatcatttaaatatatctattttttacacttctttattgaatattattattaaagaaaaaccttcctaaactgctctaaccctctaaatgtaggttgttttttcagctccttgcatagttctatatatttatctataatttttaaattcattgttattctgcctcctttaatatccaaccttttatccttttattactattcattattgaatagcaccaatcataattttttaaattaacatctggtcttttcactttctctattatgtctcttcctttgtctatatctataaatccattattaaaatttactctcataaagtttttttcatttttaacctcttcaatttcgctttgaacgtacacatcattagcataataataaaaacagcttgtactattattttttatgttttgtagtaattctctttcatgaattaagctcaactctatttacactcccctattcttatttttaaaattgttcatactcatatacattcacctatatgctcttctataaattcatctagtttcgacaatataattcttatatctcttccaaacctaataattggagctccttcaatatgtgtaactcttcttgcttttgcttccgaaactcctaatatctccgctaattctttaatattacaagtcttcttttttaacttttccctatactcttgtattgttataggttgcttttctatctctaacattcttaatacatctcccttttatttattaaggttgccgccctctcataggctataaattccaatacattttaataactttttttgttttaatgcttgtcttttctttactgttttttaggtatgatgttttgattcttaatacaataggatattttttatttattttcttcttcatcaataaaaagttcctgaattgttgtttctaatacctctgctattttttttaatgttccaaactttacattatcaaaatttcctttttctatttttactatagttacatttgatgttcctactaattcagcaagtttcttttggcttaaccctttgagtattctatgtattttcactttcattttatcgctccttttaacttacagttaatatatttttataaatatttatctattggttaatttataactttattatatttatcttccagttaaaagtcaacattatatataaatttatttaacttttagttaaataatgttattattaatattatggaggtgcattatggatacaataggtaatacaattaataaattaagaaaaaatagaaatatatcaaaaagcgaactagctagaaaaatagatgtttcaccagcctatataacaatgttagaaaacgggaaaaaaagtaatccttctttagagatattaactaaaatttctaatgtattagaaattcctttggatacgttggtaacatccccaaaaactaaagaaaataaatttgacctttttcacatattagaagaaaaggcacaaaaaaaggaacttcaaagtcaaataaaatcagataatactaaagaatcttcaactaaacctactgcacattttacaattagtgatatgttattaattagttttataaattctttacatcatgaaaagccctatgataaaaaaatattagatattaaaaataagtgtgataatggagagccattatctgatgaagatatgaatattattaataataataagcaacgtaaaattttagaaagtgattttgatattgataccgatattagtgtaatggactatgaaaaagaatcatataatctatttaaaaaattgttgatttcatttggatatgatgcttctgttccaactccatatttctttaaaaaaattaaggctcaaattgaattagaaataaacatgaatcaattcaaaaaataataaataaaaatctattataatgaggtgatatcatggcaaaaagaagcggcggcgaaggctcttcaagatgggtcactagaaatggtaaaaaatattggtgtataacaataactattggatatgatccacttacaggaaagcaaaaaagaaaagctatatacggaaaaactcaaacagaagcaaaagcaaaattaaaagaatatcaagattcctatacaaatagttctgaccattctactttaggaaatttttattatgattggatatggaatatcaaaaagcaatctttaaaaccttctacatttgagaagtgggaggggatatatcgaaattatattaagcccaataaaggcttaaatgatgctcgattaactgaaattgatacattgtatttgcaaaaaatcattaataagcttcttgaaaatcatacagtatcacaaataactactttaaaaagttgtttaagaaattgctttaaatatgcaaaatcaataaataaaattaaagttaatccagtagaagaaattatattgcctaaaaataatgatgttgaagacgtaaaagaaaattatatcccagaagaagagcaaaagaaattaattgaagctctcaaaaatgattcattagaaggattgatattaataagtttaatgtgtggcttacgtttaggtgaagctcttgcacttcaaataaatgatattgattttaataatatgtcaatcaatataaataaatctgcaaaatatgtgtggactggtgaacgtgataaaaaaggtacaaaaatatatgaatataaagtattcaaaccaaaaacaaaaagcagtatacgagaagtacctcttccaacaatgctaaaacctataattaaaactcttataaaatctaacatgacaaataaattgaaatatggtgagttatattttgataataaattaatcttctgcagggaaaatggaaattatatagataataagcaacctagcagacatttaaaagccgcattaaaaagagctggaataaaaacagatttacattatcatagtttaagacatatttttattactaattgtttaagccgagatattaacccacgtactgttatggattgggctggtcatagtgatatcagaatgacaatgcttatctatgcagaggtaaacaaagacaaaaataaaaaagaatatgaaaaaattaataatatgtttcaataaaaaataacagagctaatattaagtataataatattgactctgttattttttatgtatatttaatttaaatatttaagcatctgaactaaatagtctccgcttaaatcgtctttttcgtctttgtctaaaggtctatttccaaatctaacaaagctatttgattcataaaaatcagttaattttgatttatcttcacattctaaatatgtaatttttccgcctatatcactttgaattgattttattttatcacaagccaattttaatagctcatcaccagtaattaatgtattcaaattatctttaaaattttttcctagttgagctatcaatggagctggtatactatagcctttaatattttcatcatatgttccaaatttacttattctttttgccaaagtcttactcaatttgttttttgccacatagaagttctttatagttaatgtaaaataccctattaatcttatttcttctttataagatgtaaataccaagtgcgttggtgctatattttgtttactaaattcaagtgccttatatcttataaacttttctacgtctggattttgagggcaataaaaatcagagaggaaagtttttgttttctcctctccgatttgttcaaccatttcttttaatgatactaaattatatcctgtcatcaatacctaattaaagattttcaataaatcttttccttttatttcttttaccgatttactcatttgaacttcttttccttgcttattgctggcattctccaaagctattactagacctcttgtaagagtcttgtcttttaaattgacatttttacaaatactcttagtagccatatgcatcaacctaccttttttatattataataatattatttcatgtttttatcatttatattcactaaacaatctttgtatacgataattttaacatatttttcgttttgtgaatacataatttcatataaaatacacgaaatatataaaatttataataaaaattgcaatataatatataatagcaatcatatattataattgctattatatattatgattctttttcaaaattgtttctttaaatttattttttgatttttgttactttaattgttgctaagggagtaacaattatcatatctcaaaaacatcaaaacagagcttaaatgtagtagcgtagccttatgtattaattattgattgttactacaaatagatacttacgattcccgtatgggtcaccattgcaataaacatcagcttttaggtaactaaatatgctggtgtttttattatttcacaccattttcacaccatagtttttgtatgatttttttacaccatttcctgctttaaatgaaatgcaccaatatctataataacatcattcacagttattgattttccttcatgcatgagctcaatacaagtatatagtaatccattttaaaattgtatttctacactaaaaatcaaatgatatttactatatttaacaaatcattatttctagcaacataactaacaatttttctttactttaacaaaccaaaattattaaaaggataaaatctaaaaatagcttttccttcaatatcttctttatctatatatggattactccacaatcttgcatcatctgaatgtgcacgattatctcctaaaaaaaaatatttttcattaggaacaaaaaattctccatcatatttttcattatttttcacataatcctctttaatatcagagccatttatatttatgattccatcatgtattacaatgtggtcccccggaagtccaataactctctttataagtctcttttttaattcatcagaattaaaaactataatatcacctctttctattttatctgtgttatgtatacgtgttactaaaagcttgtcatccttatttatagtaggaaccattgatggtgtaggcacgtatacattaaaaaacaaaactttttttataacaatagctatcattattgctaataatatcggcattatccaatcttttaaaatttttttcataattacttttcctctcattttatattctcttaatatttatagttttttattaagatatttaaatacaatgattccacatatatattgaaaaataagtaaagtcacaaatgcaattacaagatattgagatattggatgaatgtatcctatagcattgagtatagaaaatactacaatcaatccacaatataacataagcattattttataagtaatacaaccacttttatctcttatcattgtttgcctttcatcttccatctctatcttctctattctcaatttttcattatattcactttgattttctggttttgaccaatgtaaatacttacaagtagtaactactccagatccaaaacaagcgccaccgaatccccataataaactttctaatctatattgagtaaatagtgccaaaccaaaaagtactgttcctaatattaaataacctaatcctatatataagtctgacttcttcatttattttcctcctcataaataaaaatttcttctatactcatatcaaaatatctagcaattttaaaagctaatataattgatggattatatcttccattttcgagcgaaccaatagtttgccttgaaacttctagtgcatttgctagatcttcctgttttatacctctttcttttcttatcttctccaaatgatttttcaaaatatacctccattaaagtaaagttagctttccatgaattattatattattctttcctttttatgtcaaataaactttccatagccatcacaaattaaatatagctttaaagtcaaataaatatagatattaatatttatttgataagatacattagattaattattcacaaaacatccaacaccaaaacaaaaagagcatataaaacaagtttacgtactcttctatactatcttaataaaataaattaaacatcaaatagtgtactatgtttaattctaaatgaatacatattaacataattaaatttaaaaggagatgttaatgtggtatacaatgtttatttatgtgaattattaggagtaatcttcatttcaataactggttctttactacactttgtttatgattggtcaaataaatataagccatttgcacttatttcagccgtaaatgaaagtacttgggaacatcttaaaattgccttctggcctacgttaatatactcattactcgaatatgcctctatttcagaaataacaaataattttgttattgcaaaagcttcatgcttaattataattcctctttcaattgtatttctattttattcatacacaaaaatactaaaacgtaattacctagtagtagatattttaatttttatactatcaatatactttggacaaaaaatcagtttctatatattaacaatgactcagcttccaggttttttaactactttatccttatttattattttaattctaataattgaattttctctatttactttttttccaccaaaattttttattttcaaagatcctactaatggtacatatggtatctagaaaataaatcgcaccataatattcaatctataaaatattcaatatttatgatacacttacaaatagaattgcattaattaaatattttttgtaattaattttaagcatatgagaaagatatacttgataacaacttgtgatttttattcataagctttgtattggaggataaaatatgaatcaaaaacaaatggaaatgatgaaaaaaataatagaagaaaagaagcaaaagggaaatagcacaaataaaaatgctgaaaaaccaaaaaaagttatcggaagaatgcttcttcatagcggaagaacaactttatagatatagcattaaaaccatacatataaatataaaactaagccctctctattttctaataataagacagggcttagttatattaaaatcatgtatttatatttataaaattattttaatttattatactcctcatctaaaactggttctaaccactcattagatgcaccttctgctggaacctctattgcaatatgagaaaaccaactatcttttgcagctccatgccaatgttttacttctggatctatattaaccacatcaccagtttttaattctctaggttcttttccttcttctacataccagcctcttccaccagtaattaaaagtatctgcccccctttatgatgaatatgccaattattacgacatcctggttcaaatgtaacatttcctattactacaccttttaaagaaagcatatttaaataacttttacctataaaatattctgcaaatgcttcattcttatttcctctttcaaaaacttcattaaactccatacctatactccttttccattcaattattttaattttatacctattatctgattctatgttacaacttaaagttaactctaagtcaataacgaatttagtttttccttgtaaaatgaaaaactaaattcgttattgtaaggataaattcaagatgtataattataaaactccctaatttgaattctatttataaataagtaattttttaacttataatccatatataaatatacgtttccattatttaatacatttttatagttttacttaatttttatccaaattaatgtaattttctctattattttatactatattgtatatttattcgaaatattgtaaaatttaattgttacaatatttatttgtcaattaacttttaattaacatttgtatgatatagggggataaattactttgaaaaagagaagtttacttaaattattcactaccgcaactatactttgcagcataacattaatgaattgtacaactgcatatgcacagtggcgtaaagataatactggttggtggtattctgaaggtaattcatggtcaacaggttggagattaataaataacaattggtacttttttgaatctaatggatatatgaaaacaggatggcttttagataatggaatatggtattatctacattcctctggtgaaatggcttccgatactgttcttatagacggaaaatactcaacatttgatgcaagtggcaaatggacaggctatttaaatactactaataatacttcatcttcaaacacattactttcaaaggctgaattcagtagtatcgtatgtgacaaaatgcatgaacttgtaaataatcacagaaaatcaaatggaataaaagaattaaatattgataaaaatttagatcaatctgcatatttaaaatccaagcatttaattgataataattattttgctcatgattatagtggacaatccttcagtaaccttgtatattctctttcagggcaaaaaattaatggagaaaacatagctcaaaattatttaactgaaagttcctatactaaatcgtccgcacaagatttagcaaatcgtttatttaacagctggaaggaatcctctggtcataatcaaaatatgcttagagaaagttttagcagttttggctttggttttgaaattgcatccaacggctatgtttatgccacacaacattttaggattaattagtaaattttttaggacaacctttatctataaaataagatttaaaggttgtccttttaattcatttaatgttgagaatttattatattaagaatttcttctcttatctgcatatattctgaagtatatctagaactttcttgattaacacctgctatatcataagtaaaatcagtcttaaattcttttactattcttccaggtcttgacgacattacaattattcttgtggctaatgctaatgcttcatcaacatcatgagtaataagaaatactgtattttctgttttattccatatatctcttataagagcctgcatattctgccttgtaagtgcatcgagagcaccaaacggctcatccataagtatcattctaggcttattcacaaggactcttgcaagtgatgccctttgtttcatacctccagataattcatatggtttatgttttccaaaatcttttaaccctacaagttctagatagctttttgttaattcctctatctggcttttaggaaattttctcatttttaatccgaatgatacattatcatatatattcaaccaaggatacaacgtaggagcttgaaacactactcccctatgccaatctgctcccttaataggctttccatccattttagcctcaccatctgatggctgatgaaatcctgcaattattttaagtaatgtacttttcccacatcctgatggtccaagaacacatataaactcaccttcttcaatattaagatttacatcttttaatgctgttacttcacctttttctcctgaatatcttaaatttatatcttttaatgttactacataattatttttatcattcattatttcttccataagataaatacctcatttcttatataccttttcacttttatcagtaaattatatataaactttcttgcttgattattttatagcatcttctatatatttaggatttacagctttatcaaatactgaatcctctggaactgatgtaatacttttttgttcaaataaaaattgtgcagtatcttttaatgactttactaaatcgcctttagtctcactagttccaaaatatttcggatctagctgttcttgtgcagaaagccatattgatccttgcatttgtgataacgcttcatcttgtgatatctgtaatgcgtctgatatagtttttactgcttcatcttgattttctttgtataaattaacgcctttatttaacgctttaacatatttggtaactaaatcagggtatttttctgaaaattcctttcttacaacctcaacgttagatgtaagtattcctttttcagccatatcagcacttgataataatatctttccatcagataataaatttgcaagtgttggctcccatacatatgctgcatctatatctcctctttgccaagctgcataaatatctgctggctgcatatccaaaagttcaacatccttttcgcttattccattaagttttaatgcatttagtaaactataatgtgctgttgatgcaaaaggagttgctattttcttaccaataagatctttaattgaagctatatttgattcatttcttacagctaatgattcaacttttccaagcacttcatgtatccatattaattcaacatcagctccatttgctattccaagagttgctggtgaagatccaagaagtccaaaatcaatactccctgatgctaatgcattatttacatctttaccagaatcaaattcaacaaggtttatttccactcccatttcctcttcaaaatatttctttgcttttgctattccctcatcattgggcatctgttgagttcctatattaacaaccttaggacttccatctgctgctacatctttactcttacttgagccacaccccatgaacatcgtacttactgtacaaagaatcgctattgttttaactattttcttaatattcataacctatttcctccactcttatataattttctattattctttacctttccacggtacaattttcttttctaatatccttaagaactgatcaagtaaaatacctgtgattcccattataattattccaacgaaaattatgtcactccttaaataattactcgcatctaataccatccatccaagtcctgattttgctgcaaccatttctgctgctactaatgtagtatatgcaacccctaccgctgtccttattccaacaaatatatctggcagacatgatggtaaaatcacatgaataaatatctgatatttacttgcccctactgtatatgcactatttatataatcttcctttattttcaacactgctgaaacacatgatatatatattggtgcaaaacaagctaaaaacaataatgttatttttgattcatttccaatgccaagccacaatacaagaagtgtataatatgcaagtggtggaagcggacgataaaattctattatgggctcaaatattgctcttattttcgaattatatccactagctagtccaaatgggactgctattaatgcagcaaagaaaaatgaaataaataatctttccatacttgcacctaaatgttgaagtagactataatttttgtatccattctgtataatatcaataaatgcattccatactgcttgtggtgtaggaaccattttagaattagcaattccaaaattagttacaacaaaccatacaagtaaaattaaaattattgttgctaatgtcagcatgttttcaattgtaattctcttattctttttactcatatccatacctcattcactaaatttacagttaattaaattccattatgttctaattaatataaaacaaaacaagggcattttatatattttattaaaacgcccttgttctaatctattatcttatttctaaacataatatatattttatttataataaacctccttcttatgtatagttttattttaagttttctcatccttcctttaaacaaaaaaggtcttcttaaagtaaacttttaagaagacctctctgccttttatttttatttgctgccttaatatgtttatataataatttaaattgaatatctgtacaatgtcttttaatactattttatttgtactccagtacatactacaatatgtcatggagcttatatgctatatcaatcatttctcttatctcaagttttgataagtcaacatttaatatctcttcactcttttttattttataattaacggtatttctatgtatatataactcattagctgtatcttgaagactaccgttataactaagataacatcttaatactgtaaaataatccgtattattataactgtcatactctattacttttccaattgtctcatcaataaagcttcttattacatttctatcctgtatagcaaaaagtaatttgtaaattccaatatcatcatatctacaaatatcattattatacttcttcctatttattataaccacactatctgcctgtctataacttttatatatacatcttatactctttgtttcttttccaattcctataaaaatactttttattaaatgtttactttcacaatgtttaacaatcttttgtaatatttctaatactttagattctgttgtattcataaataaaaatattaactgattatttatcctaacacaaattgcctgtttataatatacagataaataattttctatacattcattaagtcttataatatatttttcatcattgatcatatcaaatttattcacatcaaataccgcaatacaatatttattttcacttttaaatccatgaatttcaagttgtgataaatatagatcttcacgttcatgataaaaaatagcattctgtattgatgtagatatttctagtgaatttttctcattttcagttattttaatacagaaaactctcattatctcagccatatgaacatgccatggcactacaaaaagaggagtatttgtttcattacagtaatctatacatttcttgtcaatgttttttatatatggtcctatatttatcactataccacttgcttttgactttattattccttctataagattaataagctcaaattcattagatagtcctattcctgttaaaaaagttacttctccaccttctaaaaatgttgctatttctatattttcaaccatatgaacccattttacagctttacttaatcctttctctccagcaattagttttatatcatgattttttacactttcatataataaccctattgttacgctcaaccttctcacttccttaaccaataaaattatattagcctcatcaaaacatgataaggctatataattattctattaataacagcaaattaaattttaacctaaaagatttaaataaaaggcatttccattaaaatgcatcagcatgtccttctccagtgcttactttataagattccaatacaggtataacaaaaatctttccatctccatgatttcctgtactatttacattcattattatatccactactttttcagtctctttttcagatacaataagagtaaatgctcttttagacataagatctgacgtttgttcagtatgatcatctaacatataagttacaggctcttttcctcttccaaatactcttctacatgtaaatgccggaaaaccttcctctaagagagcttttttagtctttgatactttattcaaccttacaattgcaagtatttcattcataacactccccccttataagccttttaattttgtgctaatagtatatgcctcagtaacaggagtaacaaatattcttccatcacctgaatttccattctctcctgttctagctgcattcattattacttctattaattcatcctttttttcttcttctactaccataagtaacatatcctttggtaattcatcataaaaaactgatcctatctgtagtcctttctgcttacctctcccatatacatccatcttagtcactgcattgaatcctgctttccttacggcttttagtacattttcaaccttttcaggtcttataattgatcttactaataccattttttaatctcctttcataaaataaatcttttaaggcaaaaaaacaaaggagcaagataattaaacttaattatcttaactcctttgtttaatgaaaattataatacaaacatatatataattcaataagatagttttacattttgacaataatataacagctaccattaatttgtttgcatttcttttttatctgactagcttcttttgcaagtaaataaacactatcaaacgtcacttcttttttagttattcctgcaatagatattgatactaacggaaacttttcttctattccatgtctgttttgtgcttctatgtatcctctttttaaatctttttcatcataatatactaattttaattcatcaaattcttttattatagattcacatatattgtttatatctcctgaatatattattgaaataaagtcatctcctcctatatgacctataaaatttctatttgatatatttctatttattatgtcagctaataattttattatcctatcaccattttcaaatccataaacatcattatatgctttgaagttatcaatatcaaaatatagtacacaatactcttcataatgtgatatgcatttttctatttctttttctatcagaaaatttcctggaagacctgtaagaggatttgaatatcttgcattattaacttctatttctgtagttttttctattaaatcttttattgtaactattccataatattttgaatcttttgttactgtaacatgatcataaatattttcctttgctcttgtcattgcaaattttattactctttcaatagacattttataatccacactcaaaaaatctgtttccattattgtagatattggttttgaataataaatactatatccatactgccaacctaatctgctatataatgcatttcttgttattgttccttttaccacattatcctctactacacataatccaaatatgtccttgttctttttaaatagtaaatcgacacttgatactggcatgtttggacttatatatattttacttttagcgatatccttaatatatacattggttatattatttatatattttttctttttaacaatattgatatcatctattatttgtcttatattatctgatatttctaatatttcttcacttggtctctgtataaaatatccttgtccatattttatacctatattaataagagttctaagttcatcttcagtttctattccttctgcgatcaaaatagaatttgtaactttagaaaagtcatacatacttgtaaccagtgcctgttttgtcttatctttatcaatattgcgaataagctgattatctaattttaaatattgtggttttatattacataataaattcaatcctgaatacccagaacctacatcatccatagctattttactatttttactgttataaaagttaatagcatctttaaaacgattcatattttttatatcatttctttcagttatttcaaaaattatattttcaaaatctactccatatttttgcaaacatttatcattaaataaatttctaaattttatactgcttataatagcaggatcaatatttaaaaatagctttgtatttaattttttatgacatgaattctctagtgccttacatataaaaagccattctaattcaaaagatttatcacattcttctgcacactttaaaagtagttctggattttgcatttctgtattttctggtcccctacttaatgcttcataccccataacactcaaatcctcaagagatactattggttgaaatacagttcttatattttttgtattaataacatcaataaactcatcatattgcttactggcaagcttaaaacatatagcttttcccaaaatataaattcctcctaaatctttcaaataaaatcaatttaatcatatctatagaacactatatttgtacaatattaatttaaatggttatttaggttaaattattgtaaaacttattatttttatataataaaaagcaaaccaaatatttattatgaatactttaggtttgcttttattaaaataactatattattttatttgtaatcatctacatcaaattcattatttttataataatattttctatcttcttcagtaatttcacgaataactctgcatggatttcctactgctataacattatcaggtatgtcttttgtaacaacactcccagaaccaatcaccacattatttccaatagtaacacctggattaattacaacacttcccccaacccatacattatcaccaattgttaccggaattccgtactcatatccagagtttcttgattgtggatgtattggatggccagctgtatatatagatacattaggtgcaaacattacatttttccctatagttattttaccaacatcaagcattatacagttataatttgaatagaaattttctccaacttctatattacttccataatcacaacgaaatggctgttcaatatgaatttcttccccagtttttcctattatgcttttaataatttttttcatttcttccttgttatcaggtctgcataaattgtaatcatatactttaagttttgtttccattctttcttccgaaagtccatctaaccacgctttatatggaagtccgtttaacattctttctttttgattcatgttatatccctcttacttttttaatctttttgttttaattttagtttttttattaaaccaatacaatacatattttaaactattgtttatgcttttataaatactcctgcattcagaaattaattttcacatctatcttaaatatactctttattactttcataaaccttaaatattcgagttatcatcaaataaaataatagctacttcacaagatttaagattaatacttccatcacaaatttctttatttctcacattagataataataatttacctgtattattttttagctttaacgttgaatcttctttcccaaaattagcaacaatcaatatagatttatcattattttttctataatatgaaaaaatattttctttatctaaatattctggttcaaaatcaccataagtgaatatttccttatattctttacattttctaagtgctataagatttctataataatttaaaatagaattgtcgtcttgtttctgtttttcaacatttatatctatataattaggatttactttaagccatggatttccatctgtaaatcctgcattcaataaattattccattgcataggagttcttgaattatctctgctttttttataacataccttaagcgcttcttcttcattcaacccagtctttaatgccatctcatattgatccttagtatgaatatcatcatattcatctatactatccattggacaatttctcattccaatttcctgtccctgataaataaaagggattcctcttaataatatacttacagttgcaagcatttttactccctcatcattctgtgcgtaatctggaagatatcgtgatgcccctctaggttcatcatgattttcaataatattagctagaaatcctttaccaatagattttctttgtgattcaaatatagtattcctccacgaattaaattcaatttttttagcatcataccatccatggtcaccatgatttagtacttcagctgaaaaatcaaacatggttgaaaaatgtccattttcacctataaattcttcgagttcttcttctttattattaaatacttcagcaacagtaaaagcattatacttttcaaaagtttcacccttaagctcttcaagcatttctcctattccttctacttcctctaccattttagctgcatttacaagtccatcttcaccgtctggctcataatctggaaaacttgtatctttcttaatattcataatcgcatcaattctaaagcctgcaagtcccttatcaagccaccagtttatcatttcaaataattctttcttaactttttcgttattccaattaagatctggttgctcttttgcaaataaatgaagataatataaatctgttccttctactggctcccatgcacttcctccaaagtaagatctataattacttggtggattaccattctttcctttttcaaaatagaaatattctgcatattcaccgtaaggatcttttagtgctttttgaaaccattcatgcttatctgaacaatggtttataacaagatccattaaaatatttatatttctctttttagcttcttctaaaagttcatcaaaatcttccattgttccaaattcaggtgcaatactgtaataatctgaaatatcataaccttgatccacaaaaggtgatttatacataggtgaaatccatataatatctattcctaaatcctttaaataatctaacttttcaataatacctcttatatctcctataccatctccattagtatccttaaaactttttggataaatctgatatgctaccttatcatgccaccattcttttttcataaaaaaacctcccctcaatatacttctagtatatatacttttaggggagatttcttatacaatattgataaaatattatgttattttgacataattatgttttctaaaatttattgaatctaatctatatttttaatattattctacattagaattctttgttagtttattcaattcatctatagctgcaacaagttctatttcatattcttcatataaatcgccctcatcttcacctagctgctcttcataaaatcttattaatgatctaagttcatctactctactcacacacttctccttaaagattttttgctgcatttaatgcagcattatagtctggatcacttgaaacttcactacagtattcaacatatgtaaccttattattttcatctattacaaatattgatcttgctaataatccaacttcttttatatatgttccataatttcgtccaaaatctctattcttataatctgataatgttgtaaccttatctactccagctgctccacaccatctaatttgtgcaaatggtaaatccatggatataacataaatatgaacaccatctaacgaagatgcttcttcattaaattttcttatttctctatcacatacaggcgtatcaactgatggaactacaacaaatattctctttccttttgtatcatttaaagttacatttgccaaattattattagtaagattaaattctggagccatatctccaactcttacatcattatctccaatagtaacatttttacctttaaacgttatgttcatataaatcactcctttattatttatgaattctatttcgtatacattacaatatgtatattcccctcttcgtatatttttacactttattttattttttcattagatgtgtggatactaaagcttttaaatgaatatattatttcttcggttgctcgtctggcacctctatatctaaatatattattatttaatagtaattattatgtaataatatagatatattatatcagtaaaatttatatttgaaaataatattatttttaaatataaattcatctgaagtcttcacaaataatatcagctaaaacctttgttccatttattattatagatacaccatttcctggatgtgtagatgaaccaatgaaatataatcctttaattttttcagattttatatgcggtcttaaatatatgtcctgactaagcttatgacttaaaccaaaagcatttcccttaaaagcattaaactttttatcaaggtcatctggtataagataatcttcacattcaatatgcttttctatatcttctaggccttttatatcagatatatgttttattattacatttctataattcataatatcttttctcgtccatttgacagtttcaaaagataaatttggtaccctaaccataatattaagaactgattttgatttgctacataaactttcatctacagcactaggatagtacatataaattgatgggttttttgaaagggttccattaaaaggatcttctatagattttttaaaatccttacttatataaatattatggacatttaatacatcatattttttattaagtcctaaataaatcataaagacggaacatgaatattcctttttatcaatacaactgtttgtgtaactcatacctaagctgtatcctggaattaattccttaactgcataaggataatcagcattgcatacaacacaatctgcctcataaaatatttttttagttcttacacctgcaactttattattttttattacaatttcttttacctgactatttgtttctatttgcccgccttcttcataaattaacttttgtaatgcacatatatattgataaagacctccctttatatatgaaagtccataagcatgagatattgctggaatcattgtataaaggtttgtattcttatatggatttacccccatatacatagcttgaaaaattaaatactcgtttaattttctattatgaatcatactagataaatatttatttgaattttcaagaacatccatctgtagtgctgattttattgaatttacattgagtatttctttcatgtttagcattggcttgcaaagaaaattattattagcaatcaaatattttttcatggttttataaaaaaattcttcatactcttgagaaagtccactttcaatactttcaagaacatcatttgttttttttaagtctctatagaaactatattgggtcttatctgcatagaaaacattatatattggctctaatcttatcatttcaaaataatctttataatttttacctaaatctttaaaaatatcagtatatactttaggtgtcatcaaaatacttgctgtaagatcaaaattaaaatccttaatttcttttctattgactttgcctcctactgttggctctttttctagtatcgtaactttaaatcctttgctaagaagtcttacagcactgcataatcctcctatcccacctccaacaattacaatattgttcattttgaatatcccctatcataaagtaatttaattattagaacactataaatcctacgattccagacaataccgccaaaagtataggatccatcttaaatttataactaagtacaaatgctgaaagaaagataataaagcttctaaaatttgctgtaacatcatccataagcataattgctgctgctgcaattaaaccaactgcacacaatcttatgtattttaaaattccttctgcatatttattattttttttcttcataaaaagctttgctattataaatattattattatagaaggtaaacttactcctaatgtggcatatacagaaccaattattccacttgttttatatcctacataggtggctgtattaatcgctaagggtcctggagtcacctgacttattcctataatattagtaaaactttcatttgacatccatctattaatatcaactacttcctgcttaattagaggaagcattgcatatcctccaccaaaactaaataatccaattttaaagaatgtaaagaataatctgattaacatattattttctccttaaaacatctataacccctatagctgcagcacccaaaattacatatataggtgtaatcttaaatatagcaaccaaaactgctgctaaaagaggaattataaaatttttcttattaacttttgcagttttccccatacttattacaggtactgctattagagccactacagctggtcttattccttgaaacactctttgaacaacaggactattttctattcctaaaaatactgatgcaactaaaattattattataaacgatggcaatattgcacctaatgttgatgttataaaaccaactaaacctttcattttttgtcctacaaaagcacttatattaactgctaatggtccgggagctgattgagaaatagctaccatatcaagaaattccgtttcacctatccattttttcttttcaacaacttctttttggattattggaagcattgcatatccgccccctaaagtaaatgcacctattttaaaaaatgtaataaacatatccattaaaatcttcataaacttctccttaaattactttgatataattactatacactctattataattccaaataattaactttttattatttattaaatgatcagaatttctaaaaattatttttccaactaaaaaagatgtactaaataaattcaatacatctaaaaacttatattctactgttccaaagctccattttcatttacataataaccatcaacccatgtatttgatgccattttaccatctgaataattaaaatagtaccaaactccatttattttcttccatccttttctcatcattcctgcaacaccatcatcatttattgtattgaaataataccaatatccatttattttttgccatcctgacttcattattcctatatttgaagtattactttcatctagataataataagcctcatttaaatcaataaatccagttgccattgttccatcactatagaaataataccagtttccattattgcagaaccaagatgtcttcataaatccttgtgctttatcgccttcactctgtggattaaaataataccaatttccattaatagattgccacccagtttttaaacttccaaaatcatctcctgaaccctgtggatctaaataataatacgtaccattaagatttataaaacctgttgcctgtattccattgctataaaagtaataaagccttccatttaaactcatccatccagtctgtatgcttccatcaggtttcttgtaaaacctattaccattataactattccatccagcttgtgctctaaacatagtaagtgatggaatagaatactgcaattcatgcttaacctgttcctgtactttatagtatacttcagtattaccagttaaattagtattctcatcaaacacattagttccaatctgactcacactataaggaatatatatatctgaaatctttttacatccatcaaaagcacttgatcctatagattttaaactttccggtaattgtatgcttgataaattctcacatccataaaatgcgtactggccaatttccttaagtttattacttaaaataattttctctatattattatttctttcaaatgctccatcttcaataattgttacttttgctggtatttcaactgagccgctagctttacttccatctaataaaacattacctattatggctaatccatcattatttctttgtttttcaagccatggtgtatttgtaaatgcccatctccctatttgtagtgaatcacctttaaaatcaacatcagttaattttccacataaaccaaatgaattggcatctattttttttacagttgacggaatagttactttctctaaattatcacaccctgtaaagcagtctcccccaattgactctactccttcttcaataattacttccgttaagttttcacaaccattaaatgacatgttacttatttttttcactgaacctggtataacaactttagttattttatcattattaaaaaacagctgttcacttatttcagccacatctgatggaatatctacttcaccagatatatcttcatctatacttttaagtactccattttcaatataaaatcccttatttgatttatctgatgcaaatacttttacattggtaaatatacttgaacatattcctgcaatcataatacttatcaataatctttttctttttatcattatttcccctccaaattataataaatatatacattgtatcaatacagtttattttccagttttaggttcttttttctatattcataaaaaaataatgattagcaataaattaatcattattatataaagactattctaaaattttataatcttctaaaaatcctgtattaaaatccccacttctaaaaattttattatccatgagtcttctatgaaaaggtatcgttgtacttactccagatataataaattcatcaagtgctcttttcatcctttcaatagcttcttctctattccttccccatgatactaattttaatatcattgaatcataaaatggcgggataacatatccactgtacactgcactatcaactcttattccaatcccacctgaagctatatattcatcaattttccctggacatggcataaaattattgtaaggatcttctgcatttattctgcattcaattgcacatccattgacttttatatcatcttgtgaaaaagataacttctttccataagagaccagtatctgttcttttattaaatctatacctctaaccatttcagttacgccatgttccacctgtatcctcgtattcatttccatgaaataaaaattattatcttcatttaataaaaattctacagttcccacactattatatttaaaagcttttgatgcattgactgctgcctctcccattctctttcttaaattttcatcaagtgctggtgatggtgactcctcaacaagtttttgatgacgtctttgaattgtacagtctctttcccctaaataaactacatttccgtaattatcacctattatttgtatttcaacatgcctcgtatgatttaagtacttttcaagataaacagcagagtttccaaaataactatcagcttctttttcacattcccttattgcacttataagctcatctttattttctgcaactctcattccttttcctccgcctccagctgatgctttaactataacaggatatcctattttctcagcaacttttactgattcatcaacacttttaatttcaccatcactacctggaacaataggtacactcgcttccttcatggtttcctttgcattagacttatcccctaatttttctattatagtataatgtggacctatgaaacatatattaaattcttcacaaaattttgcaaaacttgtattttccgaaagaaatccatatcccggatgtatagcttctgcttttgtatgaactgcaatattaattatattatttatgtttaaataagtatctttaggagatgattttccaatgcagtatgcttcatctgccagttttacatgtagtgaatttttatcagcttctgaatatactgcaactgtagaaatcccaagttcattacatgcacgaattattctaactgcaatttctcctctattagctataagtatctttttgaacattttatcaccacctattatgtttctattatgcttttatgaattttaagaaatctttatttcaaacaaaggttgtccatattctacaaaatctccatcttcaaccaatatgtctattatttcaccattgaccccagcttctacctcattaaataatttcataacttcaaccagtcctactacagtgttttcatttattttttcattaagccctacaaatggttctgaattttcttcttttcttaaataaaatgttcctgcaagatttgattttatataatttttatctattttttcttcattattaattagattcttttctttctcatttctgcattcattaataactttcatctcactattattagttttatcaatattaaatgcaggttttaatagttgcttttcaataactattctgctatcattctgttcaaattcaaaatgtgatatatcatgtttttcaactattttaattattttttctaaatcttctatttgtatcattttaaattcaccacctatatgcttattagttttatagacttttttaagtcttcaatatatttctctctctctaaataaagatcttccgctttttcaattgttattcttttaaatttaatcttttcagaaggcttacgctgaacaattctttggaaatcataatatatgacacgagctatctttggataccctccagcagttgctctatcagctaataaaattattggatttccatctggaggtatttgaattgtcccaaaggatacttctcctgatatcatttctatatcatgtttaaattttatttctggaccatttactctatatcccattctgtcagatttactatctattacaaattctgaatcaaaaaatttatctatactttcatacgacacatcatcaaactgtctatcttctaaaactcttatttcattattctctgaatttttaaatatagcctcttttatataccattttggataagtaaatgcttttttacttttcctatcaaataatttctttattatttttttagataagtcatttttttcagaaatatcaatttcatcaccattttttaatgctcttccatcctttccacctatccctcctcttatgtatgtacttttactttccataataagtggtatatcaaatccaccagctattgataaataagctctacatccgtatatacatgctccaaatttcaatatacaatcctcattcaaatatactggtcttcccataggaactttaattccatttatagttggagaaagatctgctcctgttattgatattagatttcctttttttatttttacctctggtcctattaaggtgatttctaatactgcctcattttcattatttccaacaattatatttgataatctcatagaaaaactatccattgccccacttacaactacaccatatttttgatatccatatcgccctttatcttgtattgtagttaaaagacctgcttttaaaatacttatactcatgatattttctcctttattttaagatactcatcataagaaattggataaaactttgctatatctccacactttaatagtgttttattctctctattgatatcaaacaacttaataggtgtttgtccaattatctgccatcctccgggtgtttctataggataaactcctgtttgcattcctgcaattccaactgatccttgtggtataactagccttggagtactttttctcggagtgcataacttctctgacaatccacctaaatatggaaatccaggcgcgaatcctatcatatatactagataccttttatccgagtgaatttttattacatcatctacagtaatattatttacttttgcaacatgctctatatctggtccaaattcgcctccataatatacaggtatctccactacattttctttataatgatgagaaaaatcaatattcaataatatatcttctaatttttcctttacaaatttaaatgattcttttccttttatttttaatggatcataaataagtgacacactagaaaaatacggtatatactctacaagtccataaaatgatttcatatcaagatattcacaaaatattcttatccttttatttatatcttcacttattttatttccaaattcaattaatgcacaattttcactaacctgtactatatcaaaatttaattcttccatgatttatccctcctatctaaattaaaggtaaatcctttttaatataataaaaaaatccataactacagaacaaatttagactccattgccctgcaatcatagattacattttaaaattatttatttttgttgattcattatacaatattactcaattccgttatttctatattttcatttttgaaaacattatttattttttttacaaattcaagtgaccttacaccatctccatgtacacatattgattctgcatttataggtatatctattccatttatagtttcaacttttctttcttttatcattcttacaacacgatttataacttcattttcatccactattactgcaccctcaatattccttgaaactaatgatccatcatcattataagccctgtctgcaaaaacctcactagcagatcttaatccaattatcttagcggcttctaacaacttacttccacttaatcctaacaaaattaaatctgaactaatagattttataccatcacatattgcaagtgccaaatccaaattattacctgccatattataaagtgcaccatgaggctttacatgcttcatttgtactttatgagcaatacaaaatgcatttaatgctcctatttgatattgaaccatagtcttcgcttccaaacatgaaacattcatatttcttcttccaaaccctactaaatcagataatcctggatgtgcccctactgccacctcatattcctttgctaatttaacagtcttgtccataactaatggatctgaagcatgaaatccacatgcaatatttgctgatgaaatatattgaataacctcttcatcacatcctatcttataatttccaaaactttcccctaaatcacagtttaaatctactctatacatacttttcttctcctgattataaatatataaaataatttttaatactttaaactactattttttatatccgttataagcatatgtcctggtgcatgtgttattactattttaggttttacattcatgattactgactgaggtgtaacaccacatggccaaaacacgggcacttctccttcttttattgtaactctatcaccaaaatgtggtttatttatatcttttattccgattatatttggatctccaatgtgtaccggtgctccgtgaacctttggcatacttccacttataagaacagactttactatttcactatatggaagaggtctcatacttacgaccattttaccattaaaaatccctgctggaacacaatcaatatttgttatatacattggtacattacatttttcttctatatgccttattgtaatattttcttctaaaagatcagattcaaaagaaaaactgcaacctataagaaagcttacaaagtcatctctccaaaaatcttttatatttgtgtattctcctgtcattataccatcttcataaactctatacttaggtatatctgttgttatatcaatatcttcccctaaaaatttcattatcttatcgcccacatcaccaacttcaagtattggacatgattttggatttctttgagtaaataacagaaaatcataagctaattctttaggtaatattacaagattagcttgtgcatacccagcacacattcctgctgttggttcaattatctcttcatttcttattagtcttctaacttcataaggattcatttttgaacagtccatttgctcatctccttatattatctttttattttcatatacttcattaatctgatcttcataaaatcctagttcaattactttttcaaaccatgttgcacaagtctttctaagctccatcgctgattttatggtttctctcatcaaacttactattgaagaattcatttccatgcagcatccatctattgctggaatcaaatctccatacatatctatcattccacttcttgaagctgttttaattacctcttcttccatttcttttgtatgcataatatttaagtcatcctttaaataagctaatgctgcaataagtccatagcatccccagtctgaaactgttgctgttataatgttatcagcctgtacacttgcggctatacctccattacatccacacttacatcttcctttggctgcatatggaatatattcatctaactgctccttaagtgttcccatacctatttcatttccaagatcacctatagcaatatttaaaactcctctttctttaagtttattaaataacacatcttgttttgcctcaagttcagttacatcaagaccaaccgcattgtgatatacaccttttgaattagcccctggacactcaatacttataacagctgatggcactccttttttaattaattcttcagcttgatattcagctctttctgaatccttagtaaattcaattgctgctattgataatggatattcatataatccttcaattgtatcatgaaaatgtatccccacagcatatgctaagttttttaccgcttctatgttatcttttgggcatattattactggcttaacgccaaatccctttactaaggctcttgctaaaagcattgtacttacaattccatccatttcagctttcttaaatggtctcaatacaaaacctgtcattatataaaccatatccccatcttttaatgtatcaacaagtttctttgcactattagttgaaaggggttctccagtatattcccttgctgcactatataaaattctgcatacaccatatcctcgtggatctaaattcattaaactatctaaattttctccaatattaaaaattgtaagttcttcttgattcatgattgatcctccttttaacaaacactatattcttcaatatctgtatcatttaaaaattcttcaagaagtgaatcttgtaattttttaataatttcaggagcttttcctccaacggatttcccattaatctcacatgctgccatgcagaattgtcctgaacttgtgacaactacttcatcagcattcataagctcattcaaattaaatggtgtttcatctacagggatattaaatctcttacacatttttattaaatgtgccctagcaatcccaggaagaattaaattatctgttggtgcggtttttaaaataccatctttgattattgaaacattgctgtgtgcacattcagttactctttcacctctatgaaatacagcttcatcacatcccatttcttcagttttctgtgctgccattacacttggtaacaaatttaaagtttttatattgcaatgcaaaaatcttgtatcttcaagtgttattaattttaatttatgtgacatatcttttatatttaatggtttcaaaattatccataaattagccttagcatcacctttgggaaaagcgtgatttctcatttctgttcctcttgttatctgccaatatacaaattgttctccacaatcaactttcttaaccatatcacaaagtaattctttaagctcactctttgtataaggaattttcatctgcaataaacctgcactattaaaaaatctatcaatatgttcatctagagcaaatatcttgtgatttctgctatatgttgcatcatatacaccatccccaaagtaacataccctatcattcataggaactttcatattctcaattaaatcatactctccattgtaataacctaaatttttcattcttaattcctcctatacaatacaacttattaaacaaaaaaaacacgcatttattagacaatacatttttgacaccattgcctaactatacgtgtttttatatctttttttatttatgaatacatcttacatcacgattctaatattttcaataaataattaaatttagaaattatttattttttataatatataaatccaaaattttttctgtattttacattgtattatggaattttttcgttatactaaattttttattacaatctacagtgaatatttttattctagaatcccctcttttacattttttagaataaagtgtgtcttagttcccgaaacacctccaagacatttaatttctctgtgtattttttctaattcggctgatgacttgcataaaattttaatcataaaatcgaaatcacctgtgagataatagcaaaaaactatattcttatttgctctaattgcatctgtaaatgaatcataatattttgggtgatctaaacttacctccataagagcacttgtttcattccccagttttgcttcatctacaactatagtaaaattttttattactccgttcttctccattttatgaattcgttcaagaacagcagaaactgataaatgtatctctttacttatctctgacgcttttactcttgaatttttctttaaacactgtaatatcatattatccatattatccataatacatcccccaattattgctaaattttctttattaaaattataaactcaaataatttcctagtctatatttcatattattttataaaaaaacaccctactgtctagaattgtcaactatctgctgtttagcagaaaagctggctgctcattcagtaaagtgtctttttattatctataatttactttgacattccaataaccattcctattacatatggtataagccatatcaaccatactattatactaaatttatggaaatctctctttttatcatcatcatttttcttcaatacataagtagcccatactgcatggaatatcataagtacaatagctgcaaatccagttattccatgtatcattccagcacttttacttatcactacttgatttttcgctatttgtcccattaaaaatgttcctgtagaatcacataaaagacctagccaaaaaaacaaaacatgatttttattaagacttttagctcttctttcactaaatactcctatagtgtaaaacacaagagcagctgttataaatattattgcaaaaattaattttccattcattttatttagtctcctttatcccatctcttaatttaatcaaactattttttatctctttaatctcatcataagtaaaattttcaaaaactttatcaaaactgctgtttatttcttttctgaattcttttgcaaattcaattcccttgtctgaaaatgtaacatatgtatttctattgtcatgctcatccttaactttctttacataacccgctttttccattctagaaactattcctgatacagtcccctttgctaaagacatttcattacaaagctgagatatattaacttttttattatgagcaataagttttatcaccattatttgctgatttgttaatccacttccttttaaacttttactcactacagccattgtatctgagtaaatttcttttatgagcattgatatctcaaaagactcttctttcatttatatttccttctctcaataattatttataataaaaaaattgccaaggcgactatgttatatcccatatactaaaaagttagctttaataaaattaattttttaataaaacaaattctttagaactcttaatttattaatacacgtttttaatattacaaagttattcacagatttcactgcaatataatttcctaaagaataaaaaaaatagtttgcatagatactttttagttcctatgcaaactattctattctatattttaaaattattcaagtggatttatatttaagttttgttaatattatacgcttttttcaaaattgtgataataaattaaatattttaataacatatcacaattataaattcaattaactatataaatagcctattttttatattcttctgccaattttttaaataaaggcaatgatttcttaattgtttctgtactaatgcagtatgatgctctaaaatatcctggacatccaaagtcccctccgggaactaataataaatcatactttttagctctttcacagaatgctacttcatcatcttctaatgcttttgggaaaagataaaaagcaccacctggattagtacattcaaatccagcctcaattaatccattatacagcaattctttattcttctcataaacagttatatcagaaggcatatctgcacatcttgcaactactttttggaataatgcaggtgcatttacatgagttaacactcttgcagcgcctccaatacttgcagatatcatattaaaatctacaatttcatctggaattacaatatagcctattctttctcctggaagtgaaaatgatttactatatgaataacaaactaaagtgttatcataatatttaggaagatatggtataagaacattattatatgcaacttctctatatggttcatcggctattagaaaaattggatgaccatattccttttctttttctcttaataaatttgtaagttttataattgtttcttctgaatatactgccccacttggattattaggtgaatttactataatcccttttgtatttttatttatcatcttttcaaattccggaaaattaatttgaaaatcatctacttttgctggtacaacttttaattctgctcctgttgattcaacgaagcacttgtattctggaaaatagggtgcaaaagttataaattcatcattttcttctgctaatgctttaaaacatatagttattgatgccgctgcacctgcagtcataaataaattttttccagtaaagtttgttccaaatcttttattaaggcttttagctaaaagttctctacactcaggatcaccttgtgcaactgtatatccatgtatactgcaaggatcttcattttgtaatatatctatcattgtttctgtaataaactttggagttggaacatttggatttcctaagctaaaatcatagatattctcttccccaactacttttgctcttgccctaccatattcaaatattgatcttattgttgactttttacttcctagttcatacattttttttgatatcattactgccactcctttatttataaagtaactaattatagttacttactaatcttttcatatactaagtattgcttatatttgtaacttttttaattatcctataccaccataaaatattcctagaatataaactattattgttaatccaacaaatacatattttgttagtggttcaaaccattttcctattggtttattgtgtccaatttgaacttgatcttttgcaaatccctttgggcatacccagaaaaacataactgctgcaagtagtgctcctagtggaattatgtatattgatactatatccatccaattacttactgtatctccatcttcaatcattatacctacaataattgcaataactgcaattattcctactgaaatctttcttgatactccaaatctttcttgaatagactctataggtgcttcaaataaatttactagagaagaaacagccgcaaataaaactgctaaaaagaatagaatcataaacagatttccaaatggcatcatttgaaatactttaggcatggtaataaacataagggctggcccagctgatggatcaagaccaaatgcaaatactgctggaataataacaagggctgcaagcattgctgcaattgtatcaaacacagccacattccttgcacacgatactacatcttctgtcttttttaagtaacttccataaacaagagttcctgaccctgcaattgatagtgaaaaaaatgcttgtcctaaagcatacacccatgtttttatgtcctttaatgcattccaatctggtttaaacaaatattgataacctttatctgaaccttctaaaaaacctactctaactgccaaaactataaatagcataaagaatataggcataataatcttattaactttttcaattccatttgctattcctaatatcataaagataaatactaaaaacaatccaaacatatgccatggaacacttccaaattttccacataactcgttaaaatattctccagaattacttttaattaatgaacctgtaattgaacctactgtaaatttcaagatccatccaactacaacagaatacccaatagcaattgctaacgatccaagtgttggaataagtccaatcacttctccaattttacttccacgtgattctgttgcttttctaaatgcccctatgggaccagactccatagctcttccaaatgccatttctcctgttacaccagcaatgccaatgataattacaaataaaaaatatggtattaaaaatgctgcaccaccaaattgacctgttctataaggaaaaagccatatgtttcccattccaactgctgatcctatgcacgcaatggtaaatccaagtttactattaaatgtatctctttttctaattttagtcatattcatctcctatcagcttataataaatttttttcatgtccttttacaaaactaaatatagaactctataatataaatttacaaaaactattctttattatattgtattaaattatcaaaaaaaatcaaatttttttcagaatttaataagaatttatataaaaaaattagaggtaaattaaataaattcatttaatttacctctaatttgaatttggactatcgtgcttgtaaaaacttttcatagttttcaatcttatcctctctgttagttcttcttaaccaatcattgtactttaagatatcttcttctacattttttaattcaagcttattatttcttttccttttgttttcaacatacatatttatttttattatattacccattatcttctcacctccctctatataatactatacaactcttttgtgtcaatttggtatcaaaattacatttttttaaatttatttttttgtattcgtattctttaaattaacttatatgaaataacatataaattttccaatatatcaaaataataaaaggaacatttaactttctattctacatagtatccacatctgttgggaaaaatagaaataattcttataattatttttattaaaggtgtgtagcatatgataaagaaaatattaattattttattgtgtagttttacaataatgaattcttccgtagtcccatcatattcagtcagttttgacaaaacttttatatcttctttatataatgaggataatgtaaattctgattataaaaccgtcatgaaacaggatttattaatattaatgattgcttatccccaatatatacaagatatattatgtgaaaatgataatgtatatatcgttatgaagagtggtgcaaagtttatatatgatgataagaaaaataaaagttctgaagaaaaattgtcaaatcctgaccttcaagatatgttagaagatatttatcctttaaacaaaacaaatgaaattatgagcaaagattttaatcctggaagaataagacactatggattattaaatgaagtttatggctcctcaaaaagttcagttgaaaagaatttatgttcattaaagtacggatatacaaattatcaatttaacaaacaaaataacgctaatattgctttagaaaatacattaaaggaacttgtacctttatctaaaaacaatgataaaatagccgccatactttatcctgcaagtggtacatataattatagagtaatttcaggaactggtagattaagtccccatgcttatggaattacaattgatttaaaaagtgataagcgtgattactggaaatgggcttccaaggaacaaggtgaatcacgaattcgtgaatatccagaagaacttgtaagtgcatttgaaaagaataactttgtatggggtggaaaatggggatattttgatattttacactttgaatacagaccagaaataattcttaaagctcgatatttttctcaacacgataatgataataattggttcgctggcgttccttctgaagatagttatgttaaagaatgtattagcttaatcgacagtaaaataccataatttgaaaagaggtgctgaaatgttgcaatataaaaactgtcacataattattttaaagaaattcatctctattttatgtatttttttcagtatattttatattttatttaatccatcagtaacatttgcagatgagaacgatgatgtaaaatcacacgttgaaaatatatttttaatacgcaataaggctatattaactcaagaccttgattctattcaggcattatataatactgatataaaatttggtcaatgggcatatgaatatgaacaaaaaaagattaaatatataaataactgggcagaaaaacaaggtgtcaaatttattgatataattccaaatataataatcaaaaaaatagttccttcaaaaaacaaagataaatattctttatacataatgtgtaacactgaatataaatatatatatccagatgatgaaagcaaagtgaatagctctagaatcggcacatatcattccatgcaactttctaaggaaaatgatgaatatataataacaaaagaatggtatacagatccatttgctgattctctaagtctagagaatattaaagcagacaagattaaagaatttataagttctcaaccgcctagagatatgagtggaataggtgaaaggcgtttagcttctattgattatgctatgaaatattgtggcgctgcaacactggaagaatacgaatataaatataataaagactataaaaatttcaactgtgagggcggtgattgtgctaattttgcatctcaaattctccatgaaggtggaaaattcaaagaaacatcagcatggaattatgataaaggagacgtaactggaccttgggtaaatgcagataaatttacttattatatgcttaacagtggcagagcatctgtaattgcaaaaggaaattatgaaaaagtatataaagcttcttataaacttcttcctggtgactttgttgcatatgaaaaaaagggagacataacacatatttctgttgtaacaggtgcagattcaaaaggttattcccttgtcacatgtcataatactgatcgaaataatgtaccttgggatttaggatggagtgataaaaaaataactttctggcttgttcacgtacattattaatatatttatctatattttaataaaagagataaagtatacactttgaactaactataattaatcattatactgttcaaattataactttatctctttttatatatcaatatattatttttttctattcatttactgttggtagagaacttaaattattattttcattctgatctggaagacttcttaaatattcttcgccttttttagatactcctactgctactccatttatgcctccactttttgctaaagtaacaccttcatctttagataaacgtgttccatcttctaatatatatcctgtaacctctccagaatgtttaattaaagaagttatattctgcgcatcagaatttggtgtaggcacatctttattaatgtttactggcatatttccaatcataccatcacttttattatttgaactatcataactaattggtggattactgtatgtaacatctgtattatttgaatttactttcatatctggaattccacttgtaacactacttacatttaatgtatttttattttcactcatataacaacacctcttgcaataatatttaattagtactattattttaaccattcaaatttctttaattctacattaacaaaatttctaatcatttatatagtcatcattctgaaatttctgtttgaaacataattcataaaagacattcctatttactaatgaaaacatacataaaaataaaaaaatcacaagaactattatactaaattagttcttgtgattttttcagtaattattctattcgtaatagcaaataattggcgttcctgcttcaatattttggaatatcttttcagctacttcatatggtgcatttacacatccatgagaaccatttgtcagataaatctgtcctccaaattctgttctccatccagcatcatgaattcctatattattattaaatggcaaccaataattaactttagattcataatcttcaccttttaatgtggcatttctctctttataattcaatcggtatgttccaactggagtagaccaattattggctgcatttcctgtaacaacatccccttctactattaatgctccatttttataaaaccatatatgttgctttgtcatatcaagttcaacatatgtatttccaacatcatctttttctctagatatggcttcttgagagtaaactggctctcttgtaactttttcgccttgctttataacttcaattaattgttttgtttcctcaggtttattaattatccagccataattcccccctgaaacttgtatttttttatttgttgatgttgtaaaatctcttgtattagaataagtattataatttcgtgctaatgattcaacatactgtcttgcatgattttcatcaacagtaacttccatattatcatcaacattaagccatttgcttattgttgatccatctaagacctcacttctactaccaaatgtatatgtaatctttgaatctgcaattttgtctaatgactttttagcttcgtttacttctggcgaattttcagtatatttaggttctacataacaacctaattcatttaagtctataactgtatttccatctttaaccgcttctgaaaccttattaactaaaacttcctcatcaattttacttcctttaacttcagtaactatattaaatccgtcatccccatattcaaaagttggatttttaggttctattatattttctttatcaaaaaaagaagaattatcaatcttatcttttagtagatctttatcaaatgtaactaattgttcatttgtaagttcgtttttggtaaataacgatgctatccataaaaatggattttgactttttttgaaattttcaatcttatcaccttgctcatattctaaagcaatatctgtacctttaatttcttccgaaacatcatttctaccttgcaacttgagcgtatatccagatatctcatcagccagtaatgcttctgcctgcttaacagtttttcctgaaacattcacgtcatatatcgttgaaccaaaataaaaatgattcataaaataagctgatattcccagatacattgctattaaagggcaaagggacattaccatgatttttgcaacctttttactattatcttttctatgtcttctcattttttgtcttccctcccgtattatatacaaacttaacttgtaaattttgtcccttttcatcaaaatttatatatttactataacataaagacaataattttaacattttattatttcagcaaataatgcaactaatgtgactttttacatgttttcttttgatattatcatattctattaatatttataaataaaacagagtatatcatatactctgcatcatttataaaatatgttttgttatattactaataaagttttcatcaagttttttacttgaccatatataatattctctattattttttctataaattatcccttcttcttttccatcaccataattgtctgaagatattttttgtttctcgtatccactactcttgtctgaattactttcttctttattatatattcttatccacaaatcatcttgattatttgaatattttatttcaatttgattttcatcaatttgatttatataatccacattgtatccaatatcacttaaatttggtccattatattgtgacaagtattcattttgtattgacattccataagatgctgcctttgttttattaggatcatgtatttcgttattatttacattatcattactactttgcaattcactactactgacagcttgattattatttatactatttggctcgtcttcttttttagaaacattattattagattcatttgccttatcgcttacttcttttttgtttgtattactatctgatttattttctttctctggtgcaacctcattgttttttatatctaaacttttttcattattattttcatatgttttattcttatcttgtgttttattatctgattccttattttcagtttttgtgctattttctttcacactattttcttttgtactatctgatatattattactgtcctcttttactaaaggtacatcattatttttctctgatgaactttggttttcttcactatttaaagtatgttcactttcagtttgagatgattcatcatgattcactagttctggataattaattgttactgcatatgttactgcaaatgcgcaacaggctgcaacaactccgctatatttaaaaaacgcttgtccttgaaatagtgattttttatttactttcgtttctacttcatcagtttctctaattctattcataactctctttttcatatcatcatctacatgaatcttactcatttcatctttatacctattcctcaaaatcatatccctccttaagcattttttttaggatatttcttcctctatgtaataatgaacgaatggttgattccttcttattaactatttcagctatctgtgctgtcgaataatcttcataataaaataaatgtataacttctctatactttaagggtaatttcatcacagcttcaataatatcatcattcttgtattcatcgtaatatggaagttctatcaattcttctctacttttaaaccatgatgatttaagtttatttttacacatatttcttgttactgtaataagccacgatttcttatgatcattaccttgaaatatatcaatatttttcataagctgcacaaatacatcttgcaatatatcttcagcatcatgaatatttttcatatatgaatatgcaagtcttaaaatcatatcgccataatcatctaaatcacgtgagataatttcatccgtacgcaatgaaatatcagccattaaattatccccctttctataaaatatacaattcaaaaccataaattgttgcaaaaaaaataaattgtatgtaaaaataatataacatacaattcattttaaatcttatattgagtacataatttaaaatcagtccaataacattttaataaaatattatttttaaacttatttaatttcttcataactaataaatctattacctacttaatatttttcttatatttcattagaattttttttaaacttcttaaatttttctacaatctcttcattactagaaaaaaactcatttaatctatctattttttccacagtgtcgctacttattacatgctctatcagttctgtttctgcaagaatttcatctttaacacctatgtttttcaaaaatccagctattatattatgtctgtctaataaatatcttcctataaccctcccttcatctgtcagacttataacaccataaggctcatattttatcatcccaagttcccctaactttttcatcatcttcgaagctgacgaatcacgtacattaagattttgtgctagtttatttaatcttataaatttattttcctcacaacatctataaatcatttcaagataatcttccatagatggtgtaagcagcttcttattcaagtttatattctcataccctcttacagtatggaaatcttttttcataatttactcaccaccaatataatatttatgtgaattttttgtttttatgtgtcaatttttaatcataattcatatgttagactaaagaaaaaaattttcactaagctaaactagtacaaaattaaggagtagataattatgaacactattattaaaaaaactatagacacatcattaactgatattaaattaggacaaaaatgtaaagttacatcattaacagctgaaggtaatattcgaagaagatttttagaccttggattaatctatggaactgaaatcactgcactaagccaaagcccctctggtgatcctgtggcatatatgatacgaggtgcagtaattgctataaggtctgaagatgcatctaaaattttagttgaagagctttaaaccagaaatttataaaggagattaatatgggattaactaatcagtctaccggtgctaatgctttagataaaactcttaatcttacgcgtaacagtaatactaaaataattgctttaggtggaaatcctaatgttggcaaaagtactatttttaatggattaaccggtttaaatcaacatactggaaattggcctgggaaaacagttacaaatgcaacaggaagttatacctttaaaaattttcaatttactttagttgatattcctggaacctactctcttatggccaattctgttgaagaagaagttgctagagacttcatttgttttggtaatccagatcttacagtaatcgttcttgatgctacatgtttagagagaaatttaaaccttgtacttcaaacaactgaaataacaaacaatgttctagtatgtgtaaacctaatggatgaagcaaaaagaaaaggcatatcaataaatattaataaattgtccatgcttttaggcttacctgtagttgcaactagtgcttctaaaggtgaaggtttaaatgaccttatgaattctgtccacaatattactattaataaaataattaatattcccgtaaaaataaaatataaccaagctattgaaaattctatttctataattcagaaagttttaaagccattgttaaatggcaaaattaattcaagatgggtatcactaaaattattggaaaatgataaatccctcattgaatcaataaatatgcatattggttttaatatatatgataatcctgaacttactgattcaattaaactagccaaagaaaatctcattcaaaataatattgatgaaaaaaatttaaaagatgaaatagtatcatctttagtattaaaatctgaatctataagtaaaatggtactgtcagttagtaattcaaaatataatgataaagatcgaaaaattgataatataattacttcaaaaaaatatggacttcctcttatgatattacttttaggtataattttttggattacaataacaggtgcaaactatccctcagaacttctttcaaaattcctattttctattcaagataaacttactgaattatttttatatataggtgccccatcatggctggaaggtattttaattcaaggaatgtacagaactcttgcatgggtaattgctgttatgctgccccctatggcaatatttttccctctattcactttacttgaagatttaggatatcttccaagagttgcatttaacttagataatttctttaaaaaatcaaatgcatgtggtaaacaggctttaacaatgtgtatgggatttggatgtaatgctgctggaatcgttggatgcagaattatagactctccaagagaaagattaatagccataataactaataattttgttccttgtaatggacgttttcctactcttataactattattacaatgttttttacaggaatatttatagggccattcagatcactcgcttctacagttttattaacactagtaatattattaggaatttttatgacacttatgatttcaaaacttttatccaaaacaattttaaaaggaattccaacaacattcacattagaacttccaccataccgtaagcctcaaataggtaagattatagtacgttcaatatttgatagaacactttttgtattagtcagagctatttctgtagctgcgcctgctggaattataatctgggtaatggcaaacataagtataggtgacttaagcattcttactcattgtgcaaattttctagatccatttgcacactatctagggttagacggctatatattaatggcttttattctaggatttcctgccaatgaaatagtatttccaattattataatgagttatatggctacaggaagccttttagaacttggaagtacaactgaattgtataatttgctctctgctaatggctggacttgggtaacagccgtatctgtaatgctattttgtcttatgcactggccttgcagtactacatgcctaacaataaaaaaggaaactcaaagttttaaatggacattaatatcatttcttgttcctaccataactggtatgattatttgctttgtatttacaagcacagtaaggcttttaggattagcttaaaatgtcctaaaataagccatgaatttacttacatataaattcatggcttatttaaattgtaattttaataaataatctaattataattctactattacaggaagaatcataggtttctttttcatttttttatatatgaatgtatcaacttctcgtcttattgaatttttaatttctgcccactgtgttatattattttgaagacagttataaactgattctcttacaatatcttttatatccttcattaaaacttctgaatcacgtacatatacaaaacctcttgaaataatatctggtccacaaactatacttttacctcgcctatctatggcaactactactgttatcataccatgttctgcaagattttttctatctcttagaaccatatttccaacatcaccaattcccataccatctataagtactcttcctgatggaactttgccagtaactactccactttttcgtgttaattcaaatatatctccaacttcaagcatgaatatattatctttattaactcccatactttcagctatacggccatgagtcataagatgcttaaattcaccatgaactggtatgaaaaattttggttttaataaagcctgcattaatcttaattcttgttcacatgcatgacccgaaacatgtatttcttctattgacttatatattacatttgcacccttttcagttaagtcattaattacattagatactgctttttcatttcctggtattggtgatgctgaaattattaccatatcacctttttcaatttgaacatatctatgagtcgatgatgcaatccttgttaaggctgccattgattctccttggcttcctgtagttacaatggtaattctatcattaggataattatttatctcctccaagcttattatcatatcttctggtatatgaagatatcctaatcttcttgctacttcagagattttttccatacttcttccactaaatgctatttttctattatatttcaaagcacaattgctaatctgctgtaatctgtgtacatttgatgcaaaagtagaaactataattcttccagatgcttttccaaatagattttctagtgtttctccaacagtcttttctgacattgtgtatcccttatgaagagcatttgtactatctgccataagcaacagtacaccttgctttccaagctgtgctaatctctgaagatcaataacttcattatcaataggagtaaagtcaattttaaaatctcctgtatgaacaataattcccattggtgtatgtaatgcaattgaacaactgtcagcaatactatgattatttcttataaattcagctttaaaattttcaaattcaataatctcagtaggtttaacttctgttaaagtacaatccttaagcatttcatgatcttcaagttttgtttctataagacccaaagtcaacttagttccatataccggtacatttatttgctttaatatatatggaagcgcccctatatgatcttcatgtccatgggtaataagaattcccttaactttgcttttattttttactaaatatgttatatcaggtattaccatatcaatcccataaagatcttcatctgggaaagctaatccacaatcaataacaataatttcatctttatattcaaaagctgtcatgttctttcctatttccccaagaccacctaacggaattattttgatctttttttgtaatggagaaagcttttttttcatatactttttcttttcattatgtttattttctttatttactactttcttaatagtttcatttttattttcatttttttcatttcctatattacccaacttctcacctctaaactttatcaattaacttattttaacaactctatactattatattaacttaacagtattaaattttaaatacatatttcacttatttgatacttaatataattctcattgttaagttatccaagatacctctaattaatacttataaaaattatatagtatattaattttcataatgagttatatttttctttttcttaaagttatgtatagcagtattattgccacaagactcaaaaataatcttaaatagttttcttcaatatttataaagtcataacttatcattacttctaaaaatattgaaggtatttttcctaataaagttgctaaaataaacatccagccttcaactccactcatggatgctgcaagtgtaacaaaacctgaaggaataaatggcaaaagtctcccttcaaatataatcaaaccactttttatccctctacttttctgtaatttatctaagattttatatttgcttataaaatctgatgcaaccttttttatacctattctataaactagaaatgttatatatcctccaatagtttctcctgcaagggatataaaaaaacccttaactggtccaaaaaaaattatattagcacatgttacaaaaactgatggtagtatacctataagagcaattataatactaactactatagatatgataaatgctatattattatattcataaaaaatagcaatcatattgtcaacattaagcataaaacatactcctattctaaattgaaatataaatacactatatagtacatactttatatttgcaactcagtaatcatgttaaacaaaaatttatatgctataatttagagtacaaaattataattattttaatacaaaacttatatggggtgatttactttgatattttccacattaaaaataaataaaaatgagcctatttacctccagcttgaaaatcatattcttagtggtataagaaatggaaccataaataaaaatagtaaacttccttcaactagagaagtcagtaaatttttaaaaataagccgtaattctgttatttcagcttatgaagaattagaaagtaaaggaattattgtgaccaaaagaggaataggctcttttatcatcgttgaatgtgaaaaaaataatattgaatttaatattaactataaatcaaagattaatgattatggaaagaaattaagagatcttgatattgtaaaaagtgagcttccatcaaaaaagaatatgatttcttttaaatcaattgctcccgaaagccatttgtttaatctagatgattttaaacgttcacttctagatgcctggagctatgaaagcgtaaatcttcttaactatggttatgctaaagggtataaacccctcttagaatatttatcacaatatatgagtgaaaaaagagttcacatggacaataaagatatacttataacaaatggttttacagaagcttttgacattataattagttcactaacagaaaaaggcgatgttgttatatgtgaagaaccaacacataatactgctctgaaaataatgaagtcctatggattagaaatagtacagataaaaatggataatgaaggattaaacttatcccttcttgaagatgcattaaagtctcataagcctaaattcggatatctaattccatcttataataatcctactggaatagttactaaaacagaacgacgtaatgatatatataagctatttatgaaatatgaagttcctataatagaagatggctttaatgaagaattgctttatactagctcacctatagatccaattgcttcattatgtggaaatggaaatggagtcatctatattggaagtctttcaaaaatcctatttcctggacttagaatgggatggatatgtgctgataaagaacttattgatattcttgaaagtgtaaaaagaggacgtaatattcattcttcatttctagatcaaagtactttctattattatttgaaaagtggagcttttaatcgatatttaaagaatgtccgaaaatattataaagataaattttcacttgttatggatatgattgagaaatatatcccttatgagtaccttactggtgaaggcggattacatgtatttataaaattaaaagaaaatataaatacacgagaacttttggatttatgctataaagatggagtaacatttatgcctggagatattttttatagtaacaatgattgcaaaaatactttccgaattggatttggacgtgtaagtgatgaagatatagaaaaaggtatgaaaatcattggtaaaaatatattgaaactaacagatttaaaaaatgaaatataaagttgcaaaaccacctctgcttaaaaatttaatattagtggttctttaataatatggctaattgtattaaactaaaataaagaaaattaattattgacataattttttagtaaatttgaggtgttattgatggaaaagatacttagacccgtatgggctgaaatagatttagatgcattagcatacaacatgaaaaatataaaatcattagctgaagataaagaagtaattgctgttgtaaaagctgattgctatggccatggtgccattgatactgctcctgtccttcttgaaaatggagcttcaagacttgctgttgcagtattaactgaaggaatagaactcagaaaagctaaaataacagcacctattatgattctcggatatactcctgaatatttaggagaagagttaataacttacgatattgagcaaactgtttatagtcttgaatatgctcaaaatttatcaaaaactgctctttcacttaataaaaaagctaaaattcatatagcacttgatactggcatgggaagaattggttttatcccaaatgaaacttcattaaaagaagtatcagaaatttgctctttaccaggattagatgtaataggtatgtttacacacttttccactgctgatgaagaaaataaggattatactcttgaacaatttgataaatacatgaattttttacacgaactttctaagctaaatataagtattccgctaaaacacgtttcaaatagtggagcaatcatggatatgcctgaaacatttaaagatttagatgcggtaagagctggaataatactttatggatattatccttctcatgaagtaaagaaagaaaacctttctttaaaaccagcattaacaataaaagcaaaagtagctcatgtaaaagaaatggatgaaaatatgtatataagctatggcagaacttttaaaactaaaagaaaaagcattatagccactattccaataggatatgctgatggatattcacgattactcattcctggagctaaagtaattgttaatggtaaattagtgcctatagtaggtagaatatgtatggatcaatgtatgatagatgtaactgatgctggtactgttaaaactggagatgaagttattatcttaggtcaatttgaaaatttaaaaataaatgctgatgattatgctcaaatacttggcacgataaattatgaagtgttatgtatgtttaagcacagaattcctaaagtttatataaaaaataataaaccagttatcgtacgaaattatatttaaaaaaataaacagccatatatacggctgtttatttttttaatattaagtcatctttttctgatgaaccttattcttttctagatttaataaacctgtataaatactacttttaagtagtttccttctggaaatttatcactaacggcaaagtcatttggtaatgtatgttcttctaaaatctcatattctctattaaagtccttaaatgctgtatctataaactttttaaattttttcatattaaatgttgcacagtttgtagatgctataattataccttcatcattagttaaagtaattgcacttttaacaagactagtataatcttttgctgcactaaacctattatcttttgatgtggcaaagcttggaggatctaatattacaacatcaaattttaaattttcttttgctgcacgtttaaagtaatggaatatatcttcaacaacaatatcatgatttttataatcaataccattaatttcaaaattttctcttgttttttcaagacttctacttgcaaggtcaacacttgtagttattgctcctccccttgcagcagccattgaaaatgctccagtatacgaaaatgtattaagtactgttttatcttttgaatatttttcttttaatgattttcttacatccttctgatcaagaaatactccaaccattgctccatcattaaggtatattgcaaaatttacatcattttcttttacaacaagaggctctggtgctttctttccccataaataactatcctcatcaacaaccattccattgtcttcaaatctctttttttcatatattccatctatagatactaattgtctcattgctttaattataaaatctttaaatatgtacatgcccttactataccaagtaattaaataatattcatcaaagtaatcaatggttaatcctccaataccatctccctctccattgaatactctaaatgcatttgtatgtctagaatgataaagcttcattctcttagaaaatgcatttcggagcttattataaaaaaacttatagtcaaatacactatttttactattgcttaaaatccatccgcaccctttattctgatttccataatatccttttcctataaatgactttttattatctagtaaagttattatctgtccttcttcactaagaacctgtggattttccaaagtatccctagaaacaagtggatatccgtttttatattttgtgacaaattctgatttaacaataagtgctgcttccttcataaaacaccatcctaataaatatattcttttgaactaatttattattatatcatatttgttaatgattttttcatatttttgtcacatttttgacacataaatcattcataatagtatttgtaaagtagttaaagcattattatttaccccttaaccagcaaatggttaaattaaatgcctcgcacccctaagcgaggcattttttttacatataagttataatataaattaccttaacgatttttttatttattagaaatataattcttttaatttatctgctataacaccactagaacttggaatttgctttatattatatcctagcaataaaggtgatgttgtaaatcttggtgtaaccttacaaattattttatttttccaatgatagaagaatacattaaaactatcacatggtgcaaaataattatttaagatatagtgtgttatcttttttaaacatattgaaagttcatctaatccagataagttctcatctattatcatattaaattcacaaaaaccgcttattggtttatctgacagatttacagtacaatagatacttttatgaatctctataccttcaaaatacgaatcttttaaatctaatttataatctatatctctaatacctactatctgcatatgtgggtgtttcaaacttcctcctgaatgtggaccatgatttttataaaatattactgatttataattattattcttttcaaattcaagccaatgttcaacaccaaactttataagattctgaatatattcatctgtatactcactcatatttcctttacaagtataagtttcaattatcactaattgacatgtatcttttaatgtcggatatttattttttagtaatataaatggacccttttcatcaataacatcctttaactcttctctattgcaaaaaggacattccttcatatttaaatttgcaaattcatttggtttatctttgctaatatcattcaaaaatattaaatatttttcttccacttatatcaccttagacctttcttatctcatttttttatcaatacatgtgcacattttgatggaactgttatattattaccctctattgaataaatttcttctactcctgctttttctttgtttacaagaacactccatccacattcttttaaatctataaaagtttcttcatcattaggattaaatattaccactatagtattacataaatttcttccactattatcttctattttgtatgcaactacattgtctttataaaagctttcacctttattcaaaaaagataaattttttcgtatttcttcacttgaattcattcgaaatgctctatatttttttcttaatttaattaatcctctataatattctacaatatccctataatcatatgccctattccagtctaaaccatttactttatctggtgcattatagctatcatgattaaaacttccatcatcattttttttgcttcttaaaaattcttctccagcttgaaaaaatggtattccttgagaagtaagaactattgctgctgcaagtttgttcatactttttcttttttctatggaatcttctctatttgacatagtcaacttatcccaaagagtatagttgtcatgtgcagatatataatttatacattgataaggctcattagcccatgaccaatgtgaatatataactctatcataattaattcctagttgccctgttgcccctacaatacaaaattttattgtgtcttcaagaccttctcttccattaatatatcctctttcatttatattgaaaacatgccctttaacaccatctcttgtatcatcgctaaaagctgcaatctgacttttttcaaatttaattatattttgttttattgctgcctgatcacttttaagaggtgttccaccccctgtccatccttctccatacattaaaattgaaggatctattgcatcaagttcttttcgtattatatgcatggtttcaatatcatgaagacccataaggtcaaatctaaatccatcaatatgatattcctttgcccaatataaaatggaatctaaaatcaactttcttaccatatatctttctgatgccagttcatttccacatcctgaaccattagagaaatttccatttatatcttgtctgtaataatatccaggtactgcaagatttaaatttgaatcatgagttctataggtatgattatataccatatccataataactcttattccatttttgtgaaggctctgaaccatctctttaaattctcgtattctcttttcacctctatagggattagtagaatatgaaccttcaggtacaaaataatttttgggatcatacccccaattatactgtggaacttctaaattagattcatcaactgtctcataatcaaaactgggcaataagtgtatatgagttattccaatcctttttaaataatcaataccagtttctatatattttcctttaagtgttgtcccttgttcacaaaaagctataaattttcctcttctttcagcttttattcctgaattttcattaattgaaaagtctcttacatgaatttcatatattatcgaacttgctgcactagttaattcaggtttttcgtctttacaaaaatcaattggatcagtttcccttagatttattaccatacctctatttccattaactccaacagctttcgcataaggatctataacttctctttcatttccactgtttgtaactaaataattataaaattctccattaagatctctatttacttctattgtccaagtgccttgttctcctctgttcatatctaatatttcttcgggactattggtatactccttacagtcttttccaaacaatgctaatctgacattattagcatttggagcccataatataaattttgtaccttcttttgaatattgagcaccaagtatacctgtataattattataatcattacctaataaattcattatagtattacccctttgtaacttttattaaacattttagacaaaaacacagccatttaaacttttataaaaattaattactttatctttgctattactttagaagaaaatgctggtactctaatgcttacatctccacctttaataatatcatctttatcagataataaatcttttccttcttcaaaagatatattaaaatcaagataactttctttatcacttagatttaatactatatagatcttatcatttttacttgttctagaaaaaacatattgttcattttttataattacttgttcatagttaccattcttaagtgcttcacttacaacccttatccttccaagtttttcaatatgatcaaataattcattgtttttatcttcataattttctatttcatctacacttggacgtaatggcagatcagttttatcaccttttactgctttaattccgtattcacttccgtaataaatacttggtacacctggcattgtatataaaatagtataaacattaaataagtattcttgaacttttaaagtgcttgcaagtctatttacatcatgattatccacaaagttatacaaacacaaatccttatatattccaccatccccaaacattctattcaatgaatatgctatctcaaaataattcttatcattatgacttgagtatatacccttataacattcatagttagttaccgaatctaaactgtctttatttgcccatctattataatctccatgtattatttcacccataagccagaaattatcctttttcttctccgtaaatatctttaattctttaaaaaaatcaaaaataatcttatctgctgcatctaatcttaatccatctatatcaaattcatctatccaaaattccactgcatgtaataaatattctacaacatctctattccacaagtttaatttcaccagatcataacatccattccaactttcataattaaagtcatcacccataggacttctactatcaaaatttaatcctgaaaaccaattgcagtactttgaatttctaccatttttctgaatatctttaaatgcccaaaactctcgtcctacatgattaaacactccatctaatacaatctttatatcattttcatgaagctttttacataaatctttaaaatcctcatttgttccaagtcttttatctatattcaaataatctcgcgtatcatatccatgatagctagattcaaaaaccggtccaaaatatattgcatttatactcattttctttaaatgaggtatccattcttctatttttataagcctattcttttcttcataaattctgcttggctctaatacatcacaaaaacccaatgtaaaaatattataaaatactctatcttcaatccataaattcatattattatccccctttattacacatataagtcactttttcatcatgtatatataattaatataaactcgaggaattaacatgtttgtaaattctatcttatattataatttatgcagtactacgctgattgattatatttaattaagaataatacatatatttttcaaccttaaattcatcaattatattctattttcgataaaaagttttatatatttaaatctatgctcttattatacatttatttgttatttttgaaaatataacctgagattttaattctttggcactctcagaatataatgttaagataaaagtaagagattcattaataaaatttaattatttatatgctataatatcaaagaattagtaattaaattcattcgacataataatttattcattttagaaggagataataaaaatggtattaaaaaagaaatttatttcatctatagtctgtctatctttaatatttggtaatataacttgtgcttttgcggatagttcaaaagtagttacaataggtgcagatttaagtgatactcaaaagcagactgtacttgattattttggtgtaaaaaaggatgaagcagttattcttgaagttaataatcttgaagagagaaaatatcttcaaggtattgcaagtgaagcgcagctcggaactaaaacattctcatgtgcttatgtagaacctgcaaaaaaaggcaatggtataaatgttaaaactgcaaatcttacttatgttacatcttctatgattgctagtactcttgctacttgtggagttgaagatgcaaatgttattgctatgacaccacttagtgggggtgtttcaggaactggtgccttaactggagttatgaaggcctttgaagatgctactggtaaagaacttagcgaagataagaaagaacttgcgtctaaagaacttattacaacaagtgatttaggtgatgaaattggacaagatgaagcagcaggattaataaatgatataaaagctgatgttataaaaaatggtactaaagataccaatcaaatagcagaaactataaataatgtgacaaataactataacattacattaactccatcacaagaaaagcaaatatctgatttaatgactaaaatttctgagcaagattatgattataatagcttaaaaaatacttttaaaaatgtttctgatgcagttgataaaaatcttcaagaagctggaataaatataaatcgttctgaaggtttcttttcatcaattggtaactggttcaaagatttattctctggaagtaaagatttagggatattagaaaatactaatgatacagtgcttggtgatgatgtaaaagtggatgccacagataaggatgcaattaaaaatattatttctgataatggtttttgggaaaaaataaaaaactggttctcaggtctttttaattcatcatctgataagactgaagaagatagttctaataattcaaattctgattcaaaaaataatgatgctaatataaattctgaaaatacttcacaaactgaaaataatactaatgcttctgaaaacaatacttctaagcattctgaaaaagaaaaagcgtctgaaaatatttctacaaataatcaaaattaaatatatgtgtttcaatttacaattaaaatatgataatttcaacatattataataaaaaagcatggctaatccatgcttttttattctttaaggacttataatccagtcagaactgaggataactttcaactgttaaaacattgtattactaaaacgtctaattattatgtccattttacatatatatattcttaagaaataataaaaatttttcataataaaaatttttattatttcacatactattattgaaatttatatttacggaggtaaaatgatgaataaaaaaatagtaacttgcatagcatcatctttggcagttcttagttgtatgtatgttgttcctcaaaaagtaatggcagatacacctactgtttctttagaagaatcatattattacacagctaataaggataaaaaagataaatctaaggatgaagaaaaagataagaataaagatgacaacaaatgcaaagacggtgaaaaagacaaagataaaaataaagacaagggcaaagatcataaagataagggtttagacatatttacagaagaaaattgtaaatacttatctgctgatcaaaagaaaactttgactgaatgtaaagaatgtaaagaaaaaggaactcctcttactgaggatcaaaaaaaatctttaagtgttatgattgaatgtatttttaaaggaaaattaggagatgaaaaatacaaagattttaaatgcttaattgaaaagaaaggaaaaggaacaaaacttactgaagaagaagaaaagaaattaaaagaatataaaactataatcgaaggaaaagataaaacaactgctgccgatatacttaaacaatttttaagataacttatgtaaataaagatgtatggaatttatctttataaaactccatacatctttaattttgcatatatatttcgtacttatacaagttaacttatttttaaacaatatcactgtattttttaaatagtactagaaataatatcagttaatatcctaaagaccaaatattattccaacaacagctgaaattcctatatatactataggatgctttttatatttaataatagaataaaagattatagcaaataatatacaactttttatattaatcaaatctagtaaattattagttattaagtattcattaatatttaataaagctatctttacaacttcaaaagcagcaactcctattaaacctacactagctggtctaagacattcaaatactgactctacagatttattatttttaaatttttcaagaaacttagcaattattattattattattattgatggtgttattaaccctaaagtcgcaactataccaccactaatacctcccgagctataacctgcgtacgttgatatatttactcccattggtcctggagttgattctgatacagctatcatgtctgcaagcatactttgattaaaccaatcgtatttatatgttagattaattaaaaatggtaatgttgctaatcctccaccaactgcaaataaacctgttttaaagaattcaaaaaataataataaatatatcattcattttttcctcctttatttttctttaatagcccaattaatgctgcgcctattacaacatatatgggtgataactgcaatataccccctaaaaaaaatgcagaaaatgctaataatatacctatataatttttaacagaacttttccaaagttttattactgagcttattattaatgctacaaccgcaacccttattccgccaaatgcatgttgtacaattgagaattgtgcaaaattttttaaaaatgctgcaattatcatgattatcactaatgatggaaaaataactcctaatgtagccacaataccaccaataattccttttaacttatatcctataaatgttgctgtattaacagctattacacccggagtacattgacctacagcataataatcaattacttcagtctctgttgcccattttttcttctctacaatttctttttgtattattggaagcattgcgtatccaccaccaaatgttatagctcccattttagcaaatgtccaaaaaagatcaaataattccttcaaaattttcacctcttatcattaattttcacttttgattaattattccctaataatcctatactatataagattatctatcaacatgtattactaaatttatttttctcctaattaaaattaacaatacctttataaactttattaaaataaaaatagattttgcattcaatttataattgtctacaaaatctataaaacattatttttacaaataagaatctatatctatttgatttttaaaagtttcaattccaatcctatctatatagtctccaattctttcttttccagttgcattattatcataaacttcaatgattttctccacaagattaaaaagattttcttctggaatacataatgctattctgtcagcaattcgtggtttcattccaccttttccaccaacataaaccatccatccttttccacttccaattaagccaatatccttaaatgcactgtctgcacaactatgtggacacccacttacaccaatcttcaatttattaggtagattttttccatgatataaactgtctaattttgatcctactgcaacagaatcttgaaggcctcttttacaaaaagttgttcctgggcacacttttatacttcttacacatagtcctatagcagctcctgggctcattccaagatctccccaagcagaatcaatatcttcttcctttaagcctacaagagctatcctttgagctcctgtcacctttattgcactaacattatacttatccgctacatctgctatttttctaagttcatccgctgatactatacctgcagttaaatgaggtgctatagcatatgtttctttatctctctgcaaaactgcccccttctccaacaaatcctttttcattataaatgcctccttgaatttatttaaccttactatatgattcttccttaaaaccaactaaaacaacatcattacttactaatattggacgcttaattaacattccatcctttgaaagcatttctgcaatttcttctttagacattaaacttactttatcttttaatcctaattctttataaacttttccacatgtattaaaaaatttttttggttctagcccgcttttatctatccaagctattaattcttctttagtaggagtagcttcaacaatatttcttactattacttctttattattatctttaagatatttaagtgcctttctacatgttgaacattttggatactctataaataacatttttcttcctcctaatattaataataattatttacagataattattctaccacgttttttaagaaaggtaaataagcacaaacctcctatataatgcatatagaatatatttttaagactctacttttttaatttattataaaactattaatatcctataactattacactataaaatccacatcatataaaaaatacactttatattattattatttgtaatattaataaaagcatactttaaaatttatattaataatataattatattgattcaataaaattcattattttatatataacttgaatcgttatctcatcaacttcaaaataagtttcatgctttccattggtaacaataataacctcacaattctctgcatactttgcaaatttataatgagcatcagcaataacgtgagtatcacactctgcctgtaacaatattacaggtattttaacctttgatatattttttttatttctaatatatctagtagccttagaagcttcaaaataccactttgctgaagctcctcctgtctgaaatgacttattttttaatattttatcatattgataattgtatcgttcttcacaatttgttgatctacttggaaatctacgctgtccattatatgatttctgtcctggcatatattcatttccttttccaaaataaacccatattcttgaaagcatatctgcaataaaagctggagtattgcctgtatttatttgatgcattggtgaactcaaaattgcaccattaaaatattgtggatatttttctaaaaatacagtccctattcctccacccatagaatgagcaaataaaattatctttttattataactattagttatcaccttttcttctataaattgcttaaagtcttcaatatagttatcaaatttttctatactgatttgtccaatatcttttcctaatcttcctgaacggccatttcccctatgttctattataaaaacagaataactagcattaataaaataataaatcaattcattatatttttcagtatattcaccaattccatgggaaataactatatttccttttggattatctactataaatttttcataatataattctaaattgtttgttcctataatatagccacttttttttaaactatttaatacaggttcaactttatttatcatatcttcgctataattagctgctgatatataattttttattccacagaattcacaatctgattttgtaatataactcttttttaagtctgaatatttcatctttattctcctaatattaataaaataaattcactacatactattataaatatacaatattttttcttctatacgaaactttcaaattctaaaaaaaataatagaccatcaattaatgacagtccactatttttataataattcttttatataaatttctttgttacttcttaaatctaaaaattctccatcttttaaaagtaatggcttggataagttatttaaatcaacttgaattattttagctatttccccagtatttaaaagaacattttcgcccatgtaataattggaaatgtgctgtaatagtattgttgtatattcataatcaagcttacttaaacttttttcttttaagatttcaagaatttcaaaaggtcccttaggtttattttcttcattataggaattaagtacatctagttcatctgctattgctattatttttgcaaagtaatgaattttttctccctttattccaagtggaaatccagtgccatcttctctttcgtgatgcataagaactccatagctaactgacttatctaaatatggaataagatctacacatttatatgctatctttgcatgttcttttacttctttatagttttctgccatgataatatctggttttctttgatacttttgatcaagcttagtaattccaaaatcatgaagaagtgctgaataaataagaagatttattttagatttttcaaggcctatccatcttccaataagagcgcttagaacagcaacatttactccatgtctatatatattatcatttccactacccttaaaaacaacattacacactacaacctctgtataattaagttgattttgtatccttacagcaaattcacgtaattcatcaagatctgtttttcttattttattcattttagaaaacatctcctgtaattcatgagcaacttgtttaaagctttcttctacattcttaagctctaattctttgctattttctgatatatcaacatcagatacatctatttctattttctctaaaaaatatgacttttttaatagtgatattaattcatcagttattatagtacctttcttaactaaaagagtcccattttctataatatccttagatataatcataccctgttttaattcacttacatttaataacgaaccttttttcatttttccccctattaacctagttaaaagattttttagtaatatagttataattacaaattataacagcatttctttaatataatattccttttgcttgtccaaatctataaattctccattcttaagcactaaaggcttctctaaattattaatattcatttgtattatcttacatctctcaccattattcagaagtacctcttctcctaaataataatttactatgtgttctaaaaagacttttacatattcataattaagttttcctaatgattcatttttaactatttgcaatgcttcaaaaggagccttttttcttttatagcctctattagaattaatagcatcaaatacatctgctatggcaataattttaccaaaagaatgtatagcatccccctttaatcccaatggatatccagagccatcttctctttcatgatgcataagaactccataactaacacatttatctaaaaacggaatttgttttacaaagttatatcctagtaccggatgattttttactacattatattcacttgtagttaaagctgtttgtttatacagtatttctctcttcacttttgtctttccaaaatcatgaagtattgctgaatatacaagaagattaagctgtgctccatcatatccaagccactttccaattaatgcacttaaagctgcaacattaacaccatgcctataaatacaatcactgccactgccatgtagaacaatatttttaattacaacactacttggctttaattcttcttgaattttattggaaaatatcctaatttctttcatgcattcactatcttcattttgtatgcttctaaatgttctttgtaactttgaagaaataactttaaattcttcctctattttattgaattcttctagtttcttttcttcaaatgtactttcattttgcacactttctgaatcataaacttgaacagttcctataaagagtaatcgttgtatatcaattatcatcttctctgtaatttccatgttcttttttaacaacacttttccgttttgttcaacatccttagctataaccatacctttttttaattctgaaaaagcaatcgatattatttttttccccataccatccaccctatccacataattccttatttaaaaacaaagttttttctttttaatgtaaacactttgtatttttatgtatattattctatatttttttatttttgtcaaaaatgtttttcatttgttgtaaacctaatattaaaataccacctataatgaaaaacataatactaaaagtactaaaagtcattggaggttttggaatttctaatgaagctggtcccataacaacagcatacaacgatccaatcataagacctaatatcatatagatagtctgagatctatagttattcaatacatatttaacaatccttatagttgcaaatattcctccaagtactccaaatccaaatatcattactataggtaaatattcaaaattaaaagtaataacttcttttactgctgatacaattggaacataaagaccaaatataagcaataatgttgaacctgatattcctggaagtaccattgctgaaattgctatcattccaactacaaaaacatatactcctaatcctattgataatctatctattgatatatccattccacctttagttgcaggattaaaatatgttatagcagatactataattattcctccaattaaaaaaactacattcttatatttatcaattaaactttctttttcttctttaattattattggaatagcaaaaattataaaccctaaaaataatgaacttatattatatatctgtgcttcaaaaattgatcctagaaataacatagatataacaaagcctgctatccatcctattcctatttttatcaaaaacttaattccatctattttttctgcttttttcccagctacaatagcatcaagagaacctatgaacttatcataaaaacctaataaaaatgctatggttcctcctgaaactcccggcacactatctgcaagtgccatacaaaatcctcttataaaattaataatatacattgtgataatttctccttctatcttttattaatattaattaaataataattactctattccctatataatatcataataatatgtaataaaggatgaatatataaaaaattcatccttcatcaacaaattaagtaatttaatatttttatttatattaaattattgttccagccttagcattacctgttttggcttttccttgtatttctgtcggaatatctttcacatcatttttcttataatgctgtttatgattactttctgttccatgagcatcacttggatctggtcttctcattcctgcttttgccataaaacttcacatcctttctaaaatactattcattttagtattaagaaaaaatcagtttagtatgcatttaaaaagacttttatttattttcatctatccatgttttccatatatcttcatctacaccaactgtagctttattaccatttctcaccactggagtattcataacattttgatttttcagtaataattcagttttaacttccttgcttcttatattattaaaatttagcttaatataatcctttgattttgtgtttattaatatatttatatctacacatctgagcacattgttcatttcaccattactcataggtttttcattaatatcaataagctgatattttatttttctttctttaaaaaatctttctgcttttttagtatcaaaacatttttttcggccaaagatttgtatgttcatataatttctccttaaaatagttcaatttctctttttttattaattatatatgttgtactatgaactttacaattataattttctatatattaaaataaatgcttcaaagcctaatacagcttcaaagcatttaccttttaactattacttacctaatccaactattgtgtctaaggcaacttccatcatgtttgtaaaagtcttttgtctttcttccgaacttgtaatttcacctgttataaagtgatcacttactgtcatgattgctaacgctttaactccatacttagctgctacagtataaagtcctgctgcttccatttcaacacctagacatccaaaagctgcccatttcttccaatcttcattgtcatctccataaaatatatctgaactataaatagttcctaccttaggatctattcctttttcaacggctgtatcatatgccttttttagtaattcaaaattagctgttggtgcatatgttcttccttggaatcttgttaagttaagatttgaatctgtgcatgctgacattgctattactaaatctcttactttaacatcttcatggtatcctccacatgttccaactcttataagattcttaactccatattcatttattaattcatttgcataaattgaaattgaaggaatccccattcctgttccttgtactgatattctttttcctttatatgttcctgtaaatccatacattcctcttacttcgttatagcatactacatcttctaaaaatgtttccgctataaatttagctctaagtggatctcctggtaataatacgctttctgctatttctccttgttttgcatttatatgaatactcattgtaaacctccgtatatttctatctaatattttcttttctaaaagctcctggcataacttcttccatagtctttactatataatcgtcttcatttttaactaaaattacagctgcatctccatctgcaaattcacataaaacctggcgacaaatcccacatggataagtatactcttctgcacttccagctatagctattacctttattttagtttcgccactagcaactccagtaaatattgctgttctttctgcacaatttgttgcaccaaaagaagcattttcaatattacatccaccgtaaacattgccactttcaaataatacagctgcgccaactttaaagttagaataaggtgcataagctctctctctataatctaaggctgttttaacaagatttttataatccatggtaattccccctattcaattaaatctttataaattgaaatattagtatatatattatatactatcttcgcatagacaatctatataccatacatgttgctatggtattaaatcaatttatacaatagcaacatgtattatatatataaattctaagttctatctcttacctgcatcaaatggttcaccagctgcttttggagcttgtgaagattttgagaataatactaaagcaattaaagttaccacatatgggaatacttttaatactactggtggtattgatcctaatgatggaataacttgtgatacatttgcaactgttgtagcaaatccaaagaataatgtagctgcaagtattccaagtggcttccattgaccaaatattaaagctgctaaagcaaggaatccaatacctgcaacacttccattaaattcacctgagtatgttacaagaataatagctccacctaaagatgaaagaccacctgaaagtaatactccaaaatatctcattttaaaaacatttatacctgctgcatcagctgcttgtggatgttctccacatgctctaagtcttaatccaaaacttgttttatataataagaatatactaatcactaaaattaaaagtactaaccatgttgttatataagtctttttaaagaataagtctcctattataggaatttgtgataagaatggaacatctttaggataaaatccactttgtattcttatacgtccacttcctgctatagttcttgccaaaaatatagttaatgcactcgctatcatattgatagctgtaccacttattgtctgatctgcatttaaatttatgcttgcaaatgcatgtaatagtgaaaatagcattcctacaataaaagccactaataatccaatccataatggaagagaactttcaggcatactttcttgtagttttgatattgctagtgctcccgaaaaagaaccaattatcataaatccttctaaacctatgttaataacaccgcttcgttcacaatataacgctccaagtgcagttataagtagaggaatagtatacacaatagcatatggaaatatatctctaattattgaccacatattatttttcctccttatctacattattatcatttggtagtataccactaccactatctccagctttttgagcttttctttgtttgaatttcttaacaatcataggtactgctgcgcttatagctgcaaaataaattataattgcaattattgtatctgctatttctggaggtatacttgtattaacgttcatgaatcccttaccagaatataataaaccaaagaatatagctgaaactaatactccaagaggactatttgcacctaataaagatactgcgataccatcaaatccttgtgaaggcattatacctatttgaatatttgatgcattacctatatattgtgcaacaccggctaaacctgataatgcacctgcaatcatcattgctaaaattatatttttattaactgacatacctgcatattcagctgcatctctgttaaatccaactgcctttaactcatatcctaaaactgttttattcaaaataaaccaaattaaaattacaactactattgctattattaatcctaaatttatatatgatccatcaaaaagattagtaagccattcagcttttaatgatgccacttgaggaatattttttgattctgtttctgtagaacctttaaaataagctggtactgcataataaacaatccagtatgctgtccagttcatcatgattgatgatacaacttcatttacattaaatttagcttttaaaagacctggtacaaatgcccataaggctccagctaaagctccaacaagaaccataagaattaataataaaaatcttggcatactatcactatataataatccaatacttgtagcacagaatcctccaaataacatttgtcctggagttcctatattaaacaatccagttttaaaagcaaatgctacagaaagtcctgtaaaaataagtggagtagctgttgctaaagtatcaccaattctttgtacattcattaatccacctttaaaaaggtacatatatccatcaactggattatctccaattaataacattaaaattgctcctgcaattaaccccaaagcaactgcaattacagaatttaaagcttcttttctagtcatgctttgatcctcctttatgaacaccagccatcattaatcctatttcattttcatcagtttcagctgcattaactactccgattaactcaccgccatttactatagcaattctatctgctaaattcataacttcgcttaattctaaagatacaagtaatactgctttatcagcatctctttctccaattaatcttttgtgtatgtattcaatagaacctacatcaagacctcttgtaggttgaaccgctattaataaatcaggatctaatcctatttcacgtcctatgattgctttctgttgattaccacctgacattgttcttgcaagtgatgctccaccttgacctgatcttacatcaaattcatttattatattttctgcataatcatgtattgcatctttttgtagtagcccatatttagaaaacggctctttattatacctttgaagaactatgttattttctaatgtataatctaatactagccctctcttttgacgatcttctgggatatgtccgataccagaatcaatacgcttacgtattgatatgttagtaatatcctcacctttaagtattatctttccttcttttacatgtctcataccagtaatagcttcaataagttctgtctgtccattaccttctactccagcaataccaagtatctcaccttttttaacttcaattgaaaaattcttaagaccaagtacttttttgttatttaaaactgataaattttcaacttttaatacaacatcaccagcttttttaggttgcttttcaactttaaaattaactggtcttccaaccatcatttccgccattttagcttcgctagtttcctttacattaatagtacctatatacttacctcttctgataacggtacaattatctgctactgccttaatttctttaagtttatgagttattattattattgactttccttcattgattaaattcttaattattttcataagttcatcaatttcttgtggtgtaagaactgctgtaggttcatcaagaataaggacttcagcatctctataaagtgttttaagtatttctactctctgttgcattccaaccgatatatcttcaatttttgcatatggatcaacatttaaaccatattttttagataattcttcaactctttttgctgcactttttacatcaacaaccattccttttttaggttcacatcctaaaattatgttttctgttactgtaaaattatgaaccagtttaaaatgttgatgaaccatcccaattcctaaatcattggcaacattaggatttgaaattttaacttcttttccatttacctttattattcctctttctggctgatacattccaaaaagtactgacattaaagtagattttcccgctccattttcgcctaacaacgcatgtacttcacctttttttaatcttaaggtaatattatcattagctactatacctgcgaattctttacggatatttagcatttcaactacatattccattaataatatcctcctttattaattaacaatattgattgacaattgacaataaacaacatgttttaatccctatataccattattgtgcattgtcaattgtcaatatttgcaccacttatcttattattaaattaacaatgaagtttagtttataggatatagaaatcctataaactacttatccccattgttaatacatttatagtaatttttaattattcaaataatgagttatcatcattgttatctttaacagtaatagatccatctttaagttttccgtaaagttcatctacaaccttcattgtatcagcacttaaatttggattttcagctggaatacctactgcatccttagttatatcaaatgttaatgtcttaccacctgggaaatttccatctaacacttgtttaaccatatcatagcttgctgaatcaactttctttatagcagaagtaagaactactgatttaccatctgcatatttaccatcatcatattgatctctgtcaacacctactacccatacgtttttacctgaatccacttgagttttagctgctgttataacaccattaccaactccaccagcagcacagaatatagccttaacacctctatcatacatagcattagctaattgagttcctgcagcaacatcattgaatgttccttgatatattacattttctttatctaaagtcattttagttcctaagttagcattagcatatgctacaccttgttggaatccccagttgaatttttgaactgctggaatcttcataccaccaataaatccaaggcttccttcttttaattcaacagatgttgcaacacctgcaacaaatcctgcttgttgttctgcaaataaaatagaaactgcattgtctgaaactttaacaactggatctttttctgctccatcatttggagtaccatctattatcacaaatttagcatcttgatatttatcttgagcttcatatactgctgtttcaaatttgaaacctggagtagctattagtctgtaacctgcatcataaagatttcctatttcctttaagtaatcagctttagtttctcctgatggttttaagtatttaggatcttgtaaactaaaatccttttgagctttttcaataccttcccatgtaccttggttgaaagacttatcgtctatagttcctgagtcagtaaccataccaacttttacttttgcatctgtaccagtagcatctccagtacttgatgaacttccgcaaccagcaaataaagttactgtaattgctgaaactgctaataatgatagtaatttctttttcattataaatacctcctaaagtatagcattttatttagtaatatataaaatcacagaaataaatcctgattttaatgcaatgtattaatttctttagatatcattttttagtattagagtttttttataaaatatgtatacaatccatatggattgattactcaaatctttcagaacctcttattattatttgaggcgatattattgtccttgtcttctctgttttactgtcatttaaaatattgcacagcaacttcattgcacttttccctaaaagcagtggacactcttcaatatatgtaaggtttaacccaaacatatctaatacatcatttttatctgaacctataatggctaaatcattaggtattttctttttatattcttctacagctttgatgacacccatagtcattctattagtacatactataagagcgcttggacattctttactatcaagcatttcttttgtaatttcatatgcattttcacatgtaaaatctgcttttagtatatagttttcttttacttttatattattttctattaatgcttttttatatcctaaaagtctttggctcattggttctgagcttaaaggtcctaatagtattcctattcttttgtgtcctctttcaattaataactttacagaatcataagctcctttaatattatcaacaaaaacaccattaagttctgttgagttaacatctgcacatgctaaaatcaatggacattgtaaactttcaataatttctttatatgtgctatcaaaatcatctgctccaaaacctggggtcattattattcctttaattctctgctctttaagcagatttaatgctctaatctctttttcaaacgaattttctgtattataaaaaattatatttaaattatttttatctgccacctgactaatacctttaataacttctccaaaatatgaattagttatatccggaactattacaccaattgcatttgtttctctttttgataaacttcttgcaatagcactaggcgtatagtttaattctttaattactgcttctattctgttttttgtttcttctttaacatatccagagccattcaatactcttgatacagttgactgtgatacctttgccttttttgctatatcacttatagttacaggcatataaattcacctcatttttcgacataatagtgattttactgcatttttatatcttatttagtcaatatggtagcgcttccacattaataataatatatccgtatatcttttgtcaacgaaaatagtatcacttttcttttaataaaagctaatagtatatcacatacatttttttcaagttggtcttttaaaaatcagataatctttatcaaattctcttaacatacatgaatattatattgtttacagaattttctgaataatttatgacgaactttccacttcttaaatatattttccatacttttacacaatgccaaaacttgtatcgtagcttgtctacttgttttgtaaaattatgataacatttacaaacatattttgtcaatcctttttatgattattataaatacaattaatctatttttttatcatgtattaataaaattttccaataccactctagaatcagcctaattttactttttattctttaattaaaaacattcacaggctggaatcttaatataatataacctttcatctttcaaaattctataattttctgcaaaataaaaatagtctctgtaaaattgaatttataaaatcccatttcactatagctcaatcatttatataatagaataatgcgtaataaaagttattctttttattacgcattatgtaattaatattatatttttatttatatatactaaaaataatctagttaaatttaagctttctttttctttaatgtatttacaaatttttcaattctttttaatgcttcaattatattttccatagatgatgcataacaagctcttataaatccttcaccacaatccccaaatgcattacctggaacagtaagaactttttcatttataagaagttgctcacagaattcatctgaagatattcctgtagattgaatacttgggaatacataaaatgcacccaatggttcaaaacattctaatcccatttttctaaaaccatctacaagtactcttcttcttctattatattccctttgcatttcttctatacttgaatctccacttttaagtgcttctattgcagcatactgagctgttgtaggtgaacacataattgcatattgatgaatctttttcatttcatttattaaagtaggatgtccacaaagatatcctaatctccaccctgtcatggcatatgcttttgaaaacccgtttattacaagtgtcttctctttcatttcaggaaatgatgctatagaaacatgtttttcatcataacataactctgcatatatttcatctgaaataacgattatatctttgtcctttaatacttcaacaattggaataagttcttcccttgtcattattgcaccagtaggattgtttgggaatggaactataacaacttttgttttaggagtaattgctttttcaagatcttctgctgtaagtttaaattcattttcagcttttaaatcaagaactttagctgtagcaccagtaaatgcagtgcatcccttatatgccacaaaacttggttctggaactataacttcatctccaggtcctactaacgctctaagagcaatatcaataccttcacttccaccaactgttactattatttcatctagtggattataacttaaatcaaatcttctatataaatatttagcaatttcatttcttaattcaataaatcctgcattagatgaataatgagtgtgtccttgctctaacgaataaattcctgcttctgtaacattccaaggagtaagaaaatctggttcacctactccaagtgaaataacatcttccatttcatttatcatatcaaagtattttcttatacctgacggaggcatgtttctaacattatctcttatcatattttctagtatcatataaatatagcctccctgtcttctactctcttttctttaaagattgttccatgatctttatatttcttaagaacaaaatgagttcctgtactcaaaacatattcctgaactgcaagtttttcagatacaaaaagtgcaacttccttcatagtcttcccctcaactataacagtaaggtcaaatcctcctgacattaaataacacgctttaacttgtggaaatttatatattctttcagctactttatcaaagccttcacctctttgtggtgtgattttaacttcgattaatgctgttactgtttcacttcctgtattttcccaattaataagagtagtatatccagcaattatacttttctcttcataatctctaattgcatcacgtacttcttcaacagttttacctgtcattacagcaatctgctcatcactatatctactatttttttctaatatttcgagtatttcctccattgcaaatccctccaatttatttagttaacaattctccattaacagttatactacttcattttgattttatattactgataatatgatcacttagataactttgactttatttcattttatataattttttaaataaaaaaaattccgttcatccacaagggacgaaggaactacttcgcggtaccaccctaataaatagcacgtatgctattcactcagtaagaatgtcaactaaacattctatcctttgtaacgtaaggaacacgtcataacctaattaagaatatatattcttagttctcagcatgaaattcaaagactgcttcatttaagtatacttactgaatcacaccaaacttcagctctctaaaaagtatatctaaaattactctttcttatcactatctttaactaaattaattttcaaaatataattcattttcaaataattatttgtttgaatctttatttattattataaactcaaatatataaataattcaatagtattttatatattattttaaataaatcatattttcttatctaaagcaaatagaaacataaaaggagttataactccttaatgatgttataactcctcaatatagactaatagcctatctattatgatgctgtttttttgcttttctacaactttggcatcttactggatcattttcaaatcctttttctttataaaattcttgttcaccaaccgtaaagataaattcctctccacaatctttacatactatctttctatcttccattttaactttctattgccagaatatatatatactctgcaacagttcacctcctataaaaacttaaagccttagcttcgacaaatatattatttcttattttaaataatatattcataaattataaaaaattattatttactattttcacactaatctagcttacagtacttcaagctcaaatttattatttataagattaattctacacttgcccccatcacataaacttccaaataatatctcatctacaaatagaggctttatattcgaatcaattacccttattatctctcttgcaccaaactcttttgaagttcctaacttagcaatataatcactacattcttgtgtaaatattatttctatattcttagagtacaacttctttttaaagtcattaagctttttcattgcaacctgttttgccatttcatcattcattccattaaatacaactattttatcaagtctatttctaaattcaggtgtaaagaattttttcacttcttccataatagcattaccttgaatttctctatcaccaaaaccaataagtttctttccaatattttttgcacctgcatttgatgtcattattattattacatttcgaaaatctgcttttcttcctttattatcagtaagagttgcatagtccataacttgaagtaaaacacttaatatatcttcatgagctttttcaatttcatctaataataaaatacaatgtggtttctttcttattgagtcagtaagaagtcctccctcttcatatcctacatatcctggaggagatccgatgagtttcgcagctgaatgtttttcaccatactcactcatatcaaatctaacaagatctaaccctaactttttagaaagacatcttgctatttcagtttttccaacccctgtaggtcctacaaacagcattgatgcaacaggtttatcttcttcattaagtcctgctcttgacatttttatgcatctaacaacttcctctatagccttatcttgatgaaatatattttctttcaattctttttctatatatttaagtgaattaatttcatttgtttcaaccgtttgttttggaatactgcatacttttgatattatttcctcaataacattttcacttactacaattttttcatccatattactgttatgcattctgacatatgctccagcctcatcaattatatctatggccttatctggaagatatttatcatttatatatttatcacttaaaataaccgcatttcttatagcatcatctgtatatgatacattatgatatttttcataactttctttaagaccatttaatatacttaccgaatcatcaattgatggttctcttacatcaatagtttgaaatcttcttattaaggctttgtctttttcaaagtacttcttatattcatcaaaggtagtagcacctataaatcttatacttccttctgttagatatggttttaataaattagaagcatctaatgcaccaccatttaatgcaccagcccctacgatactgtgtatttcatctatatatacaatagccttatctttcttgcttataagttctagtattctctttattctttcctcaaaatcccctctatattttgttcctgcaatcacagagcctaagtctaatgaatacattaaacttcctttaatcttctcgggaacatttccatcactgataagttttgcaagacccattgtaattgcagtcttaccaactccagattcaccaacatgaactggattattcttacttcttctgcataatatctgaactgttctatccaatatatccttacgccctattaaaggatcaatattttcttcctgtaccttttttataaggtcgacagtatatttgcttagaaatgcatcttctttcctaactttcactttttcttcatcatcttcagaagtttctatttctgacattgatgaatcttcactttcattaatataaacctcatcatcttcatcatgacatagattaaataacaaatctctctttgttacgccctcttgtaaaagataatacaacgcataactatcttcaagtgtaaagattgcagctaatatatgattaacatctattacttcttttccactatatttaacttgttcatctgctgtaattatcactttttgaaattcaatactttcttgtggttctccacttccaatacttatatatgtctttatatatgtcttcaaattatactgaagactatttaaatcaccaccacattgttttattgcctctgcaactttaccatcaaaagttgcagcatataaaagatgttcaggcgtaatatattcactctttctatttttagcttcttcataagccctcagcatcacatcgtttagatcacttgtaatcttcataatatttaaacctcctcggttgttaatttaaaaggaaatccttcactttttgccattgacatagcagtggctacttttgttatcgctatatcataactatatatgcctgctactcctcttccctttttatgtacatcaagcattattttttcagcatctataaaacttttattgaaaatattaactaatatctttattacaaattccatagttgtataatcatcattatgcattataaccttatagtttttaggtttttttatcttaactttatctttctgcttagtcacgactccagtttccatatttaaagcatcaccttcctaaattccttcatataagatattataaatcttttgtatattttatcatattaaaattatattaaacagaataaagaaaaagtatataaaagtagaattaactctaatttatatacttaatcttaatttattatataattttcaaaactctaatgcaatttaataccctattcttgctcaatatttattaagaagttaaccgtattatgcctcttttctttcattataaattgttatgcctagtgtaagtgcaagacctccccataaaacagttgcaccaacaccaaatagcatcaaagatactgtactcatttatatcaccacgctttctttaattatggtttttattcttctatctttttctctttccaaggtcttttagtaattagtaaagctcctataactcctatcccaataaccgaccatccatataagaataaagctggtaaagaatatcctccataaggtgctttaacttctccgataaaactttgtattaacatatatattaaaattgcaggtgttaagaatttaattacattatcccaccaacttccaattttaaaataagatatttcattagtatgttctcttattgttttaggttttattatccaaccaattaatataacttctaataatcctactactactattccatagttatttatgaagttatcaattatatcaagaagatataaccctgcacctgttgcatataaagtactaactaaaaatcctatgatacatatacctgttacaactctttctctcttccatccaaatttatctctaaatggtgctgaaactgcctctgttaatgatactgatgaagttacacctgcaaataatagacaaaggaagaataaaactcctaaaaccgtacctacagctcccatttcactaaatactgcagggaatactacaaacgctaatcctacaccacttgaaacaacttctgacattggtacgccttgagctgttgccataaaacctaatattccaaatacagcaattgctgataaaaattcaaatccacagtttgcaaaagcagtcataaatgcactattatttatatctgtctttttgggaagataacttgaataagtcaccataatccccattgcaagacttaatgagaagaatacttgtccataagctgctacccatacttttggctgcataaccattgaccaatctggcgtaaataatgtatttaatcctgttactgcaccttcaagcgtaactgatcttattgcaattataatcattattaatataagcattggtaataatatcttattagccttttcaattccaccttttattcctttataacaaatgaaccaatttataatccaaactaaacttatcccaataagaataggccaaaccattccaccaaaatcaaatggtgaatcagtaagttttaaaaaactattatggaaaaatccatttgaatctgctccccaacttttcttaaaactaaatcctaaataatttgctgcccaacttaaaatcattgaataatacgataatataataaatgcgctaatagttggccaccatccaagccattcccattttttatttgctcttgctattgccaatggtgttgatcccttaaatttatgtcccataccatattctaaaattaacaaaggtattcctgctgtaaaaatagcaaagaaatatggtattaaaaatgctccccctccatttgtatatgccacatacggaaatctccaaatattacctaaacctacagctgatccaacggctgctaagataaaacctagcttggatccccactgttctcttttttcttccatcatacgttccccctatcattttctttatgcttaaccttctgatgttttaataataaatatataatattataatttattaatttttacaagcttttattgttgaattttatactttttctttatttttttattattcattataaaacacatggtttttattgataaattcattaattgtaaaagtaatagtttatagaaaaaatctgttcctcaaacagagcatttccgctcatttaaaaagttatccctagtttttacacatataattacatgcataataaagaaactgcaaatctaatgatatgcagtttcatatatttaaaatataatgattattcaattattgcgcttatttttttctgttctttatctacacccaaaatatctttttcattttttatataatcctcaataatgttcacagcttctttttctattctttcaccaggacacacaagaggtattccaggtggatatggtgttataaactcttttgatattctaccctcacacttattaatatctatcatttcatatgataaattaaacacttcatatggttctaaaatctttttaggaatactattgtcatatacagataatgattctgatttaaaatcctttagatctaaattcaatattatatcatatatctttttaaaatcatcttcagtattaaatggagataaaatcaatacaatgccttgtgcaaaactcatttcactttgaactttttttattctaaaataatctaaaagtttatgcccactatatcctttaggaagaatcattaagtatctgcttttatctaaatcatattttccataagctttaatatcatcacacgatattattttaatttttcctaatttatttattttttctttccaatgctctgccatattaatgagtttttcataatctttctctccatatgtatcaatataatatcgcgcataatccaaagaagccataataagatatgatggagatgttgtcataaaagttctcaaataaaattcaaaatcagacttttcatcattaacaacaatataagatccttgagttaatgcaggaagagttttatgtgcactaagcacaacataatcgccaatttgtgtcatactctttggtaatttttcactaatgccaaaatgagctccatgtgcacaatctaatataactctaattcctcttcccctaaagtcttttactatttcttcaatatcatatgttataccaaagtagttaggataagttaaaattatacccttaggattagtacatttatcaaaagctttataaatattatctttatctggaggcagaaaaattccatgttcagaatcaataataggctcaatatatgaaactttaagttttcttaaaattgctccattataaatagacttgtgacaatttctctctattattacttcatctccctcattaaagcaagcaaaaatagcacttaaatttccacccgaactcccattaactaaaaagtaagcctttttagacttatatgtttttgctaataatctctgtgattctttaattacgccttctgggcaatgtaaattatctaagggatcaacttctgtaatatctaattttcccattctttccataaattctctacccaaatcatcaatttcaaaaccaagtcctgccttattgcctggcattgatagcattaaattgttttcattgtgatacttaaacaattcttctaataatggtgctttcaaacttatcatcccttctaacatacaacctgtacagctgaattctttaatacttttttagcagaatttaatatatctgcttcagtaattccttctatttttctaagttcattctcatatatattatagtctccaaacatagtatcgtatgttgcaagttctttcgctaaaataatactctgttcttctctaaacaacctctttaacttataactttttattaatgaatctaattttatttcaagttcaaccttaaaatttatttcttttattagattcataacaagttctactgctttatttacattttcttttgatgttgtaaaagttattttatacattttcaaataattttcactagaaatccttgttataacatcgtaaaccaaaccattcttagtcctcaaagtatcaaacaatatagaattaaccccttccccaaaatactgattgaacagcctgaaagcatttaattctttaaaattaagtttatctaacggaaaaaccatctgaacttttgcatttttaataccttgtcttttttcaatttggattttactagcatctattttttcatattctatattatttatataagaatttctcctaatggattttgatttccacataccaaagtatttatcgataatttccttgacagtattaaaatcaatagatgttataactgaaatagacgtattttccgggaaataattttcttcatagaacctctttaaatccgtaaccgtaagattatcaaggctctcctttgtccctattattggattttttatccttctcttattaaaaatattgtaaaacagcttatcttcacaaaactgttctatttcttcatcccattcatcaagttcttcttttataacttccatctcttctttaaatcccttttcatcaaattcaggatttaaaattatatcagaaaacagttttattccactaatgagatcttcatttaataatgtaccataataaataacataaggataattggtcatagcattctgaaatccaaaaatactacttaattgttcatttatctgtgattcacttttagttttagttcctttataaaccatgtgctcaacagcatgtgccacccccattttttctacttcaattcctgctcctgcatttaatgatatacaaattgatgtaagttcactttcactatgcttatatataagttttaaattattatctaaaattatatctttcatcttttttctccttgtctttatctattcacatcttatattactgtatgaataaattattatctaattcttctaatattgcaactaagtataatttacaattatataattcttgttatacaaaataatttaggctctctaaaaaacaaattattttttagagagcctattatataatatattaaatcttaaattcaccaacttctttatttaacaattgagaataagactgtaaatcctcaactttatcatataatttctttatttcttctgcctgtgttactgctattgtatgaatttcatctgttgctgcacttgtttcttcagatgatgctgatatattctggcttatgcccagaatagaatctttcttaaaattcatattttgattataattaattatattagacatattatcattaattataattagttcttccgataacttattaaatatcttattcgtgtctgacactgcatttgtattttcatctactattgctatattttcatttacgcactccactgcatgtccagatttttcttgaacaagattaattctatctcttatttcatttgtaaatctacttgtttcttctgacaactttttaacttcctcagcaacaacaacaaatccctttccattttctcctgctcttgctgcttcaatagaagcatttaatgctaaaagattagtttgttcagcaatatcatttataatatcaacaattgaacttatttcttttgccttaaaatcaacatcatatactatactttgtatttcttcagatatagatttatttttctctgagcaacttgataaattttttactatacttattccttctttacttaaatccgaagtatttttaatcttatcaaatgccagattagttttttcaattgcattatctatttgataacttaaatcatttatttctgtcacttcattttgtatatcatcagactgactttttgcagactttgaaatctctaaaacagaatcctccatacattcaatagactttactgtttcattagttatacttgataactcaagtgaaacttcatctactttatctgcactactttttattgtaatcacaagctttctaatcttttcactcatacaaagtaatgatttacttatgagaccaaactcattgtttttttcacataaagattctaattcactatctttttcaagattaaactcacttatcctatctatagcattcattatgtacttcatacttctaaaagctttatttaatgaaccaattactattatcgatataataataatcgctattataattaatataaactgtgtcttaaaaaagctattaataatactatcaataccactaatcggtattccaatatctaaggcaccatatttagttccgttcttttccaacggaatcattatatcataagtccaatacttctgaacatctgcataaaattttgatgtctgtattttttgattcttaactccatctatagtgtaatcatcatcataaacttttcctatcttttctttatcactatgagctattgctttaatattttcatcgattataactgcatatgcaatattatccttttttgacttttcttcaacaagattctgaagtttttctatttcattagaatcatcattatctaaaataagttctatcgatcccttaacttcatctgctgtttctattgatttattaagtaatacgtcagttatactttttttcaatatatacccaattaaaactgtagttattgaaaaaataactataatagcaacaataaatatacatattaaattcctttttatactgccattatttctttcttttcttttactcatattgcccacctttttatgtttattgtttcttaattatatcatttctttaccatttttagacatgattttatcttgttttaacattttactatatctttttacaattaataataaaaaaatatagtaatgtgaaaacttcacactactatatttttttatatactattcattatcaacagccttcaatgctattgcacattcaattctcttcttttgcatcttacatccaatttcatatggaatattcatatctccattaaaattaacattgttagcttggcatccaccactacaataaaatcttgcccaacaatccttacattttggtttattgtaaatgtgggcctttttaaatgttttagctaaatcagaattaaatgtatcttcatatatatcacctaatttgtattcttctttaccaacaaattgatgacaaggataaacttcaccttgaggtgttattgcaacgtattcaaatcctgctccacagcctgaaattctcttataaacacaaggaccaccttgaagatctatattaaagtgatagaatttaaattcatctccatctttttttcttctcttcatttcatagtaaagattatcataattttcaaatatttttggaagatcttcttctctaagtgaaagaggatgattatcttctaaaactactggctctatagataattctctaaatccttcatttaccattgccataacatcttcataaaaatcagtattatctctcgtaaatgttcctcttacataataagtttttcctggtgttcttctctttatcatttctttaatattaggtattatatcatcataagatccactcttatctggctttattcttacattatcattaacttcttttcttccatctaatgataaaattatattgcccatttctttatccatatagtccatcatttcaggagttaaaagtgttgcattagtagtcattgtaaatcttattctcttaccccacttttcttcattatctcttgcatactttataatttctttaatcttgtccattattaaagtaggttctccaccaaataagtcaatttctatgttttttcttggaccacttctttttattacatagtctattgcctttttagctgtttcaacgctcataacgccaccatgcccatgatattcaccttcatctgcaaaacaatatttacatcttaagttacatccatgtattacatttaaacaaatagcctttatataatccctgtcatccatagaactatgcgctatctcttcgtattgatcttctgaataaagaataccatcttcagccaattcttgaatttcatcataggcctcagaaagttcttcatgatcatactttccttcaagtctttctaaaacatcctttttaggttcaagcttattatcatctaatatatcataaaccagctcatcaacaacatgaacagctcctgtatttacatccaatacaaaataattctcatcctgtttaaacttatgtattaatgccattttaaattcctcctaaaatattaatgcatatatatgtaaaaatcaccaaagcgattattaatttgttaattataatgctgaataaagcagagcagtaactattcagttactgctcttaaaaattagttttcgcattctaagtttgcaactgtgcaagaagtcttacaagctgattggcaagagtttgcgcattctttacagcctggtttgcataaactgttctttatgtttgggttgtttattgtttttatgtgcttcatttataaagccctccattcaatttttctccaataattataccactcttaggacaaattctcaatggttaataatcactgtctaattatagcaatttgaactctttaaattatataatctttctatttttattattactatatttaaaaacttttcacttatatttttaattttttctagtatattcttttacataaaaaagctaccacaaaatgattttacccctcattttatggcagctttatagcctatatttctattagattatctttaaagacagataactctatttaaaagttcgttatttctcttaataaattcgtccatttcatcagcatctaattctttatttgctattttagctaaatctaatatatgttcacatataaatttaacatcatcctttttagaatcatcttttgatgcttcagcaagtttctttacaagtggattgttattgttaactactaatgtttcctcttccttaaacattcccatcgcacccattccagcttgagcatacattttactcatttcagccattcttcttgactcttctgaaattaaaatcatagctgaagttttttcatttttcaatccctcaactgaaattttacttactttatctcctaatgtattcttaaatacatcttcaatttctttattaatgttcttttgaacttcatcattttcatctgtcttacttcctaatgtatcagatatatctgaatcaattcttttaaacttgactccattttcatgcatttctaagaatgttataaaatgatcatctaatgtacaatctaagattaacgcatcaagatcatactctttaaacatctttatatattgtgactgttgcttttcatcattagaataatatactttattttcatgcttttctttattggtttcaagataatcttttaatgtaacaaattcattttttaaattcttaaatattattatatctttaattttatcatagaatttttcatctcttaaacatccatatttaatgaatatttgaatatcaggccagaacttattaaattcctccctattatttttaaataaatcaacaagtttatctgcaactttctttattatatgatttgagattttagccacatctctatcattttgaaggaaacttcttgaaacatttaatggtaaatcaggacaatcaatagttccttttaataaaagaagaaattctggaataacttccttaatattgtcagcaacaaatacttgattattataaagttttacttgtccttctcttatctcaacctcatgagtcaatttagggaaatataggattccctttaaattgaatggataatcaacatttaaatgaatccaaaataatggttcattaaaatccatgaatacttttctataaaattctttatattcttcatcagtacactcacttggtttcttcatccataatggatgtatatcatttaaagcttttggtgcttctggttctactaattcttgatattctgttccatcatcattttttcttgtttcatatttaggttcttctttaggtttattttcatcttctaaatatatttctgtaggtaagaatgagcaatatttttctattatttgtcttaccttatattcctctaaaaattctgtactttcatcatcaagatataatgtaattgtagtacctctttcagttctttcttctgaagatgttatctcatattcagtaccaccatgacatatccatttaacaggttctgcaccttctttaaatgataaagtatctatctctacttttgtagacaccataaatgttgagtaaaatcctaatccaaagtgtcctattatatcttttccatcatccattttgtctttatatttttccataaaatctgtagcacctgaaaatgcaacctgatttatgtattttttaacttcatcttcagtcataccaataccgttatcactgaatttaagtgttttcttttctttgtttatagaaactattactttatattgctcattttctttaactttagcttctcctatacttgcaagtctttgaagcttgcttatagcgtcacacccattacttataacttctcttataaagatatccttatcagagtatagccattttttaataatcggaaatatattttctgtgtcaattgaaatattaccattttcttttatcatattataaccactcctctaatcacttaaattctaaaatatattttatatctatggcaattaattgtcaaactgatataattataccctaaaaaaatcacatttcatatattctttaaatatgtttactatctttggatcaaattgacttcctgaacatctttcaagttcatgtaatgcttcattctgtgccatagcttttttatatggtctgttatttgtcattacatcatatgaatccactacattgattattcttgatataagtggaatttctacaccctttaatccaagtggatatccacttccatcccatttctcatgatgaccaagtacatatttagcaattgtatctaaatcacttgatgcatttattatcctatatcctttttcagcatgagttttcattatctcaaattcatctattgtgagtttacctggtttcatgaggatttgttcatctatgcctattttacctatatcatgaagctgggctgttagcattaactcatctagctcatcttttttcaaattcatcttctttccaattgcttttgcatatttagaaactctctcagtatgctcattagtttcaaaactcttctcctgtaaactttttttcaatgaatttattatagaactttttatacttttcttttcaagaagctttgtcctatatactttctcctctactttctttatacaactgtatatatcttcttctaaagtaactttgatagcctcacctaaagctatatttagctgaataaattcgtgctctacctcttcacatttattattaattttattaataatctcttcacattgtacttctccagcattaggaagtaaaataataaattcatctcctccccatctgaaaatgtattttgtaaactcactacatatctctcttaatacattagcaacacttatcagtaatttatcaccttctagatgccctaatgtatcatttacaagtttaagtccatttacatcacccattattattcctagtggaagattctcactttcattaagttcttgtattttttcttcaaagctatacctattatataaaccagttaacatatcattttcacttaaatatctgagctttttttcaatctgttttctttcggttatatctcttgataatccgacaattccccaaacttctccatcatcactaataacaggtatcttgacattttcctctattatttcattattaaatttatcttttactgtttgctcataatattttgtttccctagtttccattatctctttgtcaattttcacaaattcagctgctattttattgtcaggatatatttccaaatcactttttccaataatatcgtaaattccattattattataaaactccttaaatttcttattaattccaataaagcgactttctttatctttatagaatactgattctggtaaagaatctataattgttcttaatattgtgctctgcttctttatattaatttcattttcatctatttttcctatgtcaataattatcattccaaatgcttgtatataattttctttatctttaataggaattatatagaacatcatattattcccattaatgttttctttcactatacatacatttccttcgctcatcttactcttaattttttcattatatacttttattaattctttattaaaaatacttatattgctttttcctaataccgattcaagtcgtactccaaatttactttcatacttatcatttaaatatactatgttttctgctaagtcttctatccaaatgggccatggcatattattcataagtgtttttattatatctatagtattaatcaatttttttgtatcctccactctactcatgacttatatacattcattttatattactgcattataaaaagcaaaaaagtgtcattaaatttacgacactttttttaaatctatagtattaagtgaatttataatttaaaatactaattaatatcaattaaattcattatctataacatttttatatgaaatatatgttccatacaaatatccaccataaacaattattattattagtgctgttacaaaaattgaacttaatctatttgaagaacctaaagccataagatagctgtttactgctcttattccaactattgaatgaattattgcaagacctagtggaaacataaagaatataactacttgagtaaatatacttctatttatcatagattttgaagctccaatctttcttaatgaactatatctatcaattgattcattacatgatgaaagttgttgaagtgcaagtactgctgcacttgaaagaagaaatacaattccaagatatatggttacaaataatacaagtgttgataaacctctgcttgtatccatacacatctgtcttgtcattccatatatccaaaatcctctttcttcttctaattttttctgttcatcataatccctaaaagattctttatttaatattttggtaagtttatcttcttctaattttttttcctcttcacttcctttaaaattcacatttataacctgttcagataaatgaatgttattattttctattaccttatccggaacaactaaagcaaaaagcacacttgctgttggagttgtatataagcaatcatcaaatacttttctttctttaagtttatattctttaccttcaatgtttacactattaacattatcaacaaatttattagcaattttcttcaacacttcgtaattacttgcagcaagaatctcattatctgaaagtcctataggttcatttccttgcatctttctcacttgattaaatacagagattggtattatatttattgaaccagtaaaattatgtccatttatcaactcttgtattgtcttatcttcatcaactgcatactttgaaagaagctctttaacattcgtattctttgaatagtatgttcttactatcatgctgtcacatttatcattaatatcataacctaatgactccatagcctctattggatttttatcaacagtatcttcatcaatgctgtaatatgaaattgatgcatcaaattgtgtagatttttttaatgttgattccatagaatcttttaccgcaagcccacatgcaagtgaacctattgtaacaagaagcatcaaacatataactgtcatagaaataaaatttgtattaaatttacttgaaatctgtcttatgctaaagctgtttaacttattataataaatgctactttttttagaaaccatataaaacaatacagaagaaataccatagaagaataataatgttcctactattccaagtattatagaatatttaaattctattttagtgtaatccaaacttgatattccaatataatgatatgaaaatctcaagattataattgatgtgataaatataaaagatgaaatatatatatttttaactttcatcttttcattttttcttccagcacttaaaagttctataagtttatatctcgatacacatataacattaaaaaccataacaattaaatacattattgcaaaatatatagcagtcttaacaatagcttgatatgaaatagaaaagctatattttgtcatttcaagaacaaataattttgctgtgaatatagaaagaatctgtgctaaaattaatcctaaaatcaaacctgctaaaagagatattactccaatataaaatgtttctaaaaacaatattgttgacattgatctctttttcattccaagaatcatataaagtccaaattccttttttcttctttttataagaaaatttgtagcatatataataagtgctccaagtattactgatactccaactgataaaattgacatcatttgattaagcatatctatatattgtgcctgaccttcatttaattcactcaatatgctttgagaattaattgaattaaaactataaaagatacatactgcgaaagttaatgttaaaaaataaactgtgtaatccttaaaactcttcttaacattattaaatgccattttagaatacatctttagaatcacctcctagtattgttacaacatctataattttattaaagaaatcttttctagtatcttctcctcttacaagttcattaaaaatcttaccatcctttatgaaaagaattctatgtgcataactggctgtaaatgcatcatgagttaccattaaaattgttgcttctaattctttatttaatttttctattgaatttaaaagcatctttgccgatttagaatctaatgctccagttggttcatctgccaatatgattttgggattatttacaatggcccttgctgctgcaactctctgcttctgtcctcctgacatctgatatggatattttgataatacctcttctattccaaggccttctgctgccttttttacaagagattcaacttccttaccttttttccctgcaatagtaagagctaaagctatattttcaaaagctgtcatagtatcaagaagattaaaatcctgaaatataaatcctaatttatctctcctaaatgtttctaattttcttccttttaatcttgtaatatcatctccatcaattgcaatagaacctgtagtcacattgtctatagtagaaatgcaatttaataatgttgtctttccgcttccagatggacccattatcccaacgaattcacctttttcaactctaaagcttatattatcaattgctttagtaatgttatctttattcccataatatttttcaatattttcaacctttaatatactttccatttcaaattcctccacgtcttaatgtatgattttattataagaccttagcaattcttctcatattgattactctttcacgtaccttacaattttgtaagattattttatttcttggctaattatatatgtttgaagtctattaaaaaaagcggcaacgccgctttttcattcacataatattatttcaatcactttaaaatctctataaatactttagtaaaaacttctggttcagaaaaaagttctatattaagattaagcttttcacaaagctttctgcataaataaaggccaattcctgttgattttccataaatccttccattctctcctgtaaaacctttatcaaagactctgttaatatcgcttttgggaattcctattccattatcttctataactagtttcacttttttatttgcatcaatcatatcattaaattcctttttaaaatcattctttatatgagtattattataatcttcatctatatagatttttatttgtgcacattcgtttctactatattttatagaattaattattatctgattaattataaatttaagccatttagcatcacttgtaacttgaacatcagtattatcatctattattaaccttatttttttattaataaattctcgtctattttctcttatacactcgttaataatactttgtaaattaaaagttttaataatatagtccttattaaaatcagtacttcgggaataatacaaagcttgtgttatgtatctatcaattttattcatttcatctacaagagcattcttatcatttgatatgctattttctagaatcatttttgaagatgctataggagtttttatttcatgtacccatgtttctatatattcacgataatcactttgaagatgcttataatagttgacttcttcatgcatgtttctatttgcatcctttaatacttcataaaatattcttccttcatagtaattaggcttttttattatttcagataataaatatttcttatccaaattaccgcttaattcagtcatttcaccataaaaccttttctcttgtacaaattgaagcccaatatatacgattaatggtataaaccatataaaaaatataaaaaacaaaatcacattaggaatatctgctattttcaaaacaaccgcacctaagagatatatgataaaattcattataatatatggtattttcgataatatataattcccaaaattcatagtaatatataaccaagtcctctcttagtttctattccatttttaaaccctaaatcatctaatttctttctaagtcttgtaacattaacagacaaagtattatcatcaataaaaagatctgaattccataaataatccattaaatcttccctacttactattgtttctttatttttaattaaacatgataatattttgaattcatttttacttaaatcaatgcttctatctttataagatacttctcctttgtttatattaagtttaaggcctttatgttctaatatgtcctgaacatttccaacagctgttctcctcaataatgatcctattctagctaaaagtacctgagtattatatggtttcgtaataaaatcatcagcacctaaattaatactcataatctcatccatatcactatccctacttgttacgattataatcggaatattattgttttttcttatttcacgacatataaaatacccatcataatatggaagatttatatcaagtaaaactaaatccggtttatcatttaatattatattaactacatttttataatcctctacaccatatgaatcatatccatatcgtgataaaaattcaatgagttctttttttaaattttcattatcttcaataatcataattctagacatttgttcactctcatctttcattattaataaaaagcaatttttgtaaatatatacttatgttatcatctaataataaaaaataaaagcattcctttgaatataatataatccttatataatagcagttttattatttaatactctctaccataaaaataagtatataaaaatattcatatagaatgcttttattaatatgtattattattttatcctaaatataatccttcactagctttcatatctttttccatatcatttgatataatagcaacaccactaacatcttttatactgtcaattgtttcactttcattaacttttgaatactcattaccatcatactttaaaatagcatactttttaggtgcacctccaccagaatattcaactataatatcattccatccattgctcttctcgtcacttataattattggatttcttataagtgtaaaatcacttatttcttctaatgttccattattatctttatatatcactgtactgtctccaccagttccactagtgattggacctacaacttctacaaatatttcatttactccatctccattaagatcaatacaattataataatatctagtctccttagctcctttgtcatctaaatcatatttttctttaagtgctttttccaattctggttttcgttctttttcagataatacagaagctattttttcattctcaagcagaattatattatttttactttcatcagtcttagcactactttcatcttttacatttgtattttccttttctatatttgttgcagaatttgacttgcaaccattaatagataaaaaggaaataattacacatattaaagaagacatctttataattttactcttcatttgtttacctcctatgttcatatgtattttattttttcttacaaaacaaaatctcttaatcttattatgttcataaatgctataagttatttaaattttcataaccttaaatattttctttaacttataatcaatataatttatagtatatgtatattgcaatttataattgaaattacaaggagtgattctttcatgaatagtttgcctatccctgtttcaaatttagaatttaaaaacaatgtaagtatacaattcaataatattttagatggatttaatgaatttaaaaatttcaccttagatggaaatcttgtagaaaatagagaactctcattaatcaattttatatgtgatgtttttaaacaaaataataacgaatgttatgttgatttctatataaataaaatagataaatctgaaaaagataatcttctcaatttaattgacaaagaacataaatcattattacaacaaattatagatatgaatcatgatgatgtctattataaaattacagatataaggttaattccatttttcacaaaattaaatacaagagaactcttttttgtgactttttattttactaaaaaacctattacaatctggggaaattataactttaaatttccatgtttctttaataattctcatatgtttaattatttttataatattgctaaacattctaatcttataaaaattcagcagttttaaaaatcaaactgctgaatttttatatcatccattataaattatattctaataactaatttattcacctaaatgactttcttcaaatttttcattaaatttctttataaacttgttaaatggtgtttttaagaatattccaatcaaaagtgaaattccaataaaaattagtattatagcacaatcttttataactacttctttaaccataccaccaatcatttctctcattaaagatattgtatatgtaaatggtaaaaacggatgaatactttggaaaaactttggtgtaagttctattggaaatgttccacttgatccaccaatctgaaatacaagtaatactatacatataactttcccaacatttccaaatactgaacatgcagtataaataattaatgaaaatgttattccagtaattatagatacaaaaataaaaatacctggattaatacaatatatatctagtatgtaaagatcacctatagaaactacaaaaccttgaattattgccagtgtaacaaatagtaataatttcccaaaatattcttctgtaatcttaaatacatatcccaacgcttcttttttcattttcttatgctgttttggttggtcgctcctattaacattaagaaatttatttcctaaattatctgtattatgtggatttacagataataatgaaactaaaaacaaacatcctgcccacaaggctaatgttgtataaaatggagtcattgctgtcccgtaatttcccattggaaataattcttcttcaattaagttaactggattagctaaaaaatcacttctttcttcaacatcatttcttaataattctaataattctttcaacccttcatcattattagctttatccattttcccaactaaactatttatcatttcctcagcttgaggcaattcttcttttataaattttattcccgaaatccccttatctgcaccttcatatgcagtatttaacaactcacttacattaggtaattttttttctgattcgtctaatatactaattatattatcactggttgaatatgcagtatctataatactatttattttaacagcaatatcactgtcatactttgaatataaatcatctgtcactgcttttacactttctgaaagactttttatattatttaatactgataaatctggagtcgttcctgaatttactgcatttttaacttttattaaattctccttagtactttctattgatgcatttatatttcttaatttctctacagtagagtcaagtttaggacttatcttatttaatttttctactacctttaaaagtgaatttgttaaatttccaatactatttaattttccctcaagattttctatcattccaggcactttatcacttcctgaatttatagcatcactaatggctgaagcataatctgatattccaccagatatttcgcttaggagtcttatatcttcctttattgtaggatttaaatcattaagacttgcttttgagtttgttaaaaaactttttatttcattactaagatctttactgttatctattgtggtttttattaatggaatatcttcatttatcttttgcgttaaatcttttaattgaatagctcccttataagctaaatcaacagtactattaatatcatcaaattctccttgaacttcttttaataaattatatacattagtaattttaggttttatattttctaattctattccaatactctttgttgcattcaaaagagtactgcttacagtttcaattaatgttttacttatattttcttgaactccgctagcacctttatctgtgagctttggtgcaattgcatttattttttcattaaccttataaattatatctcctttttttatattacttgtaataattgaagtaatatccttagaaaattgtggtgggattgttatggtcgcataaaatttcccttgttcaagcatttgctcagcctcatcgtcatctacaaactgccatcccataagttcattttcttttaatccatggactattaagtcccccatatttatttcttttccttctacctctgttccatcatcattatttattacacctatctttatctgactagttgcttcttttgcatatggatcccatgaagctgctatattaaaccatgcatataatgatggaagtatgcataatgctgctacagttataaacgcagcataatttgtcactatatttttaatatcagttttataaatattccatattctcttcataatgtacactccccatattatttagatacttttatctttataataggttttgtatttttagctttattattctcactataattataaaaaagcgactgcaccatccttttagttgatagtttcaactctctaaatccagtgaattcacttactttaggcattatattataaatttttatacataaacaaaaaaccacacttcataaataaagtgcagtttctatttaaaataaaatcttattatgctaatgttttaaattcatatccactatttttaaagtactcaataattttaggaagtgatttagcagtctcttcctttccataagtatcatgcattaacaatactacaatttccttgtttttagatgtatctactgcattctgaaatagttcatcagcatttttcttttttccttcagcatctttactcaatgcattccagtcaatataagtcatattattatcattcaaatatccatcaagctggttcattcccttccatgacatataccctcctggacatcttataactcgtgtagaaaaatcatctcccaaaattgattttaatagttttgtatttttattgaaatcttccttgaaagattctaaatttaatgttcttcctggataaagaatattataatcgtgtgaatatgaatggtttcctatagcatgtccagaattatactcttctttaacaagttcttttgcagcttctcctccgttatctatatttttccccattaaaaagaaagtagctttaatattatattgatctaaaatctttaataccttaggagttactgttgtggatgttccatcatcaaaagttagaaatacaatcttttccccaccattactataatctcctttttttaatttatcatttatttttactgcatcataagaatattcttccccctctttgtttactcctttagaactttttatttcattctgattactattattattttcagatgctgcttctgcccctatatcatcccttgatgtttcattatttaagttagtatttgcaatattgttaagttcataatcatttgcataggctttatttaaggccccattaaatgtaaatatcgtcatcaccaaaaacatcattatacgcataatgatgtttttgactttctttttacttaataaaacttctattcttttaaatttattttctatagcattcttaaaatttttgtctttttctaaaatttccttttcatttatttctttcaatgtttctcttataatgcgtttcattgattcttcttctgcaattttattttgtgtttcatttatagcctccagacatttttctattgtcatttctttatcttcaaattcattattttcaaactcatccataatccccactcctttatagctctgctcttattgtctctatttaaaatctattttttgaattacataaatttcatcatgtttatctatattaattagatattcaatatatgaaacaagtctgtgaattttacatatataacatataaacttcacagacttgtaatatatttttaatttttataattaatttaaaataaaaatccgaagtattaaatcactttaatacttcggaaaactctaatctttatttaaaatattctaaaccaatagcttcacgtacttctgttaatgtttgtgcagctacttgtctcgctttatcactaccatctttaagcatcttatatacataatccatatccttagcaaactcttctcttctctttcttattggttcaagttcagcctgcattacttcatttagatattttttaactttcatatctccaagtccacctcttttatagtgagccttcatttcttctacttcttctttgttaggagcaaatacatctaaataagtaaatactgtatttccttctatttgacctggatcttcaactcttatgtgattaggatctgtatacatagacattactttctttttaactgtgtctgcatcatcagataagtatatacagtttcctattgatttactcatcttagcttttccatcagttcctggtaatctaccacatgtatcatttttaggtataactgcttcaggttcaactaaaacttctccatatagactgttaaaacttctaactatttctcttgtttgttctatcattggaagctgatcttcaccaactggaacagttgtagctttaaatgctgttatatcagcagcctggcttactggatatattaaaaaccctgctggaatactattttcataatttttttgtttaatttcagatttaactgtaggatttctttcaagtcttgataatgtaacaagatttaaataatgcattgttaattcatgaagttctggaagttgtgattgaacaaaaatagttgatcttgctggatctaatcctactgctaaataatctaaagcaacttctgtaaggcttcttcttattttttctggatctcttgcattatcagttaaagcttgctgatctgcaatcattataaagctttcatattcaccagattcctgaagctgtaccctattttttaatgatcctatgtaatgacctatgtgaagctttcctgttggtctatctcctgttaatattattttcttactcattataaattcactccttaaattatctcttaataaacatattattatctaaaataaaaaactccatcctaaaaataggacggagatatatccgttgtaccacctaaaatgtgcataaaatacagcacaaaattacaatataaatttcacatctatagattataatactattaatgcttctgctgtaaggtgcagctaccatatcagatactttctgttaaaataatttctagcagatttcccttaattcctccaaggcccattcactaagtccttcttactaggattacaccatccctagttctctttattgaaccttaacttaactactcttccttttcattggatttattcataatttaatttattactatattaattctaaaaaaattaaatgtcaacatataaggctattttaaattattttcaatataaaatagccttatttaaactatttatttctatctacaatttcatttattacttgttctctattcgaacctataacatttgaaattttagttgacatagccttttctttataaattgaatccctattagaattcacaattttcattattttcgcttccatattttcataggttattaaatcttcatagtaattatccacaatatcctttaaacatgttgctaattctcttggatttctataaactgttctcattttcttctccttattattaaaaataattagttttaatatttatataaaataaattaaaaacctgttttacaagaatatttaattgttgtttattatatcactttatttaaataaattctatgatttatagttataataccgttaaaattatagtaacatttattttatactgattgtaaaatcatttggaacgatcattactatgcattttgcacgttttacaacacttgaagttacagaaccaataattctatttaaacctcttttagttgattttgtcattactattattccaatattttcttcattagcttttttaattatctcatctcctggatagccaaatgtaaagtatgtttctgtattgtaataatcctgaattttttccttagcttctgataagatatcctctgataagtcttttgccatttcaacttctttagctactatcatttcatttaacaataccagttcttttacattcattaaaataacatcaacagaacctttgggaaatatctctttaacaaattctaatgagtgcatgcttctttcagttccatctataggtattagtacttttcttttattcatataatactcccccttattatgttaccataatgccaattttataaatatttttaaatttaatgtcttatatttaatattctacattttatattcattttcctttttttatttatatttttttaatatttctctttattttcaacgcgttaattgtttacataaaaaaagttataatatctattatattattagtgtaatttacatgttacaattactaaccttaaaagcgctcctaacaaacttcaactaaccaaatataaaatttataatttcacttgtgctctgagaaaatttataggctcaaacaaaattaatatttattcaatataatattaattttatctatcagttcctttgtatctcttgtaacaagtgtttctacaggcttgttccatttattatcttcaatcaaaacaagaccataataaccatttctatcaaactgtggataccatcctatatctaatgtgatattagattcatgattaaccatatttataatatcttctgaaaattcattccaaatgctctcatcataattatttatttgtgatggattaacttttaataatttattaaaagttaatctccatttctttggtatttcaaattctactttttcatatactcctttattcattaatttttctccaccccatatacaatttttttaatttcataaaatcaaaattcatttccagtttttatttatttttaagtgtcagattaaattctcaccttctattttaccatatttttactttttagaatgcataaaataaaaaacttaccaaataaacacttgctatttggtaagtttttaactttttatttacaaacattccctgctacatttagtgcatcccatgttcttgcaaatggtggcgcataacataaatcaagcattccaagttcttttgtagtaagttttccatatatacatgctgctattacattcactctttgaacagcatccttatatcccccaacctgtcctcctagtataactttactttctgaatcataaattaattttatatatattttgctctgaccaggataataatttgtagcattcatatcattaataaatacggttttataatttaaatttaatgcttttgccttactttctgttataccagttcttcctgcttccatattcattacttttatgcagcttgatgatagtgatccttgaaattcaatatctgcaccagctaaattttctccaacaatacgcccaagtttatttgcgcctgttgctagtggtacatatgctttttcacctgttataatctgtgttattgtagcacaatctcctgctgaatatacatcctcaattgatgttttgccataattatcaactataatagctccatttggaagcatttctaaattgctgttttttaagaattcagtatttggtcttactcctgttgctataattacaacatctgcttctacttccctattagaggtcttaaccttctttacttttttatctcctataatctctgtaacactttcttgtagatataaatcaacattatggcttcttaattcttcttcaagaagatctgttatctccttatcaaaaacatcttgcaatattctatcacctaactgaaatacagaaacctttttaccatactttttagcggcttctactgcttcaagacctataaaacctgcaccaattatagcaatgttcttattattttcatctctaaacaattcctttaacctaattccatcttccatactttttaatgtatgaacattttctatatctaagtttttaattggcggaattatacttgaagcaccagttgctatcataagcttatcataataatcttcgaattcttcatttccctttaaatcttttacaattacttttttattctcaaaatctactctcttaacctcatgtaatgtttttacatcgactcctgaattaataaacgcttctggagttcttgctatcatattatttgaatcttcaaaaaagtctccaacaaaataaggcaaaccacaagctccaaaagaaactatattattcttctcatatattacaatttcagcatccttatgcattcttctaaattttgctgctgcacttgttcctgctgcaatccctccaataattataactctcattatactttcctcctgagttcttcttatgtatataatacattcttctttattattctatgacttattaataaaaataatctattgtcttataataatttatattatttttaatacattttgtcaatatatcctatcggtttacttatatattgttttagttatattaataatggatataagtggctgtatcacacttttagttaagaattcatattataatttcctaaaaaaataaaaaatgcaaagataccacttctatctttgcatttaaacatttgattctgctttacttatttatatatttgtaaatttttcatactaagatctaaaattttgcaagagtgggtcaatgctcctacagatatataatcaacaccaatctctgcaattttttttatattttctaaacatacatttcctgaaaactctataagtgcctgaccattaattaactccacagccttctgtgcagtttctaaatccatattatcaagcattattatatcagcatctgcttctaatgcttccctaaccatttcaattgtttctgtttctacttcaatttttctaacaaaagaagaattttcttttgcaagtttaactgcattttttattccaccagctgcacttatatgattatccttaagcattactccgtcagaaagattgaatctatgattaaatcctcccccaattttcacactatatttttctagaattcttaaatttggagttgtttttcttgtatccaataactttgcttttgtatgcttaatttcttctacaaatctactggtcagtgttgctataccactcattctttgtagtaaatttaatgcaattctttctcccattaatatttttctagtgttgccctttagcatgcctattttttcttttatataaacattatctccatcatttttatataaatcaatctcaacatcaccaagtatttcaaatactcttttaaatatttcaaggcctgcaattataccattttccttgcatataagatcaactgtagacatacttttttcacctataatacaatttgttgatatatcttcatttggaatgtcttcaagtaatgcattttttattatattatctatagctaagagattcattttcaagttttcctcccatttcttcaatagttcttctaacaattcgttcattttcaagacttaactctgttatattagtatttatatctttcacaataacaatattgttttctatattatctattttttcattaattaattgtgctccacgcttagaaaatacaagaccttctaaaagtgaattgcttgcaagtctattagctccatgtattcctgtacagcttgcttcacctactgcatataaattctccatagatgtttctgcgtctatatttacttttatcccacccatgaaaaaatgctgagctggagaaacttttataagttctttagttatatctgttcctctttctaagcatgatttataaattgaagaaaatctatttataatatattctttacctaaaaatcttatatcaagatttacatatggagtttctgtctttctcatttcttcataaacagcctgagatactatatctctcggtaaaagttcatcaataaacctttccccatttatgtttgtaagctttccaccttcacctcttaaagattcagatattaataatcttctatcatctttatcttcttcataaaaagcagttggatgtatttgaatataattaatatcctttaattcaacattatgcctgactgctgctgcaattccatcaccttttaaaattctttgattagttgaatttctaaacagtcctccaattccaccacatgctagtataatagatttagcatatacatttacctgttcattatccttaatcaatataacgccagagcacacattatttttttctattaaatctgcaaaataagtatcttcataaatggttatatttttttgatttttgattttatcaattaatatttttgcaacactttccccagtattgtccttagtatgcactattctatttactgaatgtgctccttctcttgtaaaatcaatatttccattattatcagtatcaaaattcagtccaaaactcattaattgttctatattatatgcagattcttccgcaagaactttaactgctttaatatcatttttatattgtcctgcttttaacgtatcttcaataaagaatggtatatcttctttattttttgctactgatatccctccttgagctaaaaacgtatttgtcatagttaatttatctttacatactacaagtatttttagattttttctcaagtttaatgctgaataaagaccagatactccagatccaataataacaacatcaaaaaatttattcatttttttcacttcctaatttatgcatattctctaaagattttaatgccttttttcttatctcctcgtctaatataacttcattattcatatttaaaagtgactcatataaattttcgagtgttgtctttttcatatcttgacaacaaattttatctcctggtatcaaaaatgttttatctggatttttattttttaattcatataaaatcccctcttcagttgcaactatatatgcttttccatcatcattagtagcataatcaataattccacttgtacttccaatataatctgccatatctcttatgtcttttggacactcagggtgtacaagtacttttgcttcactatgtttttctttagctttaaaaatgtcttctttgcttactttattatgacacctacaaaacccatcccataatataaattccttatctggaaagaactccgaaatataactacctaaatttttatctggcaaaaataatatctgtttattaggaacattttttaatatttttaatgcacttgatgaagtaactgcaacatcacaatgtgcctttaccttataagtagaatttatataacatactacaaatgcctctggatatttttctttcatctcaaccacagctttactactggccatatctgccatagcacatcctgcactaggacaaggcataagtacttttttctgtggtgataaaatttttgcactttctgccataaatcttacaccacaaaacattattgtatcctctttacaatctctggctttttcacttaaataatatgaatctccaacataatcagccaaagcttgaatttctcctggctgataataatgagccaatataaccgcatttctttctttttttaatttcaatattttatcttctaaacttaacttcatatttacaccactctttttaatgtttacaggtgtatatacaccttttgaattattatatcactgcatgtccacacattcaataaataaaaatatattgaattctaaaaactttatattaaatttattgatatactattattccttaatattgaatatatattttcatacatattctaaatataaattaaataaatcctataaaaatttttgtcttaatttattaattaacagatctattatagtaattaattttaaagattattttatttctgtattgacatatgattccagttgtactatcattgtattaacagcttagtacaataatacagtaatacaatataaaaaggagtgagactatgtcatgggattttaatgatgacagaccaatttacttacagcttatggaacaaattcaattaaaaataatctgtggcgtttataaacctggagataaacttccttcagtaagggatattgccagtgaagcttctgttaatccaaatactatgcaaaaagcattaacagagcttgaaaaaacagggctagtatttagtaagagaacaagtggacgatttattacggaggattctgatatgatcaaaaatataagaaatgatttagcaaaacatcaaatatctaactttctaaaaagaatggaagagataggatatacaaaagaagaagcaataaaacttgttgaatcaatagtaaaggagatgaaataatgaataataatgctattctagaatgtaaaaatttatctaaaactttttctaacaaggaagctcttaaagatattaatttaaaagttaataaaggaagaatagttggtcttcttggtccaaacggaagtggtaaaagtactctaataaaacttgctaatgcactccttactccaacaagtggagaaattttgattgatggtaaaaaaccaggtgtagattcaaaagaaataatatcttatcttcctgaaagaacttaccttaatgattggatgagagtctctgatattataaatttctttagtgatttttataaaaattttaataaagacaaagcttatgatatgttagctaaattaaatataaatccaaatgataaattaaaaacaatgtctaaaggtactaaagaaaaggttcagcttattcttgttatgagtcgtgaagctaaactctatcttttagatgaacctattgcaggtgttgaccctgcagcaagagattatatactaaatactataataaataactacagtgaagatgctacaataattatatctacacaccttatatcagatattgaaagaatacttgatgatgttattttcatatcttatggagatatatatttatcaaaaagtgttgatgaaattagagaaaatgaaggtaagagtgtagatgctctatttagggaggtatttaaatgttaggtaaattaattaaatatgaatttaaagctactggaagaatccttctacctctttatggtgctcttttagtatttgcattaataaatagattgcttttcagaagcagtttagatgaaactatcaataacactttcggaactattggtggcatagctaatattttaagtgtatttgcatatggatgtacaatggctgctgtctttgttgttacattttttgttatcgttcaaagattttacaaaaacattcttggggatgagggttatttaatgaatacccttcctgtaaagccttatttaaatataataaataaaatacttacatctgcaatttggacaatagtaagctgctttgtagcatttatgtcaattattcttctatttgtaacgatagatagtgttcgagatatcttctctaatatcattccagtattaagagatgtatttaattattatggtggtacaccttttatattagcaatagaattctttatagttggacttgtagaattaataacttcaattactatgatttatgcttcaatatcaataggacatttattcagtaaatctaaaatccttatgtcatttgttgcttttatagtgttaagtatactatcaaacattattaattcaatagctgtgtatatattctcatcaaatcacatatcaatgtttactgaaccttcatcaggaatgttcagtggaatattattactatcaattgtattagaattaatatatttcagtatatacttctttataacaaactatgttcttactaaaaaactaaatcttgaatagatatttcataataactttattataaaaatatttaacttattataacaaaaactcacttgatatttaaaaaaatccaagtgagttttttattgtttattatttatttaactttttaattaattcttctacatttagtccatgtactgcacatgcatcttctaatgtttccatttgcgaagatggacatcctatgcaatgcataccaaactccattaatatttttgtgttttcagcatctgcatttacgatatcagctataatcatatcttttgttataactccattttcagactttgcaccttttacttcttcaccaaagaacatttccatgtcttcttctacagttgaaattccaccaattccaaagttttcaactaagacatttgcaacattaggtgataagaatgctggtaatgttggtcctaaatgaatttcttttactcctaaatataaaagacttaaaagtactataactgctttttgttcataccacgcaatattataaataataggtaattcatttatatcggttaattcaaatacttctttcaacttaagtgctattaatgctaatgaatatgaatcattacattgacctgcatctaatactcttggaattcctcctatatcacctaagtcaagtttattatatttatactttgcacatcctgctgttaaaatcacagtatctttaggtagtgctttagcaaaatctgtatagtaatttctcttagatgctcttccatcacacccagccattactacaaacttcttaattgctccagacttaaccgcctttactactgtatcagctaaagcaaatacctgttcatgagcaaatccaccaataatttcaccagtttcaatttcagttggcgctttgcaagtctttgcaagttcaataatttcagagaaatctttcacacttccagcttctccttcaatatgtttacatcctgcaaaaccagcagcaccggttgtaaacattctatccttataagaatcttttggtggtacaatacagtttgtagtcattagtattggtccattaaatgattcaaattcttctttttgtttccaccaagcattaccgtaattacctactaaattgttgtatttctttaactgtggataatagtgagctggtaacatttctgaatgggtataaacatccacacctgttccttgtgtctgtatcaataattgttcaatatctgctaaatcatgtcctgatactaatattcctgggttctttcctacccctatgttaacttttgttatttcagggttaccataacttgaagtattagcagtatcaagaagtgccattccatcaactccaactttaccagtttctaaagttaaagcaacaagatcatcaacacttaaagtatcatctaacaattttgctaatgtttcttgcataaatgcatctatttcttcattatcatatcctaatgcatttgcatgtttagaatatgcacttaagccttttaatccataagtaattaactctcttaaagaacgaatatcttcattttctgttgataaaactccaacctcattagattgtgacttatcttttaatattttatttatttcttcagcatctttatttccatttactaaatttttaattgcacctaaaataccagttttattatctgaacttatatcccatactgcagcttctgataaaccttctttacttgaaagtttttctattaactcattcttctttgctaatgtttctttaactcttatataaaatacttcatcatcaaaatttgcatttgttattgtagtaaataaattaagagttatatagtgatttaattccttactaacttcctttccttcttctcttaatttagttgtaacttctgataaaccttttgttacatatattaacaaatcttgcatatttgcaagttctgcacttttaccacacacaccaacttttgtacatcctttatttcctgctgtttcttgacattgaaaacaaaacatattattttccataataaactcctccaatattataaatattaattttaattaattaataactatgtatttctaaattaatagtatctctttgctgttcatcagctatgtactcattgtatccctaattccaaactcagtatgtaacatatgttacaactcaaaaaaaatttaaaaaaacagactaaatataatattcagcctgtttttcaaatttataaatatgtttttaccaattcattatcttgttattgaaaaagttccatcatcattttttatatatttaaactgatcatttatagtgttaacaaatgctttaatccacaaatcccttaaattataaaactgttcaacatctatattttctctttcccatatttctttatgaacgcatattctttttttccatgtaattatatcatcttcatttactattatttcatcaactctatcacatggcattccatctaaaatataatcattaattttactatatatttcatatgcagtatcaaatgatgtattactgtttttaacttcattagcagcctttattccttgagttatatatatattctgtattttcaccacatcattaacatcatttacaattatagctctagtccaagatgccattcgaccttctgcattgtgtatcctttcttgaagccatccatgtatgttcgatgtatcaataatttcttctaaaggtctatttggaagcattttgccatattttttttctatttctttttctatattattaacatctatttctactgatgatgctaattttactatttctctttctaaattttcaaaccaaactattttattaaataaccagtaatgaatcttacctaaaaataaactcatgctacttctcctttttatcttttataaattcatatttagtatttgcatttttatattatacatgtaattaaaaacatactctgtaacataagttacagagtatgttttattctttatataattttatcactttttgtctaattttatctaaataattacaataaaataatttttagatattttatgatataattaacaaatacttatattacaaaaggtggttttatgtatgaagcaagtaattagcttaactcaaagcaaatttaatttagacgagataaaaaaactaataccaaaagattacttaatagttttcttttctcctattgaatggattgatgaaattggaaaatccatttcagaaaattatgaaaacagtattggatgttcaagttataaaaatataaataaaaatatttttgactactattctgtaagttttttaggaataaaaatagaaaatgttcaattattgctcttaaaagatataaaaaataatataatttcatattataaagaaattttatcattaaaagatatatataagaagaatcattcagtcctacttgagtttactgatggattaagccttgctgaagaatctgtactaacagttcttacaaatgaattacccgacattccacttataggaggaagttctgcagataatggtgattttttatctacaaaggtctgtataaatggagagtctgcttcaaatgcttctgctttatgtatgattacaactcctatggaaattgaatattattgtgaaaatatatatgaacctacagaaataaaaggcataatatcaaagtcagaactttttgaaagaaaggttcatgaaataaatgggatacccgctgtagatttttattgtaactcattaaatatatccaaggaacatatgaaagatgaatttatctatcatccgtttgctagaatagttggtaatagatattttatttcatcaattatgaataatgaccaaaatagttttaatttatatggacgaatttttcaagaatcctacatttctatatgcaatcctatggactatataaagttatgggaagatgcttcaaaaaaatatgctgatagttatctagggggaattttcataaactgtatattccgaacacatctttttgaaaaagaaaattcaataaaaaactttcaaaagtatcttagtacatttggagaatttatctgtatgacttcttatggtgagcaatattgtgattctcatgcaaatcaaactatgagttattgcttatttaaataatattttttaacaatcggggggataataattatgttttttaaaaagaaaattaagcactctatttctacagatcatgaatctaaatccaattcagatctaaaacattctttagaacctaagaaattcaacgataaaaaagatgttcttattcatactatttctaaaactaaagaatgcgtatccaaattattagatagcgaacatactattatagaaagtatttttaaaattaaaaactcctcagaggaaatgaatacaacagctgaaataatatcaaattctacttctgtaataaatactaaaataatagaatcatctaatgaattaactgaagtaatggatgatttaaatagaaataattcacatcttaaagactgcaacaaaagttttgattctttaaaatcaacaattaaaaatacaaatgagggaatcactgattttaaaaaaagctttgatattcttgaagataatgtaagcatggtaagctcaaatctctcttacataaatgaaataagtgaacaaacaaatttactttccctaaatgcaagtattgaagctgcacgtgctggtgaagctggaagaggttttgcaattgtagcagatgaagtacgaagcttagctgaaatgacaaaagaaacttcagcaaaaatagataaacaattaacaaatattcaccaaactctaactttaataaaaaactcagtaaatgaaattactcaaagcatggataacactaactcatccatagatacaacaatatcaaattttaatattttagaaagtagtaataaaagtataacctctaagataacaaatgatataaacaatataatttcactaaaaaacaatatttctgaaattcaagattctgtagataaaaatgaaaaaatatctaatgaattattgcttctaattgatgaactttcgctattagaaagtacaaagcctttaatctttaatcatattcaaagttatcttcatggagtagaaaaaataatataaatatagaaatgactgcttcaattttaagcagtcataatctataaatataaacactattttaatattttttctattaatggacttatatctactttctcatctgtaataacaaaagcttcttgaagttgctttaaccaatcctctttaagttcttcatcatgatatacatagcatatagtatctccaacttttatactatcaccttttttacagtttatttttagccctacaccatgattaataatatcttctttagttgctcttccagctccaagatgcattgcaagtattccaagtttttctgaatgaagcacctttatattaccgtctttttctgattttacttctgttacatatttagattttggaagaagagaagtatcatctatcatttctacacttccaccttgagccttcaccatgcttttaaacatttcaaaagcttttccagagcttacagcttcttcaagaagttttcttgcttccttttcattttctgcaatctttccttgtataagcattatttctcctgcctgcatacaaagttctgtaaagtcttttggtccatgtccttttaatgtttcaatagcttcaataatttcaattgaatttcctattgcatttccaagaggctgattcatatcagtgatcattgccattgtatttcttccaagattatttcctatagaaatcattgcttgtgctaattcaacagcatcttctatggtatgcataaaagcaccttctccatattttacatcaagtaaaattgtatccgatcctgacgcaagtttttttgacattattgacgatgctattaatggaattgaatttactgtaccagtaacatctcttaatgcatacaattttttatctgctggaaccaaatctccagtctgtcctattatagcaattccaaccttttgtacctgatttttaaactcttcttcacttaagaaacagttaaacccttcaattgattctaatttatctaatgtacctccagtatgtccaagccctcttcctgacatttttgcaacttttaaaccacatgctgcaaccattggtccaagagccatagaagtcttgtcaccaactccaccagttgaatgcttatccgcttttattccatcaattgatgataaatcaataacatctccgctattcatcattgcctttgctaaatatgctgtttctctatcattcattccatttaatacaattgccataagcaaagagcttgtttgataatctggaatagagccatctactatcccatcaatccaaaattgtatttcttcatcattaagttcaaatttttcttttttcttatttataatatcaacaaaacgcatattaatccctcacttttctattaactcatatattcaattttatcattttaaatgcattttcaaaatatatagcactttaggaaacgttttctctggctatattttaataattaacaatttgaaatagtaatataatactatttcaatatgttaattactctttttaaaatcttctttttagtacccttgtgttgcttctccttttaaaagtccaacagctctacttgttccaattctttcacaaccttcattaatgaacatttcaagatcactaacagtactaactcccccagctgctttaatctttacatttggccctatatgtttcttaaacaatttaacatcttcaatagtagctccaccagttccaaatcctgtagatgtctttataaaatcagcaccagcttcagttacagacttacacatagctattttttcttcttctgttaaataacaagtttctattattacttttaatactttatcaccacatacttcttttagtgcttttatttcctgtgtaactttatcaaataatttattcttaacatcagtaatattaattaccatatctatttcatttgcaccatcttctaaagcttttttagtttcagctactttagcttcagtacaagaatatcctaaaggaaatcctacaactgtacagatatttaattctggatatttttcatttatacgtgatatataacatgctggtatacatactgatgctgtcttatattcaattgcatcattgcatatcttttgaatatcttcccaagttgcaactggatttaataatgtgtgatctacatgacctaaaatttctactttattcattattttacctcttttctttatactaaagttttctctctatgtgataatattaataccattttgttataaggtcaacataaaatgttaaagttcaaacatttttttgttatatactacaactattaaatttcaacaactaaaaatactttaatattttattcaagtatcaatacttgttatttatagaatacagcacatattcttattttaacaataattagttcagtatattcacttcccctttaattctttaataaaaaatgttagaatataaacaataaattcaaagaataaggtgataagtttgagtaaaaaattgcagcgtgcaaataaaataatagatattctaaaggaaaaaaacggtgctactgtaaaagaattatctttaactctcggagtatctgaaatgacaataagacgtgatttagaaatattaaaatcaaataacataattaataatgtatatggtgccgctatttataatccttcaaataacatagaaaaactcgaatcattttatgacattgaaaatgaagtaatacgaaatgaagatgaaaaaattaaaataggtaaagctgcagctaatcttatacaagaagatgatgtaataataatcgatactggaacgactacagaaaaattagcacagtttatagataataatttaaatatcagtgctcttatatttaatactaatattttgatggctctatctaaaaagaaaaatattaatcttattttctctggtggttactttcatcaaaatactatgatgtttgaaagtccagaaggaatatcattaatagaaaaaacacgcgcaactaaagtttttgtttctgcgtcaggaatccatgaaaccctgggggttacatgttctaataattatgaagtattaacaaaacaagcaataataaaatcctctgttgaaaaaatacttctagtggattctaaaaaatttggtgttgtcaaatcttcttattttgctgatttaagtgattttgatacaattattactgatagcaacattcctgagcaatggagacaaaaaattaatgatattggtataaagcttattactgtaatagtatagaatataattcttaatctaaattatattctatactaattagttattaaatttacaatgcttctctttctaaagaatccgttataatcaattttctttttgatttttcatcacttgaattattaatagccataaaattatccataatattttcacttatattgattatgtctcctacactaagatcctgcttgtcccttttatatatacattctaatacagaattaataatcttaatctttttactttcaagtttcattcctattaaattgtaattattattagttccatttcctcttgatattttacttaaagcattaaaaagtctttttatttcatttctaatcatattaggggtttttaaatccttattattcaagaagttatttatatcatttatattttttttgcttaaattattgatgcctattatttcataatcatttctatttcctataccattatttatgttatctattccactacttatgtttatagctaaagtagaggctatttctttaatttcagttattgttaaattctttttcatattaattctatatttttttatattatcattaatagtttgaaggtaaattggtaatatactaatttgaaactttttataattaagtatagtaccatttccttcatttattcttattaaagctacagcagctgcattagcttctttttttatatcaactttctttcttaaatcttttccttttaagaatgtattaatatcatttaaattttccttatttaccttatatgcatccataatttgatagtcgtttaatgttccacatcctaaatttatactatatatagccttttcttcataaacttcattagttaactcctcttccttttctaaaatatcatccattgatgtttcaccatgaattgtattataatcctctaaaactgctttttttaatttacatgtttttttcttaggatataataattgaggcatatattttagtgttaggcaaatcatatctattagtatttttttcataattattactccattcatttgatttttaaacttataaataagctttcatttcactgttaatattttacattatactttgcgttttgtaaaatatttccatagaattatttgagtaataataaataattttctattctaaaagttcttcttcaagtctttctatatttataatacttattttgttcctatcaaattcaataagtccatcatctctaagtttcataagctctcttgaaagtgatggtctaggtattccaagtaaagatgctatctgctctttacttattttcaaaattacagttttattgttctgactttttgactgttctaatataaagttaacaactttctgtcgtattgttttaaaagatatggtttttatttttctatttaatataaaaattttattgctcaataaagttataaaattctttaaaattatttcttcattaaggcaaagtttaataatatcttcttttttcaaataagatattatacaatccgaagaagcaattattgtggctggatatttatttttatctgaaaatattatggcttctccaaaaacttctcctgctcccatacgtttaagaactatatgttttccgcttgagtatattctctgtatctcaacaattccatctacgactaatcctagatttttacaaacctccccctcattagcaattacctgtccttttgaatattccttagaaatatgacttaattctgaaataatcatttctatttttttatcatctatccccttaaaaaattcattttgctttattttatctataatctcattagcatttttcattttattcacccatttcaaatgtattgatatatttgtctttagtttattataatcagtttttttcataataaaagacttttcatgaattatttttcaaagaaaagtcttttatttctatattctaagcttcttctgctgatatattttctgaatctaattgtgtctttttaaacaagtttacaaatgtacctataacaattcctattaatgctggtagtatccaccctaacccttgtgaatataatggcagctttgaaaaatatctcactaaaatttcaatattaaaaccagcttgacttaaagcatcgataacactaactattcctgtaaataatattgttaataagtaaaccattttatttcctttaaacagtctatctaatattgcaagaactataagcattatagctattggataaatagcatttaatactggaactgatactgctagtatttttgtcaatcccatattagctaggatcatacttgaaagtgataaaattctaacccatgtaatatattttactttagaatttaagctagcaaaatattcgctacatgaagttataagtcctacacatgtagttaaacatgcaactgtaaatattactgctaaaagtattgctcctggttcaccaaagagatatgtcattacatagcttaaagtttgtgctccattttcagttcctccaaatcttcctccactagttgcgccaagatggcataacattgaatatactgcaattaataaagcacctgcaataataccagcctttattgagcaagaaactactgccttttcagattttacacctttagactttattgcaaatgaaattactataccaaaatttaatgccgctattgtgtccattgtaagatatccttctaaaaatccttttacaaatggtgaggatgcataatctccagttgcaattccatagcttcctaatggtttaaatattgctgaaacaaaaactaatgttataagcgctaataatattggtgtcaaaaattttcctatacgatcaacaagttttgatggtgacaagcataaccagtatgctaaactaaaaaatacaagtgtatataaaaacctagcaagtatcatgcttatatttgtatctttaagaaaaggtgcaactgccatttcaaaaggtaaacttcctgctcttggaataccaagacaaggacctattgataaataaatcaatactgtgaatactgttgcaaaaattggatttactctttgtgctaaatttcttagtcctccagatttagcaactgctataactcctaatacaggaaatccaactgctgtaataaaaaatcctaacatagaaatccatgttgcagttcctgctgattgtcctaaaaatggtggaaaaatcaaatttcctgctccaaaaaataaagaaaataacattaaacttactagtctcaaatctttttttgataaattatccataattaatatccccctcttattcttaattaataactaacaaaccataaatcttaatcttttcatatatgaaaatttaacattagttcttgttaataattaactaacatcaaatgatttctacaaaattactgaaaattactttaggcccctttaattttcatttccctactatactacttttcttctaattcaatcacttgattttaattaatacaatattagttagatttattaatgaacgaaaaaaataccccatcccttataacaaagggacgaggttaacacgcgataccaccctaattccacaaaagaaagaacatatatacatataatcaactcttgcagctctcagttacgtacaattaatacgctttccttgtaacggtggaatttccgttgaaacttactttttcaaattcagtttcactcctccaagatgattttcagtaatacactgcacattgactttcatcatccgtcaactttctgtagaacaataattattacttactttttcttttcatgggatttttatctaactttgaatttataatacacttattttaaaaacttgtcaatatttttttataattatcgacagactattaatatgcttttttaatattatatatataattttatatatccaatttctcttctataactattataattgtatttaaactttttattcctttaacttttctaaaagattatcaagttcatcctttaatctctttatctcatttttttcaagatttatcttacataccatttcttttggcacgcatgttatctcgtttttaagatttcttcccttctctgcaagttcaactataacaactctgtcatcattaatatctctatatctttttataagctccatactttccattttttttaataatggtgttagtgttcccgagtccaaatgaagccttttcccaatttctttgacagtacttttttcatcctcccaaagaacaagcatagccacatattgagtataagttaaattaaacttatctaagcatggcttatagagcttaataacttctctcgatgcagcatatagtgaaaaacatagctgattatccaactttaaatcatcaaaattactcatcatccattccctccttaaatatatgttcttaaataaactttttcttaactacttactaaactatcataatatagtatttataatgaatatttacattcaaataaatatagataccctattattttataatagttaaaacacttaacctttaactatccttaatataaaactaggtatctataattatttaatatattttttattttattataactaatttttaataaaacttattataggttagattcaataacttgtttaattctttcttttggtaaaaatcctaccattgtatcaacaattttattatctttaaataagatcattgttggaacacttgaaattctaaattcatctgctaaatcaccagactgatctatatctactttaataattttagcttttccttctagttctttgcctaaatcctcaagaacaggtccaagcattttacaaggtccgcaccaagttgcaaagaaatcaactaaaacaacaccttctgaaatttcatttctaaattcgttactatttactattttcattaaactctctcctttattttctattattaatatgcactactatatatctatcttggctttatatttttctaatatacatatgtttaaatttaattttactcaatttaatttgttaaaattattatatatacatatatgcatattgtcaatatatattttaatatagaaaataaaaaacagtagttttattatgttgaaagtttgacaatgaaaaatttcaataaataacaactataatagaaaattattaattgtcaactttcaactttgtataaaatactacctaactattattttaaaatcccttaaatttattttatattcactaagcatttcaatgactgtatctctaaattcattctgaggtgattttttttcaactactttaactggttttataagaatatcactattcctattttgtttatactgtttagttaaaatttctgctgttttaaccaataaatcatcccaatcatcaactaatataatatcattatcaatctcaaatccctttggttctcttcctgaaaaatctttatatatttctaattcaacattaacagtgttaacttcattttcagatatttcttttaattttatatcatcttgtgaagttatttcttcttcattttcgttaatattatcctctttgatttccatttctttattcccttcatctttcatccattttacatagccttttatattttctacaacctcatatatagaaatacacgtatctctatattcctgacttaaattaaaatttctactatcttttataagcttgcttgatttatcttctatatggtctattgtattttctaatatcacagatacttccaaaagtcctctttgaatttcttctgacatacttggaaaattttcaataacatactttattgtatcttctttaaataaagacaatgttttacttgatttactaatctttttcacatcattaccaataatattttcattaacatttttgttgatcattaatccttgcgtttcctctcttttaaaaaaccccattactcacaactccattcatctaataaattaatatcattatattaacatatttttactgttttgttaatgtattcttttttgtgtatgatactcatagataataatattaaataataaaaagacaaagaaaaatcattttttgaatttcctttgtctagtatttatttaattactttcacaatattcaattatagattctgctacttttttagcctgaactactgcttgaactacagtttttgcacctgttactacatctccagatgcaaaagttccttttttagtagtatgccctctatcatcagtaacaagaagtccccatttatttgtgttcaagtcttcagtgcttgaaacaatatacgttcttggtgattgacttattgcaattattgttgaatcgcattcaaaaaattcctctttaccttcaataatttctgtcatcacttttccatcttcacgtaatatattttctgtacatgcaaggcttacaccattgtctttaatctctaatggagatctaaataatttaaatttaatcccattttcttttgcttcccttatttcttctttggtagcagtcatatcttcaaagccttttctatatagaactgtaacatctgcaccattaattttagccattcttgctgcatccatcgctacatttccagctccaattacagctactttcttaccaagtctgtatacactaggtgattttaaataatcaattgcaaagtgtgtatttcctaacgtttcccctttaatatttaatgtcttcggattccacacacctgttccaataaaaacagccttatatccatcttcaaataatctatcgagtgtaattactggtcctataatagtatttggtcttatcaataccccaacatctataagcttattttctagtttatctacaattgattttggaagcctgtattctggtattccatatcttaaaacccctccaattttatcatgagcatcaaaaattgttactttatatcccttttgtgctaatataaatgcaattgttattcctgctggacctcccccaataatagctattctatctttatccttagctacattttctaaatccaaatcatctaaatatttcccggaaatttctgcttccatttcatgaaattttatgggttcaccctttattcctcttatacaatttcctttacactggtcctcatgtggacatactaaagcacatacaacagataatggattattattaaataatatttcacctgcttcatgaatctttccttctttgtacaaactaattacttcaggaataggtgtatctatgggacaattttccctgcaccttggttttttacataacagacatctatctgcttcttcttttaataatatcattgttttctcctttaataatatatttcctttgtaccttaacataaacaccatattgaattatattttaaacttttttactttcaaaatcaaacattatatttctattgataataattatctctatatattatacttattattgatataaaataaaaaatttaaggaggtctttaaaattttaaaattcaaaggagataatcatatgtggattatttttgcacttttatcagctttttttgcagcagtcacatctatattagaaaaaatagggatagatggcataaattcaagcctagccaccgcaatacgtactatagtcgtactaataatggcttggggaattgtattttttacaggaactcattcagaaatatctgatataagtattaaaagctggatatttctaattttatctggtgttgctactggactttcatggttattttactataaagcacttcaacttggagatgcttcaaaagtagttccaatagataaatttagtgttgtaataagtatgtttttagctttcataatacttaaggaagccataacttttaaaactatacttggtggtatttttattactttaggaacctttatactcattctataaaatgtataaccttttatactaaactctaataataaaaatatatctgctaatatatttttctattaacagatatgcttttattaattgtttttcaattttctctgatatcttcctataaatggtgtaattatttttcttggtaacaaaacaaatatcttgtatttaaatcctggtattatagttgtattgttttttattaaaccttcatatgccttttgggccacatattctggactcattgcagttgcattatctttttttcctgcctttttagaaaaatttgttttagttgctccagggcaaagtgctgaaactgtaatattataccccttcatctcttctgcaagtgcttctgtaaaagataatacatatgcttttgttgcataatatacagcagtatatggacctggatgatatgatccagttgaagccacatttaaaattttacctttatttatttttatcatctcatttgcaaataccttagtaagataagttacagcattcatattaagagacattatacttttatctctatcatagctttcattaataaattctccaacatatccagcacctgcattgttaattaatatatcaacattaattcctaactccattatttctctatataattcctcaacatctttttctttactcaaatcttttgaaaatataaatacttttactttatattcatcaattaacttttcttttatttctataagctttttcttatcacgtgcacacaataacaaatcatattgattttgtgcaaaaatttttgttatttcatatcctataccactggttgctccagtaattaatacgttctccatctttaattcatctcctttcagatttaaccatatagacgtatctttaatttttcagtcctctaataattatatacaaaaaaactctcctaagaaaatattaagagagttttacatttttataatataattttttaatattttattctttattataaaccaattgcccttcaaaatatgttctgcatacattaatatctgatatttcctcaaagttacttgtaaatatatttttatctaatacaataaaatctgcattttttcctatttcaatacttccaacataactttctcttccaagtatatatgctgcatcaatagtaaaactctttaatgcttccataacagttactctttcgtctggatttaacctatacttaggatccatcattatattcttgtctaatttatcctcatcactaaacttatagagatttcttgtaacagaacaccatactccttttataggattaatactttcctcattaaagtattcacatgaagatgctataagtatattattattaattaaagatttatatgggtataatctttgaattctatcttcacctatgaactcatattcatattttgtcctaacactattttgataataccaaaatggatgtattattgcatttaattccaaagttttcatccttcttaaataatatttagtaatcaggcttaaatgaactattgaatttctacattcattataattattatttttctgtgaatattcaattccatccatcgaaactttacatgcattatcccctatagcttcgactataacattaaaatctagtctatttgccatttttattccttctttaaattctagaacatcccatttaaagcgacccgtatagtcagaatcatcttggttatttctatatggtttgaataggaatgcactttgcatttctattaatccatcagcttcaaaacatgctctactaatatcaaaatatttgcttttatatattatttttaatctctttaagtcatgaagctgttcataaatagtctttcttcctatttcgtatggaaatatgttaacaccataatctatccttaattttaatttatcctttatttcagccattctataaacatcaaaaggaatttttgaaaaattattttccacaagacctattgaagttattccataagaatgaagtattttttgaaattccatcaaagaatttaaataatctttatttttataagttttaaattcattaatattaatgatatttacagcattatctttaagaattccccaaagctctccattttcatcaagttcaatttttccacctataggctcataagtattcttagtaattttaaatctctcaaaagctttatcattaagccatagcatttttccagtaacatcgcttaaaatgattgctttattttcacatatatcatttaatatttttttattaggtcctttatgaaatttatcacaacttatgaaattatcaagctcccatccacatccatatattacttctttatcaatatgtttattaatatattcttttataaccatctcatactctttcaaattcttacattcaaataaactcaaatcatccttgttcataattaatttttgaggaattttcacataagcatctacaaacgatggtattactattttatatttcaaatctattatttcagtattattgtccaataaattcatagcatcattcttcgtacctaaaaataatatttttccatttccaattcccatagcttcatatgtagtattatttttatcaaaactatatactatagcatttataaataatttctctatagttactattcttttactattcaaatacattattaactcaccacttttcttatatattgagccctgttaatatatatattcattagctttagagatttgagtgttttctatataaaaatagatatacatatttttaatatgtatatctattttagaaatatgtatatttttattgaaatactacacttatctttcatattttaaaataataccactttacatatttcttaaaatatttataaatttattctttatatatctttatttcttttattttttattatataataattattatccacaataataggaggtattttatgaaagaattgttaatagaagaaggattaaaagctccagattttaaattactcggatctgataaaaaggaacataaactaagcgattatataaataaaaaagttattttatatttttatcctaaagataatactcctggttgctcaagagaagcacaagactttaaagaatcaataaaagacttcactgataataatacaattataataggtataagcagagattccattaaatctcatgacaaatttattgaaaagtatgatcttccttttcttcttctttctgatgaagaagaaactgtatgtaacctttatggtgtattaaaagaaaaaactatgtttggtaaaaaatgtttcggcatagaaagaagtacatttcttattgatgagaatggaataataaaaaaaatttatagaaaagttaaagttgctggacatgtggatgaattaaagtgttctatagttaataattaacttttaactaaattataattaatctaatataacttaataattaatctaatataacttaataattaatctaatataacttaataattatattagattaattattttaataataaaaagagtagttataataactactctttattcttacctggcgacgtcctactcttccacacagtctcccatgcagtaccatcggcgctatagaccttaactgtcctgttcggaatgggaaggagtgttacctctatgccatcaccaccagattaagtgagcctccaaattttacatttggtcaagcgaacttatgcaaatcgtgctaacgatttgtattccttatttaattaagaaacttgtactcctcagctcgtctgagtgagtttccttattaactttttgaaaaaacttttgttctttcaaaattgcacataagtgagaatccaaattttacatttggttaatcgaacttactcagcgaactaagtgagtcgagtttcctcttaattaatgtatttacaactcgattatattggtcaagccctcgacctattagtatcagtcagctaaatacgttaccgcacttacacctctgacctatcaaccttgtagtcttcaaggggtcttactagcttatgctatgggaaatctcatcttgaggtgggcttcacacttagatgctttcagcgtttatcccttcccgacttagctacccagctatgcttctggcgaaacaactggtacaccataggtcagtccatcccggtcctctcgtactaaggacagctcctctcaaatttcctacgcccgcgacggatagggaccgaactgtctcacgacgttctgaacccagctcgcgtgccgctttaatgggcgaacagcccaacccttgggacctacttcagccccaggatgcgacgagccgacatcgaggtgccaaacctccccgtcgatgtgaactcttgggggagatcagcctgttatccccgaggtagcttttatccgttgagcgatggccctcccacgaggtaccaccggatcactaagcccgactttcgtccctgctcgacttgtaggtctcgcagtcaggctcccttatgcctttacactctacgaacgatttccgaccgttctgagggaacctttgggcgcctccgttacattttaggaggcgaccgccccagtcaaactgcccacctaacaatgtcctgtcaccagtttcatggcatccagttagaacttcaatactatcagggtggtatcccaacaacgactccattaaggctgacgccctaatttcccagtctcccacctatcctgtacagacaataccgaaattcaatgctaagctacagtaaagctctacggggtctttccgtccaatcgcgggtagcgagcatcttcactcgcactacaacttcgccggattcacagttgagacagtgcacaagtcattacgccattcgtgcgggtcagaacttacctgacaaggaatttcgctaccttaggaccgttatagttacggccgccgtttactggggcttaagttcacaccttcgcttgcgctaagtgttccccttaaccttccagcaccgggcaggcgtcagcccctatacatcagcttacgctttagcagagacctgtgtttttgttaaacagttgcttgtgcctattctctgcggcctaccaaatggtaggcaccccttctcccgaagttacggggtcaatttgcctagttccttaactgtgattcttccgtcggccttaggattctctcctcatctacctgtgtcggtttgcggtacgggcactacttctctttctagatgcttttcttggaagcatgaaatcagatacttcggttccgtagaaccttccccatcacgccctaggattgttagaacggatttgcctgttctaactccctcaacgcttagaccagcatccaatagctggcacatcctatccttctccgtcacaccatcgataataacgattatagtggtattggaatatcaaccaattgtccatcgactacgcctctcggcctcgccttaggtcccgactaaccctgagaagacaaactttactcaggaaaccttagatattcggcctgtaggattctcacctacatctcgctactaatgccaacattctcactcgtaatcagtccaccgctccttacggtacgacttcagcccgattacgacgctcctctaccgctcatacaaagtatgaacccgtagcttcggtggtaagtttgagccccggacattttcggcgcaggatctcttgactagtgagctattacgcactcttttaatgagtggctgcttctaagccaacatcctagttgtcttagaaatcccacatccttttccacttaacttacactttgggaccttagctgacgatctgggctgtttcccttttgaccatggaacttatctttcatagtctgactgccgtgctgatagtatctggcattcggagtttgataaggttcggtaagcgctatgccccctagcctattcagtgctctacctccagtactcacatttcacgacgctagccctaaagctatttcgaggagaaccagctatatccgagttcgattggaatttctccgctatccacagctcatcccatgctttttcaacagcaacgtggttcggtcctccacgaggttttaccctcgcttcaacctggccatggataggtcacccggtttcgggtctacagcatgcaactagtcgccctattaagactcggtttcccttcggctccgtaccttaagtacttaacctcgctacataccgtaactcgttggctcgttctacaaaaagcacatcatcacacacataaggtgctttgatcggttgtaggcacatggtttcaggttctatttcactcccctcccggggttcttttcacctttccctcacggtactgcttcactatcggtcatcaggtagtatttagccttgggaggtggtcctccctgcttcccacaaggtttcacgtgtctcgtggtactctggtgcagaactgatcattatgacttttacttacaggactattacctcctacggtccaactttccagttgtgttcggttaatcataatttcacgttatgttctgtccgcaaccccagagataaatctctggtttgggctctttccttttcgctcgccgctactaagaaaatcgatttttctttctcttcctctaggtacttagatgtttcagttccctaggtgttccttcgtaaagctatgtattcactttacgatgcatgaggtttctcatgcgggtttccccattcggaaatctccggatctctggctatgtgcgcctacccgaagcttatcgcagcttatcacgtccttcatcggctcctgatgccaaggcattcaccatgcgccctttgtagcttgaccttttgtttgtttattatctccaattactacgtcagctacaatatttattcattcgcgtacacatgtactactcatttcataaatattttgcttccttgtacttgaatccactaaactacacaaatacttattaaatcaagtttacttaatttaatattatttgcttttaatcattcacaaagaatatttattcttggctttgttgtattatatacattaatctatgtgcaattttcaaagaacattttcgcttgcctactacagccaattacttcgtcaacttcaaaaattattcattcatgtacattagtactactcatttcataatttttttgcttcctcgtacttgtcattattagacttcgcttttgaaagacttagtctttcaaaattgaacagaatcaatactcattaagtaacctttgagcaagttgtaatttttatagatgctttgcatctttgtactagtcaaacgccatgtttgctagatttctccatagaaaggaggtgatccagccgcaggttctcctacggctaccttgttacgacttcaccccaatcgctgaccctaccttaggtcgctgcctcgcttacgcgttagctcacgaactttgggtattgccaactctcatggtgtgacgggcggtgtgtacaaggcccgggaacgtattcaccgcgacattctgattcgcgattactagcaactccagcttcatgtaggcgagtttcagcctacaatccgaactgagatcggttttatagttttgctcactctcgcgaggttgcatctcattgtaccgaccattgtagcacgtgtgtagccctagacataaggggcatgatgatttgacgtcatccccaccttcctcccggttaacccgggcagtctcgctagagtgctcaactaaatggtagcaactaacaataagggttgcgctcgttgcgggacttaacccaacatctcacgacacgagctgacgacaaccatgcaccacctgtcttcctgccaccgaagtggcttcctccattacagagtaattcaggagatgtcaagtctaggtaaggttcttcgcgttgcttcgaattaaaccacatgctccgctgcttgtgcgggcccccgtcaattcctttgagttttaatcttgcgaccgtactccccaggcggaatacttaatgcgttagcggcggcacagaggtcatgacaacccctacacctagtattcatcgtttacggcgtggactaccagggtatctaatcctgtttgctccccacgctttcgagcctcagtgtcagttacagtccagaaaggcgccttcgccactggtattcttcctaatctctacgcatttcaccgctacactaggaattctcctttcctctcctgcactctagatatccagtttggaatgcagcacccaggttaagcccgggtatttcacatcccacttaaatatccacctacgctccctttacgcccagtaaatccggacaacgcttgccacctacgtattaccgcggctgctggcacgtagttagccgtggcttcctccttaggtaccgtcattatcgtccctaaagacagagttttacaatccgaagaccgtcatcactcacgcggcgttgctgcatcagggtttcccccattgtgcaatattccccactgctgcctcccgtaggagtctgggccgtgtctcagtcccaatgtggccgatcaccctctcaggtcggctacgcatcgtcgccttggtgagccgttacctcaccaactagctaatgcgacgcgggtccatctcatagcggattactcctttaattgctgtaccatgcggtactacaatcttatgcggtattaatcttcctttcgaaaggctattcccctctatgaggcaggttacccacgtgttactcacccgtccgccgctaatccactcccgaaggagcttcatcgctcgacttgcatgtgttaagcacgccgccagcgttcgtcctgagccaggatcaaactctcaataaaaagtttaatcttagcttactcaaaataaagaattgctggtttacttaaatgtttatattatattctgttcaattttcaaagaccattttctttcacaactttacgttgttattatgttgtcaccctcaagcgacttactcagtatatcacttagtttgacatgtgtcaacatttttttcaaaacttatttcgcttcattaatttcagcttttatatagttttaaatttattgcttgccgtcttaacgacgtgttttataatatcattaatataacaaagtaaacttttcatatgctgctattttttctgatttatattagatttcctttgatttttcttcacttttctttcattttcaattaatgacacaccacgtactgtttttgaatatttagcatatctgcatcaacattttctcatctataattcaaattattgttttattctttagatttctttgtttacaaatacacctttttaaagcttcaaggttatcaatgatttgacatcattataatttcataaagaataaaaaatctacctcatttaaaactgaagcagattttttctttaatctattatttttttaattaataatagcatacaactggagttccactatctatattattaaatatagtgttggctaaactatatggagcatttacacatccgtgtgatccaccagctacatatatattcccaccaaaactacttctccatgtagcatcatgaattccaattccaccattaaacggcatccaaaaacttaccggtgtgctataaccttccccctttaatgtggcatttctttctttatattcaagtttataaactcctcctggagttccacatccattacttacattaccagaaactattggtccatcaataataagtgaaccatctttataaaaccataaatgttgacttgataaacttacctctacataggtattgcctatatcatcagttccattacaaaatggaacctgcgaatatttaggctccctattgtcagtcttcccatcctttatagcatctagtatatatttcacttcttcagatacatctatttttcttccataatccccaccacttactgatattgtacttcctcctgttgtattgaactttctagtctttccaatagtattatatttttcagcaaacgactttaaatacgaacgaattttttcttcgctaacacttacattataatcttcatcaacatccaaaaagtcacgtattttatcaccatctaatacttcttgtgtatcccctatgtgataagttatttttgttgaaacatatttgtctaatatatcctttgcatcggttatttcctttgattctgatgtaaactttggactgtcataacactcttcttcatctaaatcaatatttgtcttccccgattcaattgcattagttatagctgttgtaacatgttctttatttaatttattgccataagtttcttttaaaatactatatttcccctcttcatattgtaatataggattctttggttcctctacaccatctgcattaaagcaagaaaatttatttatattattattaagtttatcaacatcaaaagaaaccatttccgaagatttataattattactgcaaaatccagatattatccatttaaaaggattttgagattctttaattttctgaacttcagtatcatcattatatataaggtttatatcctcaccgcttattgtttcattaaatccatctctccctttaatcttcaattcataattttttgcattactaataatttcatcataggcttcatttacagttttaccagaaacactcacgcaattaatagtagagcctaagtaaaatctattaataaaaaatacagacgtccccaaataaactgccagaataatgacaccaattataaccactcctactattatcctattatgattgctattttctaatatcatgtttcctttcacccccacaatattattataccaatttttggaagctaatatggttcctttttattttctaagagtagtttatttattttcatttttctaccaagtatctgtattttttcaaaaaacactctcaccatagaacaacaaaactttcaattcaccctaatatttaattttctatttaggaattagttttttaaattaaaaaagttcaaccttaaaactaaaattttaaagttgaacttttactcaataatcatttaagaattttctattctttttatattatacctttaaaagtattcactattttaatcttcctttttcccttagaagagctaataacatatctggatttgaatttataatataattttccggaaaatcaatagactcaagcatagtgatagcttctttaaactctcctattttagtacaaaaatgtgcatcactatttattataatagtatttccatattctttgcaaatttttgcaatttttgtgcaatttccaaggcttcctattctagatgtagtgaatgaactattatttatttcaataagaacattattttcttttgcacatttaataacttcttcaaaattaactggaactgttgggtttcctaaatgtcctataatatcaacttttccactcttaattacatttataaatgcagctgtattttcttcagcatttcccactttataaacctcatcatgaatacttcctataacaatatccagctttcctagtgtatcatcatccatatcaagatttccttcataatcaattatattagcctcaacaccataaagcatcttaacaccatacatctctcttggaagtactttgtagttattgaagtaccatatatgaggtgcatttggcattgtacatccatgttctgtggttcctaatacttttatccccttttcactagcagcctttgcattttccattaaagtagaatatgcatgaccacttacaattgtatgtgtgtgtacatctagtgcatacttcataagttattcctcttttctttaattaattatttatcccatagaaagcatcgtaacatttcatcccatgatttcaaagcgattgtatcaaatgtaaatttggaatactcgtttttcttcaaataggtgataatggctacaatctcctgggtattatacctattaaaggtataagttcaactaaatttaactggagcataaaactccacatgaaaagtttcactttgtagtttaatcaaccctatttctaaattctcctctattaaatgcacttatattttcaagaaggtcatcaaataatctttttcttgattcttcacttgcccaagcaacatgaggagtcataactaatctttctttatttctcactcctaaaagtggattatcttgtggtattggttcaacatcaaatacatccaatgccgctccacctataatttcctcatctatagctcttgctagatcatagtctacaactattggtccccttccaacattaatgagtacagaatcctttttcatctttgatagtgcttcataatttataagtccttttgttttttcatttagaggtgaatgtatcgatatgacatcactcttatctagtagttcttcaaaactaacttgtgcgtaatcaggatttacatttttaccactcgttgaataatatacaactctagctccaaaagcctgtgctattttagcaactctttttcctatagcaccaaggccaattattccccatacctttccacataaatcattataagtcatattaagattagtaaacatatcacttttagaatattccccacttttaataaattcatcaaaataacttatattattatataagtgaagaagcatagcaaaagtatgctgtgcaacagtatttgtagaataaccagcaacattagtaactgctattttattttttcttgcatatttaatatctatattattataaccagttgccatttcacatattagttttagattaggtgcatttttcaactgttcttctttcaaaatcactttattagtaagaataatatctgcatcacttattctttctgcaacctgatctccatatgtcatatcgtaataaactacttgtccaaattcattaagtttaatataatcaacatttcctaaggttttgccatctaacacaacaatttttttcataatttacagcctctcttctaacctaataaattatatacaatctaaatttaatctcaaaataatcatatcttaattaattttaaatgtaaacttttaattattcttatcactcttacatgctatattttgatttgatatatttattaaactcttctatatatttaataaattattattaaacataactaactttgtaataaatattatccacaaatttaaaataagacttatagatatagtgcttcaccaatctacaagtcttatactgtttacattatatatttatctaactgcatctggtttaatatcccaaatttcatctgcatattgttttattgtcctatcgctagaaaactgacctacattagcaagatttgcaaggcacttctttgcccatttctttttatctctataatcttcaaataccatttcttctgtctttttgaatgactcaaaatcagctagtaaataatattgatctctttcctctaataacgcattataaagatcttcaaagtatcctgttcctccatcatccaaagttccatttatcaatgtatcaactgctctctttatagatggattatctctatagtatgctttagggtcatagctatgattaatcttttcaatatcttcaactctaagtccaaaaatataattattttcttctccactagcctgaacaatttcaatattagctccatcataagttccaaatgtaggagtagcatttaacataaacttcatattacctgtacctgatgcttctttacctgctgttgaaatctgttttgacaaatctgatcctgggaataacttttgtgcatatgacactctatagttgtgtacaaaaacaactttcatcttcttcgatgcttgatcatcactatcaattaatcttgctatttcgtttataaatttaactataccttttgctctcctatatcccggaaatgctttcgccccaaagataaatgtagtctttggtatatccaaatctggattttcctttactctataatataaatctaaaatataaagagcatttaacaattgccttttgtactcatgaagcctctttatctgaatatcaaaaaacgaatctggatcaattattataccttcttcttgtttaatataagctgctaactgaatcttcttttcatgttttatatccataagtctttcaagaacatcttcatcatccatatatttttccaaatctttcaaaagacttaaattcttaacccactcttcatttccaagtaaatcagtaataaattccgataactcactattacataatctcaaccatcttcttggagttattccattagtcttattttgaaatttattaggatataaattataccagttatttaattcatgcttctttaaaatttctgtatggagcgctgcaacaccatttacagctcttccaacaaaaatagcaagattagccattcttatcacatcatttgcaacaattctaaaattccaaattgctccttcatcatatcccttttgtcttaattcattcataagagcatcatcaactgcatatgctatctgaagaattctcgggaataatctatctataagtcttatatcccatttttccaatgcttctgcaagaattgtatgatttgtgtatgcaaaaaattcttttgcaattcctaaagcagttgtgaaatcaacattttcttcatctactaatattcttaaaaattcaagaatagaaatcgttgggtgagtatcatttaattgagctacattattttttgcgaattccgaaaaatcacttccatatttagttttgtgctttttaataatgtctttcattgatgcacttgaaaagaaatattgttgtctaagtctcaatatcttccctgcttcagctgtatcgttaggatacagtactcttgatatatcttctgctttatttcttgctgaaacagcctctatatactgttgattattaaataaattaaaatcgaattctctaagggcctcacactgccacaatcttagagtatttatattttttgttccatatccaattatcggcacatcatatggaacagccttaacagtcatatctgaaaatttaattatttgtgtttcagagtcttttctaatactccaagcttctccatatttaagccatgtgtcctcacattctgtctgaaagccattttctatattctgcttaaataatccattactataccttattccatatcccatcaatggcatatttaaagtagctgccgattctataaaacaagcggcaagtcttccaagccctccattaccaagaccagcatcctcttctatttcttcaattttatttatatcaattttcatttcacaaagtacttcttttacattatcataaagcccgagattcataagattatttcccaaagctcttcccattagatattctgctgataagtaatatgccattcttcctctattataagtatcactagtttcattccagttatcaataatttcttctaaaaccgtcaatgaaactgcattaaaaatttcatagtctttagcatcttttaccttaactccatgttttacttttaaatatctttcaataccgttttttattttttctttatccaccattactcacaccttccataaattctagttaatctatatattttatttgccaactcatttgtaaacacattatctttagctctccaactccaattacttgctaaagttgaaggcttatttattcgtgcttcatttccaagatttaaaaaatcctgcataactcctatggaagtgttagctacactgctccatacccctcttataactccccaattatatccttcttcttctgtaagtttaaaatattcaactgctttttctttctcttctttagatcctgtaacttcaaaccatcctcttactgtgtcattatcatgagttccagtatatgcaacacaatttttttcataattatgtggtaaataaggattactactatcaccaccaaaggcaaattgaattatcttcatccctgggaaacctgtcctttttttaaattccaatgtttcttctgttaaatatcctaaatcttcagctataatttcaatatctcctattttctctttaataacgttaaagagtttcatctcaggacccttaatccattttccattctgagctgttttttccccataatcaacagaccaatatgcttcaaatcctctaaaatgatcaattcttaaaatatcataaagtttcaaacttgattttattctatcaacccaccattcaaaattggtcttctctaaatacccccaatcataaataggatttccccatagttgtcctgtttctgaaaaggcatctggaggacatcctgaaaccttcaatggttctaaagtttctttgtttaataaaaaaatatctggattgctccatacatccgaactatcttgagcaatatatataggtatatctcctattatctttatattttttttatttgcataatcctttaggtttttccattgagaaaaaaattcatactgtaaaaatttccaataattaacatcttcttttaattcatctttatacttttcaatttcttcattttttcttagctttatatctttattccacgaattccatgaaataaaattaaatttatattttaaggccataaaaagactgtaatcatcaagccatttcttttcgtcttcaataaattttgcaaatgactcatcatcttttgaattaaaattcatataagcttttcttaaaactttcattttttcattgaatattaatccgtaattaatcatctctttgttatcaccaaaatttttttcttcataatcatctttatctaaaagatttttttcatttaatatatctaaatctataaaatatggatttccagcaaatgccgaaaatgactgataaggagaatccccataactagtttgaccaagcggcagtatctgccagtatttttgtcctgctttttctaagaaatcacaaaattcatatgcacttcttccaaaagtacctataccatattttccaggtaatgatgatatatgcataagaataccgctgcctctttctatccccaatttcaatacctcccatatactcaataaatagctatatattaaaacatgaatccctttctacaagttctgtatcaagtattacatgcttattttcaccatcagttgttattaatgaaaataataactcaacgcttgtctcagccattttctttttaggctgttttactgtggtaatacttggattgtaatatttactttcatccataccatcaaatccaacaatagatatatctcttggtacatcaagcccattatctatagcagccttaatagctccaagtgccattatatctgataacgcaaaaattgctgttatatcttttcttttttttaacagtttatttacattttcatatgctgttccactattatattctccgcttattatcaattcatcatcaatatctatattattttctcccaaggcttttttatatccatctaaacgccaccagctcactccaaggtcattaacttctcctaaaaccaaagcaatctttttatgacccttttcaataagataacgaactgctttatatgcacttttagaattatctattccaaccgatgaataatacttcttacctttttttgaaattgtatttactgaagttaaaactacaggtactttgatgtcttcaaaactatcttcttgtatttcggtaaagttgcctcctaggcatataactccttgaagccttttttcttttacaaatccaatcatagtttcaacatcttgatatagattaaaatcattttgttgtaatatcattgtataaccattttcttcaattatatttccaataatattagtcatttctgaaaagaatggattaaatactccctttactaaaactcctatatttttagtattgttttgcttaagaattcttgcactattattcggaatataattactatctttaattatttgtaaaaccttttctcttgtactttgtttaacatctgggtgattattaataacccttgatactgtacttactccaactcctgaaagtctagctatatctttaatgttcattatttttctcctatagttataattttatttattcggtaacggtaccgttcattcattaattttttattaaattatactataatttctatattttttataattttttacaaatattttataaaagatcatttatactttaacattagctacatcaatattatattcaaaatttttataataattcaatttaagtattatttttacttttttataatattatgttatcaaaaatcaactaaattctcaatgtattttttacatttactctatataaaatctatacccattgtaaatataatgtaatcaaactatttttcattaaactttattatataaattatcaaagaaaaatactcctatgaaaattccataagagtatttaaatactaaatatttcttttttgcttccatattgcaaaggcaactttaaaaataactgcttcattaaacttccttatatcatatgaagtacatttctgaattttatccagtctatagatcaaagtatttctatgcacatatagttttttagatgcttcgctaagatttaaatttaattcaaagaaaacatcgatactctgtataatatcattatctaatctttcaaatccttcattaaacttagctataattctatttttttcatcttcatttaaattatctataatgctttcaaacattagactatccatgttaaaaaccttccctgaaacatgatatttataggctagatttaatttatatctacataaatcaaagttcttttttaaagaaacataatccgatatttctacataactcatataacatttcatataaattgatgtatataaagtttcataaatactgcaagtatgctcttgaatgttttcaaaacttccaagaagaattacatattctttaaatgtaaatatcagtatttcagtatcactatagacattgtttaatatttcaacagcttcctccgatttatcctttacacttattacaattagaaaagaatcttcctttagctgccttgtattttcttttattttttcttctgatatatctacgccatttaataaatccaaaattattttttcagaatctatgctatattcacaaaacttatccttaatacagaacttcaaaagtccaagagactccttaaacaaacctggaattataagtttgacttcactaaaaccaagtaagaaatcatcttcttccacctctgactggaagtatacaggatcagcctcaaatacaacttttccatctatatatgctttaaatggtattttacaattattatatatcttttctaagtactgatctaatcctgtcattctcttcacctcatgtcataaatatatatgcagtcaaaatagtaacttattaacagattcttaattctgaatctttatcaaatatatgaattttatctatttgaacatgtaatttaattttgtcttttggttcaaattttgtgcttccttcaacttttgcagtcatgctactacttccagatttgaagtaaatgtaactttctgcacccattctttcaacaacttcaacatctccaccaattgtaacatctacagcatctttaactaatgcttctgaatcgcttaaatgttctggtcttattccaaatacaacttccttatttacatatccaccatcttttaatattttagccttttcagttggtaataaaaccttgttgttttcgaatttagaatataattttccgtcttcttcaacaactaatccattcattaagttcatttgaggacttccgataaatcctgcaacgaataaattatttggtgtattgtatatattaagtggtgtatcaacttgttgaattataccatctttcataacaacaattcttgtacccattgttaaagcttctacttggtcatgtgttacatagataaatgttgtttctaagtcttgatataattttgatattacagttctcatttgaactcttaatttagcatcaaggtttgataatggttcgtccattaagaataccttaggttctcttacaatagcacgtccaagtgcaactctctgtctttgtccccctgataatgcttttggttttctatctaataaatgctcaatatctaatttcttagcagcatcttttacttttttctcaatttcttcctttggtgcttttcttaattttaatgcaaacgccatattatcatatactgtcatatgaggatataatgcatagttttggaaaaccattgctatatctctttctttaggttctacatcattaactaattttccaccaatatataattcacctttagatatttcttcaagtcctgcaatcattcttaaagttgttgatttaccacaaccagatggcccaacgaaaactatgaattctttatcttcaatttctaaattaaagtctttaactgctgtaacatctcctgaataaattttataaatatgtcttaatgataaatctgccatatttttgccctcccaaaattaattaatactatgttttttattataattatctgatacatactatttttattttatgtgaaattttaaatctactatatgatgtcactattaagatttacttaataaacttatttgctttttagattcacatcttccatatgtttattttactatatgtaatcctttaatatctatacggaaatttcacaaaactataataggttttttgtaagaatatataaactataataaaaaaaacttaagtgcttatataaatttacaattcacttaagttttatttgttactttttttctaatacatgtacattattaatttatttttgaatacttttcatcacatgatggatacatatttctatcccatatataatcattatctattaaaaattggtcattaactaaaaaatatttattaatattttccgaatcattattagttatgtcaatctgataccacttttcatctatttttaccatattccatgaatgggatatacctcgtgctgttcctataacaatcctattttcaacacctgcattattaaacattttataagcagtcattgaatacccctgacacactgcttttgatgttgtaagcgaagaatacacgcttactgattttaaatcataatcatattcatatctattcataatataattattaattgctttaaccttatgaaaatcagacatatcatcattaataatatcctctgtaatgttcataagttccttatcaatataattttcctgctcttttgaacataaatattttatatttaaagttgtttcaataccttcattaatattatatgcttcaggctttatttgagtccacgatctttcaagataatcatcttgagaataagcctctttaagagatgactttaaatttaatacaaaattatctttatcacctttgaatacaaattttatcttatcctctctatttatcatattttcatatatatacttttctgcatcattccagtttgaaaatacttcatatgcatatactggtatactcatagttaaaatttgcaccattataatacccgctaacatatgctttctatatttagaaaaacatttcacacttttcatcctctcgtattattaatttttcactatattaatacaataaaaagctatattattggtactataatatagctcttcatgtattgaatcattaaattttatactggtaaaacttcaatatatatacatattataattatctaaaacaaaaaaaatagccgtctgaagaataaagaaaatcaacttttcttgtttcattcaatcgtctattttacatgttgcgagataagccataagccgggttatgtgttaagcaatcatctatctaggtttattgttgccaataaactcaagcgacgcacccagaggcgggacgggcagcccctataatgcctctctattcggtcttgctccaagtggggtttacatagccgtgaagtcgccatcacgctggtaagctcttacctcacctttccacccttacctaagtttcctcaggcggtatatctctgttgcactttccttcaagtcaccttgactggacgttatccagcaccctgccctatggagcccggactttcctctcctagatctaagtctagcagcgattgcacgtctcactcgcagactttatcttaccatacttttatgaattaatcaaattatttttaatttaaatcaatataaaaataattccaagtaaaattattactattattccataaaggcttactccacataaaagaagtactaaaagcattaaccatagcacacacattttaggacataacaatatataaaaccaaggtgatctcccaggcttaaaaaaaggcggtcctccaaagcacctaggtcttctacctccatacccagaacaacaatttccacaatcatcatcgtgttcatgacgatgtccacctgaaaaacccttaacagcctttttcccgtgtttatatatatttttaaagtctttctttatatcatcaaaaaaaccgctacttttactcatataaaactccataatattgttctcattgaaatattatatgataacttctgtaaattaattcaattcattatatattaataaaattcataaggatcttttgatttttttgaatctataaattcaatatccttaaattcctcttttaaaaactcaagagtttttaaaaacaccacaaattcagttccaaaatgacctgcatcaattatattaactccaagttctttataatcacttacaaaatgataagttgtatctccagtaattatacaatcagctccaagtctttctgctacgttaaaaaaatcttgaccgcttccattaataactgcaatagtattaattttttcacgtcctttagcaactcttagattatcaatttttaaattgttttttatccttttgataacttcatctaaacttatactatcatttagtcttattattcttcctataccacaatctttattttcatttctatcatgaggttctataatctcctcactactaaatccaagcattttaacaatagtttcatttataccattttgtgcagaatcaagattagtatgacatgcatataaagttatatcttcttttattaatttaaaaactttatctccaagaagttcccctttaacaatactcttaggttttctaaaaaataaaggatgatgagctattatcatatcacacttattttgcacagcctcttcaatcacttcatttgtacaatctaaagcaaataacacctttttaatattctgatttggatctccaaccattattcctacattgtcataatcctctttaagaaacactggtgccattttttcaatcttatttgatatatcaataactttactcattaaaatctactcctaaaattttttcagcaaattttccattatttcaattttgctatcaagttctttttttctagataatgcatgttctgtgttatcttttataaaactctttacctttttatatttatcaattttttcatataagtaatctttaaacacatcacttttcttatttagtagaattggacttacctcataaaaaatattttctaacttagttgaattattttctttatatttgaccttgaatacttcataatatttaccttcatcaaaacatacatcttcgtctataatttcataatcagatatatataaatattccctaagtacttctggattttgtgctggctgcaatacaagataatccatgttttttactttcttaatatcattttctagtatatctctgattaaatttccacccataccggcaattaatacaccattaacttccttatcttttactggtgtaagtccacctccaagtctaagttcaattttattacttaatccttctaaagaaacattaagcttagctttattcaaaggatctttatttatatcagaggctattaccttatctgcaagatttcttttaattaattctatagcgatataaccatgatctgtccctacatccataataacatcacatttatccattatatttaatatccaatttagtcttttgcttagttccatttcatcaccacttttatttaattaatcagtaattttaatatttattatcacaaaatattaatttattactatttttcaaaataaggaagaagcacctaaaacaggtgcttaatctaaataatcttttaattttttacttcttgatgggtgtcttaattttcttaaagccttagcctcaatttgtcttattctttctcttgttacattaaattctttaccaacttcttcaagagttcttgctcttccatcatctaaaccaaatcttaatctcaatactttttcttcccttggtgtcaaagtatcaagtacatttataagctgttctttaagcattgtaaatgctgctgcttcagctggagctggagcttcatcatctggtataaaatcacctaaatgtgaatcttcttcttcacctataggagtttctaaagatactggttcttgtgcaatcttttggatttcacgaaccttatctactggaaggtccataacttttgaaatttcttctgggaatggatctcttcctaattcttgtaataattgtctttgaactcttataagcttatttatagtttcaaccatatgaacaggaattcttatagttcttgcttggtcagcaatagctcttgttatcgcctgtcttatccaccatgtagcataagtagagaatttgtatccttttctatagtcaaacttttcaacagcttttataagacctaaatttccttcttggattaagtctaagaataacatacctcttccaacatatcttttagcgatacttacaacaagtcttaagttggcttcagcaagtttcttctttgctctttgattaccttcttctatttgttgtgcatattctatttcttgttctgaagataataatggaaccttacctatttcctttaaatacatccttactggatcatcaatagctattccttctggaactgataaatctatttcctcttcagcatcagctgtttcattagcctctccaataatttctatattcatcatttctaatgcttcatatattttttcaatttgttctggacctaaatctatatgatccatagcttccataatttctttatatgttaaagatccatttttcttacctttatctaataattctttaactgctgacattttaacgtttttatcatttttatcatccttagtctttgcagcttttccttttgctttttgttccataataaaattgcctccttccgttataaccttttaacctcattctccccttttaagacttttagtaagtcttgttaattccattgctatttcaatagtttcctggaatttaccttctttttctaaaatactctgcttttttttaagatcttcaatctttttcttaagcttataactttgaacttcttgcatataatccttaataaccctatctttatcagtaaattctaagatttcttgttctttgatgtttattagttcttttgaactttctacatcatcgcatcgactttctaagtacgatattatattactagtatcttcgtttttaccttgtaatattaatgaataaattttattatgtgagtccaatacaaaatctccaacttttataagttcatttaattcctgaaaatattcctctttaaacatcaactttattaatgttctttctgcttttaaatatccaggttctacatataattttgttccataatctgcctttttattcataaagttattttctttttgatctttcgccattacttgagaaagcaagtcatatatcgcctgttctttaatagaagtttcttctgaaatcttcttaatatatacatctttctctataggattcaaatcagccaatatttcagcaaatttctctccatactttaccagttcattattatctcttaaattaattccttctgctgccttctttattctatattcaatcaaaggcaatgcattatctactaatcttagaaaagcatcctttccattgtttcttacaaattcatcaggatctttaccttgcggtacttttaaaactttaacatccaatcctgcatgccttaggatctcaagtcctctaagtgttgccgtctgacctgcaacatcggcatcatatgatattattactttattaacataacgctttaataatcttgcttgattaattgtaagtgcagttccaagcgaagctacagtattcgttattccatgctgatgaagagatattaaatccatatatccctcaacaataatgatataatcttgttctaacttatttttagttgcaaaatttaatccatataaatttgtgcctttgtgaaaaacgactgtctcaggtgaatttaaatactttggtttagaatcatctaacactctgccaccaaatccaataactttacctcttacatcaaatactggaaacattactctatttctgaatctatcgtaggtatttccttttttttcactttttaaaattaatcctgcttctaataaaagattttcattgaagcctttctttttcagatacattattaaatcatgccatctatcttgtgcgtagccaagtccaaagcgttttattacctcttcccttattcctctttttaagaaatattcttttgcaaaagaagttctctgtaaattataaaaataatatcgtgctgcttctgtgttgaccttataaagcaactctttcttttttgtaatttgagattcttttgcatttcctaattctaaaggaatccctgctttatcagctagatatttagacgcttcataaaatgttaattttttatatttcattacaaaggttataacatttccagcttctccacacgaaaaacatttatatatttgtttatcctgtgatacacttaacgatggagatttatcattatgaaatggacacaatccaacatagtttctgcctgatttttttaaccttacattttctgaaataatatcaacaatatcattgtcctgtcttattctttcaattacttcttcacgtatttgcaaggagacatctccctccctactgcatttttcaacagttatatattattcgacattatgcattgttttccttctaattttcataaaaaatttattataaaacatattcggctaatttgtctagttaataatgttgataactgcaatatctataattattctttattttagttaaaattcctctttattagcaaataaatttgtttaaaaaactaatctacaaccattttgggtacaaaaatcttattaaatagtagaagacaataatcatcactcattcctgcaatataatctgcaacacctctttgaagaccttcttctttaactatttttctatacacactcggcattttatctggatacttttcaaaatgtcctattaactgttccaatataaattttgccttatttctttcttctttcaatgtgtcacccaaatatatatttttaaacataaactttctcagttcaatcattgcctcattaatttctttacttaatcctatttccaatatcccatttttaagattattatttgatgtatttacaaaatcctttatcaatatatttaatctttctgatgaattattgcccaataccttgacaatttcacaaggtatatcatcaatgccaagcaaacctgctcgtatcgagtcatctatgtcatgatttaaatatgccattttatcacttactttaaccactattccctcaagggttataatatcttttgttgtcccaagtccactatgatgaagaatcccatttataacttcttttgttaaatttaaaccttcaccttcattttctaacttattaacaactctcacactctgctcattatgtctgaatccatcttttaaataattgttaagtacttcttctccattatgagcaaatgcaacatgccccaaatcatgccctaaggctatagcttcaattaaattttcatttaatcctattcctactcctatattccttgctacttgagatacttctagtgtatgtgttaagcgagttctataatgatctccagaggtttttatatatacttgagttttatgcttaagtcgtctaaaagatttactttgtataattctatctctatcatgcatataacatgttctcatatcatcaggttcttcatattttatccttcctaatgatttctttgaaaacgctgcttcatttattagtgtcaagctttcaaaactttcaattttttctcttacattcatatatatcacctcttttttatgtattctatatttatcattatattcctctaattatgacatacttttattatttgcaattattattaaaataatatatttaacataaacttttttaatttttttcttgacttttctatgtatattaattaagcaacgttaatattattaataatggaagcttaagcgtatacttttatttattaccatattttcttttgacttttaatataaaaaattgccaaggcgaccatgttataaaagatatatataaagttaactcttaaaattaatcatttaataaaacaaatttataacaatatactagatttacattattcttataaaaggagggttttatgaatagtgaatttcaagctttacaaaattctagcctttcaccggaagctatacaaaggtatgttcttcctaaattcaatttacaaaatgctcaaatttcaataattaaatttaaagatacggaaaaacaacgagcagtatacagagttgattacaacaataacagttattgtctaaaaaaagtttattatgaattagatgatttattatatgtatattcagccattgaatggctatatagaaataaaattcgcgttcctaaacttttaccaaccatagacaacaatcgttttgcacaatttaatgatatgctgttcatactaactccatggattgaaggagaaaaatgctcttttgataatatgaatcatattgaattatctataaaaaaacttgctcagatacattctatttcgagaacttttaaacctattttaggaagtaatttaaaggaaggcttcgatgattactacatatcaacattaaaacattttcaagacttattaaaatcatcaaatgattcttttaaatataaagataagttctcaaaaaaattcatttcagactttgatttaaattttagattagcaaaaatttctttagatatgtctaataaaatagaacctagccaactaagtcgatcattatgtcatggagattatgttaataaaaatattcttatacctgatgataatgatccatggattatagactttgataaatgcaagatggattattgtgccagagatttatcctactttcttagacgtctattaaaaagagaaaatacaaagtgggatttggatttatcattaaatattcttaaaacgtacaacaatataacaccacttacagaatcagatatttattatataatatcctatatatgttttcctcaaaaatactggaaaatatcacgtgactattttaaaaatgttcataaatgcaataaaaattcattttttactttgcttaataatgcaagttcaaaatctgaatatcagtatgattttgcagtaaacataatagaaaaattaaatttataaaaaaaaatcctctcaaagatttaattgctccttattaaggaaatattctttctgaggattttcatcttttaaattattactaaacttcatatttttctataaaaagtcattatgaacatttaaaacaaaatacttcaacacaaaatagaactgaaatttaaatcactttaagtttcagttctaaattatttaattatttaatatttttaaatgattctctttatcttggatttttaacttgagcctgtgctgccgcaagtcttgcaagtggcactctaaatggtgaacaagatacataatccaaaccaacattatgacagaattcaattgatgatggatcacctccatgctctccacaaattccaagatgaatatctggacgagtcgctctacctttttctgctgcaattttaaccaattgaccaacaccagtagcatctaacttagcaaatgggtcttgttcataaatctttttatcgtagtatgaagctaagaacttagctgcatcatctcttgagaacccaaatgtcatctgtgtcaaatcatttgtaccaaatgagaagaattcagcttcttttgctatttcatcagctgttaatgcagctcttggaatttcaatcatagtacctactttatattttaaatcaacaccattttcagaaataactttttcagctgtttctactataacatctttaacatattttaattctttaatttctccaattaacggaaccataatttcaggaattatactataccctttttctttattaacttcaatagcagcttcaattatagctctagtttgcatttctgctatttctggataagttacagcaagacggcatcctctatgacccatcatagggttaaattcatgcaattctgcaactgtagcttttaattcctcaaaagttattcccatttctttagctaatgcttcaatatcttcatcttcacttggtaaaaattcatgtaatggtggatccaataatcttattgttacaggcataccacaaagtgcttcataaatacctttaaaatctgatttctgcataggtaatattttagctaatgctatttttctttgttcaacatcttttgaagtaatcatttgtcttacagccataattctatcttctgcaaagaacatatgctcagttctacaaagtccaacaccttctgcaccaaattctactgcctgttttgcatctcttggagtatctgcattagttcttacttttaattttcttatttcatcagcccaagccataaatgttgcaaaatgccctgttatttctggagctactgtcttaattttttcaccatatacattaccactagtaccatctaaagatatataatcttggtcagtgtacacttttccattaacttcaacagtcttctttttctcatcaactttaattgatccacatcctgctacacaacaagtacccatacctctagcaacaacagctgcatgggaagtcattccccctcttactgttaaaatacctttagcagctatcataccttctatatcttcaggtgaagtttctaatcttactaatactacattttcaccgagactagctctttctttagcttcatctgctgtaaatgctattttaccacatgctgctcctggagatgctggtaaaccttttgcaattggttcagcattctttaaatcttcagtataaaatgctggatgtaataatgtatccaattgttttggttcaacctttaatacagcttctgttttagtcaacattccttcttctactaaatcaacagcaatttttaatgctgcttgagctgttctctttccatttctagtttgtaagaaatatagcttaccttcttctatagttatttccatatcttgcatatctttatagtgattttctaacgtattaacaattccaatgaattgtttgtaaatttcaggattttgctcttctagctttcctattggttgtggagttctaataccagcaacaacatcttcaccttgagcattcattaaatattcaccaaaaattcctttatctccagttgcaggattccttgaaaaaacaactcctgttcctgaagtttctcctttattaccaaataccatttgttgaacatttactgctgttccccattcacctggtatatcatttaaccttctatatacaatagctcttgggttttcccatgatctaaatacagctttgattgattctactagctgtacctttggatcttgtggaaaatcttcgcctttttcttttttatatatttccttaaattgagcaactaattcttttaaatcatctgctgttagttgagtatcgaattctacgccatttttttcttttatttcatcaatcttattttcaaataatctcttttcaatatccataacaacatcagagaacatttggataaatcttctatatgagtcatatgcaaatctaggattattagttaaactagccatagcttcaacagctatatcgttcaatcctaaatttaatatagtgtccatcataccaggcattgatactcttgcaccagatcttactgaaactaatagaggatttgtattatctccgaattttttacctgtaatttcttcaagctttgttaaacttgcatatacttcatctagaatttcagatgaaatctcttgaccatcttcatgatacttagtacatgcctctgtcgtaactgtaaacccacttggaactggaattcctatctttgtcatttctgctaagtttgcgccctttcctccaagcagattcctcattgaagcatttccctcactaaaaagataaacgtatttctttgtcatatcaatactccctcttttcctataaatttctcaataatatatatactaacgaacttcttataaaaattcgtagttaccctaataaataattcccttttttcccaaatttattctccattacttccaagtttaacaaataattttgtaatatttgtcttagaaaccttaccgataatcctaaattgttccttttcttgactattctcaacattttcaactatcggtatactatcaatctcgtgttctataatttttttagccaaatcatatgcattatcatctttacaggcacatattatgttaggcattcttgtcattataactccaactggaaccttgtgtatatcagttccacctattgaaattttaagaaaatcctttctagaaaccgcaccagttaatattccattattctcaataaacaatgttcctacatcgtttaaaaacaagtatacgattgcatcatacaccattgtgtcttcattaacagtggtaggttttgacattatttcagatacctttattttacttatatgctgataaactaagccgcttgatgatttaccttgatatacataaccaaccttaggtctagcatctaatgtacctatcatagtaagtactgctaaatcagctcttaaagctgcccttgtaacacctaatctctcagctagcgcttcgcttgttattggttgattttcttttactaaatttattatctcttcctgtctaggtgataatttcaaatttatccctctttctataaatacaagaaatatttgaataatattcatttttatcacacttttattataacactattttcgtgttttactagagtgaattttcagaaaaatcaaacaaatttattaaatatctcttgtatagtgattttaaattattttttctattttttattgtaatattaagctaattttcgtcagaattatttttcttttcttcttcaaaatctactgtataagtatatattgtttctccaccagtaaatgtttttccatcttcatcttttgaatttttaacttctgtcttaacatcattaactttattcttaactacatcagctaaatctgatgccttatttttaacatcattagctacctgagtaacatacttattaataacttctaccgatccatcttcctttgtcacttcaatagtaatttgagttgctatagctgcaataacaacagctgctaatattggtggaattgtaattgctattacactagctgctattccagcattaacaggtatatctaatatttctttatcatcctttttaatttttattcttgtaacattacctttttcaatcaaaccttttatcagattttttaactcttccatagatattgcattaaaagcatactcattttctttagtttcactattttcattttctttcttttgattttgttctatatagattatcgcttcaagtacatctccattacaagcctcaagagcttcttttgcttgtgcataagacacattgcatctttcacgtactacatcaacttgttctaatgttatattttccataaataatcactccttaataaatttcaacatttctaagcttttaggtttctttgtataattattagctataaaaaaggtcgttaccttttctatttcatgttttatctcattgtttaaattcaatctatatagcttatctacattaactgtcattaaataccttaaagcattatatgcacccttagatatatataccccatgttccttaggacactcttcacatactcccccaaaggaagataagcttatataattagaaacacctagtcttttcctgcatatgctacaagtgtctaatgttaaactatatcctgttgcttttaataattttatttcaaaggccctaattaaaatttcatagtcaagtacatccgtatttagtaaatacaatattgtaacaagatctttaaaaagtttctcattcacttcattttcttcacaagcaatatcaattaactcacacaaataagaagaataagtaagtttgtctaaattatttaaaagtccttgaaatgagtttattattttcccttcttgaagagtatataaatttttacccttatacaccatatattcaccatagcacaagggcagagtaagagataaaaacttactcttgctctttttagcccctcttactatagctgttatctttccaagtttttcagtatagaaccaaaccagcttatcgttttctctataatcttgagtttttattattactgctttagtctcaaaaactgacagattaatcatctcctatttactcttcttataccctaattctttcaataagttttgattatcacgccattcttttctaaccttaacccatatttttatattaacttttgctcttaggaatttttctatttcatatcttgatgtttcgccaattcttttaagtgtctgaccattctttccaattattattcccttatgagaatctttttcacatattagatccacttcaatgtggtatgttcctctttcgttttgtttcatttgaagtatatctactgcaataccatgtggcacttcatcccttaaagttcttaacgccttttctcttactatttcagatataacaaatttttcttgaacatctgttatcatatcatctggataatatttaggaccttctggcatagcttttttcattaagtctaataaagcatctacatttttaccttttatagcggaaattggtactatttcagcaaattcaaattctttagaaaacatttctaatgtttttgctactctgtcttgagtattctcatcaactttatttagtacaaaaaatactggacattttttaccttttaatgtttctaatataaatctatcacctttacctatttcttcacatgggttagttaaaaacaaaactaaatcaacatcttttgttgattcctttgcagaattaaccatgaactctcctaatttatgtttaggtttatgtattcctggagtatcaacaaacaccatttgaaaatcatcaccagttaatattgtctgtatattatttctagtagtttgaggcttattagaaactatagataatttttctcccattatataatttaataaagttgattttccaacattaggtcttccaacaattgttacaaatcctgatttaaacattcttcctccttatagcctagatttctaggcttctttttaaagttttgtcttataagtttataaattactaaatttacatcttaaaattatattcgaatacacatatattaagcaatattttatactataatctatacatgactcaaattatatgttaatgatatatgataaaattttagaatattttcacaaactaaattaaatttattttctctttaattttcacctgctatagttaatagtatactctatttattttcaatagacaattgtttataactggctttttaataagtaaagttatatttaacatttaaaaatatttttagtgtatacaatttcatatttattaatcacattaattattaaatcctaaatacagtaaatataaaaacagtgagaagcatcccaaaaacagcaccaacaacaacttctaaaacagtatgaacttctgaatccactctactttgtgcagttattactgcaagtaaaaagcttaaaagtatacatattggttcttcagttatcaaagatatagctgtagcaattgaaaatgccaatgcactatgtccgcttggcatacctccttttaaaggggtcccttccccaaaaatcgctttaactattattgttgctatacatacaataacaagaacaataaatatagtatatggttctgatgtttttactctttttacaagtgtatatgaaagatttgataacttatcccaaaatattatatacccaactacaactgcatttatggctgttaccagcacagcacctgctgctgcattttttgcaacctttgccaaaggatgataataattagtcgtcatatctatagcagcctctatagctgtattcactatttcagcacttataaccattgatatagtaactgcaagaatcaaaaattcatactttgtgacatcaaagaaaaaacaccctattaagataaataaagatactataagatgtattttcatattacgttctgtacgcactgtatctattatcccatttattgcattattaaaactatctagaacttttttcattttcatagccccaactcaactccactcatttaagaatttaaagctgatagttaatttattatattttagtattaactatcagctcgtattttatatttctcttgttatgttaagttcatttagaatttcttcttctctttttctcattataactttatcttcttcttccatatgatcatatcctaaaagatgaagtactgaatgtactacgagatatgaagcttctctttcaaaagaatgattgaattctaagctttgttctagtgctttttctaaagatagaactatatcaccaagaacaagttcttctccatcaaaatcactctgcgaaaattcataacccttatacatttccttaaagatttttttattgtcgtaatcaagcataggaaaagataacacatcagtttccctatcaatatttcttgtctcattattaatttcacgtatttcttcattatctacaaataacaaagaaacttcacatggaatttctacctcttcttctttaagagcaaattctataacttttttaagttcctcttctaatctattatctacttctatttttttctgtctgttatctacataaatcatttagttttctcctcatttttattattgtcattattctcttcatttaaactcttaattttttctttaggatactcaattctatggtgatatattccatttaatgctgttaaaaaacacttcttaatcttttctatatcctttattgtaagattgcagtcattaagctgaccacatgataatttatcactaatgatattatttatcatttccttaatcttatcttcactaggttcctttatggatctaactgctgcttcaacactatcagcaagcataattattcctgcttccttagaattaggaattggacctggatatctataatcttcttctttaactgcttctggattttcactattatttttcattgtataataaaagtatttaacaagtgttgttccatgatgctctcctattatatcctgaataactttaggaagattatgctttcttgcaagttcaataccatctttaacatgagaaattataatttttgcactcaaattaggagtcatatgattatgaggattttctcctcccatctgattttcaccaaagaaatacggtctttctgtttttccaacatcatgatagtatgatccaattcttactattaccgaatttgctcccacttcctctgatgccatttctgcaagattagcaacaagcatactatggtgatatgttcctggtgcttccattaacaactttttcaaaagcggatgatttggatttgataattctaaaagctttagtgttgtaacttcattaaatgttccttccaaaaacggaagtattcctagtgcaaatattcctgataaaacaccgcctataaatgttattccacttttaatcaacacttctcttaaattgctcgatattaatattcctgtagacactgtaattattacacctactattgatagatataaagttgaatataaaagttcatttctctgttgcatttttttcaaaagagtggcacctaatattgaactaataaccccaagcatcataacctgtgcatcaacccctgtagctatacttattactatcacatttaatatacttattactattgatattttataattaataagtaatgtcaataatattggtgcacatgcaaaaggtattaagaacggtgataccaaacctattgttctagcaaatacaagtgtcataagattaattacacttattagtgttattttcttagtatttttaaatatttctgaataatttctatcaatataattgtattgaagaaacataattatacctacaaacatcgcaagcacaatatatacatataaatatatagaagtattcttaccatcatcaagcattcctaaatcagatagaatatctaattgattttgagttacaggtacaccttctttaactataatctgattttgtttaattactacttttgctactgatttacgagtttcatctattaattcttgtgttttttcttcatcataaaaacagtttggatttatctgacctttaaccaattcctcaagcacatatttaagcttatctgccaaatttaatttttctactaaagaaactgcactgtctctagctatatttaaactctcatcatccttttcattaatatttttctcataagttttatctattatatttaaaacatccttctgtaaagagcttaattgctcttttggaatatttaaaagttctttatattcatcctcacttaaagcaataccttctatttttttcagttcgctaacattactctcaacacttgtagatgtggctgtctgagcactttgattatttattatagtatttaatttttcaaaaagaagtataacattatcttctgcttgctttttgacttctgctttttgagtatactgtttatcaaccttctctaaagccttatcttcggcttcctttgttgctctttcatctattgtatctcttggagcctttatatctgatctcggtatatctcctacctctaaactatactgttgaggctttattgctgttataagcaataaatatgataatacaaaaacacttacaaataacaatattcttcttatattattcctttttttaatattaatatcttgtttaaccttcatgttaatcaccttttcatcttcaataaaaaatcacgatatattcttagctatatcctgttctactgtaaatataacttttactaacaattttccttcaccaatatcttctgttgtaatgtccttatttattattttaacatcattgctaagggttcttttcagagaatcctctagtttattacatgcgtcctcaataattttatctttatctccctctacaggagttgcctttttctcaaaatatactatactgttaaaaactccattgttttcttctattttatcataatactgaaatttatttataacttttttcaagtaaatttttctgccccaaaagcttagatatatatcgctttgtttatctccacttctctcaagtttttcaccatcaacctgaacttccatatatttatcatagaatgtatttgcaattacttttccttttggttttgtatctacttcaaatccctctcttccttgaactggatggattaatacatcaccttcttttactatgtctcctggtactacagctggatttccagagtatgtgtatactctttttatctctccatcagtttttgccacaaccgaatcagactctttcgcttcagttgatggaggattaaccttttcttctattactaaatgtaacgttgaaccctcaatccttgttcttatccacattatctgattatttatagtctgcatttttctctctatttcatatacatttatatctgtttttttcaaacctggttttattccaatagaatcaagctgccttcttacttcaaatggagtaagattttcttttgtttctatatcaatagaccatatatagttagataatccatatattattccaaaaaaaataaacactcctacaactaaagatatacttttttttagttctatcagcctaaaaagccatccattcttattagttatcctaattttacctttatacttttttactatagatagtatttcatcataatttgcatactctgcatcaaacataatagttgttaaatcaagtttaataacattgttaactggaatacctttattccagatagcatttaatattttttcagccctaagcgcttttacttctatggttaattttccagaaataaatttattaaatatcatatcttactctcctcatatgatattccttcaaatttaccgctgatagtcatgcttgtctcaccaataaataatatttcaaagtttcttccctttattattattgcacctattcttgaatttattttaaccatagaactttcaaacgctattattcctctgtgattttcaattgttatttctctatttccaattactattatcttgggaaggtccattgaaatatcactgggaaactctaatttattcaatattttttctcgtcctttttgaaatttctcttccatactgtcctcctatttaaacttactcattgtaatttatgttaggattctctatttaatgcacaaattttatcagttaacatttgaaagtttatgatttcaagtaattttttatatttagcaaataaataataacttaaaacttgaatttttagataaaaataataaaagaactcaagaaaatcttgagttcttttattatttattatttaaatagtcttttacaatctgacttacaagtttaccatcagctctgcctacaactttaggtttaacagctgacataacttttcccatatccttaatgctatttgcacccacttgttcagctgattctattattatttttcttatctcttcttcatctaactgttgaggaaggtattttaacaaaatctctatttcagctttacactgatccactaaatcttgtctgtttcctttttcaaactcaactagagattcacgtctttgcttaacttccttagctaatatgctgatgacttcatcatcttctagctttctattatcagttttttccaccaataatagtgccgattttgcagtgctaattacgttagctgtaaatttgtcctttgtctttaaagcagctttccaatcttcttgtaatctatctttaataattgacataattgtaccctctttcaaaggaaaccataagcctatttgaattttctctttcttgcagcttctgattttttctttctctttacgcttggcttttcataatgttctctctttctaacttctgagataacaccagctctagcacattttcttttaaatcttcttaacgcactttcaagtgtttcgttttctccaactttgatttctgacatttaatatccctccctccgctagcttaaattaactcagctatgggcttaataacacatattgtattatacaatatttaaataattactgtcaagaaattaagcaaaaatcctgacatatttcaaataatatttactttagcctggtggccattgtaaattccttcctccaagcacatgaaaatgtaaatgttttacagtttgaccaccatcttctccacagttatttacaattctgtagcctttttccgcaacaccaaggtctactactaatttattaataaccttaaatatatgtgctataacatcagcattattttcatttactgaattggcactttcaatatgttcttttggtattactaaaaaatgaattggtgcttcaggatttatatcattaaaagcataaactttatcatcttcatatattttattgcttggtatatcaccatttattattttacaaaaaatacagtcttccactaaatcacctccccttatgccagctgacaatttaaaattgagaattgacaattttagatgaaattctttacggaatttcttttatatataaataataacaatataatatcagttatattaatattatctattaatcaattcaattttattataacaattttttataataattttccagtcacataatcaccgtttgcttcttctattctgcatggaactatttttcctattatttcctcactaccattaactatttctactttaacgtaatttcttgtataaccttcaaatactccaggcttttttgaaacttcctgttccaccaagacgtccatatctcttcctacaagacttctactaaagtttccttcatttttttcattaagatcaatcaaagctttacttcttttttctttaattgttccatcaatctgattatccatagttgctgctttggttccttttcttggactgaatttaaatatatgagtttttgttaattttaaattcttcaaatattcataagttaaattaaattcttcatcagtctcaccgggaaatcctactataacatcagtagtaattgaagcatctttcaagttctttctgattttatatactgcttcttcatattcctttgcagtatatcttctattcattctctttaaagttgtatcgcacccactttgaagagataaatgaaactgtgggcataactttttcatacttttcattttttcgataacactatctgtaaagaaacaaggttctattgatcctattcttactctttctatgccatcaactttttctatttcctctaatattgtcattaaagaaacatcgccttctaaatcaacaccatatgatgctgtatgaattcctgataatattatttccttaaacccatgttccgcaagtttctttatctcacttatgactttttcaggatccttagaacaaactgcacctcttgtatatggtattaaacaataagcacaaaatctattacatccatcttgtatctttaaaaacgctcttgttttatcttgatattcttctatatttaaatcttcaaattccttatttctaagaacttctccaacaacaatttgtgattccttttcatccttggctttatttacataataaacaatatcacctttgtttcttgttcctagaacaacatcaacaccttctatttttgctacttcttctggtgatacctgtgaataacatccaacagcagcaattatagcattttcatttattcttcttgctcggcttattatctgtcttgattttttatcactcatatttgttactgagcatgtatttacaacataaacatctgcaaaattgctaaagtctgttatttcataaccttctcttatgaacttttctgccatagcttctgtttcataatggtttactctgcaacctaatgttgaaaaggctacatactgttttccatcagtattttttctaactaccttatcagcagttgttttaattttagccatatcgcctgttgctctcattattttaatttggcttgccattaatctagtttcctcctaaatcacttaattcatactgaattaatgcagtagcagtaaatcctgctgtttctgtacgtaaaattcttcttccaagagttacaatatatgcaccacgattgcttaactctttaatttcatcttcctcaaatccgccttctggaccaattactatacctacattatgtatataactcaaatcttctttttcttctcttaattttttcataagagttttaactccaaagttttctgcattttcatacggaacgataacaagatccatattctccaagtttaacatagcttcttcaaaatttattacttctttaactttaggaattatgcttcgttttgattgtttgcttgcttctaaggcaattctatttaacctatctagctttttaaattctcctttaagtttaacatcaactctatcagtaattgttggtataaattcattaatccctaattcagttcccttttgaactataagatccatcttttgcccctttggaagcccttgaaaaagataaatctttatatcactctcattatttgtatcaagcttctgaattatatctactataacttcactcttatttatggaatttatctttcctaaatactctataccttcacaattattaagaataatttcttcaccttcactaagtcttaaaactttgtaaatgtgtttcacatcttcaccaacaattattcctacattttcattaatattatgaggttctgtaaaaaatttatgcataaactctcctatccgatagatttagcaactatgcagttccattctccatccttgttaatttccataacttcaaaaccacattcttttaatttgtctgtaaccatttcaactctatcatgaattattcctgaagttataaataatcccccttcattaagggcttttttaacatcagctgttaatatacatattatttcagcgattatattggcaactactatatcagctttaccttcaactacatctaaaagatttccttctaatatttcaatattatcaagattattaaatcctacattttccttagctgaatcaactgcaactggatctaagtcaactcctacaacatgttttgctccaagctttgcacctgcaattgcaagtattcctgatccgcacccaacatcaaatacagttgtatcaggttcaacatatttatctaaagcttgaatacacattcttgttgtttcatgagttcctgttccaaatgccattcctggatctagttctataactaaatctttttctgattcttcatattgttcccatattggttttattacaattttgtcagttatcttaacaggtttgtagtactgcttccagttatttgcccagtcttcttcatgcatttctttgtagcttacactaccttcaccaatttcaatatccattttctttaattcttcaagaccttttttaactgtatcaataatttcatcaactttatcatcttgagagaaataagctttaacaactgctgcatttcccttatgttctaatatatttatatctgcaaaatcccaagttaaaggtccttgatccctagataataaatcttgtggatcttcaattgcaacattaggacatcctaatccataaaatattcccgaaattggttctaacgcctcgctttttgtaattacactaacttctatccaaataccttccatgttcttcttccttcctcttattcaattgacagttattattgaaactctgatgaatttcttctatttttatcattattactatcaattggcattcttaattattatcattttgcagattttatttaaatactgcaattatattaaatttaaaataaaactctatatttatgtactaatttcctttaactgcaattaaaaacttcgttttaattccctgttctgtgaacattctttcatgttctgtttcaacatttccttcaaaatcactattgtgaagatcatatgttatatatttaattgtaaacttactttctttaaaatattcaagagattcttcgaataattcatcatcatcggttttaaaataaatctccccattatcccctaaaaagtttctatattgatttaattgtcttgtatgagtaagccttctctttttatgtttttcttttggccatggattgcaaaaattaatatatattctatcaattgaatcgccatcaccaagcatctcatttataagtcctatttcctgtgccataagtttcacattgtcaacttctctatttctttcttcaaaagccttttcaatgtttcttttagctaaacctaaaacttcatcttttatatctattgcaatataatttacattgggattctcacttccatgaacagccataaacgtgccttttccacaaccaagctctaaataaataggattctctttatttttaaaagtttctatccattttcctttgttttcttttggatttataataaaaaattcacaactttcaagctcaggtctcgcccaaggtttttttctcattctcatttttcttcactccgtcttttatcattcataataattatacatatattaatttatattgcaattttttatcaatttaaatagccttttataactactaataaactacattatataaatgataggttctcatttgtatttatgtgctatatatatttttaattttaatcaatcatattttcttacatataacttaatgaaatcctataaacatttcattacaatgtactttcagtgtaaataaaactatacttgcaatatatttatttacactaaaaattgtatcacaaaacataactaaataatatcttgccatctgtatgaaactaaaataggttgctgtgttaaataattactcagcaacctatttttattttactttttatatttatcgactagatcttcaagttcgttttcatatttatctataaagtcatgaaaattcatatttttcttttcaatcaaaagtgacagttcatataagaattctggaatttcttttgctaaaatctgaccatatacttttcctagtctagcacttccctcttcaaacgaaccatttatatgaagttcaaatgtatcctgaagttcatcatcaacttttttcttctttccagtaagacctataaggcaagcttcatgtatcccacaagaatttccacatccagaaatatgtactcttggtaatacatcttttgtataattcttttctttaaaatactctataatctcattaagcattttctgactttctaaaagtccgatttgacatgttggaactcctatacatgatatactttgctctaaatgtgtctctccaccaagattttgagtttcatttaacaatttttctgcttcttctccatttagatttctaatatacattccttcagtcatagttaatctaattgatatatccttcataccatcaattaaatttaatattttttcgagtatatatactgaaatttgccctccaataggatgaaaatacacactatataagccatcctgcttctgctctattaatctgttatttttaatatgtgtttttattccttcttttttaatagtatgtggtgataaatttaaagttaaatcttctttttcttttataatagataaatgttttttataacaatcaataaattcttcttctcccattctatccaaaatatatctaattcttgccttagctctgttattgtaatctccttctgctataaacatctgaaccatagcttcaacatgatacaacacttcactaggatttataaggtcacctaatgctattcctaccctaggattctgcccaaggcctccacctaaatatactttaaaaaattctttattattttcagttaccgctaaaaatcccaaatcagtaatgttacagtggcctgaatccatattactactagaaaatgatactttaatctttcttggaagtttatacgatgttattctctgcaaaaaataattatttactgctaaagcatatggcgtaacatcaaatgcttcaaatttatcaactccagcaagaggcgacattgctacatttctaggaaaatttcctcctgctcctcgcgtatatatattataatctagtgcttctttcataatatcacatatatcatctatagataaattatgatattgaatcgcctctcttgttgtaaaatgaatcttttccaagccatatttttcagctgttttacaaacccatcttaattcatttatatctgtaatgcctgatggaatcctaagtctaaccataaaagtattcttacttctttctgcatatgcccccatacctccagaagcatgtttaaactccataacagacacgtcaccatttaaaaatctatgacctaattctctaaactgttcaatttcttttattaattcatcttttaatctattcaaaaaaacatcacctctacctaaaaatcattactctcttcatacttagtatttattatttattttaaaaaataccacaagttaaaaatattattaaaatataaataatataaatattttctaaagtactaatcatattcctaaacattgtataaaccttatataaatcttctataaaatttatcaagacatgattttaaacaccgaaagataaatgaattatataacaaaaacataaaggagatgttaaaatgcaaataaatggagtaagtaatagttatacatcatcatcaaataacactagtcaaatacaatccttacaaagtcaattaaaaagcttgcaaagtgatctaaaaagtgttcaaagtgatacaactttagatgaggaaagtaaatcaacacaagtttctcttttagaatctcaaatttcaacaatacaatctcaaatttcaagtattcagtctgaaaatagttcaaattctaatgattctcaaagtaaaaatcaacaatcaaataaaaatgatgatattaatagaggagatgttgtagtatcaggaaatctgaatacacttattgaagcaactcgttcaggtgatactgatacaataaataaacttaaggctcaaagtaattcggaacaaaacaacacctactcatccttttaatgattaaaaatttatctatataaattaattattgcaagtgtacatttaaactgtattattttaattctaaaaaagctgtctataaaaatttatagacagctttaaaatatcaaactctatttttttccgaatagtttctttttatgagttcctgttccctcatcagcttcttcaccagatgccttcataaatgcataaagtgcttcttcttgtgctttatttaaagatttaggaatatcaactataactttaacgtattgatctcccttacctgttgaattaactctttgaattcccttgctctttagtctaaacatagttcctgactgagtacctgctggaatagtatacttaacatttccatctactgtagcgacagttatttctgtacctaatgcagcttttgccatagaaatatgtgtatctatataaatatcatttccttttcttgtaaacaccttcgatggagtgacatttattttaatatataagtcaccaggagttccgcctcttagcccatgttctccttgtcctcttaaaggcattacatttcctgtgtctacaccagctggaatattaactttaatcgttctattctttcttatattaccttttcccttacattccttacatggagtctcagtaatcttcccactaccttgacaatgatcacatgtagaagttgatacaaaacttcctaaaggagtttgtctttgaactcttacttgacctgatccaccacatgttggacatgttttaacatttgtccctggctcagcaccagaaccactacaatgttcacagttttcgcttctagttatagaaatttccttctcaacaccaaaaacagcttcttcaaaagtcaatgtcacagtgtattctatatcattacctcttactgggccatttcttctcctagagcttccaccgccgccgccaaagaatgattcaaaaatatcgccaaatccacccatatcaaagccatcaaatccaccgaatccaccgccattgaatccacctgtaccatcaaatgctgctgatccaaattgatcatatttagcttttttttctggatctgaaagaatctgataagcttcatttatttccttaaacttctcttcagcttcagcattcccttgatttctatctggatgatattttacggctaattttctaaaggctctttttatttcgtcatcacttgcgcctttttgaaggccaagcacttcataatagtctttatttgccattgttttatactcaccaccattaaattaattgacatttgacagttattttttgtcaaatgcttttgtttatacttttttactttagaaaaagggaagacgagtttgccttccctgtattaattatatctaaaatcagattttagtaaaccctattatttatcgtcgtctactttaaagtctgcatctactacattgtcatcatgtggagcactttgttctccagctgcagcatttggatcaaatccttgaccttcagctcctgcttgttgatacatcttagtagctattggatagaatgattggttaacagcttctatagctgcttttatagcttctatatcttcaccatctttaatcttctttaattcttctatcttagcttctacatttgctttttcatcagctgttactttatctccagcttcagttaaagctttttctatttgatagattgtttggtctgctgtatttacagtttcaatcttttcttttctcttcttatcttcttcagcaaatttttctgcttcttttacagccttatctacttcatcatcacttaagttagttgaagctgtaattgtgatgttagcttccttaccagttcccttatctaatgcagataccttaacaataccattagcatctatatcaaatgtaacttcgatttgaggaattcctcttggagctggagctattcctgataatgtgaatcttccaagcgacttgttatccatagccatttgtctttcaccttgaactacgttgatttcaactgaagtttggttatcagctgcagttgagaatacttggctcttcttagttggaatagttgtatttctttctattaatggagtagcaattccacctgctgtttcaattcctaatgttaatggagtaacatcaagtaatactacatccttaacttctcctgttaatacaccagcttggatagctgcaccaacagcaacacattcatctgggttaactcctcttgatggttcttttcctgtaaatttcttaacagcttcttgaacagctggaattcttgttgatccaccaactaatattatcttatctatatcatttaatgataatttagcatcagctaaagctttcttcattggttctattgatctttgaactaaatcgtgagttaattcatcaaatttagctctagttaatgttaaatcaatgtgttttggaccagttgcatctgctgttataaatggtaagttaatgtttgtttgcattgaagatgataattcaatcttagctttttcagcagcttcttttaatctttgaactgccattttatcttgcattaaatcaattccgttttcagctttgaaagtatctgcaatatagtgcataacagcttcatcaaagtcgtctccaccaagtttagtatcaccatttgtagataatacttcaaatacaccatcacctaagtcaaggatagatacatcgaaagtacctccacctaagtcatatactaatattttatgagcttcatccattttatctaaaccgtaagcaagagatgctgctgttggttcgttgattattcttaatacttcaagacctgcaatcttacctgcgtctttagttgcttgtctttggctatcattaaagtaagctggaacagtaataactgcttgatttacagtttcacctaagtaagcttctgcatcagctttgattttttgaagaaccattgctgaaatttcttgtggtgaatattgttttccatctatatcaactttataagatgttcccatatgtctctttattgaaataactgttttatctggattagtaatcgcttgtcttttagcaacttgccctactaatctttctccatttgcttggaatgatactactgatggagtagttcttgcaccttctgtattagctataactgttggttctccaccttccataactgctacacatgaatttgtagttcctaaatcgatacctataatctttgccatgatttattcctcctaaaaacatttaagttttattttttaatttatataaacaaattttaagtatatttctaatttattttattaaataattacatttaatttgcaaccttaaccattgtatgtcttattattttgtcatcctttttatatcccttttggaatacttcagcaacaacatttttttctaaactttcatcttcaatatgcataactgcattgtggaagtttggatcaaattcaccagttgcatctatttcttcaacgcctaatttagaaaatgcatcttggcatcccttcattgtcatttctacacctttttttaggtcttctaatgtgccatcagctgcaattgctctttctaaattatctataactggtaggatttcttttacaacatctacataagcatcgctgtatattccttctttttcttttatagatcttcttctataattgtcatattcagctctcagtcttaaaagagtatcttttgttgtatctaattcttcttgaagtttcttattttgctttttaatcatatcaagctcatcctcttctgtgctttcacttccttcagaagtttccactttttcttcattattagattcatcattaactactgattccttttctgtagtttcttcattttcaactacttcagtcttaatttcttcattcatcatttctttattatcttccataagtctttaactacacctcatctctgaatataaatgattatattttttgattatttaatatattattaagttcttttacaacctgagataaaatggtaataacccttgagtaatctattcttcttgggccaattaatccaatttttccaacaggtctatctcctaaggagtattctgctgagataatgctgcattctttagcctgtggtttataattttcatcccctatacttattgtgatatcatctgatggattaaataattccattatagagtctttatcattaaaaagagaaagcatttccttggctttatttatatcgttgtattctggataattaaaaatattagttgttccttccatgaatacttccgatgaatctgctgcatttaatgtttcatataaaagaggcaaaatagcattgaatatttcttcatactgacctaaatcctttttaaggttgtttatcacttccaaattaatctgttctattgaaagacctgaaagtcttgaattgacaacctcatttattctatttaaaacatcaatagtcggaacattgctatttaatttcataatatgattttttataagtcctgtatctgttagaaacacagaaactatattatgattatcaacttttataagctgaattgattttataaaacttttcttaactgacggtgcttctattacacatgtcaactttgtaagctctgataataagctgcttgtttgtttgactatcttatcaacttcaagcattgctgaatccacaatgtactgctttatccttaaattctcttctgctgtaagtcgctgactttccatcaatttatcaacatacaatctatatcctttacttgatggaatccttcctgctgaagcatgtggttgttccaaataccccagatcttcaaggtctgccatttcatttcttactgttgcagatccaattcccaaatcataatttttagcaattgttctcgatcctacaggatcaccagtacgaatatagtcattgataatagcttgaagtatttttatttttctatcatcaatccccatagtctcacctctttttattagcactcattagcaacgagtgctaatgactatgttttaaatatattatttatgatgttttttgtcaattctatttatttttaatatatgtatttattatttatattttatcgtttgcgtttaattatctttaaaattcttcaactttctctagtttactaccctacttgctctcacaaagaatatatctactctcagacgattatctaaaataaaaataatcatgatttatattctaattcagtataaaatcactcattacataattagatagttcaattcctttctcactcaaatatagtttttccgaatcaacaactaataaaccttttttaatattattttttattacttcatcgtaaatatcaaatacatcttttccaaatcttttcttaaatgtttttagatttattccttctatcattctaagtcccataaacataaattcttccatatcatcatttatattatttacgtgaatttcttctgttacatcttcattattatttatcttttctatatatattttaatatcatctatgtttttgaaccttttttcatccacaaaagaacttgcagaaactccaagtcccaaatattcattacatttccaatatactttgttatgaaaacattccttgttaacttttgcataatttgaaatttcgtattgattatatccgtaatcttcaaggaatccttttgtaaataaatacatacttctttcctcttcttcatttggaatatttaacttatcattattgtataaattataaaaacaagttccttcttcaattatgagactatatgctgaaatatgatcaggttcaagactcataacatcttttaaacttgccttccaatctttcatatgctgatttggtaatccaaacattaaatctacattaatattttcaaatccagcctttctagcttgattataattttttttaaactcttcaaagctatgaattcttcctatttctttaagaagattatcatttgttgtttgcaatcccatacttattctatttacattataatttttcattaaaactaatttttcttcattaagtgttcctggattacactctattgtaaactcaaagttatctttaaaatctaataaatttatagtctttaacagactttctaaatttatttcatttaaatatgatggtgtaccaccacccacaaaaatacttgctattttatattttgaacattttcttaaaatttcttcattcaatgctctaatatactcatttattaaactttcttttcctgcatatgatggaaaatcacaatataagcatttttgtttgcaaaatggaatatgtatatataaagacatttctttcattaaaatttcctcctaaaattcaaaaagactgaccaataaggtcagcctttttaatttaactattattcattaatctactttaagtacagccataaacgcttcttgtggtacttcaacagatccaacctgtctcattctcttctttccttctttttgcttttcaagaagtttcttctttctcgatatgtcaccaccataacattttgctaatacgtcttttctcatagctttaacagtttctcttgctataatcttagatccaattgctgcctgaattggaacttcaaacatctgtcttggaattatttcttttaacttttctgcaatacctctacctttgtgataagctctttcatcaggaactatcattgataaggcatctaccacatctccatttaatagaatatcaagtttaacaagctttgttcttatatatcctttaaattcatagtctaaagatgcataacctcttgttcttgattttaaagtatcaaaaaagtcatatataatttcatttaatggtatatcgtaattaacaactgctcttgtttcttcaatatattgcatatcaatatatgttcctctacgatcctggcaaagttccataacagctcctacataatcctttggagttattatagatgctttaacaacaggttcttccatataatcaacttctgtagcttctggaagatttgtaggattagttatttctaaaatttctccatctgtttttattactttgtatataacagatggtgctgttgtaattatatctaaattaaattctctctctactctttcttgaattatttccatatgtaataatcccaagaatccacatctaaatccaaaacctaatgctatagatgtttctggttcaaaactcaatgctgcatcatttatttgaagcttttccaatgcttcttttaattcatcatatttagctccatcaactggataaatacccgaataaaccattggaatagctggtttatatcctggtaaagccttttctgtaggccttaatgcttctgttattgtatcaccaactctagcatctcttacattttttatagatgcagttatatatccaacatcacctgcacttaaacttcccattggaagtacattaggcgtaaatactcctacctcagtaacatcatataccttattagtcgccataagtttaattttgtcgccaatttttacttttccatcttttactctaacaatacatacaacacctttgtaactatcgtaatacgaatcaaatattagagcttttaacggtgcttcttcatccccattaggagctggtatattctttactactgactctaatacatccttaatattaagccctgtttttgctgatatcataggtgcttcttcagcatcaattcctataatatcttcaatttcttgttttatttcatcaggtctcgctgatggtaagtctattttatttattactggcgctatttcaagatcattatctaaagctaaatagcaattagctaaagtctgtgcttgaataccctgagtagcatctactacaagtacagctccctcacaagctgcaagacttcttgaaacttcatagttaaagtctacgtgacctggagtatcaattagattaagaatatattcttcgccgtcatctcttctatatataagtcttgctgcttgagactttattgttattcctctttctttttctatctccatattatctagaacttgttcttccatttccctctttgttaaggttcctgtagtttcaagtaatctgtccgcaagggttgacttaccgtgatcaatatgtgctactatcgaaaaatttctgatatgttgttgtctttcacttttcataatacactaacctatattcaattaacagtttacagtttacagtttgcagttaatgatgaaatctgatactgatttctttattttttacaatatattaaaaaattataatgtataaatgttttatacaaaagtttctatttaactgctacctattacttgttaacttttaactgggtaaggtttagcttttcacccccgttataattaaatcagctaaattatatcatacatctatttaaaaaggctattaaaatttaactatagacaaaaataactatttaatgctgtttattttattttcaatatacttaattatttctgattctgatgaaattttaaactctgcatctcctaaacgaacaagtacttttttattatcagaatcctcataaatttttaaaaatgaattatcttttataaaatttgcaaaatcagctccaaatttttcacttactaattcataattttgtttagtatttcctaaaggggataatgttttagtatttattatattaatatgtatcaaacatgcaatgactagtactgtcattgcaattataggtactacagtttttaacacgtattttttatactttctcttcaatgtcaacaccctaacttatattataaattctttttaggcatatgaaagaaaataacaagtctaaatcattgacttgttattttttgataatgccttatattagagtatttccattaaattgtcttttattcaataaaacttatttagtatatattttaacattaattattcattatcatatgccaataaaaatatatctattgttttccgtttaatatttcagcaataattcttgccatacattgtgctgttacttttgattcatctggagtatttgtatgcgatcctatttcaaataatacacatccatcacttttactttgattaaaagcatttttacctctattatatgtgtaaatttctcttggaagtcctggaaacaattcttttgttttattaaatatcttttctgtaagttctttatttttttcatatcttgtactatttttagcatttacaaacataattcttgatgcactcataccatatacttcagttgttgtagctgccttgttattaacagaatctctatgaagatctattattattttaaaatctccatattcttttaaataataatctacagtttctgctgatctattataactatcatcatatgattgacagtgattagttttatcatgaattacagatattccatagttattctttaactcattttcaagaacatctcctacaccaactacatttgtttcttcatttaaactatcaggagcatttgcatcataattttcacttgtatgggtatgataaattaaaacttccggtttagattcatcaagaggtttctttaatgcaggattgtaaatctgtgtatttgtactatcgctagtataagtttcctttgatatgctatcttcactaacagtaaatggattataggaaacaatcgtatttgaactgttattagatgaattattactcacataattattattatctaatttatctatacttcctaaaatgcttaattcctttgatagtatcttttcataagtaaaattttgaagtcctaaagcttctaaacatacattgcttattgaaagtttattttcagcataagttccttcatcataaactgtattttccactataggcaaacctatatttaaaagttgcacataaacaaaagcaccacgttctttattatctttaagaataccaatcactcttataaaaaaaacacttgctaaaatcattaatattactaatcctacacttacttttggtctgcctcttatttttttctgtggactaattcttttttctctcctaccggcatatatcacctaaatccccccagtttatagttagcagttaacagttagcagttaacagttgtaggaatacactgcatatttgtttctactgttagttgttaacagtttttttctacggcaatagcctaatatatccttttcagctggaatataaaactccaactgaaaagtttcactttaatctagttcatttttattactatatatttatattagctattttacataattattctattaactcataaacttatttatgtcttccatatccatattaggctgaactgccatatttatgccatttgaaattattttagcaagagaatttattattagatcaatatcttttggagtaactatcatttcaccaagggactttgatgataacacttctcttattaatgaacttttttcatttttatctagtgacccaagcattttataaaaatcatttccacttgatgcattattcattaatgaatctacaaccatgtctatagtatcattagctattgtcacagcatcaacaacagttggcacccctattgcaataacttttactccaagattatcttcatttatctgttttctattatttccaacaccagctccaggcgatatgcctgtatcaccaatttgtattgtagtattaactctttcaactcgtcttgccgcaagcgcatctatacatataacaacatcgggtttaaccctttcaactgttcctttaattatttccacagtttcaactcctgttatcccaagaacaccgggagctatagaacataccggccttacagaatcatccataatttctggcataacagtttttaaatgtcttgttaccattattccttctgttacttttggtcctaaagcatcgggagtcaccttccagttcccaagacctacaacaagagctgttttttctacatctatatttatcattcttccaagtatttccgaaacaacctgtgatactctatccatagtctccccatcataagctgtaaattctggtatatctattgttacatagtttccttttggctttccaatttttctagccccattttcatctttaacttttacagttgtaacctttatatcattatcaatttcattaataacttctattccgtcaatatccttttcttttctatgcttttcttgatatatttcctttgcttcaagagctaaatctgttcttacatttgtcacaataaacactcctcactttaaattaatagcaatctcactttctactttattttttgattaaatttattttttccgttatcacctaatttaatacttgaattacataacttctgatgttataataaggtttgttgaatatgaactcgtacgcagatttccccaaaaaactgcaagagaccctataaaaatctaagggggtgaattaagaatggcaaatataaaatcagcaaagaaaagaattaaagttactgaagttaagactttaaagaacagaatgataaagtctgctttaaagactgctataaagaagtttgaagctgctgttgaagctaagaacactgaagaagctaaagctttatatacatcagtagttaagtcattagatatggctacttctaaaggagttgttcacaagaacatggctgctagaaagaaatcaagattagctgctaagttaaacgctatggcataatctgataaacccaccttttaggtgggttatttttttatctattaaaatatttattaatactaactattatataataagtaatttttcaactttacttttttactgtaagagtatttataagcataaattccatttccatatttttatccgctcctgaagatttcatttttgtttcagaagtcacacataatttaacaagctcacaaagctgtttctctgtaaatctactactttgtgtcattaatttttcacatacgaactgtggaagcctgtattctgacataaaattttgtactctttttccttgagacatacctatttttatttcataaagacgtgcaaaatgtttttcaacagcacttattataagcatatgttgatctgatttgtataagatttccttcattatatctattgctttatctatttttctagaagctataagttcaacaagatcaaatatatcttcttcatttgaacttgatataagaatatctatgtctgatttttttatatcccttccttcagagtaagatataagtttgtctatttctctttttataatatcaaaattgttttgaaccttgtcacaaaaataagcaagttcagttcttcctattgatttttccttttccttaaatatatccgctaccttttttataaatttatctttttttaatttgtcacaaaataccactggaaagtacttttcaattggagtaagttttttatttttatttggtttatctcttttatccttacaaagatagtacattaccaatatagtataaggcggcatatctgaaatatatttttttagttcattatatatttttgttcctgtagaatcacatttttcttgtaagaaagtagctctatataccaacacaacttttctttctcccataaaaggcattgtttcacatgcatttactatatcatcaaaagttgtattcataccatctatttttattaaattaagttccttaaaatcatctgtaacttctctatttattattatatctatgccatcttttatgagttcttcatcaagtccacagaatacatatccattttttatatttcctttttctatatctttttcatacacttcgtaattaatcaattttaaattcctctcatgtttattaatatttatttgatatctagtatctacaatattcctcacactaatgtaagtaattatctcaaatataaaattaagtgaatatattattttattgagctaagagaaaatgcatgcacgctcctaaataaattcaacccaaagataaagctctacttgaagagttttattttatgaacatacctctatcaatttatcatcaacaataaagaccttgttaacaggtccatctttaaaacttattatatcataatcattataataaatttctttaccagacatgtttaatataaattctttatcttttaattttaaaatataatcacttttcataacttttaaagaaagtttatctttaaaatgcatatttttttctatcctataactctccgatgcgtttgaagctttagaaagacgttccatatcaatttcttttttagaagatacaagaactctatcacccttatgacatattagcaatgcgccttctctataatatcttatattcattatagggctatacatagatatagcaataacaattatagagatagccggaagatatataaattttttataacccttttttataaaatataaacttattaaaagccataaataaaaaaatgctacatattcattcccataaaacattggcattgaatataaatctattttatttattaaagcatcaaaaaatcttattatatttaagcaaagatagctaaaaaaatcaaatagccatgaaaatttatatgaaggtataagcatatttcctaatattacaagaatattaacaaatggtataaacataagattccccaatataaaattcaacgaaaaatctttaaaaacaatcatcatatatgggaaaataaatacttgcgcacttaatgttacacttagactttctcttatcttttctggtaatttataaagtttataatttatcttttgatttaataatattattcccaaagtagcaagatatgataagtgaaatgaaatttccattattccataaggtttaaaaataagtaatattaaagcagataaagaaagtgctgataatgaattattattccttttaaatatcttgcttccttcaacagttgaaagcataacaaatgcccttatacttgaataattccctcctgtaaatacaacatatacaccgcataatatgagtccaatcttatttcccaagaaatatcttaaaaatccatacactactgcaacatgaagacctgatacacatacactatggattattccgtaatttttcatatcatctttgtcttcataatcaatattttttgaatcaccaaatgctattgaagttattaatcctgctcttctcatacctaaattttctttaagcctttcaaatatattcttcttaaatttatataatccacttataaaatcatcatcattttcatagatttcataaacttctgctcttcctactatacctgaatatctatcactttcatctatgattttagcttttatattatatcgtttcccttctatcaaattgttcttacaatctaaaataatatttttcccattaactttcccaattgtttcataattatttatttcaacaattctaactatactttcaatattatctgaaattttatagtacgaagtattaatatacaaacctgtcataaaaaataacaatatgaatatacaaaattccattccaaaataacttaaaatatatacaaaaaagagagctccaataaaaatcgaaagccccctaaaatccatatatattccataacaaatacagcttatagctattgctccaaaaatatatattataggattattaacttcttcaaatttttttaacaacatggactcacctcattaatgagtcttgccactttctacataaaatttcaaatactaagaaaaatattgctgaaaaaatcaactcaataactataatgtctcttatagcaacattattaatataaattataacgaaaactgatacaaacactataagtaatgatataagaaacattacaagttcatttgaaaattttctaattgaaattccactattaaacataacaaatagaattgttcctatagatagaataacaacagatataacagatgcttccttaccttctgatccatataatgcaattaaagtgactatacttaaaagaatacttcgtaaaatcatagtattcatagttatttctcttccttttctaagaataatcattaaagttaatggtatagataatattccatttatagttataatattccacatatctaaactatcaacctgtccaacagctgtactcataaacaacacaataaattctgaaagtagaaccataaaataaactctaaatgctctatcaatattcttattgaaggtcttttgaaaatttctcaatctaaagaatccatcgagataatttttttcaatatgtacatcacatatttttttaacaacattagatgattttccttttgcaattccaacattagataagtttaatgcaggtaaatcccctagaacttctcctgttgttgcaactttgtgtccatcttttataaataatgatactatctttgatttaatatcaggtgttaccctacaaaaaactcttactctacataataattcctttagttcactttgatttaaggaatccagttctattcctgccactacttgattcttactctttataagatttgcttttgctgcattagttatagcacttaatttactttcctctgtaaatattattggaactaatgctttatccttaattttacttatactattttccaagttatcttctaaaggattttctaatcccattattccaacaaaaaccatgttgctttctatattttctgatttagatggttcataactgaaatttctatatgcaaaaccttccgttatcattccttctattgaaagattcatatcaattctctttatttcagatcttatttcttctgtaagttctctttcaattccattaaccataaaatgagtacatatatctaaaatcgaatcaacatttcctctagagtttgctctacatccccttttaagttttgtaacaaccgtaacaaaactcttatcagaatccataggaatatctataattttagtatttcttgcatctacagaacttttataaattttctttcgtgcagcatactttaaaaatgcaagctcatcaagttcacctatattattatcatcttgtccattaaaaatactattattacaaataagtgatatttcaactattctatcaaaagttatttcttttacatatggatcatcagttgatattatatcattatttatatatatctttttaacttccatttccttcttactaatagaaccgatcttgtccaaaaataagatattaacatctttaaccaaattaaaaacagaaaagtttactatatgtatattttcatctatgaactttttaattacacttttagctccaataatttgtataaaaaacattggaaaacatccaagtgcaaataaagctgtaatacagtgatttctagctatttcagaattgaacgcaactgaataaagtgaaaaaactatacaaaatgctaaataaatcaaaagatattttcctaaacgctcatagatttcacatccaaaattatgttttctattgcttgaatatatcatcattgaaagtaattttccaagttgtgatgatgttccagttgcaataactacccctgtagcgtcaccgctttttatctgtgttcccttgaataaaatatttttcatttgatttatatcatttacacttcctatgattttatcagaaaatttattacttaacttgtcttctcctgttatggatttttcatctactagcaaattatttgtttctattattctaatgtctgctggaactacacttccacttccaactttaacaatatctccaacaacaagttcttcactttttatagtcctttgtactccacctctaataactatagcctcatttttctctaagttagataattcagttattcccttatctctgtttatatgatgaataacagttattatcaaattaacagcaagtattccagtaacaatatatgcacatatattgcttttaagataaaatagcataattataatcattatataagctagaacatatttctgttttaaagcacaaacaatcttcatataaagtttatttgtgcttggtacatctaccttatttaatccatatttcttttgtaatgctagacatctctgttcatctaatccctgtagattatcactattaagcaactgaacaatccttgcccaggtattattacaatatctctccaaagtatccccatcctcctataattcaataattattttatataattatctcaacaaatacaccctttactatatatattacttacccattataaatgctatttgaataaaaggcaaaattattgcatatatattctatacaattttttcatatataaattaaagaaatcctataaaaatttttaactcattttatatttagaacttatatatattgaaatttatacttaatattaaaatcactatgttatttaagttatagttgtaaagttcatactataaccttacaacatatatattatagttttcgtataattttctttcttatttatagttattttttagttttaggattaaatataagagccattaaatatccaaagaaaatagatgctgttattcctgctgctgcaccttttatcccacccgtaaacgcacctaaaagacctatttcatttacttcttttattactgatttagctagagaattcccaaagcttggtagtggaactgtagctcctgctcctccaatttcaactaatttatcatataatccaaaagctccaaggaatactccaattgtaacaaatgccactaatattcttcctgctgtaagctttgttttatctattaatatttgagcaattacacatataagtcctccaactataaatgcacgaatataatccattgtactttcactcctttaataatttaaatcaattcatttcaatggctactgcatgagctattccaggtattgtttctccttgaagtgatgatgtagtactcataagcgcaccagtagaaactaataatactttttttatttcttttttcattagttttttatataaatatcctgtgaatactacagcagagcatccacatccacttccacctgcatctgtattctgattttcgttatcaaaaattatctctccacaatcaatatgattggatgtaatgtcgtatccatattcttttattaaagtatctgaaagctctctgcccacttttccaagatctccagtcgctataatatcataatcttctggtttccttcctgtgtccttgaagtgagctacgattgtatcaactgctgctggagccatggctgcccccatattattagcatccttttgtccaaagtcctttacttttccagtcgtaatataagtgaccataggaaacttaccttcatgccccaaaacagctgcaccagaaccagttacagtccattgtgatgtctgtggtctttgagaaccataatctaacggaaatctaaactgtctttctgctgaactgaaatgtgatgaagtagttgcaataacatgatctgcgaatcctccatccattattaatgatgcaagacttaatgactcagacattgtagaacatgctccatacaatccaaaaaatggtatactaaattcccttgccgcaaaacttgacgatataatttgattaagcaaatcacccgaaaataaataatctatatctttttcttttagatttgcttttttcaaagcttcacttatggctgtaaacatcatttgactttcagcctgctcataagtatcttttccacatgtatcatcatttaatattacatcaaaataagaacttaatggcccttcaccttcttttggacctacaattgaatgtgttgatattatcttaggaggatgttctaactttactgtctgacctccaatttttttctttttcatttccatatgtttcaccccgttttttagttaacatttatcatataaattcacatttttctatgttatttttctgcactaatattaataattatctattaatatgtcgattaaatattaccttaacatttatattaataatgtctataatcgtaatttcaaatactcataaactattacctatgtccataattgtataaagtaataaactatacctacaattacagaacttccaacgccatatacaagcactggtcctgctattgtaaacatctttgcggcaacaccaaaaacaaacccctcctttttgaattctattgccggggaaactactgcatttgaaaatccagttataggaacaacagtccctgcacctccaaaacttgctattttgctatatgtgcctgttccagttaataatgcacctataaatatcattattataggaacaatattcataactttttcttctgaaaaaccaaaatatatatatatgttatgaatcagctgtccaacatcacaaataatacctccaacaagaaaagcttttaggcaatcttgaaaaatttttgatttaggagtaatctcatttgccatagtttcgtactttttctttattctagcttctttcatttcacttttgctgctcaattttttcaccttccttatttttattatcaattttattatttgtataaatttattttttagtcctaataaagatatttatttaatatgacttaatgtatattaaaatatttattaataaatcataaaaagtggctaatccactctttttatttaatgttaacaattaacagttttgattgaaaactatagtttttctttactttgtaattgtcaaaatctattgaattcactatattcaaacactatacttttcaatacatcaaaaaaactccatactactttacatctaagtagcatgaagtctgttgtcattacttattttccaattacacataaaaatcattcttctaattttttcttcatttgaagtagtacttttttttctattcttgatacttgtacctgacttattccaagcatttttgcaacttgtatctgcgttttatccttgaaatatctaagcattattatctgccttgctttttcatcaagacttctcaaagcctctttaagggctattttttcaattaaattaacatcatcttcaccctttttttcactaagtttgtctattaacataactggagctccgtcatcttgatgtatagtatcataaagatactgaagactgtttgcagattcaattgcaaagacaatttcctctttttccacaccagcatattctgctaattcttctattgttggagatcttttaagcttatttgttaactgctctctataatagtgaatttttcttgctagacttttcacattacgacttactttaatcattccatcatctcttagaaatcttttgatttctcccattatcatcggaactgcataagtagaaaatttcacattataatttaaatcaaaattatttatagctttaactaatcctatagaaccaatttgaaatatatcttcataatcatatcctctatttagaaattttttgcttatggatgctacaaggggaagatttatttctataagcttattcatagcatcattatcaccttttttagctagtgataatagttctggattttgatcatagttatattcctctcgttttaaattctctttatccattttattcacctaacttgctgtactgaatttcttcttaataattacccttgtgccagcccctttttcactctctacccttaaataatccataaacgtatccattacagtaaatcccatacctgatctttctaaatctggtcttgaagtatacaaaggctccatagcttgtttaatatcttcaatcccctttcctttatcactaactattatagtaacttcattgtcataaatttctgcttctattcttacagttctatcttcctgtccatcatatccatgaataatggcatttgtaacagcctctgaaacagctgttttcacatcacttatttcatccattgtaggatcaagttgtgcaataaatgcagcaactgatacccttgcaaacccttcattttctgacttgctaaaaaactccaaagccattttattgtgtgacattgataacccctccatctaaatacagctaactgcttcatctacagtattatacttatcaattaatttatataaacctgccaattcaaaaattctatcaacatttctactagtctgtgcaatacaaagctgtccgcctttattcttaatttttttgtacctccctacaacagcaccaataccagaactgtccataaaagtgactttagaaaaatttaaaataactttacttatgtcatctctatcaattctgtcatcaattttaatcctgacttcttcagcactgttatgatctaattctccaattagagtagcaattaaaatctcattttctttttcaaattctaaatacataaattattaataccaaatagacctctggtattatctgacacctccctcacaatattcattaccatattttaacatatttttttcgatttatcaaacatttttttccataattatagagtttacattaaattctctaataaatccaataaaattaaaactcagtgataaaataattctatcactgagttttaattatcacttcttctttttgctacctttatcgtacttatacttaacaatctcatcatttaaactcttaaaaaagtctgtaactgtttctccctctttaagaattaacacctcaattgcgtcatcaagactatccatagtatatatatgaaatcttccatttcttatatcttcttcaacttctgcattcaatattaattcatcagtattacttgatggaatcaatacacccttgttttcaactgtatctataagcttacagaccctatggaatccttctattttttcattcacgcctccaataggctgtatttctccaaattgatttattgaacccgtaactgcaatgttttgttttattggctttttacttaacgctgacaacacacatattatttccgcaacagatgcactatcgccttctatcattccataagtttgctcaaaactcaattgaaggtctactggcaatttttcataaggacttataagactgctcaaaagtccccttaaaatacttatagatttttcatgaatttgtccactcattttgcattccttatgaatatctattatatttccatcaccttgaagtgcaagacaagtaactctcataggttttccaaaattatatgaacctgttccaacaacagatagtgcattaattattccgaccttttcaccagttgtagtaatgagtatctttttgttagtatagctctccatcacatctcttagaattttttcctcttcatatgctatattaattatatcttgcctatcaatttcatttttattttctaattttgcattgttatcagcaagataaagtatcttattcacataatactcatctattgagattttacttctgcttcctgcaatccttgcaagatatttcatgagttcatccatagcttcatctgtcatactcaataagttatcttttattatcttcttcttaattatattacatatattttttctaatatttatatcataattaagttcactttctgcttctattcttataggaaaaatcattttaaaatcctcatccttatcaaatagaacttcatagctctcataatcacctataagaataacctttacattaattgggattggttgaggttttaaaccagctatcgaaagtacttcaaggtaactttttgtataattatagtcaacttgtccatgaattaatgccttttttaaataataataactagaaccactgtttattaacgatgtaagcctcaatattaaacagccaccatttgcctttacaagacttccagcacttataagtgacatatctgttgaatatccacctgtagtatttctatattcaatatttccaataagattacttactgtaggatcttcttcgtatattacccttggatggtttactccagtattatccacaagaacattaaccgaaaacttccctaatacctcttgaatatattcttcatcatcctcaagattgatagtataacattccactatttcatcatctaaatactcaaacatttctattaaatatctatacacattatcataagcaataaattcaagtaaaaaatcatctttataagactgcattttattttttatatggtctctatacaatgatttaagcttttctatagaatcaatttcaatttcttttaacttttcaagtattacttctgcttctttctttaagttagttgcttgtttttctatactttcttgatcttcatcctcaagatcatcgtattcgtcttttgtcatttcatctccttcttcttttattggaatgaagacgaatccccctgttgttgctttaa
